United States Patent 7,750,207 (ZEA MAYS RIBULOSE BISPHOSPHATE CARBOXYLASE ACTIVASE PROMOTER) - sequence listing, part 12

SEQ ID NO: 16103 - DNA, 662 bp, Zea mays
  misc_feature (655)..(655): n is a, c, g, or t
gccgttcgggattatattccttccgccgtctgtcccctcgccgggaagaaacaaacgaagccagccagccagccagccgggtcctcccgcgtagcgtagccgtaggcgtagccgtagcagcgtgtgcgagaggggaagaaatgctggagggaagggcacgggtggaggacacggacatgccggcgcggatgcaggacgcggcgacctccgcggcctcgcgcgcgctcgacctcttcgacgtcgccgactgccgcgccatcgccggccacatcaagacggagttcgacaagcggtacggcgtcgggtggcagtgcgtggtgggcgccaacttcgggtgcttcttcacccacagcagcggcaccttcatctacttctccatggagcgcctctccttcctcctcttcaaggccgccgtcgtcgcagccgccgccgccgccgtcgcctcctaatcaaccaagtctccgtccatcacaccgtgcactttgtactgctagctagtactatataacatttgtaatgtccagaagctcaaatcctgtacggccagcagcctgtgtaaatacatcgccccatgctttcgctcgttcctcaaaccatctcggcccccgttcgtactgagacaaaataatataaagtcgtaatcacaactggattnaaaaaag

SEQ ID NO: 16104 - DNA, 686 bp, Zea mays
gcacgagcccttccggccctgtccttctatcgggaaccttttctcccctccgggcgtttgccttccgccggcccggccgggggaatcaagaaacaaacgaagccagccagccagccgggtcctcccgcgtagctagcgtaggcgtaggcgtagccgtagcagcgtgtgcgagaggggaagaaatgctggaggggagggcgcgggtggaggacacggacatgccggcgcggatgcaggacgcggcgacctccgcggcctcgcgcgcgctcgacctcttcgacgtcgccgactgccgcgccatcgccggccacatcaagacggagttcgacaagcggtacggcgtcgggtggcagtgcgtggtgggcgccaacttcgggtgcttcttcacccacagcagcggcaccttcatctacttctccatggagcgcctctccttcctcctcttcaaggccgccgtcgtcgcagccgccgccgccgctgccgtcgcctcctaatcaaccaagtctccgtccatcacaccgtgcactttgtactgctagctagtatctatatatatctatatatgccatttgtaatgtccagaagctcagaccctgtacggccagcagcccgtgtagtagtgtaaatacatcgcgccatgcttcgctcgttcctcgtccaaaaaaaaaaaaaaaaaaaacgcggcc

SEQ ID NO: 16105 - DNA, 1891 bp, Zea mays
  misc_feature (797)..(797): n is a, c, g, or t
gtcagcggcgaaaaaagaaatctgaggccaaacagttccccacgcatcgaatgaaaaattgagaacaagtgaattccaaattgctgtatgccttgtttgacttcgattgtgcactgttattgtaaatttacaacagtatgataggtatgacaaaaacttcctatccgcatgattgaattcgtctttgtataagaacgtacaagtttctgaatgtctgtatcacttgcagaacaatcagatacactcatctatacagtaaaaaaagtatgtatttaattgcaacatgaagacaacagtccgatctggataatctcgaaacaaaacccaacgtttcaggagttcaggttcgtgctccacaccctgcaactcctgtttgcttcatccagagagaccatttaacagcttctaggaaattttcgttcctttgcagggcagcaatgaggttagcatatgtcactcgatcagggctgatgcctttaaccctcatctcttgcatcagtttgacggcatcttcaggcattctcgctatcccatatgcttttatcaaggtattgtagctgtacagatctggctccacacctcggtcctttagctccgcaagaacattcgaaacatcttgtatccaacctcttctaccatagatattgatcattatattgtaagtgtagtgatcaaacttgcatttcgctctcttcatcttctgcaaaacagaagcgaactcttccaatcgccctgcctttccgtaagcatccagcatgcagttgtatgcctcaagagaaacaggaaaccctgcgtcnctgcatcatttggacaaaataattcatactcagaaaattgccgccttttgcatatgcagcaataatcgtattgtatgatatgatatccgccaggccctgcttgcgagccatgataaagaccttttcagccctgttaaaaagcccggcttttccatatatatctagcaacacattgaaggtaacagtgtttgctaagtgtccctgttgaagcatttcgtcaaaaattctggacagctcgtcaacaggtatagcccgcccacagcaattaataatgcagttatacatggcttcatcacatttaacttgactcttacgtatccagtaatatgtatcagccaacttctccagcagaccacatttttggtaagtccgaagcatgtcgagaaaaaggtatttatcaggaattatttctttttgtttctccatttctgccaaaactgaacaagcatcctttagtcgtcgtgctttaatgtacatcctcacaatgacactgtaagcaatcatatcaagtacagaagctgaagccttcagttcaagcaaaatagtttcagcatcggcaaacctttccatcgtgctgaaaacatcaatcatagtgcaagagatacggggattcggatgtgtttaagacttaggcatctgattgtatatcctaacagcatcattgtaattgccaccctctttgcaagaacatatcaatatatggtataagttgtcttcaaaagcagaatctttccacttcttttcacgcagaatatacaaagcttcttccagtaaagaattttgaaccaacgatgttactaaaatagagcatgaggtggcatcaagcaaaatcttgtcgaagcaagattgtagaattggaagaaccttatgcattcttcctactgctccataagcccgaacaagaaaagtaacaattgatgaacacaaacagcctgctgccctcatgtcctgtagaatttcagctgcagtttcattgtcatcatgtcttgctagtaggttgatcatagtgtaaaagttggatgcatttggtcggaagccagcacccttgagcttcctgtagtacagaattgtctcttcatatatgtttgctctac

SEQ ID NO: 16106 - DNA, 971 bp, Zea mays
ttcggccggcacgactctcggcaacggatatctcggctctcgcatcgatgaagaacgtagcaaaatgcgatacctggtgtgaattgcagaatcccgcgaaccatcgagtttttgaacgcaagttgcgcccgaagccttccgccgaaaccggggtcccccacgccggcccgggagcccaaactgcggtagcgaaaacgcgagcgctgcggaacaacgatggcgacgatgtctcttgccgcggcgtcacccctcgcctccattccccgcggcatcgccgctcaggctccttgcgcggcattcctgtccatccgcttaggtggcgcgacggcgacgcggttcgctggactggcggtggcctcgcagccagcggagcgtcgcgccgcggcgatggtcgcgatggcgaagagggagcaggagctggaggagatccgggccatgacgacggaacagatggaagaggaggtggtagacctcaagggggagcttttcctgctccgccttaagcgctcggcgcgccaggagttcaagaacagcgagttcagccgcatgcgcaagaggattgctcgtatgctaaccgtgaaaagagagcgggaaattgaacaaggaatcaataaaagattgtctaggaagcttgataggaaatggaagcagagcattgtggtcagaccaccaccatctctaagggggaacaaagaggagtagaaagccgcaaaaagagggcaatgtgcaaaagtcgtttcatgcgagtgttgcaggaaggtcccttcatgatttcaacccttattgcgttgttatgtattccatgtttacattttgctaagcattgctatctgaatctgaatttcagttgttagtctcttctgtaaattttgacttatttaaatttacacttctatctgtgttatcagtaaaaaaaaaaaaaaaaacatgtgcacctgaaaggtgcatgcttccttgccaaaaaaaaaaaa

SEQ ID NO: 16107 - DNA, 883 bp, Zea mays
acgatgcatagaaagttgaaaggatgaagttagaggatctcgttccactgcgctagcgagacggcagcgctgcggaacaacaatggcgatgatgcctcctgcagcggcgtcatccctcgcctccactccccgcggcatcgccgctccgcctactcgcacggcatccctgtgcatccgcttaggtgtcgtgacggcgacgctgttcgctggactggcggcggcgtcgcagccagtggagcgtcacgccgcggtggtggtcgcgatggcgaagagggagcaggagctggaggggatccaggccatgacgacggaacagctggaggaggaggtggtagacctcaagggggagcttttcctgctccgccttaagcgctcggcgcgccaggagttcaagaacagcgagttcggccgcatgcgcaagaggattgctcgtatgttgactgtgaaaagagagcgggaaactgaacaaggaataaacaagagattgtccagggagcttgataggaaatggaagcagggcattgtggtcagaccaccaccatctctaagggagaacaaagaggagtagagagctgcaaaagaagcaatctgcaaaagtcgtttcatgcaagagtgttgcaagaaggttcctttgtgattccaaactttatttcattgttacgtattccatgtttacattttactaagcattgctatccgaatctgaatttcagtcgttagtctcttctgtaaattttgatttatttaaatttacgcctctatctgtgttttcggtgcatttttcttagctgcttcacatattaaactgcactttagacgtgcatgctatccagtaattgagaatggacagtcatttgcacctaaaagtatatggttttctgcc

SEQ ID NO: 16108 - DNA, 1924 bp, Zea mays
aggaaattaagcttacagccccacaccgacaccgccggccaccgccatcgcctcgctgccgatggcggccgccgccgccgcccggatcctccgcttggccccgcgccggatccaggttcccaagacctccccgctcgccgcactctcgttcccactccctcgaacggcgccgatcgccgctggccttggggaggcggcagcgcttctgcgccgtggcgcaggcccccgcccccgcccccgcagccgcggcgacaggggcggcgggagaggccgtgggggagttcaggaagcggctgcgggtggcggacgtgaagggcggggaggacgagggcgccgcgtgggtgggcaaggagctcgccgtgccgggtgggtgcgcacctgccgcgcccagaggaccataaccttcgtcgaggtcaatgatggctcttgcttatccaatatgcaatgtgtattgactcctgaaacagaaggctatgaccagatagactctgtcactactggagcatctgtactagttgagggagttgttgcaagcagccaaggcggtaagcaaaaagtggagttgaaggtttcaaagatcaccgtgattggtaagagtgaccccacatcttttcctatacagaagaaacgggcatcaagagaattccttaggaccgtagcccatctccgtcctcggacaaacacttttggtgcagttgcaagagtgagaaatactctggcatacgcaactcataaattctttcaagacaatggatttgtttgggtttcgagcccaattattactgcctcagattgtgaaggagctggggagcagttttacgtgactactttgcgctgaaggtggttctctactcaaagatattcctgctaccaaggatggaagggttgattggtcacaggatttcttctgcaaaccagcatttctgacagtgtctggacagcttaatggtgaaacatatgcttcagctctatctgatatttacacatttggtccaacgtttagggctgaaaattcaaacacttcaaggcatctggctgaattttggatgattgaacctgagcttgcctttgcggatctgaacgatgacatggcttgtgcaactgcatatctccagtatgtagtaaagtatattctggagaactgcaaagaggatatggatttcttcaatacttggattgaaaaaggcatcatagatcggttaaatgatgtagtagagaagaacttcgttcacctgtcttacactgatgctgttgagctacttcttgggtccaagaaggaattcgagttcccggtaaagtggggtttggatcttcaaagcgagcatgagcgatatatcacagaagttgcctttggtgggcgccctgtaataattagagattacccaaaggagatcaaagctttctatatgagagaaaatgatgatgggaagacagttgctgcaatggatctgttggttcctcgggttggtgaacttattggaggaagccagagggaagagcgtcttgattaccttgaagcccggttggacgagcaaaatctgaataaggagagctactggtggtatttggacctacgacgatatggatcagttccacacgctggtttcggtctcggatttgagcggcttgtacagtttgctactggaatggacaacatcagagacaccatcccatttcctcgagttcctggctctgccgagttttagcgccctggaagtgttgtcgtatacgtatactttagaaacattctttcctaggatgtaatgtgaggaaaggcatacgttgtactgtacaactgtttcatcattgtacagagttgagctgagacttgtgattaatcggaggcaagcagtgctgtggcaagctttgtcgtttgttgtaattgtcgtcaaagaatgtcaatggtggatgatgcaattttttc

SEQ ID NO: 16109 - DNA, 1498 bp, Zea mays
tataacttgaaacagaaggctatgaccagatagactctagcgtggtcgcggccgaggtactagttgagggagttgttgcaagcagccaaggcggtaagcaaaaagtggagttgaaggtttcaaagatcactgtgattggtaagagtgaccccacatcttttcctatacagaagaaacgggcatcaagagaattccttaggaccgtagcccatctccgtcctcggacaaacacttttggtgcagttgcaagagtgagaaatactctggcatacgcaactcataaattctttcaagacaatggatttgtttgggtttcgagcccaattattactgcctcagattgtgaaggagctggggagcagttttacgtgactactttgctttcaaacagcgctgaaggtggttctctactcaaagatattcctgctaccaaggatggaagggttgattggtcacaggatttcttctgcaaaccagcatttctgacagtgtctggacagcttaatggtgaaacatatgcttcagctctatctgatatttacacatttggtccaacgtttagggctgaaaattcaaacacttcaaggcatctggctgaattttggatgattgaacctgagcttgcctttgcggatctgaacgatgacatggcttgtgcaactgcatatctccagtatgtagtaaagtatattctggagaactgcaaagaggatatggatttcttcaatacttgggttgagaaaggcatcatagatcgattaaatggtgccctccggctctgcccgggtcacttgtcttacactgatgctgtcgagctactacttgggtccaagaagaaatttgagtttccggtaaagtggggtttggatcttcaaagtgagcacgagcggtatatcacagaagttgcctttgatgggcgccctgtaataatcagagattacccaaaggaaatcaaagctttctatatgagagaaaatgatgatgggaagacagttgctgcaatggatttgttggttcctcgggttggtgagcttattgggggaagccagagggaagagcgtcttgattaccttgaagcccgactagacgagcaaaatctgaacaaggagagctactggtggtatctggacctacggcgatatggatcagttccccacgccggtttcggtcttggatttgagcggcttgtacagtttgctactggaatagacaacatcagagacgccatcccatttccccgagttcctggctcagccgagttttaggcttcctttcgaatgtaggaattttatggggatggtatatgaatttcacaggaaatggttcaaaaacacatgaattatcttttaatccaaaggaggccttagcgccccgaaagtgttgtcatttgtttcatcattgtacagagttgagctgagactcgtggttaatcgagccaaccagtgttgtggcatgcttctccaaaatatatatccagcaggtgctcctgactcactcc

SEQ ID NO: 16110 - DNA, 1176 bp, Zea mays
aaaaatagggtggcgttttccttcccgagtggaagacttgagtgagagagaaggacatcgaggtcccgctggacctgcaatccgaccaactctttgcagattttctgccgcttaagtgtgatgcctgctcaggcatcttctgcgcagaccatgtggcctacgcccagcatcactgtggatctgcttaccaaaaggatatccaggtacctgtgtgccctctctgtaatgtgcctgtgcctgtggccagaggggagccccctgaccgtgctgtgggagagcacattgacagagactgtcgctctgatccagcacagcaaaaacgtaagatcttcaccaataagtgtgaacgcgctggctgccggcagcgagaaatgatgaaactgacctgtgaacgctgtagccgaaacttctgcatcaagcaccggcatccactggaccatgattgctctggggaggggcacccaaccagccgggcaggacttgctgccatctccagagcacaagctgtggcttctacaagcactgtccccagcccaagtcaaaccatgccttcctgtacctctcccagcagagccacaacccgatctccgtcctggacagcccctccagtgattgctttgcagaatggcctgagtgaggatgaagctctgcagcgggccctggaaatgtccctggcagaaaccaaaccccaggttccaagttgtcaggaggaagaagacctagctttagcacaagcactgtcagccagtgaggcagaataccagcggcagcaggcccagagccgcagctcgaagccgtccaactgcagcctgtgctagggccctgggcttggggagggaggttcacctgaggaggactgtggccctcacacctctagggtacacagggagaggaggcccggagcaccctggagggcagagacaagcgggagtgatgtggaggtcgccctgggagcctctggaaggccttgctagtgctccagctgcatggaagagagcggctagcaactgttccctggttgggccctcagtggatgctgggccaggccctactcttagccccttcatcatgtcatctcccttatgctggagctgccccgatgtggagtgggcaggaaggggcctggaaaaaataaaggatcttggcagttgataaaacgcaaaaaaaaaaaaaaaa

SEQ ID NO: 16111 - DNA, 2294 bp, Zea mays
tcgcgcaccgtctacagcgaccgcttcatccccagccgtgccggatccaacctcgcgctcttcgacctcggcccctcgccctcgcccgccgccgccgccgcctcctcgtcctcctcccacgaggccgcccccgcggcctcgtccggatctgcgcccgccgcggcgtcgccctactgcgcgctcctccgcgccgcgctcttcgggcccgacacgcccgaccgggtcgcgtcctcggccgccgcgtgctcgtcctcctcctcctcctccccggggctctcgcctgtgggcacccccgccaccgggaacatcttcagattcaagacggaggtgcgccggaacgccaagagggcgcttttttccggaggggaggaggaggaggacgccctgttccccggcattttcaccaccaggggcgcgggaccaaggaaggtcccgaggtcgccctacaaggtgctggatgcgcctgcgttgcaggacgacttctacctcaacctcgtcgattggtcttcacataacgtcctcgctgttgggttgggcaattgcgtttacctgtggaatgcatgcagcagcaaggtcaccaagctttgcgatttgggggtggatgacaacgtttgttctgtggggtgggcgcagcgcggcactcaccttgcagtaggaacaaatcaaggaaaagttcagatctgggatgcaactcgctgtaaaagaataaggacaatggaaagccatcgcatgcgtgtaggtgctcttgcatggagttcttcgttgctttcttctggaagccgtgacaagagcatcctccaccatgatatccgtgctcaagaagatcatgttagcaagcttaccgggcataaatctgaggtttgtggactcaagtggtcttatgacaatcgtcagcttgcatcgggtggcaatgacaacagactttttgtttggaatccacattcagtacagccagtactgaagtatactgagcacacagcagctgtcaaagctattgcctggtcacctcatctccatgggctgcttgcatctggtggaggaactgcagatagatgcatacgattttggaatacgaccacaaatgcacacttgagctgtgtggacactggcagccaggtctgcaatcttgcgtggtcaaagaatgtaaatgagcttgttagcacccacggctactctcagaaccaaataattgtttggagatatccaacaatgtcgaagcttgccactttgacagggcatacatacagagtattgtacttagctatttcccctgatggccagaccatagttactggtgctggtgatgaaacgctccggttttggaacgtgttcccctctccaaagtcccagagttctgacagtttaagttgcgtcggaggaacatctttcgttagaagctacatccggtgacactgagttgtagttttgctgagctcataggactgttgcagcacatgttgatgaccatcaacatcaatccatttgcaacagccatgccaccaggccatcaaccatcaaaggtagcccactttttgagatagcgcgatgcagtttggtgaaccggcttgcgaatccaggcatggctcttttcgctgggagtgtacatatttatcagagcagcggcctttataggagtggacatagaggagggggggcttcaagcatcagcattgtcccaactgataagagtacgcccttttgtttgtttgctcattttgccggtcaaacactgaaaacgtcggcctgagctgtttgtgtagtgcgctagcagctaacctattcgaaacatttactggcctgtgaacacgcccatttcatccatgttggcaccatggtgtaaaatgagaacactcgtggctccaggtttgttttatagtgtcttggaaggaggggctgattttgccctcacctggcttgtttcacatagagacaaccaagaaacgtgtgttcattgtttattgatatatggataccaaggcaatgctgaacttttagcatatatatatttttttatcacgcgactatctttgttgtaaagtgatatctaatgcttgcgtcttgcgttgtcacttctttgcaacctaatgattggaggcaattattgatggatctatcatactagtgattcatttaggtcctagactaatcctacagctgtacttacctgacaaggtttttgactttcaagctagttcacaaccacaacaaaatttggggatgggcgaaccagtagctgttggaagagttacggatccttttttcatcagagttgccacggctgcaggcatgcaagc

SEQ ID NO: 16112 - DNA, 2712 bp, Zea mays
gcacgagaccattacctagaacatcctagatcaaaatccgtctatccccacagccgccttgcctccattgtctctccactcccttctcttccctctcacctcctaaaacctccattgcccgcgcgcacgagcgcccgcgtcgaggactccagctcgtgtgtccgtgcgaacgcgcggttttcttgtcacgaactgtcgctccggtcaggggattgaggaggtggggcggcggcggcggatttgtcgggcccgagattcccggacaaggagaaatgaagtacgtccttgtcaccggcggggtagtgagcggcctgggcaagggcgttacagccagcagcatcggcgtcgtcctgaaggcgtgcggcctccgcattacgtccattaagattgatccttatcttaacactgatgctgggactatgtctccattcgaacatggtgaagtgttcgtactggatgatggtggcgaggtggacttggatcttggtaattacgagagatttttggacattaaacttactcgggacaataatataaccactggaaagatctatcagtctgtaattgacaaggagaggaaaggggaatatttgggaaagactgtccaggttgtgccacacatcacaaatgccatacaggagtggatcgagcgtgttgctaagataccagttgatggcaaggagggacctgctgatgtctgtgtgatagaattggggggcactataggtgatattgaatctatgccatttattgaagctttgggtcagttctcttatcgtgttggtcctggcaacttctgcctggtgcacgtcagtctagttccagttttgaatgttgttggtgaacagaaaacaaagccaacccagcatagtgtacgtggtttgaggggactcgggctcaccccaaatattttagcttgtcgcagtactaaggaattagaggaaaatgtgaaggagaaactctcccagttttgccatgttccggcagcaaatattatcactttgtatgatgtttccaatatctggcgcattcctttgttgctacatgaacaaaaggctcatgaggctattcttaaagttctgaatctggaaaggatggacagcatcgctcgagagccaaagttagacgaatggattgcaagagctactatatttgatacccttcatgacactgtgaggattgctatggttgggaagtacactggcttatcagattcatacctctctgtgttgaaagccctcttgcatgcatctgttgattgccacaggaagcttgttgttgattgggttgcttcaatggatcttgaggactccactgcaattgaggcacctgattcatataaaactgcgtggaatttactgaagggggcaggtggaattttggtacctggtggctttggtgacagaggtgttcaagggaaaattttggctgctaagtatgcccgtgaaaaaaatgtcccatatcttggtatatgtcttgggatgcagatcgctgtggtggagtatgctcgtcatgtcatgaatcttactgatgcgaacagcactgaatttgatccaaataccaagaccccttgtgttatttttatgcctgagggttccaaaacacacatgggtgcgacaatgcgattaggatcaaggaggacatttttcaagattgctgattgcaagtcttctaaattgtatggcaatgtcacttatgttgatgaaaggcatcggcacagatatgaggtgaaccctgatatggttccagagttcgaaaatgctggacttcagtttgttggcaaagatgatactggaaggaggatggagattatcgaaatacccaaccaccgatattttgttggcgcacaattccatcctgagttcaagtcaagaccttcaaaaccttctcccctatttgtggggctaattgcggctgcatctggacagttggatagggtcctgcaagaccgctgcactggtcatgctgtttcagagaaacatgttctgagcaacggctcatatacacccgcaatacaccaaaatgggcacccaaagaagctcccaaatggtctatcaaacggaacatactatggcaatggcaatggcaatggcgtgcatgcttaggagcatcagtggatggatcgaggatttgcaactttttgcttacagatttgcgattcctaatgcatcagttttgtcgtggctggcttgactgactaccatcatggtcgctcgagaaacaaaaagttcctgtgctcgatgtggactgtctggtagggatagtgctcgttcggtggtttctagcgaagcgcgagatagtggtttctgtgttcgccgatctctaccctcttctgtaagcaaatggagcagatttgggtcagaagagtttacatgctgtacatcctaaagaaaagctgaatgttttggttgctcaaattaggttttcagtgaggtctagagctgatgcttagaaatgcgcagcagtgcaagagagtatttcgaaattaagcaagtctgtattttgaatttggatacttttttttgtgcttgtgcgcaaataagttgatgccctgcgcttgcttctccggagagcaaaaaaaaaaaaaaaaaaaaaaaaaaaaaaaaaaaaacaaaaaaaaaaataaaaaaaaaaaaaataaaaaaaaaaaaaaaaaaaaaaaaaaaaaatagaaaaaaaaaaaataaaaaaaaaaaaaattacaataaaaag

SEQ ID NO: 16113 - DNA, 3646 bp, Zea mays
cttctctctccccaagccgccttgcctccgttgccctccccactcccctctcacctcctaaaacctcccttgcccgcgcgcacgagcacgcgcatcgacaccttcagctcgtgtgtccgtgcgagcgggcggtttcctcgccaagaactgtcgcgcgggtcgggggattgaggaagagagtgtcggcggcggcggcggcgacgacgacggatttttctggcccgagattcctggtcaaggcaatatgaagtacgtccttgtcaccggcggggtggtgagcggcctgggcaagggcgtcacggccagcagcatcggcgtcgtcctcaaggcgtgcggcttccgcattacgtccattaagatcgatccttaccttaacaccgatgctgggactatgtctccattcgaacatggtgaagtgtttgtgctggatgatggtggcgaggtggacttggatcttggtaattacgagaggtttctggacattaaacttactcgggacaataacataaccaccggaaagatctatcagtctgtaattgacaaggagaggaaaggggaatacttgggaaagactgtccaggttgtgccacacatcacaaatgccatacaggagtggattgagcgtgttgctatgataccagttgatggcatggagggacctgctgatgtctgtgtgatagaattggggggcactataggtgatattgaatccatgccatttatagaagctttgggtcagttctcttatcgtgtctcgtcctggcaacttctgcctggtgcacgtcagtctagttccagttttgaatgttgttggtgaacagaaaacaaagccaacccagcatagtgtacgtggtttgaggggactcgggctcactccaaatattttagcagaacatcctaatctaaaattagaggatagtgtgaaggagaaactctcccagttttgccatgtgccggcagcaaatattatcactttgtatgatgtttccaatatctggcgcattcctttgttgctttgtgaccaaaaggctcatgaggctatccttaaagttctgaatctggaaagggtggatagcattgcccgatagccgaagttagacgaatgggttgcaagagctgctatatttgatacccttcatgacactgtgaggattgctatggttgggaagtacactggcttatcagattcatacctctctgtgttgaaagccctcttgcatgcatctgttgattgccgtaggaaacttgttgttgattgggttgcttcgacggatcttgaggattccacagcaattgaggcacccgatgcatataaaacatcatggaatttattgaagggggcagatggaattttggtacctggtggctttggtgacagaggtgttcaagggaaaattttggctgctaagtatgcccgggaaaagaatgtcccatatcttggtatatgtcttgggatgcagattgctgtcgtggagtatgcccgtcatgttatgaatttcactgatgccaacagcactgaatttgatccaaataccaagaccccttgtgttatttttatgcctgagggttccaaaacacatatgggtgcaacaatgcgcttaggatcaaggaggacatttttcaagattgctgattgcaagtcttctaaattgtatggcaatgtcacttatgttgatgaaaggcaccggcacagatatgaggtgaaccctgatatggttccagagttcgaaaaagctgggcttcagtttgttggcaaagatgatactggaaggaggatggagatgattgaaatacacaaccaccgatattttgttggcgcacaattccatcctgagttcaagtcaagaccttcaaaaccttctcccctatttgtgggactaattgcagctgcatctgggcagttggatagggtgctgcaagaccgctgcaatggtcatgttggttcagctaaacatgttctgagcaatggctcatatacatccgcagtacaccaaaatgggaacccaaagaagctcaccaatggtctctcaaacggaacatactatgccaatggcaatggtgtgcatgcttagaccatcagatggatggatcaaggattttgcaactctttacttcaattatgcggttcctaatgcatcagttttgtccgttcgaggaagaaaaagttcttgcgctcgatgcagactgtctgctgggaatagtgctcgttcggtggtttttagttaaagaactaagctggatctctttggaaggcacgagactggtttctgtgttcgtctctaccctattgtgtaagctaaaggagcagatttgggacggaagagtttacaagttgtatatcctcaaagaaaagctgaatatttttattaacttaaattaggtcttcagtgaggtcgagagctgatgcttaaaagtgggcagcagtgcaagtgcaagagagagtatttcgaaatcaggcaactctgtattttgattttggacattttttttgtttcttgtgcgcaaataagttgatgcactgttgcatgatcatatatcagttttgactttaaaatccatcttgagcgcttgcttctcatcattcctgcgacttgcattgtggcaatctaaaacctatttaaaccgtgataaataagctagtttatttttaactaagctgtgatataaattaaaaagaacgaaagggttttttttttttttttggcaaaatcatcctatatcataacaatttcgagtttttttgccgagttgatcgaaattccttgcggtgcaaaaatacacgagcataaaactttgccatccagaatctatctatggaaaccgaaagctcaatccgtgaccgtgcattgttcttcgccctcaacggctcagggttcccactctgagagaagcttgtcgatcagctccaccagcttccctgtctcctccggctggcgcatcgcctgctccagcgcccacgcttcctcgatcctggcgtcctgcagcatcgcgtcccgcaccgcctcccgcagctcccgcgtggcctgcaacccgtccgttgccatctccctgagcgcagccagcgcgcccctggggtcctcaaggcggcagagcccctcgacggcgtcagcgtaggtggcggcgtcgggccggcgcggggagtccgggcggcagagccagcgcagcacggaggaggcttcgcgcgcgcggcgcagggagaggaggctgccgagcagcggagacgccagcaggagcggtgagggccgggccgggtgatggcgcagcgcggtgaggagcgcgaaggcagcggagagggtcggaagcgaggcaaggtgcgcggcgagggaatcgagggggaggccgtcctgggagcccgggaggaggagcgccgcggagaggaggcggccggcggcggggacgtggcccgcgtagaggaggcgcgggaggagcgcggagatcgcgtccaggtcggacggggagaggggttgaggtgggggcttggattgcggcagcgcggtagcgcagatgccgcgaaggacgccggcgagcggcggcgcgaggcggattggcaagcggggcagcatcgtcttctaattttttttttcctgcaggagggcgcgccgccgcccacgcgtccggcgatatctcagatctagcagaaactatc

SEQ ID NO: 16114 - DNA, 1309 bp, Zea mays
tttttttttagattcataaaaacgtttgagaccaaagtagaaattaaaaatgtttattgggaatcctgtagtcaatgatagacgaaacgcataggagaagcaaaagaacaagcaacaacctttcctcatcgagtggaaaatgcgactttttttcctcgcgaaagtgcgtaataaagaaactcttgcacatcttattgggcctgacgactcctgagcaggaagcagcgcttcacactgatgaattgccggcgcccaccaaggagagcagcgcgtccctgtagtgtccgtgcgccttggccgcgatgacgtcctccagcttggccccgaactgctggtggtaggcggctctgatgtcgtccatgtcgtggtccgaccgcgtcaccgccaccctcgtcagggcctccttcccgtggtggtcggcgccgtccctcagcgcgccctcaatcacctggctgaagtactgggccggcgcgacgaggcagagcacggtctccagcagggtctcctccccgcgttggcccaggtcctcctcgacgtgcctgccgtgcatctccttgtagtacatgaacgtctgcacgaggtggggcttgctcctggtggtcaggatgcggagcacctcgtcgttctccaccagcttcccgttcccggcgcgcttcacggcggcacccagcgcctcggcctccgccttcgccacctccttgtccacccgcgggccctcgtacctgtacgcgctcaccagcccgaccagcaggctgcagtagggcttgtcccgggcgcggtgcgcgacgtcctcctcgagggagcggtggaagagcgcctggtacgcccggcgcgcgcccagcagctcgtcggcggaccgcgcgcaggcgacctccacgacgacggcgggcgggtggtggtggtggtggtgcaggacgtggtgcgccagccgcgcgtcgcgctcccacgggtgcgtcgcccacagcaccaccaggtccctgaaccgcgcgaactcggcggccaggtgcagcatgtactcctcctcgcgccggtccatgtcgccgccgtggctgctgaagaagcccgggaatcccctgcggaacgcggaccgcttctcgggctgcccgcgccaccgtgccagcgccgacaccatcgccggctcgtccacgccgagcccgccaaggcctgagaaggccctggtgagttgctgcacttcgtcggccattgcctggatctccaacgaaaccggagcagaggagactatgagcgatcgaggacttcgttctgtgtctgctctggtatgcttatcccggccgaacccgagggtacc

SEQ ID NO: 16115 - DNA, 1617 bp, Zea mays
ctcactccaccccgttaaaatcacgacgcggtggtgactggtgagtccacagtccacactccccactccattttctaccatcacactgacacgttcatagctagctagtcttcagctagtaacgtacgacggactaatctcgatctgggagcgaggaggaggacgacgataatgaagatgagctccgtgcccgcggcagcggcggtgatggtggtggtggtgctgctctctgcggcggcggcgactgtgacggggcaggcgcttgtgccgggcgtgatgatcttcggcgactcggtggttgacgcaggcaacaacaaccggctagcgacgctggtgcgcgccgacttcccgccctacggccgcgacttcccggcgacgcacgcgcccacggggcgcttctgcaacggcaagctcgccacggactacaccgtggagagcctggggctgagctcgtacccgccggcgtacctgagcgaggaggcgcagagcaacaacaagagcctcctccacggcgccaacttcgcgtccggcgccgccggctacctcgacgccaccgccgccctctacggcgccatgtcgctgagccggcaggcggggtacttccgggagtaccagtcgcgggtgggcgcgtcggccggcgagcagcgcgcccgggagctgacgtccgggtccatctacgtggtgagcgccggcaccagcgactacgtgcagaactactacgtgaacccgatgctgagcgccgcctacacgcccgaccagttcgccgacgcgctcatgcagcccttcacctccttcgtcgagggcctgtacagcctgggcgcccgccggatcggcgtgacgtcgctgccgccgatggggtgtctcccggcgtccgtgaccctgttcggcggcgggaacgcgggctgcgtggagcgcctcaacaacgactccctcaccttcaaccggaagctcggcgtggccgcggacgccgtgaagcgcaggcaccccgacctcaagctcgtcgtcttcgacatctaccagccgctcctcgacctcgtccaaaaccccaccaacgccggattcttcgagtcccggcgggcgtgctgcggcacgggcacgatcgagacgtcggtgctgtgccaccagggggcgccggggacgtgcaccaacgccacgggctacgtcttctgggacggcttccaccccacggacgccgccaacaaggtgctcgccgacgcgctcctcctgcagggcctacagctcatcgcgtgagccacagccacgcaacggcctcccgccgcccttctacgtacctaccttgctgcttctgtcgttccgtcctgctactgtgtctcgtgtgcttgtctgtctgtctgtctgtccatgatctctcgtagctttgtgatgctttggaaagacttgggagtgctgtaagatttctggtctgtataattacattcagcgtcttcccagcctcttcgctgaattttgaacttggagtgatcaacgtaaaaaacacacaacatttttagagtattgatacaacattgctcgatggtgaagctagaggtgtttagctaaaactttgtatctaaatccgatattagtaaaactttggatctgtggcttctgcagttc

SEQ ID NO: 16116 - DNA, 1522 bp, Zea mays
cctcgcccgttaaaatcacgacgcggtggtgactggtgtctggtgagtccacactccccactccattatctaccatcacactgacacgttcatagctagctagtcttcagctagtaacttacgacgggataatctcgatctgggagcgagggggaggacgacgacaatgaagatgagctccgtgcccgcggtagcggcggtgatggtggtggtggtggtgctgctatctgcagcggcgacgactgtgacggggcaggcgcttgtgccgggcgtgatgatcttcggcgactcggtggttgacgccggcaacaacaaccggctagcgacgctggtgcgcgccgacttcccgccctacggccgcgacttcccggcgacgcacgcgcccacggggcgcttctgcaacggcaagctcgccacggactacaccgtggagagcctggggctgagctcgtacccgccggcgtacctgagcgaggaggcgcagagcaacaacaagagcctcctccacggcgccaacttcgcgtccggcgccgccggctacctcgacgccaccgccgccctctacggcgccatgtcgctgagccggcaggtggggtacttccgggagtaccagtcgcgggtgggcgcgtcggccggccagcagcgcgcccgggagctgacgtccgggtccatctacgtggtgagcgccggcaccagcgactacgtgcagaactactacgtgaacccgatgctgagcgccgcctacacgcccgaccagttcgccgacgcgctcatgcagcccttcacctccttcgtcgagggcctgtacagcctgggcgcccgccggatcggcgtgacgtcgctgccgccgatggggtgtctcccggcgtccgtgaccctgttcggcggcgggaacgatgggtgcgtggagcgcctcaacaacgactcactcaccttcaaccggaagctcggcgtggccgcggacgccgtgaagcgcaggcaccccgacctcaagctcgtcgtcttcgacatctaccagccgctcctcgacctcgtccaaaaccccaccaacgccgggttcttcgagtcccggcgggcgtgctgcggcacgggcacgatcgagacgtcggtgctgtgccaccagggggcgccggggacgtgcaccaacgccacgggctacgtcttctgggacggcttccaccccacggacgccgccaacaaggtgctcgccgacgcgctcctcctgcagggcctacagctcatcgcgtgagccacagccacagccacgcaacggcctcccgccgcccttatacgtaccttgctgcttctgtcgttccgtcctgctactgtgtctcgtgtgcttgtctgtctgtctgtccatgatctctcgtagctttgtgatgctttggaaagacttgggagtgctgtaagatttctggtctgtataattacattcagcgtcttcccagcctcttcgctgaattttgaacttggagtgatcaaaaaaaaaaaaaaaaactcgagactagttctctcctcgtgc

SEQ ID NO: 16117 - DNA, 982 bp, Zea mays
aggccggccgggaccgaatcaccgctcaaccgcccttccgtcattcctacaggctacagtcctacgtacagccatctggaccgagttctaactactgccgccggccacctcctccgcccgccgccagcgtctccggctccgatcacctcccccgcccgcttacggccatctccccgcccacctacggccaccgccgcccgcgaaggcgtctccggatccggccacctcctccgcccagcgtgtttaccggacacgtctgccacccgtcaggccctgcccgacgctagggttgggcgacggcgtccaccggctgacgcccggggagatctcgcccgctctgctccatccaggtgcgaagtaatggaggtgctctgcatcggaacagcggataccaagtttgaggagctgcttttcctcgcggcgcaactccgctccgccctcgccgcctctggctccgactcgaaggttcaagtgagcatagtggatgtctccacaactgaaaagacaacggcaaatgatttcaaagacatcatatttatccctagaaatacaattctttcatgtcatttgggtgttgaccaacataatcttccagataacagaggtgaagcaattgcactcatgtcaaaggctcttcagagcttccttaaaaaaagatatgacagtggtatgctggtgggtgctgttggtttaggaggcagtggaggaactgcactaattgctcctgctctgaggttgttgccacttggagtgcctaagcttattgtatctactgttgccagtggtcacactacaccttatgttgaaacatctgatttggtctggtttccttcggttggtgacatctgtggaataaaacagtgtcagtcgtgttatattatctaatgctgcagcagctttttgctggaatggtacatggaatcttgtcggcgtccaatgagtctgatgaaacgtcaacaaagccaactgttggtattactat

SEQ ID NO: 16118 - DNA, 2503 bp, Zea mays
cattgggaccctcgaggccggccgggggacagagttctcactactgccgccggccacctcctccgcccgccgccagcgtctccggctccgatcacctcccccgcccgctctgctccatccaggtgcgaagtaatggaggtgctctgcatcggaacagcggataccaagtttgaggagctgcttttcctcgcggcgcaactccgctccgccctcgccgcctctggctccgactcgaaggttcaagtgagcatagtggatgtctccacaactgaaaagacaacggcaaatgatttcaaagacatcatatttatccccggccgggccgggctttcatgtcatttgggtgttgaccaacataatcttccagataacagaggtgaagcaattgcactcatgtcaaaggctcttcagagcttccttaaaaaaagatatgacagtggtatgctggtgggtgctgttggtttaggaggcagtggagggactgcactaattgctcctgctctgagattgttgccacttggagtgcctaagcttattgtatctactgttgccagtggtcacactacaccttatgtcgaaacatctgatttggtcttgtttccttcggttgttgacatctgtggaataaacagtgtcagtcgtgttatattatctaatgctgcagcagcttttgctggaatggtacatggaatcttgtcggcttccaatgagtctgatgaaacgtcaacaaagccaactgttggtattactatgtttggtgttacaacaccatgtgtaaatgcggtcaaggatagactgaacaaagaaggttatgagacccttgtattccatgccacaggtgtaggaggcaaagcaatggaagacctagttaggggtggttttatacagggcgtgttggatgtaacaacaacagaagttgcagaccatattgtagggggcatcatggcttgtgatgagaccaggtttgatgcaattatagagaataagatccctacttgttcttagtgttggagccttggatatggtaaactttggagctcgagatacaattcctcttgctttcgcagaccgaaatattcatgttcataatgagcaggtttcattgatgcgtacgactgtggaagagaacaagaaatttgctaggttcattgctgataaaataaacatatcttcatccaaagttactgtttgccttccccagaagggcatatctgcaatagatgctccaggaatgccattctatgatccagaagctacatctacactgttgggtgaattaaacacccttatacagagaaccgacattcgagaggtgaagctgtttccttaccacatcaatgaccctgaattcgcaaatgcattggtagatgcattcttgagtatggatgtacaggcctctagttcagcccaacctaagcaagatcttaatattggaaaatcctgttcaggacagaaaatttcagatagttctattatatggagaactcctgtggattttccagatgcaaaaccagaaatattgcggaggacgcggtcaatattacataaactgaaggaacagatcagtgacggtactccagttattggagctggtgctggcacaggcatatctgcaaagttcgaagaagctggtggggttgatcttatagtgttgtacaactctggacggtttcgaatggctggaaggggctcactagctgggctcttgccctttggtgatgcaaatgacattgtacttcagatggccaacgaagtgttgcctgtggttaaaggagttcctgttcttgctggggtatgtgctacagatccatttcgtcgaatggaatactttctcagacaactagaaaccattggattttgcggtgtgcaaaacttcccaaccgtaggtctgtttgatgggaattttagacagaatttggaggaaactggaatggggtacagcatggaagtggagatgatttcaatggctcatcgcatgggtttccttactactccatatgctttcaatccggatgaagctgctgccatggccaaggcaggagctcatatcgtagttgcacatatgggtctgacaactgcagggtctatcggggcaatgacagctgccactttagatgatagtgttttacgtgttcaggccattgcggatgcggcatttggggttaatcctgatatcattgttctctgtcacggaggccccatatctggacccctagaagccgagttcgtattgaagaatactaaaagggttcatggattttacggtgcatcaagcatggaaagattaccagtagagcaagctatcacgaacaccatgagagagtacaaaagaatttccttaaaatgagaaccatcgtttacatgcgtgatttaagcctgctgttctttcgttacacttcgcagattctgtcatctctgcctctttatttgtcatatacattttcttaccaatgtacctttcttgttggaatataatcataataaatgttttctttgacgaggc

SEQ ID NO: 16119 - DNA, 3850 bp, Zea mays
gtcgacccacgcgtccgctaggatcaaaaccgtctcgccgctgcaataatcttttgtcaattcttaatccctcgcgtcgacagcgacagcggaaccaactcacgttgccgcggcttcctccatcggtgcggtgccctgtccttttctctcgtccctcctccccccgtatagttaagccccgccccgctactactactactagcagcagcagcgctctcgcagcgggagatgcggtgttgatccgtgccccgctcggatctcgggactggtgccggctctgcccaggccccaggctccaggccagctccctcgacgtttctcggcgagctcgcttgccatggagggcgacgcggacggcgtgaagtcggggaggcgcggtggcggacaggtgtgccagatctgcggcgacggcgtgggcaccacggcggagggggacgtcttcgccgcctgcgacgtctgcgggtttccggtgtgccgcccctgctacgagtacgagcgcaaggacggcacgcaggcgtgcccccagtgcaagaccaagtacaagcgccacaaggggagcccggcgatccgtggggaggaaggagacgacactgatgccgatagcgacttcaactaccctgcatctggcaatgaggaccagaagcagaagattgccgacagaatgcgcagctggcgcatgaacgctgggggcagcggggatgttggtcgccccaagtatgacagtggcgagatcgggcttaccaagtatgacagtggcgagatccctcggggatacatcccatcagtcactaacagccagatctcaggagaaatccctggtgcttcccctgaccatcatatgatgtccccaactgggaacattggcaagcgtgctccatttccctatgtgaaccattcgccaaatccgtcaagggagttctctggtagcattgggaatgttgcctggaaagagagggttgatggctggaaaatgaagcaggacaaggggacgattcccatgacgaatggcacaagcattgctccctctgagggtcggggtgttggtgatattgatgcatcaactgattacaacatggaagatgccttattgaacgacgaaactcgacagcctctatctaggaaagttccacttccttcctccaggataaatccatacaggatggtcattgtgctgcgattgattgttctaagcatcttcttgcactaccgtatcacaaatcctgtgcgcaatgcatacccattatggcttctatctgttatatgtgagatctggtttgctctttcgtggatattggatcagttccctaagtggtttccaatcaaccgggagacgtaccttgataggctggcattaaggtatgaccgggaaggtgagccatctcagttggctgctgttgacattttcgtcagtacagtcgacccaatgaaggagcctcctcttgtcactgccaataccgtgctatccattcttgctgtggattaccctgtggataaggtctcttgctatgtatctgatgatggagctgcgatgctgacatttgatgcactagctgagacttcagagtttgctagaaaatgggtaccatttgttaagaagtacaacattgaacctagagctcctgaatggtacttctcccagaaaattgattacttgaaggacaaagtgcacccttcatttgttaaagaccgccgggccatgaagagagaatatgaagaattcaaagttagggtaaatggccttgttgctaaggcacagaaagttcctgaggaaggatggatcatgcaagatggcacaccatggccaggaaacaataccagggaccatcctggaatgattcaggttttccttggtcacagtggtggccttgatactgagggcaatgagctaccccgtttggtctatgtttctcgtgaaaagcgtcctggattccagcatcacaagaaagctggtgccatgaatgctcttgttcgtgtctcagctgtgcttaccaatggacaatacatgttgaatcttgattgtgatcactacattaacaacagtaaggctctcagggaagctatgtgcttccttatggaccctaacctaggaaggagtgtctgctacgtccagtttccccagagattcgatggcattgacaggaatgatcgatatgccaacaggaacaccgtgtttttcgatattaacttgagaggtcttgatggcatccaaggaccagtttatgtcggaactggctgtgttttcaaccgaacagctctatatggttatgagcccccaattaagcagaagaagggtggtttcttgtcatcactatgtggcggtaggaagaaggcaagcaaatcaaagaagggctcggacaagaagaagtcgcagaagcatgtggacagttctgtgccagtattcaaccttgaagatatagaggagggagttgaaggcgctggatttgacgacgagaaatcacttcttatgtctcaaatgagcctggagaagagatttggccagtccgcagcgtttgttgcctccactctgatggagtatggtggtgttcctcagtccgcaactccggagtctcttctgaaagaagctatccatgttataagctgtggctatgaggacaagactgaatggggaactgagatcgggtggatctacggttctgtgacagaagacattctcaccggattcaagatgcacgcgcgaggctggcggtcgatctactgcatgcccaagcggccagctttcaaggggtctgcccccatcaatctttcggaccgtctgaaccaggtgctccggtgggctcttgggtccgtggagatcctcttcagccggcactgccccctgtggtacggctacggagggcggctcaagttcctggagagattcgcgtacatcaacaccaccatctacccgctcacgtccatcccgcttctcatctactgcatcctgcccgccatctgtctgctcaccggaaagttcatcattccagagatcagcaacttcgccagcatctggttcatctccctcttcatctcgatcttcgccacgggcatcctggagatgaggtggagcggggtgggcatcgacgagtggtggaggaacgagcagttctgggtgatcgggggcatctccgcgcacctcttcgccgtgttccagggcctgctcaaggtgctggccggcatcgacaccaacttcaccgtcacctccaaggcctcggacgaggacggcgacttcgcggagctgtacatgttcaagtggacgacgctcctgatcccgcccaccaccatcctgatcatcaacctggtcggcgtcgtcgccggcatctcctacgccatcaacagcggataccagtcgtggggcccgctcttcggcaagctcttcttcgccttctgggtcatcgtccacctgtacccgttcctcaagggcctcatgggcaggcagaaccgcaccccgaccatcgtcgtcgtctgggccatcctgctggcgtccatcttctccttgctgtgggttcgcatcgaccccttcaccacccgcgtcactggcccggatacccagacgtgtggcatcaactgctagggaagtggaaggtttgtactttgtagaaacggaggaataccacgtgccatctgttgtctgttaagttatatatatataagcagcaagtggcgttatttacagctacgtacagaccagtggatattgtttaccacaaagttttacttgtgttaatatgcattcttttgttgatataatttatactttgtggagagttgctgacagacgagttttgtatgctacgaaaaacaaagaaattagtttgcattctttcactttggtgcatctccatgagaaatt

SEQ ID NO: 16120 - DNA, 4914 bp, Zea mays
  misc_feature (724)..(724): n is a, c, g, or t
aaatccctggtgcttcccctgaccatcatatgatgtctcctactgggaacattggcaggcgcgccccatttccctatatgaatcattcatgtatgtttatttctcagaatgatttctcatgtttgagattgcacctgtttgatgtgaagatctaatgattgtttcttgctccttgccagcaaatccgtcgagggaattctctggtagcattgggaatgttgcctggaaagagagggttgatggctggaaaatgaagcaggacaagggaacaattcccatgacgaatggcacaagcattgctccctctgagggccggggtgttggtgatattgatgcatcaactgattacaacatggaagatgccttattgtgagttccaacaccctccttcagctcactcatgttttacaggatgttatgttgtttagttctaatgttttctttaattagcatagttatattcacaaaaaaggaaaaaaaagtttgagttatttcctctatgcagatgaatgtaagagttggaagtttgcctttatattcccaaattaatgacccgtctacacttttatggaagctcatacaccatattatgttatcaagatcagtataaaatcaaactgatgggtgtactttagcctagaaagcggtacattatatttgtatcttagaattgttaaatgtatataacttcagctaaaatgcacaaacctgtcatgctcaaacnactgtaacgatgggcaattgtgtgaatccaaccattatattgctatgtttttttcaacacatatttgaacattaattttgtgccatctgaattgcagaaacgatgaaactcgccagcctctatctaggaaagttccacttccttcctccaggataaatccatacaggatggtcattgtgctacgattgattgttctaagcatcttcttgcactaccggatcacaaatcctgtgcgtaatgcatacccactgtggcttctatctgttatatgtgagatctggtttgctctttcctggatattggatcagtttccaaagtggtttccaatcaaccgcgagacttaccttgatagactcgcattaaggtgatctcttttccagttctctagtacgttgttcaacacaaactaaatttgttcatgtcacttatgtttgttattgttccatttcctctaacaggtatgaccgggaaggtgagccatctcagttggctgctgttgacatttttgtcagtactgtcgacccaatgaaggagcctcctcttgtcactgccaataccgtgctatccattctcgctgtggactatcctgtggataaggtctcttgctatgtatctgatgatggagctgctatgctgacatttgatgcactagctgagacttcagagtttgctagaaaatgggtgccatttgttaagaagtacaacattgaacctagagctcctgaatggtacttctcccagaaaattgattacttgaaggacaaagtgcacccttcatttgttaaagaccgccgggccatgaaggtctgtcttctttgtgaacatctttatatcgattttctagttgtaatccaatactgatgtgtcttaacaaaaaatcatggcagagagaatatgaagaattcaaaattagggtaaatggccttgttgctaaggcacaaaaagtccctgaggaaggatggatcatgcaagatggcacaccatggccaggaaacaataccagggaccatcctggaatgattcaggttaacatctacaaaatggaacttgtgttactcagttgtctgctaatgtggttgataatatccccccctttcttgtcttgaaaggaatttgctttgctaactcctctttctgaccatactcaggttttccttggtcacagtggtggtcttgatactgagggtaatgagctaccccgtttggtctatgtttctcgtgaaaaacgtcctggattccagcatcacaagaaagctggtgccatgaatgctcttgtaagtatttatatattacaaacagtgcaaaaactataacttcacttcaatatgttggttgtgatggtggaattctcttttctcacaggtccgcgtctcagctgtgcttaccaatggacaatacatgttgaatcttgattgtgatcactacatcaacaacagtaaggctctcagggaagctatgtgcttccttatggatcctaacctaggaaggagtgtctgctatgttcagtttccccagaggttcgatggtattgataggaatgatcgatatgccaacaggaacaccgtgtttttcgatgtaagccacaaatcatgttttaatattctccatcaatgttatgactattgggtgtacaaattcaaaagtttctaattcgtttttttgggggcatttctgtttaccacagattaacttgagaggtcttgatggcatccaaggaccagtttatgtgggcactggctgtgttttcaacagaacagctctatatggttatgagcccccaattaagcaaaagaagggtggtttcttgtcatcactatgtggtggcaggaagaagggaagcaaatcaaagaagggctcagacaagaaaaagtcacagaagcatgtggacagttctgtgccagtattcaatcttgaagatatagaggagggagttgaaggtacacctttatgtttatagatgcccatggtttaaaaccaatgtttagtttctgaaaagtgtacctttctgtgccatgcttttgtatattttgggggtttcgaagcacgtgttcacgctgtcagtttttcatatggcaggcgctggatttgatgatgagaaatcacttcttatgtctcaaatgagcttggagaagagatttggccaatctgcagcttttgttgcgtccactctgatggaatatggtggtgttcctcagtctgcgactccagaatctcttctgaaagaagctatccatgtcataagttgtggctacgaggacaagactgaatggggaactgaggtaatcctcgcatcagtactgttttgcaatttgataaccgtaccgtacgttgacagtaacaagtttatctcaaatcgcagattgggtggatctatggttctgtgacggaagatattctcactgggttcaagatgcacgcacgaggctggcggtcgatctactgcatgcctaagcggccggccttcaagggatcggctcccatcaatctctcagaccgtctgaaccaggtgctccggtgggctctcggttcagtggaaatccttttcagccggcattgccccctatggtacggctacggaggacgcctgaagttcttggagagattcgcctacatcaacaccaccatctacccgctcacgtccctcccgctcctcatttactgtatcctgcctgccatctgcctgctcacggggaagttcatcatcccagaggtaagcgtgcgctctacatcaacaccaccatctacccgctcacgtccctcccgctcctcatttactgtatcctgcctgccatctgcctgctcacggggaagttcatcatcccagagatcagcaacttcgctagtatctggttcatctctctcttcatctcgatcttcgccacgggtatcctggagatgaggtggagcggcgtgggcatcgacgagtggtggaggaacgagcagttctgggtcatcggaggcatctccgcccacctcttcgccgtcttccagggcctcctcaaggtgcttgccggcatcgacaccaacttcaccgtcacctccaaggcctcggatgaagacggcgacttcgcggagctgtacatgttcaagtggacgacacttctgatcccgcccaccaccatcctgatcatcaacctggtcggcgttgttgccggcatctcctacgccatcaacagcgggtaccagtcgtggggtccgctcttcggcaagctcttcttcgccttctgggtgatcgttcacctgtacccgttcctcaagggtctcatgggtcggcagaaccgcaccccgaccatcgtggttgtctgggcgatcctgctggcgtcgatcttctccttgctgtgggttcgcatcgatccgttcaccacccgcgtcactggcccggatactcgaacgtgtggcatcaactgctagggaggtggaaggtttgtagaaacagagagataccacgaatgtgccgctgccacaaattgtctgttagtaagttatataggcaggtggcgttatttacagctacgtacacacaaggggatactccgtttatcactggtgtgcattcttttgttgatataagttactatatatacgtattgcttctactttgtggagagtggctgacaggaccagttttgtaatgttatgaacagcaaagaaataagttagtttccattctttcaaaaaaaaaaaaacaaaaaaaaggcctggttcgactcgtgggccaatgattccaatgcataacactattttatgttagtaagttatccagttgcattaccgttcctaaactccttgttgaaacaaacaacaccataatctcattgtaggtgttgatgcaccttgttaaggtagtgtttggtttcggagtatggtgggacggagccgctccgatcctaatttgttgttatttggattggtttcatataggacagtatggttctaaaaaggaaaaaattatgctcaaatgctgaaacatttggaaatgagtttcattataaatctgttgtttagatgtatctagaattgcaattccatccaatacctagagtcttcactctgaattgggaggggcactttttagttgaagtccaattccatgaaattgagctttaattccagctctgaattcattagacaaccaagcattataattcacaaaatcctgattccaattccagtcttgaatatctaaatcc

SEQ ID NO: 16121 - DNA, 4187 bp, Zea mays
  misc_feature (4149)..(4149): n is a, c, g, or t
  misc_feature (4167)..(4167): n is a, c, g, or t
  misc_feature (4169)..(4169): n is a, c, g, or t
  misc_feature (4174)..(4174): n is a, c, g, or t
ctgcagtagaaaattaattgctcctatgttatcattgttctatctaaaataatcatagctcattaatgacgagccgttgggcttattttataggaacacatgccacatttcacacttgtacacctaacaattagaccgaccccagcatatcctccgtcggtgctcaggaccgacagtgagcactcactgccaagcgggccctgcacggcccccagttcacccttcttccacctcccgcctcactggcacactctccccgacacaactcggcttaaactaatccgaacccatcccaccagacgcgcgcaaattaactagaatcaaaatcgtctcgctgctgcaataatctcggctcgaggcttaatccctcgcgtcgaaagcgacagcggaaccaactcacgttgccgcggcttcctccatcggtgcggtgccctgtccttttctctcctccacctccctagtccctcctcccccccgcatacatagctactactagtagcaccacgctcgcagcgggagatgcggtgctgatccgtgcccctgctcggatctcgggagtggtgccgacttgtgtcggctcggctctgcctaggccagctccttgtcggttctgggcgagctcgcctgccatggagggcgacgcggacggcgtgaagtcggggaggcgcgggggagggcaggtgtgccagatctgcggcgatggcgtgggcactacggcggagggagacgtcttcaccgcctgcgacgtctgcgggttcccggtgtgccgcccctgctacgagtacgagcgcaaggacggcacacaagcgtgcccccagtgcaaaaacaagtacaagcgccacaaggggagtccagcgatccgaggggaggaaggagacgatactgatgccgatgatgctagcgacttcaactaccctgcatctggcaatgacgaccagaagcagaagattgctgacaggatgcgcagctggcgcatgaatgctgggggcagcggggatgttggccgccccaagtatgacagtggtgagatcgggcttaccaagtacgacagtggtgagatccctcggggatacatcccgtcagtcactaacagccagatttcgggagaaatccctggtgcttcccctgaccatcatatgatgtctcctactgggaacattggcaggcgcgccccatttccctatatgaatcattcatcaaatccgtcgagggaattctctggtagcgttgggaatgttgcctggaaagagagggttgatggctggaaaatgaagcaggacaagggaacaattcccatgacgaatggcacaagcattgctccctctgagggccggggtgttggtgatattgatgcatcaactgattacaacatggaagatgccttattaaacgatgaaactcgccagcctctatctaggaaagttccacttccttcctccaggataaatccatacaggatggtcattgtgctacgattgattgttctaagcatcttcttgcactaccggatcacaaatcctgtgcgtaatgcatacccactgtggcttctatctgttatatgtgagatctggtttgctctttcctggatattggatcagtttccaaagtggtttccaatcaaccgcgagacttaccttgatagactcgcattaaggtatgaccgggaaggtgagccatctcagttggctgctgttgacatttttgtcagtactgtcgacccaatgaaggagcctcctcttgtcactgccaataccgtgctatccattctcgctgtggactatcctgtggataaggtctcttgctatgtatctgatgatggagctgctatgctgacatttgatgcactagctgagacttcagagtttgctagaaaatgggtgccatttgttaagaagtacaacattgaacctagagctcctgaatggtacttctcccagaaaattgattacttgaaggacaaagtgcacccttcatttgttaaagaccgccgggccatgaagagagaatatgaagaattcaaaattagggtaaatggccttgttgctaaggcacaaaaagtccctgaggaaggatggatcatgcaagatggcacaccatggccaggaaacaataccagggaccatcctggaatgattcaggttttccttggtcacagtggtggtcttgatactgagggtaatgagctaccccgtttggtctatgtttctcgtgaaaaacgtcctggattccagcatcacaagaaagctggtgccatgaatgctcttgtccgcgtctcagctgtgcttaccaatggacaatacatgttgaatcttgattgtgatcactacatcaacaacagtaaggctctcagggaagctatgtgcttccttatggatcctaacctaggaaggagtgtctgctatgttcagtttccccagaggttcgatggtattgataggaatgatcgatatgccaacaggaacaccgtgtttttcgatattaacttgagaggtcttgatggcatccaaggaccagtttatgtgggcactggctgtgttttcaacagaacagctctatatggttatgagcccccaattaagcaaaagaagggtggtttcttgtcatcactatgtggtggcaggaagaagggaagcaaatcaaagaagggctcagacaagaaaaagtcacagaagcatgtggacagttctgtgccagtattcaatcttgaagatatagaggagggagttgaaggcgctggatttgatgatgagaaatcacttcttatgtctcaaatgagcttggagaagagatttggccaatctgcagcttttgttgcgtccactctgatggaatatggtggtgttcctcagtctgcgactccagaatctcttctgaaagaagctatccatgtcataagttgtggctacgaggacaagactgaatggggaactgagattgggtggatctatggttctgtgacggaagatattctcactgggttcaagatgcacgcacgaggctggcggtcgatctactgcatgcctaagcggccggccttcaagggatcggctcccatcaatctctcagaccgtctgaaccaggtgctccggtgggctctcggttcagtggaaatccttttcagccggcattgccccctatggtacggctacggaggacgcctgaagttcttggagagattcgcctacatcaacaccaccatctacccgctcacgtccctcccgctcctcatttactgtatcctgcctgccatctgcctgctcacggggaagttcatcatcccagagatcagcaacttcgctagtatctggttcatctctctcttcatctcgatcttcgccacgggtatcctggagatgaggtggagcggcgtgggcatcgacgagtggtggaggaacgagcagttctgggtcatcggaggcatctccgcccacctcttcgccgtcttccagggcctcctcaaggtgcttgccggcatcgacaccaacttcaccgtcacctccaaggcctcggatgaagacggcgacttcgcggagctgtacatgttcaagtggacgacacttctgatcccgcccaccaccatcctgatcatcaacctggtcggcgttgttgccggcatctcctacgccatcaacagcgggtaccagtcgtggggtccgctcttcggcaagctcttcttcgccttctgggtgatcgttcacctgtacccgttcctcaagggtctcatgggtcggcagaaccgcaccccgaccatcgtggttgtctgggcgatcctgctggcgtcgatcttctccttgctgtgggttcgcatcgatccgttcaccaaccgcgtcactggcccggatactcgaacgtgtggcatcaactgctagggaggtggaaggtttgtagaaacagagagataccacgaatgtgccgctgccacaaattgtctgttagtaagttatataggcaggtggcgttatttacagctacgtacacacaaggggatactccgtttatcactggtgtgcattcttttgttgatataagttactatatatacgtattgcttctactttgtggagagtggctgacaggaccagttttgtaatgttatgaacagcaaagaaataagttagtttccattctttcaaaaaaaaaaaaaaaaanaaaaaaaaaaaaaaaaananaaaanaaaaaaaaaaaaa

SEQ ID NO: 16122 - DNA, 3649 bp, Zea mays
  misc_feature (3624)..(3624): n is a, c, g, or t
  misc_feature (3646)..(3646): n is a, c, g, or t
tctccatcgcgcgcaccaaatcgcactccgtccgccccgtcgatcgaacagccaccgctcacctctctcacccgccgccaaaacctcctcccctggcctcctctcatactcatatagctgagcagcccctgccacaaggcagagcatcgctcacaccagcgtcgccctgccttgccatcgcgatcgatcgatcggaggccaagagctagctagcacgccggcctccgctcgccggtgccgcgcgcgatggaggccagcgccgggcttgtggccggctcgcacaaccggaacgagctggtgctcatccggggccacgaggaccccaagccgctgcgggcgctgagcgggcaggtgtgcgagatatgcggcgacgaggtcgggctcacggtggacggcgacctcttcgtggcctgcaacgagtgcggtttccccgtctgccggccctgctacgagtacgagcgccgggagggcacgcagaactgcccccagtgcaagacgcgctacaagcgcctcaaggggagcccgagggtcgccggggacgatgacgaggaggacatcgacgacctggagcacgagttcaacatcgacgacgagaagcagaggcagctggagggcaacatgcagaacagccagatcaccgaggccatgctgcacggcaagatgagctacgggaggggggccgacgacggcgagggcaacaacaccccgcagatgccgcccatcatcaccggcgcccgctccgtgccggtgagcggtgagtttccaatcacaaacgggtatggccacggcgagctctcgtcttccctgcacaagcgcatccatccctaccctgtgtctgagccagggagcgccaagtgggacgagaagaaagaagtgagctggaaggagaggatggacgactggaagtccaagcagggcatcctcggcggcggcggcggcggcgaccccgaagacatggacgccgacgtgccgctgaacgacgaggcgaggcagccgctgtcgcgcaaggtgtcgatcgcgtcgagcaaggtgaacccgtaccggatggtcatcgtggtgcgtctcgtcgtcctcgccttcttcctccgctaccgcatcctgcaccccgtcccggacgccatcgggctgtggctcgtctccatcatctgcgagatctggttcgccatctcctggatcctcgaccagttccccaagtggttccccatcgaccgcgagacgtacctcgaccgcctctccctcaggtacgagagggaaggggagccgtcgctgctgtcggcggtggacctgttcgtgagcacggtggacccgctcaaggagccgccgctggtgaccgccaacaccgtgctctccatcctcgccgtagactaccccgtggacaaggtctcctgctacgtctccgacgacggcgcgtcgatgctgacgttcgagtcgctgtcggagacggccgagttcgcgcgcaagtgggtgcccttctgcaagaagttcggcatcgagccccgcgccccggagttctacttctcgctcaaggtcgactacctcaaggacaaggtgcagcccaccttcgtgcaggagcgccgcgccatgaagagagagtacgaggagttcaaggtccgcatcaacgcgctggtggccaaggccatgaagcggccggcagaggggtggatcaccacgcgtccgacgccgtggcccgggaacaacacccgcgaccaccctggcatgatccaggtgttcctgggccacagcggcggccacgacaccgagggcaacgagctgccccgcctcgtgtacgtctcccgtgagaagcgcccgggcttccagcaccacaagaaggccggcgccatgaacgctctgatccgcgtctccgccgtgctgaccaacgcgcccttcatgctcaacttggactgtgatcactacatcaacaacagcaaggccatccgggaggccatgtgcttcctcatggaccctcaggtcggccggaaggtctgctacgtgcagttccctcagaggttcgacggcatcgacgtgcacgaccgatacgcgaacaggaacaccgtcttcttcgacatcaacatgaaggggctggacggcatccagggcccggtctacgtcgggacagggtgcgtgttccggcgccaggcgctctacggctacaaccctcccaagggccccaagaggccaaagatggtgacctgcgactgctgcccgtgcttcggccgcaagaagcggaaggacgccaaggatgggctgccggagggcaccgcggatatcggagtggacagcgacaaggagatgctcatgtcccagatgaacttcgagaagcggttcgggcagtccgcggcgttcgtcacgtccacgctcatggaggaaggcggcgtccctccgtcgtcgagcccagctgcgctcctcaaggaggccatccacgtcatcagctgcggctacgaggacaagaccgactggggcctggagctggggtggatctacgggtccatcacggaggacatcctgacggggttcaagatgcactgccgcgggtggcgctcggtgtactgcatgccgaagcgggcggcgttcaaggggtcggcgccgatcaatctgtcggaccgtctcaaccaggtgctccggtgggcgctggggtccgtcgagatcttcttcagccggcacagccccctgctgtacggctacaagaacggcaacctcaagtggctggagcgcttcgcctacatcaacaccaccatctaccccttcacctcgctcccgctgctcgcctactgtaccctgccagccgtctgcctcctcaccggcaagttcatcatgccgtcgatcagcacgttcgccagcctcttcttcatcgccctcttcatgtccatcttcgcgacgggcatcctggagatgcggtggagcggggtgagcatcgaggagtggtggaggaacgagcagttctgggtcatcggcggcgtgtccgcgcacctcttcgccgtcgtgcagggcctgctcaaggtcctggccgggatcgacaccaacttcaccgtcacctccaaggccaccggcgacgaggacgacgagttcgccgagctctacgcgttcaagtggaccacgctcctcatcccgcccaccacgctgctcatcatcaacatcatcggcgtcgtggccggcatctccgacgccatcaacaacgggtaccagtcgtggggcccgctcttcggcaagctcttcttcgccttctgggtcatcgtccacctctacccgttcctcaaggggctcatggggcgccagaaccggacgcccaccattgtcgtcatctggtccgtgctgctggcctccatcttctccctgctctgggtcaggatcgatcccttcatcgtcaggaccaaggggcccgacgtcaggcagtgtggcatcaactgctgagctgcctatcacggttcaaaaaagttctagagcttgtgcatagggagaaacaacagtttagaaattttgtgttgtcatgttttggagctcatatgctacgttttgtgtaatgttcttggacccagaattgtcggccggacgaggaattgaacaaaggacaaggtttgaatcaatgttaaatagcaaatgatattccgtgtaaattttggtcccccnaaaaaaaaaaaaaaaaaaaaanagg

SEQ ID NO: 16123 - DNA, 2826 bp, Zea mays
aaccaactgatgtgcatatagctggccgaggcccgacagccgctgtgcgcaaaggttccgatcccgtcgagcatgatcaacccgtaccgcatcgtcatcgtgctccgcctggtggtgctctgctcttcctcaagttccggatcacgacgcccgccacggacgccgtgcctctgtggctggcgtccgtcatctgcgagctctggttcgccttctcctggatcctggaccagctgccaaagtgggcgccggtgacgcgggagacgtacctggaccgcctggcgctgcggtacgaccgtgagggcgagccgtgccggccgcccccccgccccggcttcgtcagcacggtggacccgctcaaggagccgcccatcatcaccgccaacaccgtgctgtccatcctcgccgtcgactaccccgtggaccgcgtcagctgctacgtctccgacgacggcgcgtccatgctgctcttcgacgcgctgtccgagaccgccgagttcgcgcgccgctgggtgcccttctgcaagaagttcgccgtggagccgcgcgccccggagttctacttctcgcaaaagatcgactacctcaaggacaaggtgcagccgacgttcgtcaaggagcgccgcgccatgaagagggagtacgaggagttcaaggtgcgcatcaacgcgctggtggccaaggcgcagaagaagcccgaggaggggtgggtcatgcaggacggcacgccgtggcccgggaacaacacgcgcgaccacccgggcatgatccaggtctacctcggcagccagggcgcgctggacgtggagggccacgagctgccgcgcctcgtctacgtgtcccgtgagaagcgccccgggtacaaccaccacaagaaggcgggcgccatgaacgcgctggtgcgcgtctccgccgtgctcaccaacgcgcccttcatcctcaacctcgactgcgaccactacgtcaacaacagcaaggccgtgcgcgaggccatgtgcttcctcatggacccgcagctggggaagaagctctgctacgtccagttcccgcagcgcttcgatggcatcgatcgccacgaccgatacgccaaccgcaacgtcgtcttcttcgacatcaacatgaaggggctggacggcatccagggcccggtgtacgtcggcacggggtgcgtgttcaaccgccaggcgctgtacggctacgacccgccgcggcccgagaagcggcccaagatgacgtgcgactgctggccgtcgtggtgctgctgctgctgctgcttcggcggcggcaagcgcggcaaggcgcgcaaggacaagaagggcgacggcggcgaggagccgcgccggggcctgctcggcttctacaggaagcggagcaagaaggacaagctcggcggcgggtcggtggccggcagcaagaagggcggcgggctgtacaagaagcaccagcgcgcgttcgagctggaggagatcgaggaggggctggaggggtacgacgagctggagcgctcctcgctcatgtcgcagaagagcttcgagaagcggttcggccagtcgcccgtgttcatcgcctccacgctcgtcgaggacggcggcctgccgcagggcgccgccgccgaccccgccgcgctcatcaaggaggccatccacgtcatcagctgcggatacgaggagaagaccgagtggggcaaggagattgggtggatctatgggtcggtgacagaggatatcctgacggggttcaagatgcactgccgggggtggaagtccgtgtactgcacgccgacacggccggcgttcaaggggtcggcgcccatcaacttgtctgatcgtctccaccaggtgctgcgttgggcgctggggtccgtggagatcttcatgagccgccactgcccgctctggtacgcctacggcggccggctcaagtggctggagcgcttcgcctacaccaacaccatcgtgtaccccttcacctccatcccgctcctcgcctactgcaccatccccgccgtctgcctgctcaccggcaagttcatcattcccacgctgaacaacctcgccagcatctggttcatcgcgctcttcctgtccatcatcgcgacgagcgtcctggagctgcggtggagcggggtgagcatcgaggactggtggcgcaacgagcagttctgggtcatcggcggcgtgtccgcgcatctcttcgccgtgttccagggcttcctcaaggtgctgggcggcgtggacaccagcttcaccgtcacctccaaggcggccggcgacgaggccgacgccttcggggacctctacctcttcaagtggaccaccctgctggtgccccccaccacgctcatcatcatcaacatggtgggcatcgtggccggcgtgtccgacgccgtcaacaacggctacggctcctggggcccgctcttcggcaagctcttcttctccttctgggtcatcgtccacctctacccgttcctcaaggggctcatggggaggcagaaccggacgcccaccatcgtcgtgctctggtccatcctcctcgcctccatcttctcgctcgtctgggtcaggatcgaccccgttatccccgaaggccaagggccccatcctcaagccatgcggagtcgagtgctgagctcacctaccttccttctgcgtggcatgtacggacgccgccgtgcgtttggacatacaggcacttttgggccaggctactcatgttcgacttttttttttttaattttgtacaagatttgtgatcgagtgagacagagtgttgggtgtaagaactgtgatggaattcactcaaattaatggacatttttttttcttc

SEQ ID NO: 16124 - DNA, 639 bp, Zea mays
ttcgccgtgttccagggcttcctcaaggtgctgggcggcgtggacaccagcttcaccgtcacttccaaggcggccggcgacgaggccgacgccttcggggacctctacctcttcaagtggaccaccctgctggtgccccccaccacgctcatcatcatcaacatggtgggcatcgtggccggcgtgtccgacgccgtcaacaacggctacggctcctggggcccgctcttcggcaagctcttcttctccttctgggtcatcgtccacctctacccgttcctcaaggggctcatggggaggcagaaccggacgcccaccatcgtcgtgctctggtccatcctcctcgcctccatcttctcgctcgtctgggtcaggatcgacccgtttatcccgaaggccaagggccccatcctcaagccatgcggagtcgagtgctgagctcacctagctaccttcttgttgcatgtacggacgccgccgtgcgtttggacatacaggcacttttgggccaggctactcatgttcgactttttttttttaattttgtacaagatttgtgatcgagtgagacagagtgttgggtgtaagaactgtgatggaattcactcaaattaatggacattttttttcttccaacaa

SEQ ID NO: 16125 - DNA, 2712 bp, Zea mays
ggcggcggcgccgatcccgaagacatggacgccgacgtggcactgaacgacgaggcgaggcagccgctgtcgaggaaggtgtcgatcgcgtcgagcaaggtgaacccgtaccggatggtgatcgtggtgcgtctcgttgtgctcgccttcttcctccggtaccgtatcctgcaccccgtcccggacgccatcgggctgtggctcgtctccatcatctgcgagatctggttcgccatctcctggatcctcgaccagttccccaagtggttccccatcgaccgcgagacgtacctcgaccgcctctccctcaggtacgagagggaaggggagccgtcgctgctgtcggcggtggacctgttcgtgagcacggtggacccgctcaaggagccgccgctggtgaccgccaacaccgtgctctccatcctcgccgtagactaccccgtggacaaggtctcctgctacgtctccgacgacggcgcgtcgatgctgacgttcgagtcgctgtcggagacggccgagttcgcgcgcaagtgggtgcccttctgcaagaagttcggcatcgagccccgcgccccggagttctacttctcgctcaaggtcgactacctcaaggacaaggtgcagcccaccttcgtgcaggagcgccgcgccatgaagagagagtacgaggagttcaaggtccgcatcaacgcgctggtggccaaggccatgaaggtgccggcagaggggtggatcatgaaggacggcacgccgtggcccgggaacaacacccgcgaccaccccggcatgatccaggtgttcctgggccacagcggcggccacgacaccgagggcaacgagctgccccgcctcgtgtacgtctcccgtgagaagcgcccgggcttccagcaccacaagaaggccggcgccatgaacgctctgatccgcgtctccgccgtgctgaccaacgcgcccttcatgctcaacttggactgtgatcactacatcaacaacagcaaggccatccgggaggccatgtgcttcctcatggaccctcaggtcggccggaaggtctgctacgtgcagttcccgcagaggttcgacggcatcgacgtgcacgaccgatacgcgaacaggaacaccgtcttcttcgacatcaacatgaaggggctggacggcatccaaggcccggtgtacgtcgggacagggtgcgtgttccggcgccaggcgctctacggctacaaccctcccaagggacccaagaggcccaagatggtgacctgcgactgctgcccgtgcttcggccgcaagaagcggaaacacgccaaggacgggctgccggagggcaccgctgatatgggagtagatagcgacaaggagatgctcatgtcccacatgaacttcgagaagcggttcgggcagtccgcggcgttcgtcacgtcgacgctgatggaggaaggcggcgtccctccttcgtcgagccccgccgcgctcctcaaggaggccatccatgtcatcagctgcggctacgaggacaagaccgactgggggctggagctggggtggatctacgggtcgatcacggaggacatcctgacggggttcaagatgcactgccgcgggtggcgctccgtgtactgcatgccgaagcgggcggcgttcaaggggtcggcgccgatcaatctatcggaccgtctcaaccaggtgctccggtgggcgctggggtccgtcgagatcttcttcagccggcacagccccctgctgtacggctacaagaacggcaacctcaagtggctggagcgcttcgcctacatcaacaccaccatctaccccttcacctcgctcccgctgctcgcctactgcaccctccccgccgtctgcctcctcaccggcaagttcatcatgccgtcgattagcacgttcgccagcctcttcttcatcgccctcttcatgtccatcttcgcgacgggcatcctggagatgcggtggagcggggtgagcatcgaggagtggtggaggaacgagcagttctgggtcatcggcggcgtgtccgcgcatctcttcgccgtcgtgcagggcctgctcaaggtcctcgccgggatcgacaccaacttcaccgtcacctccaaggccaccggcgacgaggacgacgagttcgccgagctctacgccttcaagtggaccacgctcctcatcccgcccaccacgctgctcatcattaacgtcatcggcgtcgtggccggcatctccgacgccatcaacaacgggtaccagtcctgggggcccctcttcggcaagctcttcttcgccttctgggtcatcgtccacctctacccgttcctcaaggggctcagggggcgccagaacaggacgcccaccgttgttgtcatctggtccattctgctggcctccatcttctccctgctctgggtcaggatcgaccctttcatcgtcaggaccaagggcccggacgtcaggcagtgtggcatcaattgctgagctgtttattaaggttcaaaattctggagcttgtgcatagggagaaaaaaacaatttagaaattttgtaaggttgttgtgtctgtaatgttatggtacccagaattgtcggacgaggaattgaacaaaggacaaggtttgattgttaaatggcaaatgagtgcagtcatgctaaatgtaatccaaatagcaactactcctttggtttttattttcatatcgtattattagtttt

SEQ ID NO: 16126 - DNA, 2031 bp, Zea mays
acacccacatcctcacctccctccgcctccgagtgccaccaaaccctagatctcgcaccggcggcagccatgtccaagccatggggtggcgtcggcgcgtgggcgctggatgccgagcgcgccgaggaggaggagcgcgagcaggtcctggccttcccggcgcccgagccacccgcggccgcgggcggcgccgccagcttcccgagcctccgcgaggcggcctctgctggcggcaagggcaaatcgaagaagaagaacaagggcaccacgctgtccctgtccgagttcaccaccttcggcgcggccgcggcccagcggcgcgcggcgcccgtcgagcccaagggcctgacccacgaggagatgatgctgctgcccacgggcccccgggaacgctcggccgaggagctggaccgctctcgcgggttccgctcctacggcggcggcggcggcttcggcgcaggcgctggaggggagcgccgcggcgggttcgacgacgagggccgccgcgggccgggcagaagctccgatcttgacatgacatcccgagcggacgaggctgacgactggggcgccactaagaagttcaccccggctcccgccgactccggccgccgcgataggttcggtgggccttcccctctcggccgcgctgatgatattgacgactggtcacgcgacaagaagccgctcccgtcgcgctaccccagccttggttctgcaggtggcttccgtgactcgccgggcttccgcgactcatcagcttcttctgacgctgaccgttgggtccgtggagccacccctatgccacacaacggccagggggcgggggagaggccacgcatcgtccttaatccacctaaacgtgacccgtcaactgcctctaccccacctgctgaggtggctcgcaaccggccaagcccttttggggctgcaaggccccgggaggatgtgctggctgagaagggggtggattggaagaagtttgagaatgagattgaccagaagaccagccgccctaccagttcgcactccagcaggccgaatagtgctcattcctcccgccctggcagccctgggtcacaggtttcggccgttgggagcgaaggagcaccaagggcacggccaaaggttaacccatttggtgatgccaagccaagagaagtggtgttgcaggagaaagggaaagactggaggaagattgatgttgagctggagcatcgtgctataaataggccggagtctgatgaagaaagaaatttgaaagaagaaatcaacctcctgaaggtggatcttaaagaaatcgagggaaagatgagtaatggttctgagcagacatcggtagatgcaaaagatttgtctgagaagatatctatgttggaaagccagcttgagcagctttcaagggagttggatgacaagattcgatttgggcaaaggccacgttctggtgcaggcagggttacaacacttgcacccactagtttaggggaggaaccacaggctacagtggtggacagaccacgttctcgtggtggtatggaaccacccccaaggcaggaagaaagatggggatttcaaggaagccgagaaaggggctcgtttggtggaagcagaaattcagacaggccaatggcaagacagagatggtgaagttgggacaacaagcatctcttagggacacttctggatcgcagtcccttttttgttctgaaaggatgggcaaaaataagtcgttttctgtttgtcgtgtttgtttggtcttagaagattgttgagggtggagataactccacatgaagctattggttgtcaagtctgtatgccgtaggatgctttacatttccctttttgccgtcttccatgtcaaaacaatatctggcaacctccgatactaactgttattcatgggtcactgaattccggatcagcttttgtcataggtcgtttatttcagcattgagtaatggaaaccttgaatttgcacttttaccaaaaaaaaaaaaaaaaaacctcggggggggcccggtaccc

SEQ ID NO: 16127 - DNA, 2270 bp, Zea mays
tgtctaaaatcgatgggaaatttactctaccaccaccacgatcatacgaaacgcggtgcggcgggcacgccgtttttcggttccgcccctgggtacagcgcgatttagcgtgcaccacccgatcccagccaacaagatcccctggaacaagatcccctctcttcctcgcattcgcatcgcctcgattccacccacccacctccgtccgcctccgagcaccaccaaaccctagatctcgcaccggcggcagccatgtccaagccatggggcagcgtcggcgccggcgcgtgggcgctggacgccgagcgcgccgaggaggaagagcgcgagcaggccctgacctttccggcgctcgagccgcccttgcccgcgggcggcgccgccagcttcccgagcctccgggaggccgccgccgcgggcggcgggggcaagtcgaagaagaagaacaagggcaccacgctgtcgctgtccgagttcaccacctacggcgcggccgcggcccagcggcgcgcggcgcctgtcgagcccaagggcctgacccacgatgagatgctgctgttgcccacggggccccgggagcgctcggccgaggagctggaccgctcccgcgggttccgctcctacggcggcggcagcggcttcggcggccccgggggagagcgccgcagcggcttcgacgacgaggaccgccgcgggccgggcagaagctcggatcttgatatgccctcccgcgccgacgaggctgacgactggggcgccaccaagaagtttaccccggctcccacagactctggccgccgcgataggttcggcggcccttcccctctcggccgtgctgatgatattgacgactggtcgcgcggcaagaagccgctcccggcgcgctaccccagtctcgggtctggaggtggcttccgcgactctccagccttccgcgactcaccagctgcttctgattctgaccgttgggtccgtggcgccacccctttgccacacaacggcgagggggcgggggagaggccgcgcatcgtcctgaatcctcctaaacgtgatccgttagttgcctctaccccacctgctgaggtggcccgcaaccgaccaagcccgttcggggctgcaaggccccgggaggatgtgctggcggagaagggggtggactggaggaagtttgagaatgagattgagcacaagaccagccgtcctaccagttcgcactccagcaggccaaatagcgctcattcctcccgccctggtagccctgggtcgcaggtttcggcagttgggagtgaaggagcaccgagggcacggccaaaggttaacccatttggtgatgccaagccaagagaagtggtgctgcaggagaaagggaaggattggaggaagattgatattgagcttgaacatcgtgctataaataggccagagtctgatgaagaaagaaatttgaaagaagaaatcaaccttctgaaggtggatcttaaggaaatcgagagaaacatgagtaatggttctgaccagacatcggtagatgcaaaaggtttgtctgagaagatatctcagttggaaagccagcttgagcagctttcaagggagttggatgacaagattcgatttggacaaagaccacgttcgggtgcgggcagggttacagcacttgcaccaactagtttaggggaggaaccgcatgctacagtggtggacagaccgcgttctcgtggtggtatggagccaccaccaaggcaggaagaaagatggggatttcaaggaagcagagaaaggggctcttttggtgcaagcagaaattcggacaggccaatggcaaggcagagatggtgaaactgggacaacaagcatctcttagggatatttccggttcccagtcccttttttttgttctgaaaagatgggcaaaataagtcgttacttatttgtttgtcgtgtttgcttggtctagaagattgttgaggatggagataactccacatgaagttattggtttgtcaactctatgccgtaggatgttttgcgtttccctttttgccatctaccatgtcaaaacgatatcttagcaacctccgatactaactgttatgcttactggattccagttcagcatatgtcactagttgattatttgtgcactgcttagtggaaaccttggatttgcacttttactgatgctatgtcacctttctgttagtgttttttttaaaaaaaaaaaaaaaaaaaaaaaaaaaaaaaaagggaagccgctcgcgatctagaactag

SEQ ID NO: 16128 - DNA, 5369 bp, Zea mays
  misc_feature (4527)..(4527): n is a, c, g, or t
gccggccgggccctggagcagcctgaaaccttgcctttctttcttcggttcttccattacccccaggccccagcgtgcgtggtctccttcctctcgtggcgacgaccgagcggccgtcgctgcctacgtgcccagtcctgttcgtcccttcgccggcgacggccacgacctggttataggcaaagtttgtcctgaactgttcatcatggtggaaggctgggtattctctgctttgttagtggtgtttctagcgttcacaacaccttgcgagtcattctacttgccaggtagttatatgcacacatatcagcaaggtgaagtaataagggcgaaggtgaactctctcacttccattgagacagaactacccttcagttactacagccttccatactgtcgtcccagagatggggttaagaagagtgctgaaaacttaggcgagcttctgatgggtgatcaaatagataattctccgtaccgtttccgtgtaaatgtcaacgaatctctgtatctgtgtactacaaccccacttgacgaggctaatgtgaagctcctcaagcagcgtagccatgatctataccaggtgaacatgattcttgacaatcttcctgtgaggaggttcacagagcagaatggaataaccatccagtggacaggctatccagttggttatattccagaaggcacttctgatgtctacatcatcaatcacctgaaatttaaggtcttggtccataagtatgaaggaggcgaagtaaaggtagttgggactggggaaggaatggaagtgatctcagagactgacaaagatgccaattctggatatgagattgtgggatttgaagttgtcccatgcagcgtgaagcgtgatcctgaatccatattgaagcttaatatgtatgataaagtcgatcctgtgaactgccctgtggagttggaaaaatctcaattggttagggagaaagagaagattacttttacttatgaggttgaatttgtaaacagtgatatcaggtggccatcacggtgggatgcatacctgaagatggagggttcgaagattcactggttttcaattatgaactctttgatggtaattctatttttggctggcattgtatttgtcatattcttgcgtacagtgaggagggacttgactcggtatgaagagttggataaggaggcccaagctcagatgaatgaggagctctctggttggaagcttgttgttggagatgtcttcagagaaccaacctcaccgaagctgctctgtgtcatgattggcgatggggttcagattttgggtatggcaattgttaccattttctttgccgcatttggcttcatgtctcctgcatcgagaggaatgttgttgacagggatgatagtcttttatatgttacttggaattgtgtctgggtatgctgctgtcaggctctggaggactttaaaaggaacgtccgagggatggaggtctgtctcctggtcaactgcttgtttcttccctggcattgtcttcattgtcctcactgtgttaaacttcatgctgtggacaagaaatagtactggagcccttcccatctcacttttctttggccttttgtccttgtggttctgtgtctccgtgccacttacccttttaggtggtttctttggcacaagggctgagccaatagaattccctgttcgaaccaatcagataccaagagaaatccctacgaagaagtactcattgctcttcatacttggtgctggaactctaccttttggaacactcttcatcgagctcttcttcattctttctagtatttggcttggaaggttctattacgtgtttggcttcctccttgtcgtgcttcttttgctgattgtggtgtgtgctgaggtatcagttgttcttacctacatgcatctctgcgcggaggactggaggtggtggtggaaagctttctttgcttctggaacagtggccctttatgtgttcctttactctatcaactacttggtgtttgatctcagaagcttgagtgggccagtttctgctattctctacattggatactctttcgttgtctcccttgccattatgctagcgactggtaccgttggcttcctgacgtcgttctcttttgtccactaccttttctcatcagtcaagattgattgaagatccagggttgtctttacacaaaatcacctgtgagctcaaatgatatgaccattgcatcttgaaggcctttcacagagcagtgctgtttgtaatgtagcttattaccgagagtctgagactactgtaccttgtaatgaatagtatatttcagcagatgtgttttgaagtttgtcacactttgctacagcattttgttgacctgccaatactgtaggaaaagtcttgcgtttattatcccatggtgccattttgttgtctgtttctttctgcaagattggcttgcagctggagaactatacgttcttatggtataatctacatgtgcaaaatgtttcccatccaaaaaaaaaaaaaaaattattttgttgctatgtatttatgcaggattccatagaacactacagctagttttatgtttgatagttaagcttgatagttcatttttgtctttttattcataccactgtcaatgacagtgatttgtgatctttagaaatatatttcagggtaacacttgtatcaagtcacccaatatcaggtttcgttaggttttgttctatcagggtaccttttcttagttaagttgattctgaaatctgtggaaaacgtagtcaaatacatttttgggaatgcacctcattcagttaaatgtatgttttcaaataccgtaaggagtcttttagggtcctatattcttatatatctttgttcgctgttcgaaagtgactctaaaagactcaaagcaagattgccgtttattagtgctattgtttccgctttagttatgagactggaggaattcaactctcaccatgttgttcggaggacctgtgttttatgttacagtttgaggcgctcaaacgtttaggtgccaccatgttcatggattgcctgtcaatttcatcttatgttaggcaacttactaagccctttctcttatcgtgcacttgcggccagtttcttgaatgtcggctaaatgtcatttgggagttagcttcattcagtgattggttatgttgctagcctgatgagatgtgtatgccaaccctatgccttttttttatctgtttctggaaggaagtcccgttcttggctgttgattttgatttattgctcaaatgatacaaaccttggcgttgcgatgttcttctcagcctcaactcgtaacgaccaaacagacataatgcgccagaaacctaatgctgatggtggccgctacgattctgcaccatcttctgcaatctacagtgtctaccttttctactcgaatggaaatacaggctttagaatgcatcagatgagtttacttctttaccccgtgacctgccattctatgatcttttgggggtattttctaatgcatgctgcctggttcctgcggttacggtcagcatgtgcctgcgtctttttgacttttagattggctttaatttataaagtattgtactgcttctatggtgtttcgttcaaaaccacatcttccagcaagcccgaaagtccgatctgaagcacattttttagcctaacctgactcgcttaaaacggacctaggccgaccagataagaataaacaggcaaggtctagatagagaatcaagcatgacatgatggcccggcacgaccctttagcgcttggcctgttttttactaaaccgtgccttttggcccgttaaactcgttttttggcccgttttttccgtgcttacaggctggcctggcccgtttaagcccgtagcgtgccgaccgttcagggaaacaagcccttgggtcggtcatgcccgacctggttttctaacggggctcggtgccccgtttaaacataactaattacaactgcatcagtctgaataaccgacttcaatccgaaaagaacaacatgtttgctttcgatgtgcaaacagaccaatgacctaggtgttcatgtgaaaggtattcccaacccttatctcttatcgctctatttcaaacttatttctgcaaacagtatcaaatagtgttatctacaatttcactcactattttacacactctactgatacagtcttacactataaattacactttttatagaataaagtttaaaataaagagtaaggtagaatagttgcttgacctaattttcgcgatccagttcgtggcatcacaataaaaaaataatagtaattatgaatttatttgaagaaaactgaccgagtaaacttgtgacaaaaagtcaaataatttataaattaaaatggagagagtattaaaaaataatcaaaaggtttttataaataagaaatttaaaattcccaaattcaattttttcttgaaaaatttataggaaaatattttaacttatcggtgtcgaagtttgnaagttgcaactcccaattcgtcgccaacgtggcagtgggtatggtaatcaagggtcacacaaagctatatccatacttgttagagaaaaaatactctatatctataccattatccccattatgggtacatacgctatattcataccaaccatggggtagcgggtacctatacccactaaacattatgggtggacatgatcatttaaatcaaaaaaagcaagtatcgaatacaaaatgttgaaatctcatacctcatcaatattgaaatatgctaacataacatattatctttatgctagcatgaaaaatttaacgaaaccaacataattttataacaaggtcaacaacattcagcattaaatggcaacaccatacaagcccatacatgagagagaataagtcccttaattcgaacccacatgtcatatgttagcggattttttagggtagcgggtatgtggcaagagagaacatacatgtgcccaccatacccaatgaatgacccaataaaataaccatagatatcaaaattcgtcgtacccataccctaataggtttttacctatcagatatcgggtacccattgccatccctaagactacctatgttcttataggtgcaacaaacttctatatggtatttgatttgataaataagataacccatcatcttctcacttcttatttttttgtttgggtcctagaatgaaatatgttgatccatcaccgcctcattcctcatagttagtccattatcttctcactcatcattttttatttggtttgtaaaataaaataagttgatcgatcaccacctcattcctcatagttagttagtactaa

SEQ ID NO: 16129 - DNA, 2980 bp, Zea mays
gactgtttcgctcgacctcgcgcgcgggtgcccagagggctgctggctgcggtccacactactagctcgtacacggacgggcgcgcactgggtggtcgatcggcgacgtgaccatccggtctgctccgtccggtctcttcgtggtggtggcggccagtggccactcacgcgcgcactgagactgagactaaggggacttctgcaggggctcgaatcgcccctgttgcaccccggccggacctcaggcctgcctgcacactctgtgggctgggcagtactcgagcagccctcacatggtctctgggactttgaatattctgaatcgaaccaaaaacaactttcgcgacgcactagcacgcagcattgttggtacattacactcattcattatactgcgtgtattgtattgctgacttataagaatcacaaagaattgatccaaaacgaatgaggcgacacgtacgaccgaggtcggtctacacttgatcgagagtacacgtactgaaaccgtggccagcgcaacacactacatacatacagtgtgttggctgccctgccagcgtcttctttcttgggagcaacagctaataacaacatcaataacgaacaacaacaatgcacaggtaattaatatcaactgagacgggacgtgtatatatgtatgcatgtgatctccgtgtagcagcatgcatcagcggcagcaggagcggggcgggcgcgtcgatcatctggcctggacgtggtcttctgtggagttgacgtaggcgaaccacctctggagctggcggttgtaggcgcacggccgctcgacgtggagcaggtggccggccttgcggatgccgtacaggaagcagttgtcgcccagcggcctgcgatttcgtcgcgaatcggatcgatcgcgcgtggttagtcaattagcgcgggcacccggcaatggcgtgcgagagagaactttgcctgccttgattggcagcagcatgcatgcatgcaaagggcaaaacgtacgggcgagtgcttactctttcatcttcctggcgagctcgatgtcgaagatcttgtcctcctcgccccacagcagcattattttctgcgaccacggtgagaattcgtttcaccttttctttttgaaacaatggattcaaatgggcttgaatgctcgctttgtttccccaaaagccagctcagagattaactgggctttggccgtttcgtaatgagtatgggccctcaaaatctagtgggaggaataacaacagaacgggaatatctctttggatgtatctgcactctgccggtcactttcatcagtcatctaacatggacccctaaaccaagtagctgtgggttaggttggtttggttttgtaagaaagtaagggcttgtttgtacaggtgaattggatgatattgaatcggtttaaatatatataaagttaaaatttatctcaattcattttaatacacactaattcaatggaattgaaataaccgaaataaaggcgggacggtacctgttggaatgcagggatcttggcgtccgtgtttgctggttatcagcccctgcaacagctccatcctctccttcctgttggtgaacatcaccttgaggtagtccttgtagaacctgtcggggaaccacatcttcctgtacatggagacggagaggagcgccttgagccccttgagcgtgtcgggcatgagcagctcggcggacgacccggcccccagccgctccatggtctccctgttcaccgcgtccgtcatggccaccacggacccggacacgcacagcgaccgcaccagccccggccgcgcctcggccagcttgaacgccaccatgcccccgtagctgaacccgaccacgtcgcaccgcgccacgcccagccgcgccagcgcccccgccacgcactcggcctggaagtccggggaccggtccgcgctcgacgtcgacgacttgccgaagaacatcaggtccgggatgtacaggttgtagcgcgacaccagcacgccgaagttgaactgccacgtcacgttgccctcggcggcgaagccgtggatgagcaccacgttgggcctcgactcggggctcttcctattcttcttcttcttcttggcggcggtaggctcgagcgggctgatggtggtgcccttcttgcccacgtggtgcttgggcgcccacacgtgcatggtcgtgcccggctccagctccatctcaatggggcggagcccggccatcttcatcaaccgtgacagcagcggcttctgcgcctcgatgaagttcaccatcttgctggagctcaagctgaagctcgatcgatcggccgcgcgcttgctccgtccgctcccttgccggtgcctagctggctttgtttggtcgccggcgcgcgtggctgcagctcgctgttcctcagtcaggcgttcgcgccgggcccgtattaatagagaggcgcaccgtaccggagcagggtcggcgtggccgcatgggctgcgcaagtgcaacgacggggagcggtgtaacgaccggcgatggcgacggacgcgcgcgagccggcgggcgggtgggtggggtttgggtggcgctgggcccagtggcagcgggagagcggagtggggacaagttgaagcggggaggcgggttcagtgatctaccggaatgcacacatgcgcgcggtagcttggattggtgcaaccaactgttctgcgcgtcgccggctcccctgcccttgaggcatcaggcatgtatcctctaattcttgacttgatgatttgttatagacgagttacgacgaagctttcagtctcttacgtagtaatgctgtacttaaaaagaggctaggtgtactctgatatgatccgaaggtttaccagaccgtgaccggcgaagataatgacaccaattaatttatttgtaaaccagcaaataaaggtggtctaaagggtttgttcggttagctctcatttcatgtagattgagtgggttg

SEQ ID NO: 16130 - DNA, 3623 bp, Zea mays
aaccgaaaccgatcacagctgactcccgaatccgtgaaatccccatcgccgtctccgtcttctcctattgccctctcctcgcccgcacagccgcactgtttcccaatcccaaaccctccgaccccacctggaacccaacacgcgcacccacagagggaaccgagcctagccgaaccttcgagaagtttccggaaagccgtgtcgtcgatggcggccgagggcggcggcggccaagagacgttcgaggcgcgggtgaagcgcctgttcgggtcccgcctcttcgacgccgtcccggactcctccttcccgacggcctcctggtccgtggccgcgggcgacgtcgagcgccaacgctgggcgaagccgtcagaggcccgcgacgcggaggaagaggcagcgggtgaggccggccgcggggacacgccctgcgcctcctcgttctacgactccaacggttgcctccgcagccggaggcgcaggtccaggcaggaggagttcgagggggacctggacgacctagatgaagacgaggaggaggatggggagagagggagggcgacggagcaggacgaggacgagggggttagggttaacatcggcctcgaccccactctggatcgggaggtgagcaaagttgtcttcggtcattgatttggtttgttttgaccactccataagctgttctttcgatatcataattgatgcttggcagtttgctggaattaagctgtgaagattaggatcgaatcaattatcgaccttcatcctattccttgacctaggatttgttgcctcctgactatggttctgcatgatttggataaaggataggcagagacgatcagagcattttgttggacattttttagtggtctgtgctatagttccatgttgtggcatttctgtttcatttgtcttcttggatgtgttctggtgactgcgagtaggaccaatgtattacatttaatggttcactaggccctctatctatggcagtttttttattttccttttggttaatgattaattttttattgtggtagttaatgatgatagtaattgactaatgaaatatcgtcatttgaatgtgatatatgcttgacctggaaacaccttaagtaacttatctggacttgtcttgaatgtttcttcatggtcggtcactatgagccatcatatctatcactgttggtttgcttctagtggactgttatcttagaagagttgtttattgcaggaagaggaggacaagtatgacagagaggcctttggtagagaggaggctgctgaccgcgtgtacatgcacgatataatggatgacggtataaacatgagcatcaacagtatagtccctgacctccttgatgattccattgaaggggtgtaccgttttaagaaggatcctcgggcagatatgagggcagcatctgcaagactcagagaagacgatgggtctgctaaagatggtgactctcactatgccactgaagcgaaggacttcctgaatgtgggaattcagacaaagaaagctgtggaggaagtaaatgtaaaacctatactgaagaggaaggaggagcaagcggatttgaaaccaaggaaacgtgtccggtttgatgctaatgttaaggatcgcgagtcggatatgtttgaacgtgatgaagattctccaatggttcctcaatccatggaagtagtcacagggaaggagagcacgcctactttgtctgtgtctcctggtgtccctgactatgtaaggaacccttcaaagtacacccgttacaccctggatgtaccagagtctaatgatgactcgaacaggacggctcttgctgacctgcatgatctgttagggagatcagaccaaaacaggatacattctgagactgctgttgagattcctagctcagtcacattcatccctcgcaaaaagtcagtggatgccatggcagtggatgacggtcccagagctattgattccaactcatctgtaattggattggtagcaggtgcctctgatgaacctgatcaatgcgagatggatgaagatgacagtaatttatcgtcaacgccacagatgcatacaaactcgaaggcaaactctcggcgttacaggtcaagtagaactgatgatgatgagtaaaattgagggccccagggtacctagtctgatgtttgtttaagaagtttttaagtttcggaatacttatgtaaatcaggatatatgtgtgctcttgtgctttgatcttgtgatctgagctaaccaactatgtttaagtacgtttcccccatatgctttgttctataatttctcatattgggatttgagcgccacatagtatgtcaatattagaaattttcagaaacttcactggtaagtcgtctaagctggtttcagtctaattgtgtcagacgatatgaacttttttctttacagtttattcttcttgcagaaagcaatttagaggaaacctaactgaccctatattttttctatcatcagatatgcacttcctttcctatgtagaaacgagtgtcagcagaataaacagttttggggacataggggcatacaaatacaatatcccatgggttacaaaatagggcatcccatttcaggtttgtgaccaaatttcagaaccaaaatccacaatatcaatctgtacattcttgcagcgtttatctactgtgctcaagacacgtagtggcggcggctacagctcatcagcaattctgtagagggcatcagccaccttgccaagcacaccaagcaggctgctcacttggtccttcctctgctccctgttcaaccggctgttgacgttctgcgcctctagctgcgccgccaccatctgactgctccggtctaggatctcaaccagctgcccctgcaggttggtcgtggcttctccagaggcattgtcgtcgctgcgctgcctcttctgcccacactgcgttggtgagtcctcggtgatctgctccgactgcttttcgtttgacgcgcctgctgtttggaaacatggatggttgttaagtatgaaatatgaacttctggagctttgtcatgtgaattttactgctgttattttgttctggttgcatgtgagattgtctgacgatataatatatacccgaaccgtttgattcaagtaaaaaaaaattgcgggtaagacagtatcaggtattgtattaagaaaaaaaacttctcacacacaagtcaataaaaccatcgaacctttgctccacccatattttttaaccacagtctaaaatttgttcctggggagtcaaacctaagacctaaagaatgctacttagactacctaaccaactcggctagaggctcttttgccatttaattcaattagaaattgtattagttgattatttttctgcgtgttacaataaagaaggtaatagttatttgaacagaaagactaaataggaaggaatagtccttacatcatctccaacagatctatacatatttctatgtcttaaaactagcattttattagaaggtgcttcagatctgttatatttcttattgtacatataacttttaagagagatcctaaaaccagccctccttcgcgtcgagcacaaccctgtcaccaaccccgcac

SEQ ID NO: 16131 - DNA, 1721 bp, Zea mays
caatccgtgaaatcacaatcgcagccgccgtcttctcctatcgccctctccttgtcggttcgcccgcaccgtttcccaaaccctccggactcgaacccaacccacgcacccacatcgggagacgagccaggccgagctctagaagagtctccggaaggcccgcatcgtcgatggcggccgagggcagcggcgtccaagagacgttcgaggcgcgggtgaagcgcctgttcgggtcccgcctcttcgacgccgtcccggactcctccttcccgacggcctcctggtccgtggccgcgggcgacgtcgagcgccaccgttggtcgaagccgtcggaggcccgcgacgcggaggaggaggcagcgggggaggccggccgcggggacacgccctgcgtctccgcgttctacgacgccaacgggtgccttcgtggccggaggcgcaggtccaggaaggaggagttcgaggggaacctcgacgacctagatgaagacgaggaggaagacggggagagggagaggaatgcggcagaacaggacgaggaggagggggttagagttaacatcggcctcgaccccactctggatcgggaggaagaggaggacaagtatgacagagaggcctttggcagagaggaggctgctgaccgcgtgtacatgcatgatataatggatgccggcataaacatgagcatcaacagtatagtccctgacctccttgatgattccattgaagaggtgtaccgttttaggaaggatccccgtgcagatatgagggcagcatctccaagactcagagaagatggttctactaaagattgtgattctcactatcccactcaagccaaggatttccccagtgtagttcatacaaagaaagctgtggaggaagtcaatgtaaaacctatactgaagaggaaggagtcacaagctgatttaaaaccaaggaaacgtgtcaggtttgatgctaatgttaaggatagtgagttggatatgtttgaacatgacgaagattctccaacggttcctcaatccatggatgtaatcactgagttggagagcacatctactttgtctgcatctcctggggtccctgactatgtaaggaacccttcaaagtacacccgatacaccctggatgtaccagagtctaatgatggctcgaacaggacagctcttgctgacatgcatgatctgttagcgagatcatacccaaacaggatacattctgagacgcctgttaagattcctagctcagtcacattcatccctcgcaagaagtcagttgataccatggcagtggatgagggccccagagctattgattccaactcctctgcaattggaatggtagcaggcgcctcagatgaacctgatcaatgtgaaatggatgaagatgacagtaaatcaccgacaacgccacagatgcatacaaactcaaaggcgagctcccggcgttacaggtcaagcagaacagatgatgatgagtgaaattgaggatcccagggtatccaatctgatgtttgtttctaagaaaattttgagtttcagaataccttatgtaaatccggatatatgtgtgttcttgtgatttgagctaattaactatgttgaactacttttcccccataaaaaaaaaaaaaaaaaaaaaaaaaaaccgggagtcacataggatgtcaatattagaaatttccacaaacttcactggtaagttgtcttagctga

SEQ ID NO: 16132 - DNA, 1287 bp, Zea mays
aatccattgtcactcgattgttaaaagctccagcaaatgttggcacccgacgcgcggcagcaactgatgcagccacagcttccgatgagaggataactgtactggtcattggtggcggaggcagggagcatgctctttgttatgccttgaaccattccccatcatgtgctgcagttctatgtgcccctggcaatgctggtattgctcagtcccgggatgcaacatgtatcccagatttggacatctcgagtagtgatgatgttatctcattctgccgcaagaggggagtgggaatggttgtagtgggccctgaagcccctcttgtcgcgggtcttgcgaatgaccttgtcaaagttgggataccaacctttggcccttcatcagaggctgcagctttagaaggatcaaaggacttcatgaagaagctgtgtgataagtacaacatccctacagccaagtatcgcacattcacggacgctgtggaagctaaaaaatatgttaaaaatgaaggagcccctatcgttgttaaagctgatggactggctgctggaaagggtgtggttgtcgcaatgactttggatgaggcgttcgaagccatagattctatgttggttgaaggctcattcggttctgctggttcactggttatcatcgaagaatttctagagggtgaagaagcctctttctttgcattggtagatggcacaaatgctttacctcttgaatcagcacaggatcacaaaagagttggtgatggtgatgttggcccaaataccggtggtatgggtgcatactcccctgctccaatagtgacagatgagctcaaacgcactgtaatggaaagtataattatccctactgttaaaggaatgtcaaccgaagttgcaagtttgttggtgtattatatgctgggcttatgatcgagaagaagtctgggctgcctaagcttattgagtacaatgtaagatttggtgacccagaatgccaggttctgatgatgcgattagaatctgatttggcacaagttctgttatctgcttgccagggagagttaggcaatgtttcactaacctggtcacccgaaatggcaatggtggttgtgatggcaagccagggatacccgggcccttataaaaaggggaccgtgataaaaaacgtggacaaggctgagcaggtgtctccggctgtcaagatattccatgctgggacagcactagatggagacggcaaccttgttgccgttggagggcgagttcttggtgtcactgccaaggccaaggacattga

SEQ ID NO: 16133 - DNA, 2754 bp, Zea mays
  misc_feature (131)..(131): n is a, c, g, or t
gagtacaatgtaagatttggtgacccagaatgccaggttagttacccatctccagtatccagtattcatttttgtagaggaacgaacaagaaattccacaaaattgattttaaaaacaagatctgaacaanagcttcatacaatataagtgtatagcggagtgtcggaatgcatcaatcaataattcagtacagacagaaagttcagaacatgatcttttggaagagaaacatccaactgtttagtaaactttcagattagcggaacgatgcattatagtttatacatgtctaaatttataattccaatttgggttttggttaatatgatcaatgtattttcgttagacaatagaatgcaaaggatatgtatatctttccaactaagtctgtgcttgtgctgcacttttgcccaaaaattttcattctcttctcttccagtggatgagctgagtagacttgattactgtaacgcaagtggaatggtgcatttctgtgtcataaaatagcatattggattagtctaggtgatcagatatattattacaatctgaaaaaggagatatgatgtatagtgaaatgaaaaattgcaatgcacgcctatttaagatctatgtaactgcctatttaggaccatctggtagccattatactattcctcactatctgtttgatcaatatcagacaaattaaagtttctttggttgtaaatttggaagctcacatttcttgaccagtgcagaatgtccaattttttactctatcgcctgcagaaaaaaatcatttccatttcttttttaccaatgacagtcttacatgtctagcttggaccgcttattttattcagtaatatctaaggatatattaatgtcatgggcatactttagatgtccctgaacccaagcagcgtcaccatgctgacactcagcagccgcaccagaagatctggaacacatgaggtactagaaaaatagaaacttagagagatttgttgcttaacgagagaagatacaaggccatcctatagatgggacaactggaccttaaggaactattctctgaaattaaagaaacaaatcaacataatcttatttttgaataaaaacaaaccataaggctactggaacattcaacatgcaggaccagtagaagtagtacaacatcaaaattaaatatgagaaactgtaagtggagagggggtggggttaagatggcttctgggcattccgcttaagatagaatgtaacattctctcgccagtcaagaaaacctctgaactcctgtcctacccatacgtagcggcaccgttgcccatgtttttcttaactccagccaaaaaaatttgaggagtgctactcaagccacccaaccaactcaagctagaagcccttttgctaatagaaaacgtacgattgtttcttggagttgttcatagctgttctgttcgcctaagtaatatgaatccaaattataaggtctctatcagttcaaactactgttctaaaaatcctaatgggttactacattgtaatatatgtttgaacttgaactttatggataatttcctttgctgcatcttcattatgcctttctagtagtacatcttcgaagtacaccacacacatttcagacgaatcatttagctgaaatcgtgtgcttgacctgtgactgaaatatttttctcatggtattccaactatccttttctctactgatctattttttgtgtcattatatgatcgagaagaagtctgggctgcctaagcgcccggggtacaatgtaagatttggtgacccagaatgccaggttctgatgatgcgattagaatctgatttggcacaagttctgttatctgcttgccagggagagttaggcaatgtttcactaacctggtcacccgaaatggcaatggtggttgtgatggcaagccagggatacccgggcccttataaaaaggggaccgtgataaaaaacgtggacaaggctgagcaggtgtctccggctgtcaagatattccatgctgggacagcactagatggagacggcaaccttgttgccgttggagggcgagttcttggtgtcactgccaagggcaaggacattgaagaagcaagggcaagagcatatggtgcggtagacgctgtcgagtggccagaagggttcttcaggcacgacattggttggagagcactgaggcagaagcaagcggcaaaataggtagcagctacccatgaccacgagattttcctagactaccacaactacggtgagcttgtagtgtttgcaagtaataaaaagggaaacggtgtaacgttcactgatttttttttggttgtggaacagcaggttgttcaaattttaacacctgcggatttcagcatgatttggtagatgtttgaaccgagattatgttcagagtctagacaagcgctagcgtgaaagcagcgccatctgaattctgaccatttgtctttcagttctcggataagtggacctcctatatgactgtgatatctcaaaccaaacacttcagagtgtgatcgacctgtcctgtcccgtccggttatccatagtatagtcaccaagctatatgttatctgggcatgtctagatgttgatctatcagaccgacgcttctttttttcccgttcttcggccgctcgcagagacaggagacggacgtctcgaccctcggagagcgacggccggcgaccggacgtcccgcgtgtctacgcctcggtggctgcaggtcga

SEQ ID NO: 16134 - DNA, 2122 bp, Zea mays
ctcgaggccggccgggccggggacacgactctcggcaacggatatctcggctctcgcatcgatgaagaacgtagcaaaatgcgatacctggtgtgaattgcagaatcccgcgaaccatcgagtttttgaacgcaagttgcgcccgctgccttctgtccttcggggctcccgttggcctggcatccacgctcgattcggccgttttccgcatccacggagccaggcgaccgccgccgcttccctactcacccttggccggcgacgacgagcgcccaccacggcaggatgacgacgctgaggaacctcaagatcaagacgtcgacgtgcaagaggatcgtgaaggagctgcgctcgtacgagaaggaggtggagaaggaggcggccaagaccgccgacatgaaggagaagggcgctgatccctacgacctcaaacagcaggagaatgttttggctgagtcaaggatgatggtcccagactgccacaaacgacttgaaactgcactggctgacttgaaagcaacactggctgaactgaaggagtcaaatgagcaaggtgccgagattggagaagctgagagtacaatcgcagaagttgaagcagttgtcaagccagcagaagattaaactaaaaaaactcttggtttgctgaactgttagcgcacatcctattttcgcatattgagcccttgtgagcttattacgagatgtttgaggcgtgaaatcctgtaccattatcatcacttctatcttgaaatttgagtttctgttcccaagttcaaagcgttactgtttgttgtctgggagagcgcacatccctggcttctccgggaagttgttagtgtaaattgaaattaagaaaaatggacgaatttgaatacagacgaaatttgcgacggtcgatggaaatgtattgtctctatgacgccatctccaggagctcatgtgcggcccgtgctaaaagaagtgtacactacatcatgtgcagtgcaggattgcacagcacattccgtgttggttaacctgcatagatataaattctgtatagacatcgtactgctgtagattcttctaccatcgtttgcatgttgattgggcagctctaactcattgtagtttcctgttacaaagagaccgggggattcttccaccatagatgccttttggatcggcccgtgcaaatactcgtgatgacaaccggttccagacatcaggtaggactttcgaaagccagcaactccaagacattctatatttaaccttatgtgcacagatatattccctctcgacattgttcaacatgactctgtcttcctctttgattgactggttgttggaagcaatgctccctgctgttcaacatgcaatacgtatacaaaataaaccatgctgacattaaccatggtttgtttgacattaaccatgctgaaaactggggtggcgttccctatcccaaaagatgcagcaatctggattaattgctcccttgaaattgcatcagtggctttcataatctgcaatgcagaaaataagaaagctttagttggaatttttatcagcatttgcttttatcaaaggaattaatatgtcaagtacaactcatggttcgtaaataactatcggatgatgtaacataagatcttacctcatcaagaacgaatttccgaaagaagctctccctctcggatagtagaaaagcaagagctgcacgggctttaaccgactgctcaggctatggccattggaaatacaggaaccaaactacctccgaaatcagtcaattcagccatgtttcattccaagttctccccaccgttctttactgcgcgaataaaattctcgaaagctttcataacatcaactgacaactgcgctagtgtccctattttatgtaactgcaggcttgccactgttctttacatttggcgtgtttgcctctatttttcaaaacaaaaccgttgtatgtctctactccgttagttgcactaaacggtgttatgtcttgataaaatagacaactcaattgtgtcaatgcccctattttgaagtataaatgtagttttgcccatgttttttagacttacgtgtttggacaacaatacaaattattttatagtaatttaaa

SEQ ID NO: 16135 - DNA, 1011 bp, Zea mays
  misc_feature (945)..(946): n is a, c, g, or t
  misc_feature (961)..(961): n is a, c, g, or t
  misc_feature (1004)..(1004): n is a, c, g, or t
agtccgtgggtttgcacgtctgttgctctctatcgcggagacggatcagcgcgtcaactgacatccctatgtccttcgccgctttctcatggccgtttcgccgccggggcggggctggcagcagtggcgcaagcaaatccgccgccacggcagaggaggacgaggagctgggcgtgaccccgcagctcctcgacttcctccggacgctctcgcccgacgccttcaaggccgccgcactccagctccaaggaggctccacggaggcggccgccggcgacctcaccagctggcaggagcggcacgccgtgctcgtgctatccaaagctaaggaactcgccaagattcggtatgatctgtgccctcggcacctgaaggataagcagttctggaggatatacttcctgctcgccaagagttacatctcaccgtatgaactacgtgccatacagaaggaaaaactcagacggatggagacagaaaactgcaagccaaaacaagtgatctctgttgaggtggagatgcaagaatcgaagcgcactagtctctcacaagcatcagaagtagatctagaatctcaggtttagttttgcagttatagcttctaacagatctagcttaggtaacgcaatcagtagcccttttatgattcctccacacaccaaatagctccacgagttcttcagatcttggatcgactctcgctagactaccagtccgctgtgtgcttttgtgtactgaaaccaagtaggtcctttcctgcattacgcagcatatgtgcttgttggctgtgctccgatccactgacatgtaaatctagggtatcttgcgcgtgaacaaaaacgactgcgtttcatgtagctatagattatgtcaacttcgattctgctgtgcatgtgttggacacaaaaaaaaaaaaaaaaaaaaaaaaagcggacgctgggaaannaaaaaaaaaaaaaanaaaaaaaaaaaaaaaaaaaaaaaaaaaaaaaaaaaaaaaaaanggggggg

SEQ ID NO: 16136 - DNA, 2120 bp, Zea mays
  misc_feature (589)..(589): n is a, c, g, or t
  misc_feature (1847)..(1848): n is a, c, g, or t
  misc_feature (1924)..(1924): n is a, c, g, or t
ttttttttttttttttgcgggaaaataaacgaatgtttttcacttgcaacaatgctggccgaaccgcagcagtactgaatgattattaaaaaaaggcaaagaaaaaagaaacaaaacttagccactaaattcccggattgatcttacaacagggggggaatgaatggatgactagacttgacagtcgtctaaaaaatcctaggactttctcagccatctcacttcaccgcctccggccggccgcactcctcttggctcttgctcgtcgtcgaggtgtctgtcggcgccgcgtccagcttcactccactcgagtgggaacgaagggagcgagcgcgaaaaaagtggttaaaagaaagaaaaaaaaagagacgagacgacgaaatggccgtcgcgcgcgcgatgggcagagcggcgcgctcaacagacggccttctcgacggagatgccgtggaggagcgggagcgagtctccggcgaaacggccgtcgcgcgcgcgcccgcaatgggcagggcggcgcgctcaccagacggccttgtcggcggagatgccgcggaggagcgggagcgagtctccggcggcggcggcggcnggcaggcgacgcagcagcaggacagtgcgccactctcgaggtcctcgagggtgacgaagcgggcggacttggacggggaggagaggtggcggaggacgtgctcgaagaggccctcgtcgcaggggagcgcgatggggcccgcgcaggcccccgacgggaacccgtactcctcctccgcctgccggagcagctcccggaacacggggtggttcaggtgcgccgcccgcaccacgaaccgccgcgccgcgccgcccacgcacaccgccacgtgccccgccgggaccgccgcgcgagccgccgcgcgggaccgccaccgccgcagcgtctgccgcagccacacgatgtaccggatcttgctgctgcatttcgccatgtcgacgcacgagcgagcgaccgagcgcgcgcctcgtccctcacggccgccggtagacgtagatctatctagctgcgcggttgggttggaccaatgtcaatcgatggcgacgaacggcgaggggaagcgccgcgagagtagagctagctggtgagagctgagaggtggcttggacttggaggcagacttgcggaggggaaggtagctaggctttatagggaggaggggccccttggcgaccctttgcctttcggatcgtccagttggcccggtataaaattatgctgaaaaggatggattggtattcttctactactctctgtgtcacaaaaatatataagatgtataaatgactaaaattctaggttttcttatctttgactagcaaataaattggaaactttaggtttgtagttggaaatgctaatgatcaaactttattagtcataaataaaatattacggaatgtacagagtacactgccaaatatataattttcctatgcagtacaggtacagttaaatgcacctcagcacctgggtcttgtttcatttttccacatgccgctttaagtaatactccctccgtttctttttattagtcgctggatagtgcaaaattgcactatccagtgactaataaaaagaaacgggggagtagtagttttggtaaaatttatcctgtaaaaaaactatttggagagttataccatccatatttggctagcgaaaactttagagagtcaaatttattatttatatttagaaaacgagaaatctagaatacacagaattgctaaaaaacaattagaaagaagcctctagtagttctctaaaagacattctaaatcaataatctagatagttaatataaaaactcctctcnnataactctctaaatgaacttcctaaatttagtcacttctcatataaccttattttctctatacatttgacaatcanttaccaactctctaaagaaaaaaagttggcgatactatgtaggtaatgaaagtgattgttgacatttgtgatttttttgtatgaatagatttaaaacaaaactacaacctgtatttatagaactattagagaaattacagtttgttactcccaaacttatttagcaacttgttaaatctatgtagagagctaaaat

SEQ ID NO: 16137 - DNA, 1240 bp, Zea mays
ccggccgggatccggtgatccggccgggattggaagcatctccggcaagagacaagatgcacgtgaacctaaatggtagccgtttgcatgtgcatgcgatctgcacgatctgtaacaaccgttagcaagtctcacgcccctgtaatttcttgtctcattactacatataggctgtaacagtggaagggaatacaatacgctattcttgctaatcttcaagcaggagagaaaaaagcataagctgagcatccatcaatggcggatgctggcaacgaggccgagggtctgacgctgttgggcctgcacgtgagccccttcgcgttgcgcgtgcgcatggcgctgagcctcaagggcctgagctacgagtacatcgagcaggacctgttccacaagggcgagctcctcctcagctcaaaccccgtgcacaagaaggtgcccgtgctcatccaccacggcaagcccatctgcgagtccctcgccgtcgtggagtacgtcgatgaggtctggcccggcgccgccgccaccatcctccccgccgacccccacggtcgcgccaccgctcgcttctgggccgcctacatcgacggcaagctgtttccggcgtggacagggatcatgaaggcggcgacggaggaagcgagggcggataagctgagggagacgcacgccgcggtcctcaacctggagaaggccttcgccgagatcagctctagctccagcaacgacggcgcggccttcttcggcggcgactccgtcgggtacctggacctcgcgctcgggtgctccctgccgtggttcggggcgctgcgcgccatgctcggcgtcgagatcatcgacgccgcccaggctccgctcctggtggcgtgggccgagcgatttggggagaccccggtggccaaggaggtgctgccgcagccggacgaggctgtggcctacgccaagaagattcaggcctactgggcttctgctaagaactgatgagcaccgaatcctgtcatgatgaaattgaagcagcaatacttgtataacactccaatcatggtgaataaaggcctctaaactgttggttaagaaaaaaaaaaaaaaaaacgatgtgaaagaagaacggggaaacgaggaaatagggtagaattggtgtaggatgtatctacaagataagagcgtatagaagtctcaacgactccgctcgctctcgagatccacaccacaattccaactccagccccggccggcctcgagg

SEQ ID NO: 16138 - DNA, 2110 bp, Zea mays
ttgggtacctcgaggccggaccgaactctcctctctcccggccggccggtgagctcgactgctccagttcttcccatttcccagccgccgcggcgccacgcagacctagcagagaaacacccacccgagatggcgatggctctgcgccgccttgcgggcgtgtccggatcgccgtcggcctcctctgccgcggccacggtgctactccggtcggcgctgacccgcccgatctccaccggcttccgcgaggagcgcgacaccttcggtcccatccaagtccccaacgacaagctgtggggcgcgcagacgcagagatcgctgcagaactttgacattggcggggagcgtgagaggatgcccgttcccatcatccgtgcctttggcgtgctaaaaaagtgcgccgctaaggtgaatatggactatggccttgatccaacaatagggaaggccataatacaggcagctgaggaggtcgcagagggaaagttggatgatcacttcccacttgttatctggcaaactggcagtggcacacaaagcaacatgaatgccaatgaggtaattgcaaatagggcatctgagatccttggacacaagcgcggtgagaagtttgtgcacccaaatgaccatgtgaataggtcacaatcttcaaatgatacatttcccactgtaatgcatatagcgacggccgttgagatacattcgaggtttatcccaagtttgcaacagttgcatgattcacttcattcgaaaactattgagtttaaagacataattaaaattggacgtacacatacccaagatgccaccccattgactcttggccaagaattcagtggctacactacacaggtcaaatatggaattgaccgcattaattgtacattacctcggatgtaccagcttgctcaaggtggaactgcagttggaactggcttgaacaccaagaaaggatttgatgccaaaatagctgctgcagtggctgaggaaacaaacctaccctttgtgacagcagagaacaagtttgaagctttggcagcacatgacgcttttgttgagagcagtggtgccgtaaatacaatttctgcatctcttatgaagatagcaaacgacatacgtttgctaggaagtggtcctcggtgtggtcttggtgaactaatcctaccagaaaatgagcctgggagcagcattatgcctgggaaagttaatccaacccagtgtgaggctctgacaatggtttgtgcacaggttatgggtaatcatgttggtgttacaattggtggtgccaatgggcattttgaactgaatgtttttaagccaatgatcgcagccggattacttcgatcattgaggttgttaggggatgcatccgtgtcctttgagaaaaattgtgtcaggggaattcaagcaaaccacaagagaatttcacaacttttgcatgagtctctgatgttagtgacatctttgaaccctaaaattggctatgacaatgctgcagctgttgctaagaaagcccacaaagaaggaaccacgttgaaggaagctgcattagaccttggagtattaacggagcaagaattccatgagcttgtcgtcccggagaaaatgattggtccttctgattgataaccccatgttcactatgtttctttgaagcattcaggttgccacatccgcgagttctggtggccctgtgtttccaagttaatgattctagcgcacccataaataaagcaaataatttttcatatggtcattaggtcctcaccgtaccgcactagagaaatgatttttgcatggcggatggtatctgagaaaacagttgtattcttgttcaaatagggagcagtgcactttgattcatgaggcgccttccattatcttggcatcagtcaaccttttcttgccaagtagctagtgctatgtaacaagtgacatggcaaccatgtatagaaattatttgcatgggtttgtgttcttgccaggtagctaatgttatgtaataagtgacaaggaaacaatgtcatgaattatttgcattgggttttgacgagtgaaatagaaatatacgccctgttttagttttcaagttaaaaaaaaaaaaaaaaaa

SEQ ID NO: 16139 - DNA, 809 bp, Zea mays
ttggggcccccctccccggccccggaagaagaagacaagtgagaacaatcatatatatattgttgcttaaagagaagagaagatcgacaagagattggcggtaatggactcctcggagctgcacatactggccttgcagagggtgaagcaggtggagccggagaacgcgagcaagatcctcggctgcatcctcctggaggaacccgacaaccaggatatgctgcagctcgcctacggcaacgacgccgaggtgcacgccaagatcagccacgccaaggccatgctggacgccatcgtcgcgtgctgctcctcctcgccggccttcggctaccactactggccgccggtgcccaataaggcgcaggcagaggagtacgcgttgcagccgcagcactacagtggcggagggtgctactacgcctctgagaacgcgctcatctacaatggcggggggccgccgaggtccaggctgtcgtcgacgcggcgcccctgccactacttcatcaagggaatctgcaagaacgggcagagctgccactactcgcaccaccggcaggaggcccaggtctgctccggcgcgctggagaagctggagctggagatcattgagctgctcaagtcgcggcacgggcagccgctgtccatcgcgtcgctgcccacgctatacggcgacaggtacggggaagagcctaaaggccgatggctacctcacggagagcaagcggcatgggaaggccggctacagcctgagcaggctcatctcccgactcagccagatcacaaccatagaaaggccgcacgggcagcac

SEQ ID NO: 16140 - DNA, 3576 bp, Zea mays
aactctatatgaacatatattttctaaaaattagtaaaaaaaattattttgaaggcatcaatttgttgcgtcttgcactttttcgagacacatgatatataatattgaccattgaactaataaataaaattaataaaagataaattgaaagcatgcgcaatgcgtgcccctcgccaaaaagaagttgaatgatgttgatgcggcaagttaaaaagaaaagaaagaggcggaaaacacagagatcacgtgttctgggatatatttccatttccatcccattatttctatttggaatagaatagaaaaagggagagggggaaggaaccgcctccgctaatctctcgatctatgtatgcatgcgtggtgcggaaggagtcaggagcgagaggagaggactcgggcaaagcagcaaccgccgccccctgcgaaccgctcgttcgccggcccttgatttataaaaggagccgaggcctgttcctcccgccggaagaagacaagtgagaacaatcatatatatattgttgcttaaagagaagagaagagaagagaagatcgacaagagattggcggtaatggactcctcggagctgcacatactggccttgcagagggtgaagcaggtggagccggagaacgcgagcaagatcctcggctgcatcctcctggaggaacccgacaaccaggatatgctgcagctcgcctacggcaacgacgccgaggtgcacgccaagatcagccacgccaaggccatgctggacgccatcgtcgcgtgctgctcctcctcgccggccttcggctaccactactggccgccggtgcccaataaggcgcaggcagaggagtacgcgttgcagccgcagcactacagtggcggagggtgctactacgcctctgagaacgcgctcatctacaatggcggggggccgccgaggtccaggctgtcgtcgacgcggcgcccctgccactacttcatcaagggaatctgcaagaacgggcagagctgccactactcgcaccaccggcaggaggcccaggtctgctccggcgcgctggagaagctggagctggagatcattgagctgctcaagtcgcggcacgggcagccgctgtccatcgcgtcgctgcccacgctatacggcgacaggtacgggaagagcctaaaggccgatggctacctcacggagagcaagcggcatgggaaggccggctacagcctgagcaggctcatctcccgactcagcaagatcacaaccatagaaaggtaaatgaattaattaattatcagaagagagaattaaagagatcattggatttgaacgcatgcaggccgcacgggcagcactatgtggttctggcggaggacgccggcaggtacaaggagttgatgagcaggggcgagagaggaggagacatgggcagcagctcgcaccaggtatacctcaccttcccttcagagagcaccttcatggaggaagacgtggccaattacttcgggtatgtattagctaggatgcatggttaattttctttatacatacatatatacatacatacatacatacatacatagctataagctaataaccctggtaagatctaatgatgcagtttgtatggttcggtgcgcgacgtgaggatcccatggcaggagaaacggatgtttggcttcgtgagcttccacaatccggagacggtgaacaccatactcacgatgcgcatcccacatttcatcggcgaatcaagggtcctggtcaaacgctacatagagaaatccaagtgcatcgaacggtacggtcggtaatacatacatacatacatacatataaacgatgctgatcgatcgctcgctcgctcgctggctgatacaaatacataaagttgcagctatcgtccgagggcgcttcgtcgcttcgtcggcatggacatggacatggacatgaacggtaaatactttaatttaatttgttggtgcagccagcaaattaatacttaattttgtatgtagacgatgatgatgactacgacgaccagcctccagcccggatggtgatgaggaatcagcaacgactactggcgacggagaagcggctgatcgagctcgagaggaagcgcttcttcgcgatgccgccgcagcagtaccagcacgtctacttcgactgcagcatcggggacgacgacggccagggccagccaccaccacgacatcttcccctcatcataacccaaccagctcgggcaagcagcagcagcagttacgacgacgacgacgacgacatccaactcccagaaagcccattcacgtcgtcagccgtgccgatgctgatgtaatgggccgggaaagggaaaccaaggtccacttaattagcttcctttgttacacaggacaggacaggacacaaaaacaccctcttttttgttgtagatataaacaaattaagggagtcacagtacacagagagagttggtgttcttagaatgcaggcacactggtgagttttaaacaagggtgccagaaagaattacttattagctgtgccataataataataagatcgtcgtctctgtttgtgccttcagtcgttattagctttaatttctagtatgcggtcatgcaatgcatgatcgagactcacctgatcctgacatgcaaattaaaatatctgcatgctagctggagggaaatctagtttgtgtggatatatagcgttatggatgtctggcttctctggctgtaatcccttgcattgcaactaggataaggttggtatgatgtgaccaactcaaacaaccaacactactacgtcctcaaacttctgctgggtcacatatatcattaattgccatcaggattacattataattacacaatgtgattcagtcaaaaatgtatatattacaattatttaagtgctaattgtatattcaaatagaaccattttcggtattaggggtcaaagtgaatgaacaactaaattcaaggactaatatttccattcatctttaaatatatttatacacatcactgagtgccttaaatatatagacgcatactgaaaataaacaacacaatttcgaaagaggcgggcaatagttgtttgaataatggatatgtctatcagggacatatatagttaactctatctcttactgcttcttgtgaatggataagaacaccacataaaaaacgaaccttttatgaaatggcgatgttttcacaacacaaaggccctagcctggctacccgagaactggaaccaatcacgcccctatagaggaccatagaagccccaagtcacccatgcatgagccattatttggttgggccaaattgtgccttatttgatctataatttataatattttgaagaaaaaaaagataggtaaaactttattgaattaaaagctacccatgaatttaagtgttaccccttctattctagattataaaatgttttattttaactatgtatctaaatataatatgtatttaagtgcttaacaaaaaactatatctagaaaagttaaaatgagttacaatttcaattaagggaatatgtattactcaagcttagatag

SEQ ID NO: 16141 - DNA, 1236 bp, Zea mays
gggtccctcgaggccggccggggctcacgcctatgactatttatccgccctccttgcgatcggacagccaggcacccgcgccgaccgcgaccggtgggcggcgggggcaagctgggtgggtttctacttctactactactaccacacgcgcgcgcgatctcgcggtggtttcatcagctcacacacagagaacaggatcaggatcaggacagatgggagccgagaacggtagcaacaacccttcgtcgaccgtcttggatggcctctacggggtgcagctcggccgtccatcggatccggcacagaccgacggtggggcgtcgtcgtcaccagcagcttgtgaacaccaccacaagcgtggccgtggtggtacagcacaggcacagcagaggttgcggatccgaaggctatggcagcacagaccgtcttgcttcaagcccatccactgcaccattacgtgtgacaagcatgctggcgagactgtcgcgaacgtcgtcacctcgctgcccttcatcgttcttggactgcaggctccaaggaagaacctgaacgccgctatctacgcgaactccctggtcgggatgggagtagcgtcgagcctgtaccattcttccagaggaggaatccggaggctcctgcgttgggccgactacactatgattgccaccacaactctgtgtttgtcgagagcagtaggcaacgagaacccaagattgctcatggccgcttcagcgttgctcctgccgtttcagccactggtggtttcggctgtccacactggactcatggaggtttcatttgcgagaagagcgtcgatggaaccggagctcaggatggcgcataacctgcacaaggtgtcgtctctgctgggaggtgcgctgttcatcgccgacgactgcttcccggagactccctatatccacgccgcgtggcatcttgctgctgccgtcggcgttggcacgtgcaacaagcttcttgaatgacacaacagcccggcctccactcagtcatgctgatatatcgatgagcagtccatttcagcacctatcacgacctacgtagaatgcacacagtatagcagcttgtcgacatttataacataaaacaccataggtctggcttatttgatagcctaggctggcttgtgtttttatttctgctaggattcgtgtaggttttccatcgttgttgtgacagtgaggtgacatgcagcaacaagagttgtatgatttaatc

SEQ ID NO: 16142 - DNA, 1437 bp, Zea mays
atccattgcgtgttccaaatcccccggccgtgcgtagaacacagcatctccggtagcgtcaccgtaggcctcgcaagtaaactgacctgccttctccgctttcccctccgtctccgtcgggagtcgagacaaagggagccagagttagtcccggcgccgtgtcgcgagcggaaggagaaggactgaaggaggcgacgatgcaggtgaagcagaaggtctacgagttctacaaaggcacggtggagcgggtcacggccccgcgcaccgtctccgcgttcctcgagaagggcgtcctctccgtccccgagttcattctcgccggcgacaacctcgtcgccaagtgccccacctggtcctgggaagcgggcgatccaagcaagaggaagccgtatctccccgccaataagcagttcctcgtcacccgtaatgtgccctgtttaagacgtgccatctcggttgaggaagagtatgatgcagcaggagcagaggtggttctcgatgaggatggcgaaggctggcttgcaacacatggagtgcaagcatcaaagacagaagaggaggaagacattccctctatggacaccttggacatagggagatctgatggaataaagtctatcccctcttactttagcggtggcaaggatgaagaggaggaagatatacctgacatggatacttatgaagacacaggggataatttggctgctgctgaaccatcatactttatcgcagaagaaccagaagatgacaacattcttcataccagaacatatgatgttagcataacgtatgacaagtactaccaaactccacgtgtctggctaactggatatgacgagtcaagaatgccattaatgcctgaacttgtgtttgaagacatcagccaagaccacgcacgaaaaacggtgactattgaggaccatcctcacttattggctgggaagcatgcatcagtgcacccatgcaaacatgcagctgtgatgaaaaagatcatcgacgttccaatgtcggggggagtggaaccagaagttgacaagtaccttttcatatttttgaaattcatagcgacagtcataccgactattgagtacgattatacaatggacgtcgaccttggcagtacaagctgattattggttggcttgaagcttgtcacttgtctcgggaaaaggaagcaccctaccagaaggcgcaggaagaaggctgaattgcgtgtttgtggttgaacatttgtgcatatgtgcttgttccttggatcggtttgcatttgtgaacaaactctgaaaagctcaaaggcaagacccatcttgtacattctgtgacgctgtcagcttgtgaatccattcgttaatataaatctcaacaacccgttcggcgtgcgtgggaaaaactcgtgcaaaaaaaaaaaaaaaaaaaaaaaaaaaaacccaaacc

SEQ ID NO: 16143 - DNA, 2207 bp, Zea mays
gaccctcgaggctggccgggttaatggaattgtccagtctcagcagaatttcatggaacttactggtcatccttcagcaatttcacatgattcatcatccaacgaagctactaacattggcacttcactgacagaacagcgctcttttggtcctttgaaagatatgagaaatgagatgttgatgcatttgatggatggagcacacagcagtggcagtgacctcatccacaatgatgaccatagcactgcacagctcgagtttggcatgttaaacaaccacaattcaacaagtcttccatcagcatcaggccaagggctgtctctgagcctcaatacacatatcttggcaccttcctatccatactggtctgcaaagcaggacttattaacaccaaattcttgccagggtgatgacaacagaatgaagaatatgcagtctgaggcttcacaggcaatccgaaactctaagtatctgaaggcagcacaggagttgcttgatgagattgtcagtgtttggaagagtgttaaacagaaaacagataaaggcccttctgaagcaggaaagtcagatggaaaagagactgatggggggactaaaagtgagggagtatcttttgatccacaagagtctggtgccaatacagcagctgagctttcaactgctgagaaacaagagctccagaataagatggcgaaacttatgacaatgttggatgaggtggatcggaagtacaaacactattatcatcggatgcaacttgtaatgtcatcgtttgatatggttgctggttctggagctgccaagccttatactgcagttgccctccagacaatctcacggcatttccgatgtctaaaggatgctatcaatgatcaaattagtgttatcaggaagaaacttggagaggatgacgatgcatctggcaaagagggcaaactaattcgccttcgttatatcgatcagcaaataaggcaacagcgagctttccaacagtatggtatgctacagcaaaatgcttggaggccacagagggggctacctgaaaattcagtctcgattctccgggcttggctttttgaacacttccttcacccgtatccaaaagactctgaaaagctaatgttatcgagacaaactgggttaacaagaagtcagatttcaaattggttcatcaatgcccgtgtccggctgtggaagccaatgatcgaagacatgtacaaagaagagatagccgagccgggccggggctagactccaactcttcctctgacaatgtgcagcggaacaaggacaagccgccatcttccgaagaaaaggaggaccataagacctcaacgagccaggtttgccaaaccaggcagcttggcgaatccaaagccaacattggtggattgatgagctttagtggagcgccagcctgcggcttccacaacgatgtcaaccccgatgacagcttcatgagcctgatgctgaaggcccagagaccgggcgaaaccgatggcagcggtctcctccatgatgccgtcgctcatcactccgatgagagcgcgcggttcatggcgtaccacctgacagagtttgggaggtatgggaacaacgtctcactgactctggggttgcagcacgccgagaacacccagccgggcttccccggcgtcagagaccaagacatctacaactccacagctcctctcaacgtcacctccacatcttcagagtatgattcggcgagccaaatagatcaacaacaacggcagcggtttgaggtgtcacctctgatgcatgatttcgtggcctgaatttcagctgacgcactggaaaacgtggggaagtgacttgtcatttgtagtgccaggacgaacaatatgcctggactgaattttcaggcgtggaaatgtagctgtagttgtaattggggtacagaatggacgaggtatatagcataaatgttatgtaaatttagtgggggcaggggtgatagtggtaaagaaatcctgtaaagatggaatacattttatacgtgtaaaatacgagtatttaagggccacgctgtaaaaatagatttacatgtaactgtaacgagtgtttgtaatgagtgtaaagaactgccacatgccatattttcgatgggtgagaagatatagaaatattattttctttgttacaaaaaaaaaagcaagaacggcccctagggccatgaaaaatg

SEQ ID NO: 16144 - DNA, 1667 bp, Zea mays
aggtacgggttcgcagttccggcccacgcccacgcgttcgaacagcaaacagataattgccctgctgaagcctgcaacgcgtctcggaaaagagactgatggggggattaaaagtgagggggtatcttccaatccgcaagagtctggtgccaatgcagcagctgagctttcaactgctgagaaacaagagctccagaataagatggcaaaacttatgactatgttggacgaggtggataggaagtacaaacactattatcatcagatgcaacttgtaatgtcatcgtttaatatggttgctggtgctggagctgccaagccttatactgcagtcgcccgcctcgcccgcgcacggcatttccgatgtctaaaggatgctatcaatgatcaaattagtgttatccggaagaaacttggagaggatgacaatacatccggcaaagagggcaaactaacccgccttcgttatattgatcagcaaataaggcaacagcgagctttccaacagtatggtatgctacagcaaaacgcttggaggccacagagaggactacctgaaaattcagtctcgattctccgggcttggctttttgaacacttccttcacccgtatccaaaagattctgaaaagctaatgttatcgagacaaactgggttgacaagaagtcagatttcaaactggttcatcaatgcccgtgtccggctgtggaagccaatgatcgaagacatgtacaaagaagagattggtgaggcggagctagactccaactcttcctccgacaacgggcagcgaaacaaggacaaagcaccatctcccgaagaaaatgaggacctgcagaccccaacaagccaggcttgccaaaccagccagctcggccagtctaaagccatcgttggtggagtgatgggctttagtggagtgctagccggcggcttccacaccgaggccaaccccgacgacagcttcatgagcctgatgctaaaggcccagagacctggtgaaaccgaaggcaccggtctcctccacgatgccgtcgctcaccactcggacgacggcgcccggttcatggcctaccacctggcagagttcgggaggtacgggaacagcagcaacgtctcactgacgctgggcttgcagcacgccgagaacagcctcgcagtcccaccaaacactcagccaggcttccccggcgtcagagaccaagacatgtacaacgccacagctcctcctctcaacgtcgcctccacgtcttcagagtatgattcggcgagccaaattgatcaacaacagcaacggcagcggttcgagccgtcacctctgatgcatgatttcgtggcctgaatttcagctcgcccactggaaaacgtgggggaaaattactgccaatttgtagtgtgtgccaggacgaataacttgcctggactgaattttcaggcgtgggacagtagctgtagttaacgattggggattggggggtacagtacaggaggtatatagcgtaaatgtgatgtaaatttagtgggggtgatagcggtaaagaaatcctgtaaagatggaatgcatttatacgtgtatttaagggccatgctgtaaaaatagatttacctgtaatgagtacttatgatccaggtaatatatatactgtgcacgctgttgaaaaaaaaca

SEQ ID NO: 16145 - DNA, 6384 bp, Zea mays
  misc_feature (3648)..(3648): n is a, c, g, or t
  misc_feature (3872)..(3872): n is a, c, g, or t
gtttggaagtgtgtaaacagaaaacagataaaggccctgctgaagcaggaaaggctgatggaaaagagactgatggggggattaaaagtgagggggtatcttccaatccgcaagagtctggtgccaatgcagcagctgagctttcaactgctgagaaacaagagctccagaataagatggcaaaacttatgactatgttggacgaggtgtgtgtgtctaccgcacttgtaccttatcattttaacaaaacttacagtattatatgtttgttttgctcgatttgttgctatcgagtgttgaggtaatccgtgtgaagatctgtaggcttttttccccaaagattagcttcacctataatccatttgatattctaatatgaattttaataaactaatacttcatcttgggacggctgcatattacctttttctcatttatcagaagtctactccattttctgccttctgttctttgaaaaatacttaaggaatcccaaccccatcagttctgtttgaattgtggcctaattactgaatccaatagttggttcctgatccaaaggttctttacaatggttcagctccatgagcttcacaagttgagttcttgaaaaaactgggaggactagtcaaaggttattgagtactcaaggttattagtttaggtggttctagccttcttaataatgcctaggcgtcaacaattatagctatttaacaaggcttgaacctatagtagcatgtttttagctgaagatcctccaaacaagcaatgagcatatttggaaaaggaaccacaaaactgttattcaggacaaggtcaccaccaaatgcaggtcacgttatccatatttgtcagatgggtgcataaatatatttttcccttagaaagacaaaattggtcttaacatgggactgatcagatgaatgagctaggtgtgttttgattgtttcactaatgcaccatctggtatgtctgaatctttaagaccaaattgaaatttgctttcaggtggataggaagtacaaacactattatcatcagatgcaacttgtaatgtcatcgtttaatatggttgctggtgctggagctgccaagccttatactgcagttgccctccagacaatctcacggcatttccgatgtctaaaggatgctatcaatgatcaaattagtgttatccggaagaaacttggagaggatgacaatacatccggcaaagagggcaaactaacccgccttcgttatattgatcagcaaataaggcaacagcgagctttccaacagtatggtatgctacagcaaaacgcttggaggccacagagaggactacctgaaaattcagtctcgattctccgggcttggctttttgaacacttccttcacccgtaagtttttccgcttaacttagagatatgttcactcacccccttttctatttgttctcatgccacgctgacactcttaggtatccaaaagattctgaaaagctaatgttatcgagacaaactgggttgacaagaagtcaggtattttttatttgcttaagatatgttttctcttatcaaatttgcaaatcattggaatgccttagtattattaaaagtgatgggtacgttaaaaggaataattttagtagttttttttgtagaaagaactaatataggttgtttcagctgtatattattgtgctgcaaacatattgtaagtgctgtagggttgctgcttgtctgcatgtatatatgtacgaatctcatcctgtctttacatcttaagtcttttcccatcgacaaaaactttaaaacaaactctgcagttgctcttttccagaacaaggtacaccaattctgttggtatttggatttggaggattacctgtgatctgatgacttgctgtcatattagtagtttgtattccgtatcaaataatggaaaccatatttactgaaactcacatgcgtccttctattctagatttcaaactggttcatcaatgcccgtgtccggctgtggaagccaatgatcgaagacatgtacaaagaagagattggtgaggcggagctagactccaactcttcctccgacaacgggcagcgaaacaaggacaaagcaccatctcccgaagaaaatgaggacctgcagaccccaacaagccaggcttgccaaaccagccagctcggcgagtccaaagccatcgttggtggagtgatgggctttagtggagtgctagccggcggcttccacaccgaggccaaccccgacgacagcttcatgagcctgatgctgaaggcccagagacctggtgaaaccgaaggcaccggtctcctccacgatgccgtcgctcaccactcggacgacggcgcccggttcatggcctaccacctggcagagttcgggaggtacgggaacagcagcaacgtctcactgacgctgggcttgcagcacgccgagaacagcctcgcagtcccaccaaacactcagccaggcttccccggcgtcagagaccaagacatgtacaacgccacggctcctcctctcaacgtcgcctccacatcttcagagtatgattcggcgagccaaattgatcagcaacagcaacggcagcggttcgagccgtcacctctgatgcatgatttcgtggcctgaatttcagctcgcccactggaaaacgtgggggaaaactactgccaatttgtagtgtgtgccaggacgaataacttgcctggactgaattttcaggcgtgggactgttagctgtagttaacgattggggatttggggggtacagtacaggaggtatatagcgtaaatgtgatgtaaatttagtgggggtgatagcggtaaagaaatcctgtaaagatggaatgcatttatacgtgtatttaagggccatgctgtaaaaatagatttacctgtaatgagtacttatgatccaggtatatatatactgtgcacgttgttgaaaccaaaaaaaaaaaaagaagaggggggtgggggtaaactgaaatggattgcaggagaatcttcagccttcgattgcatgtgcacgcttcaggctttatgtcactggtgctggggtgaggaccagctgatgccctacctttagtatcgactggcgatatgagttaaagcatgctgatcgtttttgaaatgcgaagctgtatttatgctgctggactgaaactctcgtgttctcactgaaagtctgaaaccaatacgttactcttatactagtagagtatgttttcttgaaacttttgcgtctgtcaggcaagtcattttcacgacaaattttgacttggtaccccgagtcggtggaggataaggttccctctattcccaggaaaatacaactatgagttacgtggtaatttaaaatggtgtacgtttgatgaaatctacagccgatggtactcattttttttgaagcaattactgtagggcggctctacagtattttttatttattaaagatgatatgtacagagtctcaaatagaggcattgggaaaggattacaaaaaatatctgctgaagccatgctctaatatcccttactatttggggcttcactctataacgaattaaaagcatttctttgacacaaatgtctttgcacgttgaagttgttggcggtatatttttaaanacccatccatctctattcttccgtatggtattcatatttatgttcttcaaccaatttatcgtaaaaatatatttcgtaattactccaatcgtatcaattttggtaccatgaatatgaatattttcttatctatattttgtcaaacataagatagtacaccatgatattgtgctagaattgcattcgggatgagagtgtgaaagtagtagtattttgtatttgcntgagtaaatgtgggtctgttgctgtcagatcagcatcggccatcgcgcaaaatcggacctatgacgattcattgatcagtggtcaggtctttacatttctcgagtgaagttcaaaactgggcttggtgttcctttttccttctgtctgcaagggaaactgaactaagctcgcatctagattttggagccagttaaacgggcatataatagttttagctgcaaatttgccagcctgtttctgtttcatcatcttccgaaaccagaaggaagttccttagcttattttattgggaataataagtgtctgatactagtacgtaccatacagcagatagatagatattcaggttccttcaaatgagaagtgcgagagcgagtggcgtggtcaaacgtgggggctcaatcaaaccgaaaccgaatccagcagcagaatgcatgcagcgggttggttcgtggctgtagagatggatggatggaggatcactcatccatcacctgatcgaagcagaaccgctccccaaaaacaaacagcagcagcgtcgctgccttccccttctgttaggacatgtccaatcggcatcagtcgcgcaatggcacctcccaaaactgtagtatccaccttgactggactggaactcctttccaccactgttcagttgctctctctgtccagatcggtccacgtcgatgtgttcatgcatccacccatcacatccgtgtgtccaccgaccatccactgcgataccgagcatctctcacgcgcgcgcgtgttggtgagcagtccatcgtacatgacccaatgcttcattcgaaatttcgaatgagatcgatttcacataaaaaaatacatgattctctctctctctctacttaattggcttgtttgtttgggacgtaggaatacaaaacaaagggggagaaaacaggaatagaaaatatcggaaattagaaaactacaggattcgaaaaggcttcaacacttgagaaaaaagttatacgaatgaagttcagtcaaacttcaaaaaaaaaaatcgatcagtgtatataaaccctaaagtaacctttttttttacagcgagagtgaagctacgtactgatactgtacagcagtgtgcagcaggtttgggcagggtgtaattgaagccgccgagccatgtgttattgtttggatgggagtgcagccccaaccaactcgcgcagcaagagtagacagtagtagtagattgccagaaaaaggctctgggctttccgtgggtcaggataggcaacgagctagtacgcgcaacacggcgtgcggcagccgctctgaactgctgtgcctgtgctggccctcccctgagactgacagccctggccgcctggcctttcttgagattctacacaccgagctcaggctgaggcagccagctacagctagcgcctagcggtactggtgcactagcatgcatgccttcccaggcgcgccaggccgcagcccgccggccggccggccggcacgcatacacattttgcatagagataggagcagtagtagaaagcagttaagaccatctccaaaccattcactcacatttttctccctatctttatttactatattttactacatcatcataaaatatactttctcacatttttttgggatattttcaaccaatcatcctatccagctccctctatatactataatgtagttatttaacaatttttcatcagtttttgaagtttaaaaaaattacatactatttatactaccataatatacattggtatcaagttaccgtacttaaaaagaattaatataataaaaatggagtaattaatatgtgggagaaggttagaggtctcccatatatgggggcaacctccctccccatgtaggccttattcagttataattggatcgagtaggatttaaaggaattaaattctcttctagtcaaaattaaatagaatgagaacttcatttaactcccttgtaaccgaataagcccatatagggcacagtgggggaaacccttggagagtcctctcccctatagtacaccagaaccggatatggggtggggggaggtatggggagctcttggaggtggtctaacatcgaacatctattgatccatgagtcatttttaaaaaaaatatacttaactaaacaaatggaaaatgatattaatttttacaacttcaaataaatttattataaaaatatatttcaaataagtttgcattgctgatgaccgagatgttttatactccctccgttctaatttataattcaatgattttttcaccacaagtttgaccaactcatcttattaaaaaaaatcataattattgttagtttttgctgtgatatcgtctactatacaatatacttgaagtatgactttgatttttttattttgtcgcaaaaaaattgaataatataagccagtcaaacttaacgaattgtacattgggaagaaggatccgaggagtacatgtttaggtacggaccaagcttgcagtg

SEQ ID NO: 16146 - DNA, 946 bp, Zea mays
ggcatttccgatgtctaaaggaccccgtcgccggccgggttagtgttatcaggaagaaacttggagaggatgacgatgcatctggcaaagagggcaaactaattcgccttcgttatatcgatcagcaaataaggcaacagcgagctttccaacagtatggtatgctacagcaaaatgcttggaggccacagagggggctacctgaaaattcagtctcgattctccgggcttggctttttgaacacttccttcacccgtatccaaaagactctgaaaagctaatgttatcgagacaaactgggttaacaagaagtcagatttcaaattggttcatcaatgcccgtgtccggctgtggaagccaatgatcgaagacatgtacaaagaagagataggtgaggcagagctagactccaactcttcctctgacaatgtgcagcggaacaaggacaagccgccatcttccgaagaaaaggaggaccataagacctcaacgagccaggtttgccaaaccagccagcttggcgaatccaaagccaacattggtggattgatgagctttagtggagcgccagccggcggcttccacaacgatgtcaaccccgatgacagcttcatgagcctgatgctgaaggcccagagaccgggcgaaaccgatggcagcggtctcctccatgatgccgtcgctcatcactccgatgagagcgcgcggttcatggcgtaccacctgacagagtttgggaggtatgggaacaacaacgtctcactgactctggggttgcagcacgccgagaacacccagccaggctttcccgggcgtcagagaccaagacatctacaactccacagctcctctcaacgtcacctccacatcttcagagtatgattcggcgagccaaatagatcaacaacaacggcagcggtttgaggtgtcacctctgatgcatg

SEQ ID NO: 16147 - DNA, 2942 bp, Zea mays
  misc_feature (2894)..(2894): n is a, c, g, or t
cgactacttttatattgggtgctggtgtttgttgcagctagtgggtggtggtgcaggaattttttattccgggggcaggaagaaggaggacgaggaggaggaacaagcgagagatagagagagcgctctcctatcttcttttgcttttggtattgttatcttgggatctgattttgtccccatacataccgagcgggagggaagggggcttgggttttctttctcctctcttctcttcttctcccctctcaccctcttctcctcccaaggctgactggccgtcggctcgggtctggggacagcaatccctgccgtcttgccatgctccccacgaggagcacaccgtcagagtgattctgcagaagtattcattctactggcgtgctgagcaggtgcaggagctctaataagcctagtgcgcacttcagtcatcagccaagtgattgaaaagggcaagtcagctgaaatattggttccgagggctctgtagttgcttatccacgctcgcctatgcctttgcgctgatcttgacaactcaaagcttggatatggctacttattactcgagccctggcagtgaaagagattcacaaacaatgtactcagcagagtcaggcaatgtatcatatcccgtgccatcagccctagggaactttctttatacgaacaatgcatcttctggaccttatacagaatttagtggaattgtccagcctcagcagaatttcatggaacttactggccatccttcagcaatgtcacatgattcgtcatccaatgaagctaccaacatgggcagttcactcactgaacagcgctcttttggtcctttgaaagatatgagaaatgagatgttgatgcatttgatggatggagcacacagcagtggcagtgatctcatccacaatgatgctcatagcactgtacagctcgaatttggcatgttaaacaaccacaactcaacaagtgttccattagcaccaggccaagggctgtctctgagcctcaatacacatatcttggcgccttcctatccacactggtctgcaaagcaagacttactaacaccaaattcttaccagggtgatgacaacagaatgaagaatatgcagtctgaggcctcacaggcaatccggaactctaagtatctgaaggcagcacaggagttacttgatgagattgtcagtgtttggaagtgtgttaaacagaaaacagataaaggccctgctgaagcaggaaaggctgatggaaaagagactgatggggggattaaaagtgagggggtatcttccaatccgcaagagtctggtgccaatgcagcagctgagctttcaactgctgagaaacaagagctccagaataagatggcaaaacttatgactatgttggacgaggtggataggaagtacaaacactattatcatcagatgcaacttgtaatgtcatcgtttaatatggttgctggtgctggagctgccaagccttatactgcagttgccctccagacaatctcacggcatttccgatgtctaaaggatgctatcaatgatcaaattagtgttatccggaagaaacttggagaggatgacaatacatccggcaaagagggcaaactaacccgccttcgttatattgatcagcaaataaggcaacagcgagctttccaacagtatggtatgctacagcaaaacgcttggaggccacagagaggactacctgaaaattcagtctcgattctccgggcttggctttttgaacacttccttcacccgtatccaaaagattctgaaaagctaatgttatcgagacaaactgggttgacaagaagtcagatttcaaactggttcatcaatgcccgtgtccggctgtggaagccaatgatcgaagacatgtacaaagaagagattggtgaggcggagctagactccaactcttcctccgacaacgggcagcgaaacaaggacaaagcaccatctcccgaagaaaatgaggacctgcagaccccaacaagccaggcttgccaaaccagccagctcggcgagtccaaagccatcgttggtggagtgatgggctttagtggagtgctagccggcggcttccacaccgaggccaaccccgacgacagcttcatgagcctgatgctgaaggcccagagacctggtgaaaccgaaggcaccggtctcctccacgatgccgtcgctcaccactccgacgacgagcgcccggttcatggcgtaccacctgacagagtttgggaggtatgggaacaacaacgtctcactgactctggggttgcagcacgccgagaacacccagccgggcttccccggcgtcagagaccaagacatctacaactccacagctcctctcaacgtcacctccacatcttcagagtatgattcggcgagccaaatagatcaacaacaacggcagcggtttgaggtgtcacctctgatgcatgatttcgtggcctgaatttcagctgacgcactggaaaacgtggggaagtgacttgtcatttgtagtgccaggacgaacaatatgcctggactgaattttcaggcgtggaaatgtagctgtagttgtaattggggtacagaatggacgaggtatatagcataaatgttatgtaaatttagtgggggcaggggtgatagtggtaaagaaatcctgtaaagatggaatacattttatacgtgtaaaatacgagtatttaagggccacgctgtaaaaatagatttacatgtaactgtaacgagtgtttgtaatgagtgtaaagaactgccacatgccatattttcgatgggtgagaagatatagaaatattattttctttgttaaaaaaaaaaaaaaaaaaaaaaaacaaaaaaccatgaaaaatgaaaaaaaaaaanaaaaaaaaaaaatatagagtgttgaaaatttgaattaattttggtgcg

SEQ ID NO: 16148 - DNA, 1625 bp, Zea mays
ggtaccctccggcccgggcggcccgccggcagtctggatggttcgcggacctccactccacgacccgaacgttcgggagaaggcaaattccagacaccacacaggacacagcgcattcggctaatttcctcgtctctccccaatccgaccacccccatccattcaccaacccgaaatagaaggccgtccccagccaccagcctccggagttcctccggcgatccccgtccccttgtgtgcgcgctccaggagggccttctgcctccagcttgcagagcccacctaattgctgcgagatggatagagggcagaacgggagggatgacgtcttcggacgcagggatccattttctgggtttggcttcggcccccacaggagcttgttttctggtctccttggggggagggatccatttgacgatccgttctttacccatccgttcgggggtcggatgatgggtgaccatgacatgtttgtacctagtccttttgggccgatgggagggccttttggggacatgaggaacggtgggtttatcgagcaagctcctcctaggggtaacagaagaaggcctgtgatcacagaggtcgaggaggatggtggagagaacgcagagcatggtaaccagcagcctaaccaagatccttatgttcaggagccagacgatgggattgatgagacagaaggtggccaagtcgagctgcacagggatctcagtagggctaatagtggagggcagccgcaggctcgtactttcacatatcagagctcttccgtgacgtttggtggtattaatggagcttactacaccacttcaaagtctcggcggactggtagtgacgggatcactgtggaagaaagcaaggaagctgatacaacaactaaagaggctactcatagaatctcccgtggaatccatgacaagggacattccctgacaaggaaactgaattcggatgggaaggttgacaccacacagacactgcacaacctgaatgaagatgaactagctggatttgagcaatcatggaaggggaatgctggacattacttgcctgactggaaccacaatgctggtgcacctaatagcgataattctggtgaccgtagctccaatggacgtgaccggcgatcggcctcaggctgggcgcttcctgggaccgagcaaggccgtgatccgaggcgcaacgggaagccaaaatcacgggtcatccctatctcctgaagagcatggacggagtagatatatagagtagataaataaacagctggtttgtactactatgcaaggtttaggttcaagatcgtttcaaggaaacgacctgaggtccaggtaaccggagtccgcccagcacatcgcgtgctattgtctgattctgtagctgtacagtgctctgctaccttattatccgtgatgtgaaacaatttgtgtcgtccagtcttgctgtaaaatcatcgcgtatactgtaaacctgagtctgtatgtctgagttggctttgctgtgttgttgctagttgtttgggtcgctgaaggatctgcttctgtgtttgcgtaaaaaaaaaaaaaaaaaagcatctcgtccgatctgcttctgtgtttgcgtaaaaaaaaggatgctctgcc

SEQ ID NO: 16149 - DNA, 4814 bp, Zea mays
ttcctgtacagtttattggagctataatgggtgcaagggatctgaatattcaaacggaaaacggccacattggcatgccaactaatatctgctgtgtcgttgtggagtaccttcctggtggtgcactaaaatcatttctgataaagaacaggagaaagaagctagcttttaaggtcgttgttcaaatcgctcttgacctcgccagggggttagtattttactggatcatcctcggtctccctaaatctttatcgtaccgtttcttgttggataattattgtctgcattgactcttcaatcttcgttagattaagctatctccattccaagaagattgtgcaccgtgatgtgaagactgaaaatatgcttcttgacaaaacgagaaccgtgaagatcgctgattttggtgttgctcgccttgaagcttcaaatcccagtgacatgacgggcgaaactggaacgcttggttacatggcacctgaggtaccttttcctgggcagtgacagacactcaacccctcctccactcctagctgctcttttatctcgtggtgtcatcacttttagctagctctggcacaataatagtaataaaaagacatccttgcatgaagcacttgtattagtctatgttatgtgccttgcaggttctcaatggaaatccctacaacaggaaatgcgatgtttacagcttcgggatctgtttgtgggagatatactgctgtgatatgccatatcctgacttgagcttctctgaggtcacgtctgcggttgtccgtcaggtaaagatctgattttccgccttgcatgcttgccgcttgcaagttgcaactctctagccgctgagttctgagcaagtggggatggtactacaatactacctggtttacagaacctgaggccggagataccacgctgctgcccgagctctctatcgaacgtgatgaagcgctgctgggacgccaaccccgacaagcgacctgagatggccgaggcggtgtccatgctggaggcgatcgacacgtcgaagggtggaggcatgatccctgtggaccagcggccaggatgccttgcgtgcttccggcagtacagaggtccatgacagataggtggaaacctgttggagctgcggcctctagatctcgtggatgccgatcgatcgcgtgttgttttctggggaagcaaactggttaatggagctagcccgccttaccggctcgtgtaaatcctctgtccatcaattctgtaactctgttttatcgattaatgaaaagaaccgggcttgctcgactgattcctggccgatgcaaatgttgttttttttggaagagaatcgaacttgaaatgaaaacgagatgggtgccgtaccatctggtgcgaattattggagattactacatgtgattctgagtgcagagaaacggaacatgataaggcgaaattcgaaggaatcaatcatatataaatcatatatagtttctttttgtttaggaaaaacgtaggaaccggggcctagagcatctccaagagactagctaaataactcgctaagccaaattttggctactcaatagcaaaataactctttaacagattagctatctgactcgccaagctatccgattttttaaattgagtctctcactagttaaatttggctagccacatgactatctaaaataggtacatagtctgttgttgcagtgagatgctacatatagagtaatctttataaaaagttaaatagatagttaaatatagagctaaaaatgaagagttttttggagatgtttttttattcggccactcgtcaattcgtcatatacaccacacccgccaatcggttgacttaaataaaatatggacaaatcttgaaaccgtccaccggggacccccttctgtttccctctagggctccagggctccaggctccatcgacaattccacatccacggatccacccatgcactgcacgcacgcacgcaccgaccgggtcgtggactcgtggatcagtcgcggcgcaggtctccgagtccgctctccagccaaaaaactaaccaaacgtccaaacccctcgcgacgggtcgtggatcagtcgcggactcgcggcgcaggtctccgagatgtctatccagcgttccagcccccctccagcctctataaataaaacccgtctcctctcgactccttcatcacctcaccctaccccgtcccgtccggattgaggatctgacgtgacgcgcgcgagcacgaagcctcggccccaacccgactaaaacctagccgggcttccctttcgctaggtttgcgccaccgccgatccggccgacctctccccgcccgccggcggcgatgtacaacagcatcgggctgcagaccgcgcgggggtcgggcaccaacgggtacgtccagaccaacaagttcttcatcaagccccgttccacatccggcggggggccgggcgggccccacagaccgccgctccccgacgccgccggcgcggatggcggcgggatgcgcaagcccaacaaggagatcctcgagcacgaccgcaagcgccaggtcgagctcaagctgctcgtgctcagggacgcgctcgaggagcagggctacaccgaggacgagatcgaggagcgcgtcgaggaggcgcgcaaggtcgcggaggcagagacggcagcggaggaggcagggagcgtttgcggcgccgggcgaccgcctctacccggcagatggtatgatcggttggcgtcttagcttataggtcattcagtataccttcttctgttagacggcatattcatgcagatgatagacgctgaccacactacttccatgtagccttcttttagttggatgcctccatttagtctctgagattattttccatttgaaaataaaaaaaattgttgtttctgataaacatttagtctcttgagttttttttatctacattctgattataagttgccataattttcttaggtttacagacacacagagccaccatgttgcagcacggaaggagaagcagcttgagactctaagggctgctttagggctgaacgctgatgatgcaaataaagggaatgcagaaagtgatggggagcttattcctgttaagtattacgaggaactagatactattgggcaaaaggatagcaaggattcaaaggatgtcaaaaagagccagaagaaaaaagagaatgacaaaaggagccaacccagaagttcgagaaagagcaagtatgactcaggtcacgatcatataacacaaaaacgaagaagagttcccacccaccatgattccgaagatggtttagagactgattataatgggaaggaaaagaaacacgacaagaaacgtcatcttggttcagttgataattctgaaaatgattggaagaaggcagagcgtggaaagaactcttatcacgatatagattacaacagtagcctcgacagttagggttatgtgtggctttgctatgtaatggggtgtcttctgtgtaatgggtttagactccacaattctattatataaatatatctcgaaaccttggttatggttctagcaatttttaactgagtaatcaagtatgtcgcaaaggttaaaacatcaataaagtataattaaacaggctgcaagcatcacatacatagagttagcaaataccagttacagaactcatcaatgttatttatcacaatgtcatttgtcatagctataatttagcgcattggacacaaatttttcctccaattccagcatgggctattcaagcctagctggttagcgcaacaacgaaaaaaaatacaattcactaatatagccatcttattaattcaattttttctgaaacacgtgggagaaccatgcattattatattaaaaaaagacaaaaaaaggtttagaaaagatcaaaaacaaagtgcccagaaagcacctgagaaagaaaaaaagaaaaatgaggatacacacccaaaactaaaaacaaaataccaaactactattaaacactcctaagagcagaagccccagcaaggccccaaaacatggccacatcgatggtctgccagattgtattgatgtttggggaagcatcatcaaacacacaaacatttctatgcttccaaatttaccaggctactaaactcacaatggagttaaaacattttttctttggcttagacacattcctttctgcatctccccaccattcctggaacaccgttgtatcagccgtggggtaagatgctgcagcccaaacttgcttagagttctaaaacacacatccctcgcaaagacacatgtcaccggattgtgttgcactatatcgtcctgctggtcacaaaatgtgacatcttttcgggtgatccattccttgacgagctagccgatcagctgtccaccatcggttgagagacgccagccaagtgaagtatttacaacgaggaggagcccaagtcttccatattcttttagccggctcaaaaggtgttgcacgaacatggaagagcctataagcatatttggcctaatacaacccgaggaagaaggtaatcttattaattcattaatgttccaaatactctattttttgttgttgtcttcaatggagcaccacagagcagtgtcgtagttcccgctatgtcgtgggcccatagatacgctcctcactgcagcaaggatgtgtgcctctgtcatgattagaaaaacatttagcgtgcatcatatcttctacgattttgcctagaaacatctagtaacaatctaatcatcccaaacatctccctcagatcttagtaaatcaaat

SEQ ID NO: 16150 - DNA, 1739 bp, Zea mays
atttttgcctatttggtacccagacccacgcggcggcacccgccaccgatcgagccgctccggcgagcgcagcgcagcccacggcatttgccgatttgtgaaggagcgtgaaaaagcccttcccacgctgggccccgcctccgcgacgcgagcccacacgtccgtttccggtgccttggccagacaggcagcccatgtgctgagctcacatgcctgccgctcccacacctcgccaccctcctgcctcctccgcatccgcgccccctcgcttagcctaaaccgcggggcagctagtctcgccaccgcaggccgcaccggtcatcacaccggagcgcacgcggggagcccccgtagagttccggggcgaccaggccaactaacgccatgaaggaggaaggcggcggcggggacgcggggttcgtgcgggcggaccagatcgacctcaagagcctggacgagcagctggagcgccatctcacccgcgcctggaccatggagaagcgcaaggaggaggcctccgccggcgctggcgccggcgccaggcagcaccagcagtcccggcgcccgcggagggaggactgggagatcgaccccgccaagcttgtcgtcaagggcgtcatcgcccgcggcacctttggcaccgtccaccgcggcatctacgacgctcacgacgtcgcagtgaaactacttgattggggagaggatgggcatagatcagaacaagacattgcagcactaagagcagctttttcacaagaggtctctgtttggcataagcttgaccatccaaatgtaaccaagtttattggagctataatgggtgcaagggatctgaatattcaaacggaaaacggccacattggcatgccaactaatatctgctgtgtcgttgtggagtaccttcctggtggtgcactaaaatcatttctgataaagaacaggagaaagaagctagcttttaaggtcgttgttcaaatcgctcttgaccttgccaggggattaagctatctccattccaagaagattgtgcaccgtgatgtgaagactgaaaatatgcttcttgacaaaacgagaaccgtgaagatcgctgattttggtgttgctcgccttgaagcttcaaatcccagtgacatgacgggcgaaactggaacgcttggttacatggcacctgaggttctcaatggaaatccctacaacaggaaatgcgatgtttacagcttcgggatctgtttgtgggagatatactgctgtgatatgccatatcctgacttgagcttttctgaggtcacgtctgcggttgtccgtcagaacctgaggccggagataccacgctgctgcccgagctctctatcgaacgtgatgaagcgctgctgggacgccaaccccgacaagcgacctgagatggccgaggcggtgtccatgctggaggcgatcgacacgtcgaagggtggaggcatgatccctgtggaccagcggccaggatgccttgcgtgcttccggcagtacagaggtccatgacagataggtggaaacctgttggagctgcggcctctagatctcgtggatgccgatcgatcgcgtgttgttttctggggaagcaaactggttaatggagctagcccgccttaccggctcgtgtaaatcctctgtccatcaattctgtaactctgttttatcgattaatgaaaagaaccgggcttgctcgactgattcctggccaaaaaaaaaaaaaaaaaaaa

SEQ ID NO: 16151 - DNA, 1388 bp, Zea mays
tcggacgcgtgggtcatttacagcttacaccaatttcagaacactctagattcagaactattccagacagcaaggatgtcgccatcatctttgagatactacggtattggactcgagaatggaaactacacagtcacacttcaatttgcagagtttgactttgaagattcacaaacttggaagagtgttgggagaagggttttcgatatctatctccagggcgagcgtaaggagaagaactttgacataaggaaggcatcaggggggaaatcttacactgctgtcgagaagcagtatattgttcctgtcactagaaactttcttgagattcatcttttctgggctggcaagggcacttgttgcattcctgctcaaggctactacgggcctgcaatctcagctttgagtgcaactccaaattttacccctacagtgcgtaattctgcacagaagaagaacagtagtaaaacaggtgtaattggtggggttgtggttggtgcagcagctttaggagtactagcacttgctggaatctgtatgttgaggcagaaaaggagaaaactattattggagcaacaagagctttacagtattgttggaagacccaatgtatttgtttatggtgagctaaggaccgctactgaaaattttagttccaataaccttcttggtgaaggaggatatgggtcagtttataagggtaaattagctgatgggagggtggtggctgtaaaacagttatctgaaacatctcatcagggaaaacagcaatttgcagccgaaatagaaactatttctcgagtgcaacaccgtaatcttgtgaagttgtatggttgctgtcttgaaggaaataaaccactgttagtttatgagtacctagagaatggaagccttgataaagcattgtttggaaacgggaaactgaacctagactggccaacacgctttgagatatgcttaggcattgcaagaggcctcgcttatctccatgaagagtctagcatccgtgttgtgcatagggacataaaggctagcaatgtcttgcttgatgcaaatctcaaccctaagatctcggatttcgggctcgccaaactttacgatgacaagaagactcatgtcagcaccaaagttgcgggtacatttggttatcttgcacccgagtacgccatgaggggtcatatgaccgagaaagttgatgtgtttgcatttggagtggtcatattggagactctagctggaaggccaaactttgacaatacgcttgatgaagacaaggtttacattttagaatgggtctggcaactgtacgaagaaaaccaccctctggacatgctcgacccgaagctcgcagaattcaacagcgacgaggtgctccgtgccatccacgt

SEQ ID NO: 16152 - DNA, 2159 bp, Zea mays
atctaacgaaagagcccccaaaaccttcccagaaaggcgacggagtcaggttcgaatcgaaatcggggtcaccgcggcggcggcggcggcggcgggtctactcatcagagactacagagcagggggtctcacgctccggcggcgggacgatggccatggcgccgtcctcctcttcctccggtggcggcggcggcgacggcgccaacgccgccgacgcgatggctctcgtgcaggggtacacggccgaggagctcgccatcgcgggggagttcctcaccacctggctccccttcctctctgccggcctctgtccctcctgcgcctcctcgctccgcggccgcgtcgactccctgatcacgcgaggccgcgcagctgaggaatcgccgccggtcgatcagattgagccgtcagggtgggactcggatccagcggacccgcagaaccttcctttcgagccgagtggttgggattcggatccgcccccccccccgccgccggcgccggcgccggcgccggtggagaaaccgaggatgtcgtgggcggacatggcgcaggaggacgagctcgccgcggcggcggaggatgacgcggcggccgcagcggtcactagtcccccccccccccccgaggcggggaggcccaaggtgccgctcacgagggagcagcgggaacagaggaggctcagtagcttggtgcgcaacaaggagttcaggtgctacgagagagttcgtggccagctcgtcaacatcctcgctggccttgagcttcatgccggcgtgttcagcgcagctgagcagcggcgaattgtccaatgtgtgtatgacctccaggcaagagggcagcgtggggagctcggagagcgcacatatacagaaccccaaaaatggatgcgtggtaaaggccgggtaacaatccaatttggatgctgttacaattacgctacggataagaaaggaaatccaccaggcattatacggaccattgtttctgatccaatgcctgacctctttaagactatgattaagagattggtacgatggcaagttctgcctgcaacttgtgtaccggacagctgcattgtaaatatatatgaacctggagattgcatcccaccacatatagatagccatgattttgttaggccattttgcactgtttctttcctcagcgaatgcaacattctttttggacccaacttgaaagttgctgcccctggagaattcatcggttcaattgcgatccctctccctgtcggatctgtgctagtcctgaatggcaatggtgctgatgtagcaaaacattgtgtcccagcagtccctaccaaaaggatatccattacattcagaaaaatggacccagcaaagcgtccatttggctttgaagatgacccggaactacttaatcttgctcctctagggacagttgtacaagaaactggcatatcatcagatgaaggcaagggcaagctacctgacgtccaaataacaaatatgggcaaagcatccagaggcaagaggtctaaaggaagaacagctgctgggaaatatgggagcggcattcttggagaacagtctcctgggcatgcccaagcccctgcagtggaagtgcagtcactacggaatccgcatggccagcgtcctgtctccgcttcaagtgctgagagggaaaggaattctgctgggaggtcaagggaatcgagacatcaatctagtacgcttgtggtgcactcacaagtggacaatagcaggcagtggccacgtcggtcggcgcaagagaggtggcatagtaatggcatgagtttctctgaagatggggtgggatccgcggaaaggagaccacgggtggagcatagacagatttcattgataaaccaaactataagcgacgacatggattccctgtcgctctcaggccgtgaatcaggcgaccagcctcgtgctagtgtgcggaccgtgtataacaagcccaggaggaccagattaagcctagatgattgagctcttgggttgctcgtgtctgcatacttcatgcgaagaccgatgacatcaaaaatgatatttactataaactgtattgtatattttcattgggtttcggtgtcatgaaagcaccaaaaagttaagcgtagaattcctacgtgtactgaatgaacttaattg

SEQ ID NO: 16153 - DNA, 964 bp, Zea mays
aacaaagcaagcaataatacaagctagcacaagtagtagttgctggctctccatccctactaggaagcagtagcaacagcagcagcagccagtagaagctgcagagacaagatagatcgaggaagaaggccacatttcgagctagcttagctatagagagcgggcgcagctagcaatggcgaagcagcagcaggaggtgtacttcgtgttcatgaactttgaccccgtgtacgagcgcctcagagctgagcggtcgtccaaggaggggtcggccacgctggacgcgtacctgagccacaagcacgacaagctgctcgccaagctgctccagcctgactcctaccggaagaggtcgtcgctcgccatcgtcgatggcttcgccgtcgagataaccgaggatcaggcaagcgttctgagatcggccaaggaggtgagggtggtggagaagaaccaggagctcgcatgatacgatgatctacttctcagtcaaacgtaacggccggccggacgggacggactagttttatctgtagatgctctggcacgcatcgatcagctggtagctatggctatatatttatacatatatattgtttattactaaggtaataaggtaaaggatcgtcgtcgtcgtcgagttgttcctagctatagctacttagctagtcaatcgagtgtttagttgtgagtgagtgtgtgaactcccatgcatgcatgcatgcatatggctttgttgactgcctagtcaaacatagctgctgctagtagtactgagtactgccctaatatgtataataatatagttcttcgctagctatagggcctaatgatcatcagaggatcgacgacttcgagacgactatattattgaactccatccatctgtaatggccgtgatttgttctcttcagtcatgcatgtggcctcagtaaccactattcacaaatcaaaaaaaaaaaaaaaa

SEQ ID NO: 16154 - DNA, 815 bp, Zea mays
aaaaaagaaccaagcgagcaataatacaagctagcaccaagtagtagttgctggctctccaacagcagcagcagcaggcagtagaagctgcagagacaagatagatcgaggaagaaggccgcatttcgagctagcttagctatagagagcgggcgcagctagcaatggcgaaccagcagcaggaggtgtacttcgtgttcatgaactttgaccccgtgtacgagcgcctcagagctgagcggtcgtccaaggaggggtcggccacgctggacgcgtacctgagccacaagcacgacaagctgctcgccaagctgctccagcctgactcctaccggaagaggtcgtcgctcgccatcgtcgatggcttcgccgtcgagataaccgaggatcaggcaagcgttctgagatcggccaaggaggtgagggtggtggagaagaaccaggagctcgcatgatacgatgatctacttctcagtcaaaccggccggccggacgggacggactagttttatctgtagatgctctggcacgcaccgatcagctggtagctatggctatatttatacatatatattgtttattactaaggtaataaggtaaaggagagtggtcgtcgtcgtcgagttgttcctagctatagcctatagctacttatatagctagtcaatcgagtgttagttgtgagtgagtgtgtgtgaactcccatgcatgcatgcatgcatgcatatggctttgttgactgcctagtcaaacttagctgctgcaagtagtactgagtactgccctaatatgtataataatatagttcttcgctg

SEQ ID NO: 16155 - DNA, 1722 bp, Zea mays
cggccgggccggctgttgccagccagccctgccgtacggtaggttcccacgcagcacagaactgcccacgcagcacaccccactgccccactcgcgtcgcacggatctctccttccctccaggctccagctccaaagcctcgtcgtcttcttcgccccgccacccgtcctgcacactcacaactagacatcgtaccacccaggttttgctttatgctggttcatttgtctacggacaatggactagttgctgcactgtttctgtgattcaccatgggaagcagtggagcagatacaccgtctaaggagcagcagccacctgctacctcaggtgctgcaataccacctgtttatccagattggtctagcttccaggcatatcccccaatcccaccacatggattcttcccctcacctgtggcatcaagtccacagggtcatcctttcatgtggggagctcaagctatgattccaccttatggaacaccgccaccatatgtcatgtacccccctggagtatatgcccacccatctatgcccccgggtgcacatccatttactccttatgccattacttctccaaatggcaatgctgatgctactggaactactgttgcagctggtaatactgatggcaagccctctgaaggcaaagataaaagtccaacaaagcgatccaaaggaagtttgggcagcttgaacatgcttactggaaagaatcccagtgaacatggtaagtcctcaggtgcatcgggtaatggagtcacttctcaaagtggcgaaagtggcagtgacagttcaagcgaagggagtgaaggaaattctcacaatgattcacatcacaaggaaagtggacaggaacacgatggggatgttcgaagttcccggaatggtgtatcacgtttgcaatctgagggaaaattgaaccaagctatggcaatcttgcccataccatcaagtggcccagcaactgatccaactacaaacctaaatattgggatggactattgggccaacacagcaagctctgctcctgcaattcatggcaaagcgacgtcaacaacagttccaggggctgtggtcccagcagagcagtggacacaggatgaacatgaactcaaaaagcaaagaagaaagcagtccaatagggagtctgcacgtagatctaggttacgtaaacaggctgaatgtgaggaattggctcaacgtgctgatgttttaaagcaggaaaatgcttcacttagagatgaagtaaaccgtatcagaaaagagtacgaggaacttctatcaaggaataactcactaaaggaaaaacttgaagggcaaacaacacaaaactgatgaggctggacttaacaacaagctgcaacattctgctgatgacagccagaaaaaaggaaactaatgctatcatgcaatgcttgcctacattggtcctaactagattattgggaggtgcaattgtagtatgcacattaactccttactttattgcagttaattgttaccaggttgtgataatgttgatgccaaccttttgtgtgggtgtttcctgtttcagatctatcttggcttatcttttagaagccaagatgtgactgaagctataggctgtgacccaattcactatatctgttagaaatagtggataaagtcaaacttacaaatttgaagtgctgactaatattgttatgtatacctggcaaaagactggttttctttc

SEQ ID NO: 16156 - DNA, 1704 bp, Zea mays
atgggtaggttccctcgcgggccacagcactccacctcactgctccagtcgcgagccgcagctgcgcgtcgcgtcgcatcgcacgcatctctcctgccctccagctccaaagcttcgtcgtctgcgtcgccccgcgccccgtcttgctcgctccaagctagacaccataccacccaggttttgttttatgcttgttcatttgtctatggacaatggactagttgctgcactgcttttgtgagtcaccatgggaagcagtggagcagatacatcgtctaagccaaacaaggcatccgccccacaggagcagcaacaacctgctacctcaggtgctgcaacaccggctgtttatccagactggtccagcttccaggcatatcctccaatcccaccacatgggttcttcccctcacctgtggcatcaagtccacagggtcatccttacatgtggggagctcagcctatgattccaccatatggagcaccgccatatgtcatgtaccctcctggagtgtatgcacacccatctatggcctcgggtgcacatccatttactccttatgccattacttctccaaatggcaatgctgatgctactggaactactgctgtagcttgtgatactgatggcaagccctctgaaggcaaagataaaagtccaactaagagaccccaaaggaactttgggcagcttgaacatgcttactggaaagaaccccagtgaacatggtaagatctcaggtgcatcagctaatggagccacttctcaaagtggcgaaagtggcagtgacagttcaagcgaagggagtgaaggaaattctcataatgattcatacaagcatagtggacaggaacaagatggagacgtacgaagttcccaaatggtgcatcacgttctccatctgagggaaaatttaaccaagctggcaatcatgcccatgccatcaagtggcccagtaactggtccaactacaaacctgaatattgggatggactattgggccaacacagcaagctctgctcctgtaattcatggcaaagtgaccccaacaacagttccaggggctgtggtcccagcagagcaatggatacaggatgaacgtgaactcaaaaggcaaaaaagaaaacagtctaatagggagtctgcacgcagatctaggttgcgtaaacaggctgaatgtgaggagttggctcaacgtgctgatgttttaaagcaggaaaatgcttcacttagagatgaagtaaaccgtatcagaaaagagtatgaggaacttctatcaaagaataattcactaaaggaaaaacttgaaggcaaacaacacaaaactgatgaggcaggacttaacaacaagctgcaacattctggcaatgacatccagaaaaaaggaaactaatcgagctatcatgcaatgcttgcatagcatggccctaactagattattgggaggcgcaattgtagtatgcgtgttaactccttactttattgcagttaattgttaccaggttgtgataatgttgatgccaaccttgtgtgtgggtgtttcctgtttcagatctatcttggcttatcttttagaagtcaagatgtgactgaagatgtaggctgtgacccagttcactgtatctgaaatagtggataaactcaaatttacaatttgtattgctgactaatattgttatgtatacctggcaaaaggttttctt

SEQ ID NO: 16157 - DNA, 3658 bp, Zea mays
gccactcgcgtcgcacggatctctccttccctccaggctccagctccaaagcctcgtcgccttcttcgccccgccacccgtcctgcacactcacaactagacatcgtaccacccaggttttgctttatgctggttcatttgtctacggacaatggactagttgctgcactgtttctgtgattcaccatgggaagcagtggagcagatacaccgtctaaggagcagcagccacctgctacctcaggtgctgcaataccacctgtttatccagattggtctagcttccaggcatatcccccaatcccaccacatggattcttcccctcacctgtggcatcaagtccacagggtcatcctttcatgtggggagctcaagctatgattccaccttatggaacaccgccaccatatgtcatgtacccccctggagtatatgcccacccatctatgcccccgggtgcacatccatttactccttatgccattacttctccaaatggcaatgctgatgctactctggtaatactgatggcaagccctctgaaggcaaagataaaagtccaacaaagcgatccaaaggaagtttgggcagcttgaacatgcttactggaaagaatcccagtgaacatggtaagtcctcaggtgcatcgggtaatggagtcacttctcaaagtggcgaaagtggcagtgacagttcaagcgaagggagtgaaggaaattctcacaatgattcacatcacaaggaaagtggacaggaacacgatggggatgttcgaagttcccggaatggtgtatcacgtttgcaatctgagggaaaattgaaccaagctatggcaatcttgcccataccatcaagtggcccagcaactgatccaactacaaacctaaatattgggatggactattgggccaacacagcaagctctgctcctgcaattcatggcaaagcgacgtcaacaacagttccaggggctgtggtcccagcagagcagtggacacaggatgaacatgaactcaaaaagcaaagaagaaagcagtccaatagggagtctgcacgtagatctaggttacgtaaacaggctgaatgtgaggaattggctcaacgtgctgatgttttaaagcaggaaaatgcttcacttagagatgaagtaaaccgtatcagaaaagagtacgaggaacttctatcaaggaataactcactaaaggaaaaacttgaaggcaaacaacacaaaactgatgaggcaggacttaacaacaagctgcaacattctggtgatgacagccagaaaaaaggaaactaatgctatcatgcaatgcttgcctacattggtcctaactagattattgggaggtgcaattgtagtatgcacattaactccttactttattgcagttaattgttaccaggttgtgataatgttgatgccaaccttttgtgtgggtgtttcctgtttcagatctatcttggcttatcttttagaagccaagatgtgactgaagctataggctgtgacccaattcactatatctgttagaaatagtggataaagtcaaactttcaaatttgaagtgctgactaatattgttatgtatacctggcaaaagactggtttccttttaattcagtctggttgaacattttgctgggctttcactactgcctagtttatggcctgtgccgctcatgtcggttgttcctagttattttttgtaataattaacaaatagatgagggacactgtctcaacctctgcaccaatatatatatggacacacacacacacacacacctcttttttctagaaacatcctaatcgaaaacaaagtttgcaggtttgtttcagccctgtttgattgtgagccttggcgctggcggtatttttttttaagtttaaatgatccacctgctgtaggtaagtttggttaaaagacattcctatttttctgtttagtgatactgatattagtaatccttttttttcatccatctatttaagtgtcagcagaatcgtttgttaaacttgctttcctgaacttgctcttgattctggtaagtttttgggctcctggcactttacttttatgatcttattttgatttgctttttacaggaaaatggttctggactatgtcttagatgggaagcatagttcattagtatgtctgccttacaggttcttaagcagggatcgtggaagaacctgtgttgggaggtggtagagaagatgtgtcaaggattggtttttggtcaatgtcttctctggtgccgcagaagttggagcggcatagcgagtgcatgttgccgcttttactctgtgttgctgtttgctttatgattccttttattccatggcacctgaataactcccccaagtggtagagatcaggacttgtgagctcgatgccggtgaagtagaacttttgacgcttgatgttggttacggtgatcgtgtcacccaagtggtgggtgggaactggggactatggttccattgggaagcctgatgaggtagttgaacacgaggggcacagtgatggaatgcctggataggaactccagcacctggctcagaaatggacgtgacagcagcctgtcgctgggcatcaggaaggtggtgttacggggtatcttctcctgcaccattctgatgagcatgacgaaggtgaagtagcgcactcgctgcatctcctatgccatggtggcaatgccacagctaaccatctttgtgtaagcaggcggcacacatgtttaaactacatggacacccttattatgaaaataaaaatatagaaaaaaccctctacctggatactgtttacagtctgagcacagtgacaggcttttttgtctactcttcgaccagttcggctctatcttaaggtgctggctgcagaaaatgagcttcatggcttcaataactagctgtatgatcttcagattcttggactgttgaactgtttaacggcagatattaacagttgcagccttacaggtgcttcgtcaaatgttgaggcattgctgcttaataactgtttgggggatagagtttgggttatacactgtaggtgaatcttcacgttgataccacaaacaatgtgtggaagtttcaaaaccattatcatatcaagtgtgcagtgaatcttaacgttgatgccagaaaccatgtgtggaagtttcaaatccttacaaaggaaaggtggttgaaaataacataatttacaaacgtgcttcgaaccctgggactcaagttcgtttctggtgcccgaacatctgatttcacgggtgagttagttttgaaggctaggcgcttgagtagatgttctgggttcagaactgcacttggattcccatgttttcaagcacattagtaatgttgaccattgtctattctactctgtcggacgtcaatgtcgtcagagaaagttaggaggattaagtgagattgaaggaaacagtgacgtctaagatgtggtgaattaggacttctattttttttaaactaggccacaaataaaatcttagagcaaaacctatgtaaataatcaaactaaaatgtgcaaacgtttttatctaagtgttgctatctctaccgcaaagtctaagttttaatctaaacaatataaaaaagacaattgaaatttaagtacttaatgtaaa

SEQ ID NO: 16158 - DNA, 3482 bp, Zea mays
ccacgcgtccgcgcagagcacagcactccacctcactgctccagtcgcgagccgcagctgcgcgtcgcgtcgcatcgcacgcatctctcctgccctccagctccaaagcttcgtcgtctgcgtcgccccgcgccccgtcttgctcgctccaagctagacaccataccacccaggtgacttcgcgcgccactccttccttccctccctttccccacagctttactctcccctcccgcgtccagatcccgaggcccctctccctcgatcgccgcctcccggtagcggatccggcgccggctcgcgccccccgacaggttttgttttatgcttgttcatttgtctatggacaatggactagttgctgcactgcttttgtgagtcaccatgggaagcagtggagcagatacatcgtctaagccaaacaaggcatccgccccacaggagcagcaacaacctgctacctcaggtgctgcaacaccggctgtttatccagactggtccagcttccaggcatatcctccaatcccaccacatgggttcttcccctcacctgtggcatcaagtccacagggtcatccttacatgtggggagctcagcctatgattccaccatatggagcaccgccatatgtcatgtaccctcctggagtgtatgcacacccatctatggcctcgggtgcacatccatttactccttatgccattacttctccaaatggcaatgctgatgctactggaactactgctgtagcttgtgatactgatggcaagccctctgaaggcaaagataaaagtccaactaagagacccaaaggaactttgggcagcttgaacatgcttactggaaagaaccccagtgaacatggtaagacctcaggtgcatcagctaatggagccacttctcaaagtggcgaaagtggcagtgacagttcaagcgaagggagtgaaggaaattctcataatgattcatacaagcatagtggacaggaacaagatggagacgtacgaagttcccagaatggtgcatcacgttctccatctgagggaaaatttaaccaagctatggcaatcatgcccatgccatcaagtggcccagtaactggtccaactacaaacctgaatattgggatggactattgggccaacacagcaagctctgctcctgtaattcatggcaaagtgaccccaacaacagttccaggggctgtggtcccagcagagcaatggatacaggatgaacgtgaactcaaaaggcaaaaaagaaaacagtctaatagggagtctgcacgcagatctaggttgcgtaaacaggctgaatgtgaggagttggctcaacgtgctgatgttttaaagcaggaaaatgcttcacttagagatgaagtaaaccgtatcagaaaagagtatgaggaacttctatcaaagaataattcactaaaggaaaaacttgaaggcaaacaacacaaaactgatgaggcaggacttaacaacaagctgcaacattctggcaatgacatccagaaaaaaggaaactaatcgagctatcatgcaatgcttgcatagcatggccctaactagattattgggaggcgcaattgtagtatgcgtgttaactccttactttattgcagttaattgttaccaggttgtgataatgttgatgccaaccttgtgtgtgggtgtttcctgtttcagatctatcttggcttatcttttagaagtcaagatgtgactgaagatgtaggctgtgacccagttcactgtatctgaaatagtggataaactcaaatttacaatttgtattgctgactaatattgttatgtatacctggcaaaaggttttctttgaaaaaaaaaaaaaaaaaaaaacattttgctgggctttcgcggccgcctagtttatgtacattgttgttcatatcggttgttcctagttattttttgtaataattaacaaatagatgagggacactgtctcaacctctgcaccaatatatatatggacacacacacacacacacacctcttttttgcgtctattttctgttttacttcaaagtttgcaggtttgtttcagccctgtttgattgtgagccttggcgctggcggtattttttctaagtttaaatgatccacctgctgtaggtaagtttggttaaaagacattcctatttttctgtttagtgacactgatattagtaatccttttttttcatccatctatttaagtgtcagcagaatcgtttgttaaacttgctttcctgaacttgctcttgattctggtaagtttttgggctcctggcactttacttttatgatcttattttgatttgctttttacaggaaaatggttctggactatgtcttagatgggaagcatagttcattagtatgtctgccttacaggttcttaagcagggatcgtggaagaacctgtgttgggaggtggtagagaagatgtgccaatgattggtttttggtcaatgtcttctctggtgccgcagaagttggagcggcatagcgagtgcatgttgccgcttttactctgtgttgctgtttgctttatgattccttttattccatggcacctgaataactcccccaagtggtagagatcaggacttgtgagctcgatgccggtgaagtagaacttttgacgcttgatgttggttacggtgatcgtgtcacccaagtggtgggtgggaactggggactatggttccattgggaagcctgatgaggtagttgaacacgaggggcacagtgatggaatgcctggataggaactccagcacctggctcagaaatggacgtgacagcagcctgtcgctgggcatcaggaaggtggtgttacggggtatcttctcctgcaccattctgatgagcatgacgaaggtgaagtagcgcactcgctgcatctcctatgccatggtggcaatgccacagctaaccatctttgtgtaagcaggcggcacacatgtttaaactacatggacgcccttattatgaaaataaaaatatagaaaaaaccctctacctggatactgtttacagtctgagcacagtgacaggcttttttgtctactcttcgaccagttcggctctatcttaaggtgctggctgcagaaaatgagcttcatggcttcaataactagctgtatgatcttcagattcttggactgttgaactgtttaacggcagatattaacagttgcagccttacaggtgcttcgtcaaatgttgaggcattgctgcttaataactgtttgggggatagagtttgggttatacactgtaggtgaatcttcacgttgataccacaaacaatgtgtggaagtttcaaaaccattatcatatcaagtgtgcagtgaatcttaacattaatgccagaaaaaaaaaaaaaaaagttcaaatccttacaaaggaaaggtggttgaaaataacataatttacaaacgtgcttcgaaaaaaaaaaaaaaaaaaag

SEQ ID NO: 16159 - DNA, 1794 bp, Zea mays
actcgcgtcgcacggatctctccttccctccaggctccagctccaaagcctcgtcgccttcttcgccccgccacccgtcctccgcacactcacaactagacatcgtaccacccaggtgatctcgcgcgccactccctccttccatcccttagccccagctttactctcccctcccgcgcccagatcccgaggctcctacccctcgatcgccgccttccagcggccgatccggcgctggctcgcggcccccgacaggttttgctttatgctggttcatttgtctacggacaatggactagttgctgcactgtttctgtgattcaccatgggaagcagtggagcagatacaccgtctaaggagcagcagccacctgctacctcaggtgctgcaataccacctgtttatccagattggtctagcttccaggcatatcccccaatcccaccacatggattcttcccctcacctgtggcatcaagtccacagggtcatcctttcatgtggggagctcaagctatgattccaccttatggaacaccgccaccatatgtcatgtacccccctggagtatatgcccacccatctatgcccccgggtgcacatccatttactccttatgccattacttctccaaatggcaatgctgatgctactggaactactgctgcagctggtaatactgatggcaagccctctgaaggcaaagataaaagtccaacaaagcgatccaaaggaagtttgggcagcttgaacatgcttactggaaagaatcccagtgaacatggtaagtcctcaggtgcatcgggtaatggagtcacttctcaaagtggcgaaagtggcagtgacagttcaagcgaagggagtgaaggaaattctcacaatgattcacatcacagggaaagtggacaggaacacgatggggatgttcgaagttcccggaatggtgtatcacgtttgcaatctgagggaaaattgaaccaagctatggcaatcttgcccataccatcaagtggcccagcaactgatccaactacaaacctaaatattgggatggactattgggccaacacagcaagctctgctcctgcaattcatggcaaagcgacgtcaacaacagttccaggggctgtggtcccagcagagcagtggacacaggatgaacatgaactcaaaaagcaaagaagaaagcagtccaatagggagtctgcacgtagatctaggttacgtaaacaggctgaatgtgaggaattggctcaacgtgctgatgttttaaagcaggaaaatgcttcacttagagatgaagtaaaccgtatcagaaaagagtacgaggaacttctatcaaggaataactcactaaaggaaaaacttgaaggcaaacaacacaaaactgatgaggcaggacttaacaacaagctgcaacattctggtgatgacagccagaaaaaaggaaactaatgctatcatgcaatgcttgcctacattggtcctaactagattattgggaggtgcaattgtagtatgcacattaactccttactttattgcagttaattgttaccaggttgtgataatgttgatgccaacctcttgtgtgggtgtttcctgtttcagatctatcttggcttatcttttagaagccaagatgtgactgaagctataggctgtgacccaattcactatatctgttagaaatagtggataaagtcaaacttacaaatttgaagtgctgactaatattgttatgtatacctggcaaaagactggttttcttttaattcagtctggttgaacgg

SEQ ID NO: 16160 - DNA, 2385 bp, Zea mays
ctggctttgcgtggggggctgcgtttggctgcccagatccgcgtcgcgcgctcttggtggttttcctccccctctctgagctagcgagcttttgcttgcccgggaatgaaatcggggcctcagactcccactgccgttttcggccactgcatttgggctacatgctttcctcactttgtatcttgtggttgtggagggctggacagcttgcttctcctctaacgatcttttcagctttgtttttttaccacctcggaagcttgttatactagtgctccgcttaccgagattacggttattccagcatgtttcttttagttttctttcgctaaagtaaagtcggttctgttttactggtatatatcagttgtactgacgagctctggaatttccagtgcgggtgcattaggctgatatgggggcaagtcgccggggaagtggatcaaatcggtgcttttggggaagaaatctaccaagtcaggtcctaccaagtcgaatgaatctaaggctgacaacaacagatactcgaccggggaggaccgcacattgtctgagagttctcctgtgatttctgagccggtactagttaacatccacaagaacgtagctatcaatgggaaggctgcagatgccagtgatagggcacggcaacaagatccgcagagccaaagcgttgttgagtccagatcatcggctccagctgctcagctgggagaagatcaagctgcagcgaaggcacaggcagcctttcgtggttacctggcacgaaggtcattccgtgcattaaaaggtatcgtaagactccaggcgctgattcgagggtatcttgtaaggaggcaggctgtatcaacccttcgcgcaacatggttgattgtgaagtttcaggctctagttcgtggaagaaatgttagactctctggcagtcgcatgcagctcaatgtgaagtttggtcagagtaactttgggggtgttagatcgtctgatgcatggaaagagaagctatcttcaaatgcttatgttcggaagcttctgtcttcaccaattgttttagaacctcttcacttccagtatgacaagagggatcccaattcaacctataactggtttgagagatggaccataggttgcatctggaagcctgcttttcaacccaaaagagttgctgatgggaaaccactggtaaagaaggctagttatgcaatggaaactcaatcagccaagttaaaacgcaacattcggaagggttctgctgctatcgctgggagtttccatacatctggtgaatctgataaagtaaaaaggaatccaaagaatttctctagcttccctgctgattcagtaccagatagccagttatctgaacttgaaaaggttaaaaggaacctcaggaaggtaactgattcgatggctgaagcctcaaagatatctagttccagggttgattcctcgaaggtatgtaattctacagctgaggttccaaaggaatctaatcctgtggcagaaatctcaaagatacgtagtctcctgaatgggatctctgaccatcaggatattcaatgtgagaatacacgtgaatcttcatttcctcttggaactcaagaagactctgacaatgatcatctattgcgatattcaaatatggatagcttggacttggtacctggtttgaaaagtgatcaggaaattcagctggattcggtttctataggagaaaatgttgatgatcccactgttgttgctccagcagttgaagaaatgtcaccgcaaaacattgatacggaagacaatgttttatgcaagaaagaggaagcaaggtccaaggaagagcacttgtctaatggaagccttagaactagcaagaggaagtcttcattccccaacaaatcagaatatgtagaaaatgggactcacgctactcctgttcagccaaggcagccaagctatatggctgcaacggagtccgcaaaggcgaaattgcgagcccagaattcacccagtctggattctgattcagcggcagaaaagaatggtttcacccgacgccactctcttccttccagtacaaagagtagagcacttaaagctgaatggaagcgctgaagaggcaacccatcgtccacttgaattgaattgtgcactgctctgaaacttcgctggatgaactcgaccggtcttgtcccatgttcttgctgtattgaacaaccccttgtgaagttgcgattctggttcagtttgtcgtaggttcatgtgcaaccactagtgccttgtgtcgtatattgcatggttcttgtcgaaggaacaatgcctgcgaaagctgatgttaggactgcattaactgaataacatcacccagttgcccaggtcttaaaaaaaaaaaaaaaaaaa

SEQ ID NO: 16161 - DNA, 830 bp, Zea mays
  misc_feature (10)..(10): n is a, c, g, or t
  misc_feature (12)..(12): n is a, c, g, or t
  misc_feature (830)..(830): n is a, c, g, or t
gctctttacnantggatcccccgggctgcaggggagggagagggctaactagtccccccccccccccccccccgagcaaagcgtcttccatttctcagaagagtgtgtgacaacagcggcaaccgacagacatgtcttcgccgacatcgccttggtttgcggatctcttcacagatgacagggtgaggaccctatcgcaccaggtctccacacttggggacagggtgtgggaactggagcacaaaattacccagctgatgggcgagaaggccaagctggagaagcaactggaggaggcaaaggcgatctcaagccacaaggaagaggtggggagaagcttgaaggctgaaaatgataagcttcagtcggaggttttggttgcggaggaaaagtgtagcaagtctgcagcggaggttgagaggctgacgaaggaattaggcgcgctggcggaggcaaaggaggcagctgccaaggaattcaacgacgagagagagaaaatcacgctagaatcggaggatctcaagatgaggctggaggaaatgctggccatcaaggatttgacagagagcgagaatgacaagcttcggtccgaggctttgatcgcagctgaaaagcaaaacatgtctgaagcagagattgagaggctcaagaaggaactgagtgcgttgttggaggccaaggaggcggctgccagggctttcgcccgtcaaaaaagcgaaatcccccatgaattacaggaactacagagcaacctgaaggaaatccaaacctaaaacgatctcacgggaggggagaaaacagtagcctccactctgaaattctcacggccn

SEQ ID NO: 16162 - DNA, 2182 bp, Zea mays
tcgaggccggccggggagctagcctgagccctgaggtggtgagctcactccaccacttgactcccgtctcgtctcgtctctgcactggattggaggctggggccgtgaagggtaggtaggtcgcttgatagggacaaggggggagacggcgagaggcgtttcgccgagcagttcgcgtgctcccctccacaggccgacgcggcgacgccgctgtttcagtgcgggtgcattaggctgatatgggcaagtcgccggggaagtggatcaaatcggtgcttttggggaagaaatctaccaagtcaggtcctaccaagtcgaatgaatctaaggctgacaacaacagatactcgaccggggaggaccgcacattgtctgagagttctcctgtgatttctgagccggtactagttaacatccacaagaacgtagctatcaatgggaaggctgcagatgccagtgatagggcacggcaacaagatccgcagagccaaagcgttgttgagtccagatcatcggctccagctgctcagctgggagaagatcaagctgcagcgaaggcacaggcagcctttcgtggttacctggcacgaaggtcattccgtgcattaaaaggtatcgtaagactccaggcgctgattcgagggtatcttgtaaggaggcaggctgtatcaacccttcgcgcaacatggttgattgtgaagtttcaggctctagttcgtggaagaaatgttagactctctggcagtcgcatgcagctcaatgtgaagtttggtcagagtaactttgggggtgttagatcgtctgatgcatggaaagagaagctatctttcaaatgcttatggtcggaagcttctgtcttcaccaattgttttagaacctcttcacttccagtatgacaagagggatcccaattcaacctataactggtttgagagatggaccataggttgcatctggaagcctgcttttcaacccaaaagagttgctgatgggaaaccactggtaaagaaggctagttatgcaatggaaactcaatcagccaagttaaaacgcaacattcggaagggttctgctgctatcgctgggagtttccatacatctggtgaatctgataaagtaaaaaggaatccaaagaatttctctagcttccctgctgattcagtaccagatagccagttatctgaacttgaaaaggttaaaaggaacctcaggaaggtaactgattcgatggctgaagcctcaaagatatctagttccagggttgattcctcgaaggtatgtaattctacagctgaggttccaaaggaatctaatcctgtggcagaaatctcaaagatacgtagtctcctgaatgggatctctgaccatcaggatattcaatgtgagaatacacgtgaatcttcatttcctcttggaactcaagaagactctgacaatgatcatctattgcgatattcaaatatggatagcttggacttggtacctggtttgaaaagtgatcaggaaattcagctggattcggtttctataggagaaaatgttgatgatcccactgttgttgctccagcagttgaagaaatgtcaccgcaaaacattgatacggaagacaatgttttatgcaagaaagaggaagcaaggtccaaggaagagcacttgtctaatggaagccttagaactagcaagaggaagtcttcattccccaacaaatcagaatatgtagaaaatgggactcacgctactcctgttcagccaaggcagccaagctatatggctgcaacggagtccgcaaaggcgaaattgcgagcccagaattcacccagtctggattctgattcagcggcagaaaagaatggtttcacccgacgccactctcttccttccagtacaaagagtagagcacttaaagctgaatggaagcgctgaagaggcaacccatcgtccacttgaattgaattgtgcactgctctgaaacttcgctggatgaactcgaccggtcttgtcccatgttcttgctgtattgaacaaccccttgtgaagttgcgattctggttcagtttgtcgtaggttcatgtgcaaccactagtgccttgtgtcgtatattgcatggttcttgtcgaaggaacaatgcctgcgaaagctgatgttaggactgcattaactgaataacatcacccagttgacc

SEQ ID NO: 16163 - DNA, 1785 bp, Zea mays
ctgcagcagctcaaccaagaagacgatcgtcagtacaggaacaaatatcaattttgcaaattccgattgtaacaaaacatgtgattcacctcgaatccgacgagcgagcggcagtagccgacggtggccgcggtgagcacggagctggtcgagccgcactcgctgcccaccagcgacgcgctggaccggtccagcctgacgcccgcccacggctgcgccgggtacccgtacgcggccgccgccggcacgccgacgtgcgacgacgagcgctgcatcttcctgggcgcgccctgctgggcgcggcgcctgctgggctggcgctccagcgccgcgtcggtgcgctggcgcggcgcgctctgggaccggaccttggcgcgggacgactcggtgttggccatgtagctcgggacgacgccgtaggcgtcggcggcgtcgtcgtagggggccacgtacgggctgctgcgcgccgtcgccgcggggtcgaacgcgaacacgtcctccaggtggccgctgtcgccgcgctgcgggctgaggtcgggggcgaagaggaacggcgcgggcgagcactgcccgccgccgccgtggtggtagtactcggcgaggcggcgctccctggactcggtggccgccgccgagcagctgctccgcccgcgtcgcgccgggtcgccggcgtccatctccacgaccttcacgtgctcctcccccgaccggtccatcgcctcctgcatgcgagacaccacatggctagtagtcagcagcgggcagcggcagcggcggcgtgtctaggctggagtttatttttgaaatgcagagctaatttgtcatgcaagtgtgtgcgcgcgtgggacgtacgtaggagctgcggcgcatcggaatgggatggtgcggtgagcggcgctggtaggccgctggcggcgtggcgtggtccgcgtccagcatgcgcgcgcgctgggcgcgcaggcgggactgcgcgtcgacgagggcctgcatgcggcggagcgtggcgttggcctgcctcctcaccagctggcccctgaccagcgcctgcagcttcactagtccgcgcagcgcgcacagcgccttccgagcctgcgtttcagttgcgctcgtcagatcagaaatcagatcagtcaccgtggtgtcatcgtcacagttttttttcctcaccagatagcctctgaaggtggcctggatcctgacggcggccgcctcctcgacggggcagcagctgactgacagatggctctcgtcagcagccgtcagacgagccacctcggtggcagccgccgccgctgccacggcgtgctcgctctggtcgagctcccgcgccgacggctccagcgacgacaacggggacggcgccgcgttattggccttcccctcctgcttcgtgggcgccgtcgcgggccgcctgaagctccagcgcctcttctcccgggggctgctcgcggccggcagcggagtggcgtcgccttgctgctgctgatgccgcagcgccttgtctctgacgccgctcttcctccccgccaagatgctcttgagccaccgccccgccttccccatctgtctgtcgacaaagcttgcttccgaacatccaccggctcacatgggacaacacgacagagctatatactggtaacgtagcaccgatgataagggaaggataggaaagggaagggaagggaggaaggaagcagcgacgttgcgtcggtcggaatcggatcaccactgcaggcagcacccaggccaggcagaggcagctaaaacagaggatggcagttatag

SEQ ID NO: 16164 - DNA, 1134 bp, Zea mays
  misc_feature (1130)..(1130): n is a, c, g, or t
  misc_feature (1132)..(1132): n is a, c, g, or t
gccggccggcgtcctcggggccaagcctgaaagcaaagagtgggccgggtggccaggaccaacgacttttccatagtcgtgctcgtcttcgtccacctcccgacccgactgagtagcaagcaattctccaaattagggtttctttccgcttgctttccagtttgcggcatcagtcggtggcgcctgcgatggagtctctgttcggccaatcgcagcggaggaggagggcgggcggcagcggcttcgaatcgctcaagcgtctgggtcacatctcacccgctgtgcagtcccacctcaaacatgtgtacctcaccctatgctccgcgctggccttctctgcactcggcgcgtacctccacatcctcctcaacgtcggaggcgccctcacgaccgtgggatgcgtggcctccatcgccttcctcatctccctgcccgcttcacgggaccaggagaggaaccgcttggcgctgctcatgtctgccgcgctccttcaaggcgcgtccgttggtccgctcgtcgaccttgttattgacttggattcgaggattctcgtcactgcgttcgtcgggaccgcagttgcttttgcatgcttctctggcgctgccatcatcgccaagcgcagggaatacctgtacctcggcggtctgctttcatctggcctctccattcttctctggctgcagtttgctacttcaatctttggccacaccagcgcgaccttcatgtttgagctctactttggcctcctggttttcctgggatatatggtgtttgacacccaggagatcatcgagagggcgcaccgtggggacatggactacatcaagcacgcgctgactctcttcaccgactttgtttcggttcttgttcgaatccttgtcatcatgatgaagaatgcacaggagaaatcccaagacgagaagaagaggaagaagcggtagctgctgaattaattggatgacgtatgttgttgtggtcactacttcatagtaccgtgtactcctatcctattgtactaataataataatagtaagacgaaagatgactgctgggaatgaatatgtggttctgctataaaaaaaaaaaaaaaaaactgatgatgaacgaaaaaaaaaaaaaaaaaacccgngncc

SEQ ID NO: 16165 - DNA, 1099 bp, Zea mays
atgggaccctcgaggccggccggggttttttctctcactttgtaatcgatcagctgcaatgaagtgggtaggctgggtagccgcggtcgaggatcgccatcgagagggcgacggccgcgctctcgacggttcggccagcatcagtgctcaccccacggttcttggcctcaaggtttacctcctctgccctccctcaccttatcttcttcggtatgcacttgtgttgtgttgtgttgcagggccagagcagcaactgggtggtcgtcgagttcaggcatccgaacccctccaacgacgactgggtcggcgtcttctctccctcgggtttcaggtactcgacggactatggcatgtttaggctctgcatagcgaacacggaggaggactggaggccgggaacggagcagtacaagttcatcgatcgaagcagccctggctcgtcttcctcgcgcaccgtgttctcggctactcgtcgggtggctggtacgagacaatgatgggctcgtacggggagccgatgggccgggacgggcttcaagacctctggcagaggtacgatatagcggtcttcggccacatccacggatacgagcgcacgtgccccgtctaccaggcaaagagccggtgagtccaagatgatatggatcattacggcgggcggggcggttcaacgcgacgacccatgtcaccgttggctgcggcggcggcgcgagcctgtctacgttcagagacagtgtgccgtactggagcttcttcagggacgccgacacttgatgttcggcaagctcacggccatcaacagctcgttcctcttgtttgagtacaagaagagccgcgacggccatgtgtatgaccgtttcagtctcgcacgactaccgtcacctggtggcctgctccgtcgacagttgcccccgaagcaccttggccgtctgatcgagctccggactctggagacatgtgttgatagatacactgtttgatatactttcagcattgtttttagttaccattggttctgaatgcactgaaccttctacctcgacactacatgctacatatcaaaagggcaatggtgtagaacaaatcatgtgcttctcac

SEQ ID NO: 16166 - DNA, 1274 bp, Zea mays
gtcgctagggaccccaggtgaaaccatcagctcattcgcgccccccagcgcggccatcgtgcaatccggccgctggccgcatgccgcgacccgaagtgataagccaccgcccaccgccgctggcatgagcccgatggcgctgctcacaccactgcccattccccttctctcgccgtattgccaacgcgtctcgtctccgtcgcttctggcggccggggcagttatcagacctctcatttgtctttccccccacaatcaccgccaccacgatgcactctacccctctgtccccaatgtgtggccacgccaccggcgccgccgcaggggcgcagttgcttccgtcgaccaggaggagtctagtgcctcggaaaccgcagtcgctcccgaggaagacctggggccaccggtatcctctgatgcggctgccgaggacggggtcgcgacttctgcccagccggcggaggcgagcccggaggacctggagaacatccgcgaaattaaaagggtactggagctgctgaagaagaacagagacatgacctttggcgaggttaagcttaccatcatgattgaggaccctagagatatagaaagaaagagaacactcgggatagaggatcctgatgaaattactagggatgatttagctgacgctttggctgaggttaacgaaggaaagattccagagaatcgtgttgcacttcagttgcttgccaaggagatggcagaatggccagacattgagatagaagctccaaaaaagaagagcaaacctgggaaatctgtctatgcaaaagccacagatactggcatcgatcctgagacagctgctaaaagacttaaccttgactgggactctgctgctgatatagatggcgaagaggaggacgatgatgaaactgaagtgccgtctgcagtgggatatggtgccttgtatttgttgacagcttttccggttattattgggatctcagtcgtcctaattcttttctacaattctctgcagtagctcctccccttcttgagtgagaatgtgagatgttgctgcattcttgtaaatctgagttacaaggctagttaatcagtaacattttttacgccagtgttgcaaagatatgacaacttgtatagatgtcaaattccaaattttggaatgtaagatagttttttttaaaaaaatcgtgtgaaatataacttcttgttgtttgccagtaatctaaaccaaggtttttttaaagaagaatatatttgaataaataaagtttttgtcaaca

SEQ ID NO: 16167 - DNA, 1643 bp, Zea mays
gacatcaacacatttttggtattagactattgtagctcatatcatctgtcacccatggcgaagtgcagcagcttccaaggattattctggttgctttccatgattcttctagcatcctttgttgctcatgcacgcacaacaaggcgtaatcaatgaattattaggcccattttcttttgtggtaaataggtatatcaatttatttagtgttccttaaattaatctgatggagttgcacgtgattgatcttattagggcacaccaaagagggacagcaatgctaggaacatgacgatgaccaagacgagggcatcgggcaacatacttgttagccgtaatgacgacgggccatgctatctagattccggtcttaatgagtacgtctgcagaaagactaataagtgctataagagcttggtgctctgcgtggcgagttgtcaaccatcatcatgaattcatgatactgcggagacatcatgatactgcggagacagacggcgagagatgaggctagctagatgctgtttcaccaaaatattatgtaacacccaaatctcccattttaagaaataaataagattttcgaaaagattatttggcttggagtgctcttacatatcgattaattatgcatttaatatattttcctaaaatgatcaattgggcaaaagaatatatttgtgatgtgcactgcattctggagcatggtttattactgtttgaatttgaattcggatttgaatcatttgaattctcattggatttgaattggaaactaaaaagaaaaaataaaaagaaaaatgcctacgtgtggctccctctctggtgtgtgggccgcttcctcggccggcccacttccacaccggcagctcacgcctaggggtaaaaacggtcgaaaacgatcggtaaacactaaaatcaattttcttttcatattttttctcagaaataagatcgaaaacggtaactccgaaaacgaaaacgacatcggtaatttggaaacatcagaaacgaaagttcggtacgaaaattacaccggttacaatcgaaatcttaaattcgatcggtaaaaactgtaacgtgtaccctcaattgactttaaaaattcacgcaagtcatacattcatatgaaattagtaataacatataaggtaggaggtcacattaaatatataagttgagaagtatataaaccattattatgtatttaagtaaactagaatcaagatgtgtataatgatatgacacttacattctatttgtactactacttggcatagtaaatataattagtgtcctcttggtccttattaagttatcgtgcaaattatgaatatatgtatcaatagtaataacaggtaagaaaatataaataaaatttataaaagtttcaaatgattctaaactatataccattaaatagatcttgattttaggaaaataataaaattagtttcatatttttctaagctaacatgaatttgttatgaatttataaaggatagtacagatttaatatttttctgaacaacaccgaatttattaccgacggtaaaataccgaataaaaacaataattttcggaaaagataggaagagggccaaactgtttccgtttccgatttttttaccgatttcatttct

SEQ ID NO: 16168 - DNA, 641 bp, Zea mays
tttttggtaacttctcgggagttcgccttgtgtcggtacccgggattccaccgggtggcccgcgcccggcgggatcaacacatttttggtattagactattgtagctcatatcatctgtcacccatggcgaagtgcagcagcttccaaggattattctggttgctttccatgattcttctagcatcctttgttgctcatgcacgcacaacaagtgggcacaccaaagaggacagcaatgctaggaacatgacgatgaccaagacgagggcatcgggcaacatacttgttagccgtaatgacgacgggccatgctatctagattccggtcttaatgagtacgtctgcagaaagactaataagtgctataagagcttggtgctctgcgtggcgagttgtcaaccatcatcatgaattcatgatactgcggagacatcatgatactgcggagacagacggcgagagatgaggctagctagatgctgtttcaccaaaatattatgtaacacccaaatctcccattttaagaaataaataagattttcgaaaagattatttgaaaaaaaaaaaaaaaaaccaaccccaaaaaaaaaaaaagaaagaaaaaaaaaaaacccaaaaaaaaaaaaaaaaaaggccccta

SEQ ID NO: 16169 - DNA, 761 bp, Zea mays
tgggaccctcgaggccggccggggtttttgctccgctgctcccccgccgcccctgacaagtataaccagccgcgtctcggcaaaaagtcctccgcgacagagagcgtgcagccagccaccgaccacccgcgcagcgcaggacttggggagcaagcaaggcgaagcggcctgccatggattccttctcgtcctcgccgtcgtcgtcaggtcccggcgctaacccggacgttgttatggaacagatcaagacgcagctcgcacaggcttacgcgcaggagtttctcgagaccgtcgggaacaagtgctttgaaaagtgcgtgaccaagccaggatcaagcttgagtggaagcgagagcagctgcatatcacgttgtgttgaccgctacattgaggccactggtattgtcagccgcgcattgttcacttcccagcgctaagatcacatgaataaggagatggtttcgaagatcgctcgtgagagtaatgtcgccatgagttttttgacttgtcggaatacaatgacatttgatgcttggttattcaaaaaaaaagtctgcctatagactcaggtttcttgtacacctatctgctttagtaatagagaaacgtgctctatttaagtggctctgatgttaatttatgctcatcatgtggtttgtttcgcttaatgttgtatgcttcttatgcctgtttgttgcccaagccttatcgaatatcgtgaaggatgtgttgttgttaaaaaaaaaaaaaaaaaagcggcc

SEQ ID NO: 16170 - DNA, 2154 bp, Zea mays
ttttttttttttttttgttaggtctaagatttagttctgtatgaatataagataacctagtttatcgggagcagtcgtccagtcaagcagacgttgaaaagcttaacagctactgacaacataatgtccacagttaacacaactggatcctataccgtaacttctagaaaagtagttgtggaccagtcaataacgcgtggagccagcggttgtctggccccgtacgtcaatggccggaagccatccgcctttgaccacttatggtttgttcggttacaccaattcataataggattggttgattgatgtaaccaattctcccccaattctcttttggattaatgtaaccgaacaagctaatctttttctggattggtgtaaccgaacgtgaagaaagaaagaaacacatgccaatcttcaaacggcgttcctcgcgccatccacgaacgtcatgagattacgatccgacgaccctccttttcccatggcctttgtcactacctgcttccactccgccgccatgcgtcgcacctccgcggcggcctccaaattccccatcgcctcgtcgatgcaccgccgcacctccgccgctcgcagcacgccaccatcgtccacctgcgcgcgcacgccgacgcgccactcgcgcacgacaagttgagcgttggtgcgctggtccgacatccggggcacgcacaccatgggcacccccgccgccaggctctccagcaccgagttccagccacagtgcgtcacgaagcacccgaccgccgcgtgcgacagcacccgcacctggtcgcaccactccactacgatgccgttcttgagctcctcgtctaccttcgtctcggcatccgcgagtgcagccttgttgtccttccggatgacgcagaggtacggcctgccgctctcctcaaggccccggagcagctcctcgagatgttctctcgccaccgtggtcagactgccgaaggagacgtacaccacggaattcgccggtttggcgtcgagccactccatgtacttggcgtcgtcgtcctgcttgaagatgccggcgtcgccgccggatgggagcaccgggccgacggggagcacgtcgtggtgcgcccccacggcggcgagcgcgcccacctcgagctctcggcacgtgttgacgaggacagtggacctggggctttccttgtcaagcgtttcgatcaggtctcggatcgtggtgaagacgctgtggaacatattggaagggtcggtggagtcggtgaggaaggacggcaggtcgccgaccggctgtggcgccaggcccggcatctccacgacgaacgacgggtcgtgaaggtggtcggcgacgacgccggcgtggccgtggaagtagtggtggtagatggcgaacacggagaccggctggatccagtagagcgcggacgggatcccgcggtcccgcgcgacgtcggccgcccacgggaggagcagcgtgtacacgacgcgggacacggggcggccccgcgccgcgagcgcgtccacgatctccgcggcgctgcgcgcccccgcggcgtggaaagacgtcatgtaggcgttgaacgagcccaggtcggcgctccggacgtacccggcctccgtgccgtcggagaacgggaggaactcgaggcggccgtcttcgtcggagtccttggcgccgtcgttgggctttgccgggaacatgcgcctgtgcgcgacctcggtggtggagaaggtcacgagcgcgtcgggcgccgccgcgagcagctgcctggcgaggcggagagccggggcgatgtggccctggaaagggaaggtgagcacgaggaagtgtggccgcggcgacgacatctccgactctcactagctagcgcgcccgcgtgtgtgggtctgtgctgtgtgtgtggcaccctcgctgccgcgactgcctgcatatgcctaacccggtaaccccgaggcccgagtagatggtgctgccgtgctgcggtatccggtcgcggactaaccgttggtgcacgtgccgtggcgcatcccaattcatgcatcaatctagccttcaggccgtggcgatttcagaagagaacaaacagaaaaacgccacgattgacagcgacgttgcccgctcggtccatatgatatgatacaaaaaacggaaaaaaccatcag

SEQ ID NO: 16171 - DNA, 862 bp, Zea mays
ttgggtacctcgaggccggccggggccgccccgcccgcgcccgtacccactctcccatccacgagaccacaagccacaccaaacccgcgttcatcgacggacgagctcgccggcgagagagcgactgagatggaggcggcggcagcggcggccggcgtggagctgggctcctcgaagccccagatcgcgacgcaggcggagatggcggaggcccgggtgccgctcgcctaccgcgatcagtgcgcgcacctcctcatcccgctcaacaagtgccgcgtcgccgagttctacctcccctggaagtgcgagcccgagcgccacgcctacgagaagtgccagtacgagctcgtcatggagcggatgctccagatgcagaagatccgcgaggcgcaggagaccaaggtcaagggcggcgcctccattggcctcatcccggccaccgccaagctcgcctgatacgggtcccagaccgatccgcttgatttaggtctgcctgttggctatagcagcgtccagaggcgttgcgccgtgcaaggatcctcaatgtttgttgtgtgaacagagatacgcgtttgaatttggcataaagttaactgttgtcttctttttcccttcccctctctctctatctccctgcctgatggctatcttcaggtttcaatttgatgatggaataaggaaaggtacttgtcctattaccgatgactggatgacttttttgaagttttgaaaacttgttcaaaaaaaaaaaaaagttgctgcctcaagccaactactgcggcaggcatggcaattgcagcgattaattcgtgcatgtttacattgtgaaaaaaaaaaaaaaaagcggccctcgagctccagc

SEQ ID NO: 16172 - DNA, 2338 bp, Zea mays
  misc_feature (609)..(609): n is a, c, g, or t
tcatccaaaagtggaaatagaagcaatctcgatacaatgatgtggtgacaaattcaaactcatctcgatctttttgattttttcacttaccttgattttgctttaagcacagatttaatgaatcaagccaatgaataactcaaaacatgaggcatagccacctagcatactagtgacaatacaaagaatttcaaacacatcctatacatgctaggtgccaatctcaatggggagcatgttttggattcaacaagtaatagtcaagttcacaattatgaaaagaagcttagctcaacaatattgtatcaatataagcaaacagagcctaagcatgccaaagcatcatcatgtatacaaagaacatactactaggatcatagtcacattctagcatatacacaagtgaaggtcaaaatgctacatgagatacatatataatacaagaatgaagaaagaaagactaaaatctacatgaaaaacaacaaaaacaaaaacaaaaaatggagcccttgataaaaaaggaactagacacctaattctcctcttaaaatactatattactatatcagctcacgagccgatccagactcagttaaaattgactcggantaaagagattcatgagccgagattgaataagcccgagccgactcttgagcctcgagttttttttttcgatcctaaggtccccggcggcccggccggaacaaaacccgttcgatgcgtctccgccgtttcaggacacaatcaagggctagaagccactacaggcccaaattcagcccatacccactctcccatccacgagaccacaagccacaccaaacccgcgttcatcgacggacgagctcgccggcgagagagcgactgagatggaggcggcggcagcggcggccggcgtggagctgggctcttcgaagccccagatcgcgacgcaggcggagatggcggaggcccgggtgccgctcgcctaccgcgaccagtgcgcgcacctcctcatcccgctcaacaagtgccgcgtcgccgagttctacctcccctggaagtgcgagcccgagcgccacgcctacgagaagtgccagtacgagctcgtcatggagcggatgctccagatgcagaagatccgcgaggcgcaggagaccaaggtcaagggcggcgcctccattggcctcatcccggccaccgccaagctcgcctgatacgggtcccagcccgatccgcttgatttaggtctgcctgttggctatagcagcgtccagaggcgttgcgccgtgcaaggatcctcaatgtttgttgtgtgaacagagatacgcgtttgaatttggcataaagttaactgttgtcttctttttccctttccctccctcgcgatctcgctgcgcccttttgtcaggggaagcagcattgggcgggtggcccgtcagcgttggcgtggatattattaggttaatttgtagacatttcagactaagctgctgactgaatggttagggttttcaggagctgctgtagccgtgtagcacttgcagagctaatttaggtagggtgaaaacagaaacgtgactcttgattcttggtagcataattcaagcttgctgcaaatatgacgaagttaaaacgtgaaatcaagccactgggatacatggacatttgagatcagtccagatctctctctctttttttgctgcccagtgcttgctgcagttccaaccattatgctgtcatatgttcatatattgagttgtgatgttcatgtatcatgaatacacaacagtgctaaaatgtttagaaatcagtctagctggtaggaagcttaatggaaattcatcatatcttccctgcgacctgaatttggggcttccaaactacctgaagttggttacagattctagattactgtttggtgatattaggactggaactctattctggcttgtagcttctcaagtcattggaagtgatttagacaaggcctagatttttgtttgttggaccaatttttaaatctgaagctttgtgcaattaaagcagataatgtacataggcagcaggttagtttagctacgcaggctgccattccaaacacatcgttgcagtgaagcatcaaatctaattaaaacatgtatgataaacatgtcatagcttacctatgccaataagcagaatatttctcaactatatctataggttgctgcaagcaatattgaatttgaaggaacttgcccaagtttcattttataacacattgaggtgtcatgtcgattaaattaaatggagttgccaattcatatcacatttttttattgtacctcccacttagcacttttgcaatacttca

SEQ ID NO: 16173 - DNA, 891 bp, Zea mays
cctgtgcggcgctcgaggcggccggtccggaatcaggacacatcaagggctaaaagcccctgggggcccggccggggccggtacccactctcccatccacgagaccacaagccacaccaaacccgcgttcatcgacggacgagctcgccggcgagagagcgactgagatggaggcggcggcagcggcggccggcgtggagctgggctcttcgaagccccagatcgcgacgcaggcggagatggcggaggcccgggtgccgctcgcctaccgcgaccagtgcgcgcacctcctcatcccgctcaacaagtgccgcgtcgccgagttctacctcccctggaagtgcgagcccgagcgccacgcctacgagaagtgccagtacgagctcgtcatggagcggatgctccagatgcagaagatccgcgaggcgcaggagaccaaggtcaagggcggcgcctccattggcctcatcccggccaccgccaagctcgcctgatacgggtcccagcccgatccgcttgatttaggtctgcctgttggctatagcagcgtccagaggcgttgcgccgtgcaaggatcctcaatgtttgttgtgtgaacagagatacgcgtttgaatttggcataaagttaactgttgtcttctttttcccttcccctctctctctctctatctccctgatgggtatcttcaggtttcagtttgatgatggaataaggaaagatcattgtcgtattaccgatgactggatgacttttttgaagttttgaaaacttgttcgccttgtggcttgtgttgctgcctaagccaactactgccggcaggcatggcaattgcagcgattaattcgtgcatgtttacattgcgatatattaattttggtgtgcccccct

SEQ ID NO: 16174 - DNA, 935 bp, Zea mays
cattgggacctcgagccggcgggacacaaataaaaacaagggctagaagccactacaggcccaaattctcagcccatacccactctcccatccacgagaccacaagccacaccaaacccgcgttcatcgacggacgagctcgccggcgagagagcgactgagatggaggcggcggcagcggcggccggcgtggagctgggctcctcgaagccccagatcgcgacgcaggcggagatggcggaggcccgggtgccgctcgcctaccgcgatcagtgcgcgcacctcctcatcccgctcaacaagtgccgcgtcgccgagttctacctcccctggaagtgcgagcccgagcgccacgcctacgagaagtgccagtacgagctcgtcatggagcggatgctccagatgcagaagatccgcgaggcgcaggagaccaaggtcaagggcggcgcctccattggcctcatcccggccaccgccaagctcgcctgatacgggtcccagaccgatccgcttgatttaggtctgcctgttggctatagcagcgtccagaggcgttgcgccgtgcaaggatcctcaatgtttgttgtgtgaacagagatacgcgtttgaatttggcataaagttaactgttgtcttctttttcccttcccctctctctctatctccctgcctgatggctatcttcaggtttcaatttgatgatggaataaggaaaggtacttgtcctattaccgatgactggatgacttttttttgaagtgttgactggatgacttttttgaagttttgaaaacttgttcaccttggtggcttgtgttgctgcctcaagccaactactgcggcaggcatggcaattgcagcgattaattcgtgcatgtttacatgcgatataattaatgttgttgtgccaaaaaaaaaaaaaaaaaaaggcccta

SEQ ID NO: 16175 - DNA, 703 bp, Zea mays
ggccgggggccgggagcccatacccactctcccgtccacgagaccacaagccacaccaaacccgcgttcatcgacggacgagctcgccggcgagagagcgactgagatggaggcggcggcagcggcggccggcgtggagctgggctcctcgaagccccagatcgcgacgcaggcggagatggcggaggcccgggtgccgctcgcctaccgcgatcagtgcgcgcacctcctcatcccgctcaacaagtgccgcgtcgccgagttctacctcccctggaagtgcgagcccgagcgccacgcctacgagaagtgccagtacgagctcgtcatggagcggatgctccagatgcagaagatccgcgaggcgcaggagaccaaggtcaagggcggcgcctccattggcctcatcccggccaccgccaagctcgcctgatacgggtcccagaccgatccgcttgatttaggtctgcctgttggctatagcagcgtccagaggcgttgcgccgtgcaaggatcctcaatgtttgttgtgtgaacagagatacgcgtttgaatttggcataaagttaactgttgtcttctttttcccttcccctctctctctatctccctgcctgatggctatcttcaggtttcaatttgatgatggaataaggaaaggtacttgtcctattaccgatgactggatgacttttttgaagtt

SEQ ID NO: 16176 - DNA, 859 bp, Zea mays
  misc_feature (37)..(37): n is a, c, g, or t
ttgaaggagatcctacttcattacagccgacggtatnctctctcaagtctggctccttttttttttttttttcaggcccactagggaagagtaaatattcataagaaaatatcattcatacaccaaataaaaccttggaagcagaaggtgatccagatatttttaaccaattaaacaggaataggatgctacatgattgttacacatagatggcggcttagaagattgcaagtagacattacacttacagttgcgagcacatcaaattgcagtgtaattagaacattcttttcttcccactgtttgagtttgtccttgtgcaaagaaccttcctgcctttggcgcgcctgcgcttcagtaccttccttccagaagtagtccgcatccgcctgcggaaaccatgtgtacgggcaagtgacttcctagaccttgacctcttggtcatgcagagggcagcctttccagccctaatctgcataccacgggatctccgtgttgtcattatactgtagctgaactcgattcccaaagatgaacccgcaaacgcggaggaggacgtaaatgccagagacgccgagacagccgccgcgagcgaagcgggggaggcggaggcggaggcggacgacgtggaggaggacgagacgaaggagctccggaggaacggcgaggcggatacgcccaccggggccgccctgcgagtgcggccgacgcctccgatagacgccgccgagatcctcccggagtggaaggagagagacgccattggagaggccagggcgagcgccatggtttggaggactcgcaatcgcaattgctgcggtctcgccgccggccccgatggccggcctcgagggtccca

SEQ ID NO: 16177 - DNA, 1526 bp, Zea mays
aatacatcccttgcctctttctcctcccccgcatctgcttctttctctccacgccaacccgacaccgcgcggtcggctcggctcggccatccccgccagctcccgctcgagatcccagcgccatgacgatcggcgtcgctctcttgctcgacctcacctcccgcctgccccgcgccggggcatccgccgcctccgcagccgtccgctcccaccccggtctctctaccaccgccttcgccgcgactgccgcggccgcgttgtcgtcctccggggtgccgctctccgcgcgccacctcttcggttttcatgggtttactgttgctcattgtgatgctggcacacctgctggatggaatgatggttctgatgatcttgttaatgagattaataccaagattattgattccttgcaatatgcaagaaaagactacttccagaacacaacaaaggaatacccttcagagctgaagccactcttttctgcctttgggttgaaaaattttactatcacaaccctaaggtctttcctattatattatttgccactcatacaacctaaacctcacactggttctgatgatgaggatgatgatctgcttcatgacactcaagagaaaaccatggatctggttactcccttctacaattcagtaaagcaaatcgtgcgggagacttctattgtaacgaccagacgagtatttgaaaggattgtagttcgtcatgtttcacaaagaacagcatggaaacttctcaaagatgcttcaaaatcatcaaaaaggaaagctgcaagggggatgccaactccacagtacacatactgtgttgccagaacaactttccgagcacatgcactgggaataaccgctgcttgggtagtgcaatccataattgaagtatacagatgtttcatccgtaagcctagtgaggactgtgaagcactatcaagcgacggcaatgaacagtttgacgatatgaataaattcagattgtttgggaggaagatttatgggattaccatcaaaagttgtttctctttggttttggcctcagctggagcaggcattggtgccctcgtgcatccagtgcatggacaatggttgggttgtgccttgggagatattgcaggtccaattatcgctataattgtttttgagaagatgcagctaccactatgagaaactggatttttggcgaccactggttttgggtcccttgtgcaagtcatggccttcagtcttctgtgtggttggagatccctgatctaacttgaaagttcacagttgatgaataacagctttcacctcagtgctcgtagttttgtagctccctttacagatgccttcgggtcttgtgggacatgagcatgtacttttgcagttttgctaaattttgtactctcagatttgaagaatccaaacaagaaatttaattttactagatttgagaagtaaactccatatgtatggcgccttccgtgatagtacctctcatcaaccgtttaggttatctggtttcctatctcattc

SEQ ID NO: 16178 - DNA, 1054 bp, Zea mays
ctaatcgaaaaaagttgaaatcgtttatttccatcccctcctcccttatctcccgcgctctgctcctcccagtcccagactcccatcctcgcctccgccatggccgccgtcggcatcccctcccctccggcgccacacgtcttcgcgcccgccgcatctccttcctcctccacgtactccacactgggcccccgccgtctccgcctctccacccgactcggactcgccgccgcggcggcgtcgtgccgtacgcggtgcgctgccgctgccgatggcggggctgcggcttcggagggtgcctctgcggtggcggagctggagggggaccccgacgctggcacagacgttgccggaggcgccgcgacctccacgcggccgccctactcgctcatctccgcggacaacgtgcagaaggcgatgcgcggcctcgcaattacagatgctgaccactatgggaggcttggagtcaccaggctagcttctactgatgaggtaaaagctgcgtacgagaagatgtgtgaagaactaaatagcaaagaactagaagaagaggagcttaacaaggaacatgagctcctaaaggaatcatttactatactatcaacggaggaagaacgaagattatatgattggagcttgtcaagaagtggacagcctgagcgatatgtctggccatttgaagttgatccattggagttggcaccagatcctccaaaggaaccagaagatgagttcccaaccaagctcgttggctacttcttactggcgtggttcatactctctgttggcctctcggtggccctcaacaaatgaagattttctccccaaaagaacatgaattgtaatccaataatctctctgccatgtacatcaatgacgctgttgtgtgcacagaagcatatggatgtacatgccatgctcttggcaattagccgaaacatataacaacacgttctgcacagattgaagtcgtgaatcttgtgcctggagttttcacaatcctgaattaagtatatgcccattttcaaccgaaacaagaaaaaaaaaaaaaaaa

SEQ ID NO: 16179 - DNA, 767 bp, Zea mays
gccattctggttggcgactctttggcgcagcggcagccaggtctaagcggcgatgagcaaagcaggcggcggccccggctcggccccgggcccgacggccgcggccgcggcggccgcggtgcagaagcagaagtcgctgctgcagaaggcggacgccgacgtctccagcctcgtcgacaatttctcctccctcatcaacatcgcccgagtcaacgatccgccagtgcgcaactcgcaggaggccttccagatggagatgcgcgccgcccgcatggtacattcagcagactctttgttgaaattagtgtcggaacttaagaggacagccatcttttctgggcttgcttcattgaatgagaatgtggataggaggatcgaagtgctgggtcagcaagctgagggaactgagagaatgctggagaggattgggcaggaggcagcagcaagcctcaaggagctagaggcacactactactcatctgttgtgcggtcaccatcctatgattgagggttatcccaggttatctgttaggcggtttgctcttcagggttatctcagggttttttatttcaccttgaatattgcctactgacattaccattacctttttgttgggactaaagtttagtagattcgtcttattgtttagtccttatctgtataattagtttataattagattatatttaatacttcgaaatatcattcaaatatttgaaaaaaaaaaaaaaagttctaaaaaaaaaaaaaaaatttgatgtgaaaa

SEQ ID NO: 16180 - DNA, 2061 bp, Zea mays
  misc_feature (5)..(5): n is a, c, g, or t
tggtncgcctgcagtaccgtccgtattcccgggcagacccctcgagcgcccaggccgcgcaccgcgagctctgctaccgccagctgcgcgcgctcgtgcgcgaggccggggtgcgcccgctcacgctcatggccaccgaccccgccgagtacttcgccgtcatggaggccgccggcggggccgacatctccctcggcgtcaagctcggcgtccagtacagcctctggggtggttctgtcataaatctaggaaccaaaaagcacagagataagtactttgatggaattgacaatttggattatccaggctgtttcgcaatgacagaactacatcatggatcgaatgtccaagccctacagactaccgctacatttgatcctgtcactgatgagttcattattaacactccaaatgatggagctattaagtggtggatcggcaatgctgcgcttcatggaaaatttgctactgtctttgcaaggttaattttaccccttcaaggaaaaggaggggaggctgctgatatgggcatccacgcgtttatcgtccccatacgggaccttgaaactcacgctgttcttcctggaatcgagatcaatgactgtgggcacaagatcggcctaaatggtgtagacaatggtgcgctgaggttccgctcagttaggatacccagagacaatcttcttaatcggttcggtgatgtgtcacgggatgggaaatacacgagcagtctgcccacaattaacaaaagatttgcagcaacccttggggagcttgtcggtggacgagttggcattgcttactgttctgtgggtgttctcaaagtcgcagtaacgatcgctgtgaggtatgctctgctgcgccaccaattcggtccacctaagcagcccgagatcagtgtgttggattatcagtctcaccagcacaaactgatgcccatgttagcgtcgtcgtatgcgtttcacttcgccacggtgcagttagtggataagtactcggaaatgaagaaaaccaacgatgaggaccttattgctgacgtgcatgttctttcgtctgggttgaaagcctacataacttcatatacagccaagtctataagcgtatgtagagaagcctgtggtggccatggctatgctgctgtaaatcgttttggagctctgcgcaatgaccatgatatattccaaacgtttgagggggacaatactgttcttctgcagcaggtcgctggagatctcctgaagcagtaccaggagaagtttaagggagggacactttcagtcacctggaattacttaagggactccatgggtacctacctgtcccagcctaatcctgtcactgcccgatgggagggcgaagatcatctgcgggatcctaatttccagctggatgcattcagataccgaacgtctcggttgctacacagtgtcgctgctcggctacagaaacacagcaagacgcttggaggtttcggtgcgtggaatagatgtctgaaccatctgcttacgcttgcggaatcacacatcgagtctgtcatccttgcaaagttcattgattcggtgaaaagctgccctgacgaaaaatcgcgggacgtattgaagctggtatgcgacctttatgcgctcgacaggatctggcaagatatcggaacgtatcggaatgtagactacgttgccccaaacaaagctaaggctattcataagctgacagactacctcagttaccaagtgaggcttgtggcgcgagaactcgtcgacgcatttgaccttccagatcttatcatccgtgccccaattggcatgcaatcggaggcctatgcacagtacacccagtatgttggcttctagtagagtatatacatataataagtccgagaaatatattacgaagttgcaatatagagatagatcataggtgagcaaataagtttcagtagtacatgtaaactgtaaatgtaaagcagtggatccgtaaagcactggctccgtgtgaataaattgtcagattatttttttgtctgaattgttttcaaagaagatttttatcagtaagctaaccaca

SEQ ID NO: 16181 - DNA, 4284 bp, Zea mays
  misc_feature (1464)..(1464): n is a, c, g, or t
attcaagttaccatttcactactctagaaacttttcacaaatgaacatagctacataaataaacttatggtctaaaataaggttgtagaatgttgttgcaatgtcaacattcttcactgaatattgaaagtagattgatatgtgagtgtcctttgagcaatggtctttaagccatttctatattggttttggtgtttgatgaccatcactatgttatggacttgctaagagaatggttgcatgttcataagagtgagaatcgaatattcaatatgaataatagctcaaattgaagtcagaaattaaagggcgtaatttggaaaagaggaactatgagtagttcaagtacttggatatgttctaaatggtcctaggaacatgttgaaacatcttggaaagtttagaaagatcaaacattgaaaaaggtgttctggagacaaatttgagtgaaagtaagcaattgagtttatatgaacaaatagatgaagacctatggcttagaccagttgaatgaactctataagaaaagcccaaattagactgtctgctgctctgtatagcactgggacagttcgttgtgcatcggaccgtgcaccggaccagttacacgaagagcatatttttggggtcatggaaggcattggcacaccagactattctagtggtgcaccgaaccagttaaacaaagtgcttgtttctaaagatagagaaggaacaaacaaatgaagatgttcatgttgaaaatataggagtttgtggattttaggactttatgaagaataatgcttagtgcagggtttatgcactcacgggatttatctgctgcccctgctaggaagcactagagaaatacatgtgtgtaagggagttagccatggctagagtatgccactagatttatctagtggttcctactgattgaatgacctggcataatgttcattgcatggtagatttgaatagggtcacaagagcttccagtgtgcatcattagacttttccactgatggttggagttcttgagtggctacaacgagaggttatagggatcataggaataatctagtgccccaccaaggagtcattgtagaaaatcttatagccactagaagttcccatgactagtttgacttaagcagagcgcaagtgtggccagcaaatttatccaatggtgcacattgtattgcaccagaggaatcattagagggtttaattttttatatcaaacctgagattttcgatcatggaatgcttgctctggtagtttctgttcgatgagcaccagaattttctggtgcctacagagacagctaaccaggagctcttccaacaactagttttgtgagggctctataaatatgtatttgttgggtctttgatcctcacttgccattctaagaattgcaacacttgtgtgatctcttaaaaacacctccaactcatatccttgctagttgcttgatntaaggggaaattaagagagatttagtgcatatttaacttgcacctagtggcactagtttatatttatatccttagttttattgttactcttggaggttaatgccacctagatggctcggtggattcaaggaccattgaggggcttgcggtgattgtttatcgccttcgatcaagttgattataaggggagattgtgaagggtaacttgagtagaatgatcgtggctagttggagtgctccttattgattgattcttgcgtcatccaagttgcgggtctagcttgaatggctagttagcatagaaatcattatattgagacttgccataatgtgaatgtaggttgcaagaaaccaaccacattaataaatcttgtgttcatctcttgcgtatagttcgatcttgatcactacgcttgcgctttcattcctatattattatattccttgtagttatagctctcaagtgtaagtgcagcattgatcgattccatcggtctagtttagtgtagttgtagccttgatcaactgcttcagtgtgcttcaaacttgaattatggctctgtttgaagtacgatattgttcggttcaacttctttgagattctagacttatcctctatctgatctagccactttgttttagttagagtaactctcacagtgaatcgatatgccttgactctaattatttaccaaatcactaatcttgacacctttaatacattggtgaaaggaaaaaaacctaacaataagtccaagtgccgtcgccccaagtaatgacacttagacactactatgtgcctcacgaatactattactacattcgttctagaatagaatttattttagcatttactttttatgtctatattcaaatggacgataatgaatctagacacatatataaaacacatacatcaagtattgtatgaatccactaattttttaaaatggattttaatttgggacagagggagtacgccataaccggtcaccggggaagaagaaaataaaaatagtggacctcattgggaccctttgttataagccctagaaaacaaaattagccacaaaatgtttatattcattaatcaccgaaacccagattagttgtcttgatgcctctacatttccatgagcgaacacctggttcagatgatttgttttcacacttatcaaccgctaaaccttaacgtacactaagcctatatatataactaacagcatctttgcggtgctcgcacctctatatatatggtcgcagacacccttgtcgaatggagcccaaaggagacttcacaaagagtatagctgtatctctatagctctatagcgccgatagatccatcctctctttccactcctagctagctaacatatccacacatggcggccagttccaaggtcgtgtgcgcatgcattctcatcgttctcgtcatctcaagccacgccgacgcgaggcggctggtggcggcgacgtgcaacggaacggaaggcggagcatgcaagggtggcatcttcgtccaaggatatgcaggcctcagtgcaaggcagaaaatggcggccactgcaacgagcactgagcaggtcgtcggcggcggcggcgaaggcatgccggcgaccaccacggactcccggcctacggctcccggcaacagccccggtattggcaacaaagggaagatcaacaactagtttaattgccgtgtgtgttcttgtatgcgttcttatctaagtaataagcatccaattaagctgagtgctagtagcgcaccggccgtactcgtttattattgtaatctagtgcttgctgccagcgccaccatatttatgtccattttctcttttcatttggcattagtttcgtacgtgctcgtctctgtgtacaatgtccagttcacactgtgcattatgaacttttgtattattatcttgtaaccatgcatatgttcgcatgaattaaataaagttctgcgtctagctcatatggatatgaaaaccgatcgagatgcgtcacacacttgcatatatatatgtaactcctgtgttcttctatatatatagctaaccacctcgcaggaggtaattaactgaaacatctaatatataaactctgacaaaacattataagagaagcaaaatagcaagatcgtcaagacaagagggttttatatcattctcttccccatgcatgttttctgagagcatgtgcatatatgtgtggtggtggcccgatgaacaaaagtgagctgtggagaagaggggaacttggaggactgctggctacctagctatagctagatatggcattgtctccctccctgccttgacattctcccttctgccttgcacgaaacattgccgaatttgacaccatatccaactttccaagtatcgtcccaacccatccgaagctctcaacttgtgtttttttttctttgctactatatatgcattcggttttgagaaacgttagcaaaaggccaagaatcagcacatcacagattaagaagtggggatatattttatgacggcaggtttgcatgcccccattcgcacagattcgacgtcgttgcttaaaattattctccgcgcgcatgcatggttgtcgacaataagaaaccattagtccatgatgctctctcatcacggtttagtttagattttaggactgcgcaaaaacgttcagttgcggaggacgacgtatctgtgatgagtgatgactttatagtgcttacatttctatgctgatggcgtggtggcgtcacttctagttatttactcctggcttaaattctagttatatgctggtgcattgtta

SEQ ID NO: 16182 - DNA, 930 bp, Zea mays
  misc_feature (7)..(7): n is a, c, g, or t
ccggccngggaaaaaaaaaataaaaaaaagaagaaaaaaaaaagatataaaaggagaaggcccgttaaaggcccaagcgagtagtaaccctagccctcgccacccgcctccgcctctcctccagagccagccgccgtgcgctctcgctctccctctgtctgcgacgagacttggtgggctaccgccgctgcgcttcgccaggtgctgacgccttcgccgatcacttcgccggcgatagcactcaccaggaatgggcctgtggacattgctggagggttttttgcttcttgcaaatgcgttagcgatattgaacgaagaccgcttccttggtccaaggggatggagcatgtctgaagtatcaggaaacgggcaaaccaagtcgttcaagggccagatcgtggggcttatctacgctacacagtttctgcggatgcccttaattgctctcaacgttctcatcatcgttgtcaaattggtgtctggctgagcctgatgaattggtatctgttccacctttatgtaagagctaagagatcccaaagttaattgtactcaaggttgctgtaaatatgctgtttctgtttactctaatgtggatttctgttattgttgtcgtaaattaatttggtcagaaaatgactgtcgatattcatactatccaagcgggcactttattgggggtgtctttcttttgtacattaatgaattcaagacatatttgcaacgtccttgtatgttttgtgatcgcttcctctccattttatgcttatagtgcgtttcatggttgggtactgctgttggttcgaggcatttttctcatgcctgaggttaagtgctaatgcaaaccattgccgatccttctgtttggaaaactatttttggtcttggactgacgttgtgtgggaagacttcttgggtgaaaacctcaac

SEQ ID NO: 16183 - DNA, 820 bp, Zea mays
aattttggggcgaccacccgtccggacgatgaacgggaaatgtgtgcgaggactatttactgtacatttcattgacaagaaggtcactcaggcggatcggaaattgttctttgagtctatatgtggagaggtctttcggctgaggttgcttggtgactaccatcattctactcgcatcgcttttgtggaatttgtgatggcagaaagtgctaccgctgccctgaactgcagtggcgtgatactgggatccttgccaataagggtgagcccctcgaagactcccgtgcgtccccgtgcgcctcgccagctgatgcactagaggtgtcctaggtacaggaggtgcggaaggcactgcttatatatcatcatcatcatcatcatcatcatcatatatatatatatataatagagaatagacatatatgaaagaggggaggggaaaagtgtcgtcacttgttctaagttatgggctcggcctttttgttttgggttcttgcttcaccaccgtgtgactgagtactaaagtgcctacgtacgccccgggtcgacgccggctggcagggcccttttgtttactaccttgcacatagaaggagaggagatggagagcttctcactagaaggatcggaagcgcgcgcgggggggtctgcctgatgctcttgtccttgatgcaacaacaggcggaaaactcctggacttttaccctgctgttcagttgtttgctgctgtgtcctggttgctactgaaacaaactggttaaaaaaaaacttgggtattggagactatgtgccctgcctgttggtttggtttggttgctag

SEQ ID NO: 16184 - DNA, 2016 bp, Zea mays
caggcaccagtgcatcgccaccgtaccggagggggcagcgcccaaaaaaggcaaacgggagggtgggcgagcctgctcttcctgtctgggagagagaccgaagaagaggagagagaggcgcagcgcagcgcagcgcaggcgcgcatctcccccctccccttgccggctggcccctgctgcagctctgctccggtcggctctgcccccccgctctgctgactgctctgccgctgctgctgtcgcaggcgcgccaccaacccgccgatgcgcgcgtagcggcgtaggtaccatcatcatccatccccgcgacgacccaccacccacccctgcagtctgcagcatccccttccccactcccggctggtctgctgcggccacccctgcgccgatccacctccgctgcttcctgcctcaatatattcgcccgcctcgtcgcctccgaccccgccacagaaggccttccagaaccctccgacccctcacctccgctccgccccgctccactctcctcctcccgggccggccgactccgatggccgtcgtcgaggccgccgcagccgaccacgccgcgccgccgctccaggaggaggcaccgggcgcgggcgctggcgctggcgccgacgccggggagcgcgagatgcgggatctggaggacctgctctccaagctcaaccccatggccgaggagttcgtcccgccctccctcgcctcccccgccgccctcacgcccgcgccgctctcccccgccgcctacggcttctacccggccggcgccggcttcgcggtcgcctcgccgggccacggcggcgtcgtcggcttcccggccgtcgcggacgcccacgccgcacgaggcaggaagaagggcggagccggaggagggttcagcggccacggtcaccccgccaggaggcggaccaacagccgcaccagcatggcgcagcgcgacgagatcatccgccgcaccgtctacgtctccgacatcgatcaccaggttactgaagaaaacctggcagcactatttataaattgtggacaggttgtggactgtcgcatgtgtggagacccaaactcagtccttcggttcgccttcatagagttcactgatgaggagggtgcaagggctgctctgaatctgtcaggaactgtgctcggatattatcctgtcagggttctgccatcgaaaactgccattgcaccagtcaatccaacattcctacccaggtctgatgatgaacgggaaatgtgtgcgaggactatttactgcacaaacattgacaagaaggtcactcaggcagatctgaaattgttctttgagtctatatgtggagaggtctttcggctgaggttgcttggtgactaccatcattctactcgcatcgcttttgtggaatttgtgatggcagaaagtgctaccgctgccctgaactgcagtggcgtgatactgggatccttgccaataagggtgagcccctcgaagactcccgtgcgtccccgtgcgcctcgccagctgatgcactagaggtgtcctaggtacaggaggtgcggaaggcactgcttatatatcatcatcatatatatataatagagaatagacatatatgaaagaggggaggggaaaagtggcgtcacttgttctaagttatgggctcggcctttttgttttgggttcttgcttcaccaccgtgtgactgagtactaaagtgcctacgtacgccccgggtcgacgccggctggcagggcccttttgtttactaccttgcacatagaaggagaggagatggagagcttctcactagaaggatcggaagcgcgcgcgggggggtctgcctgatgctcttgtccttgatgcaacaacaggcggaaaactcctggacttttaccctgctgttcagttgtttgctgctgtgtcctggttgctactgaaacaaactggttaaaaaaaacttgggtattggagactatgtgccctgcctgttggtttggtttggtttggtttggttaaaaaaaaaaaaaaaa

SEQ ID NO: 16185 - DNA, 2121 bp, Zea mays
  misc_feature (1231)..(1231): n is a, c, g, or t
ggtcgggcccgccgggcccgggcagtcaccccgagcccaacaaaccactcccaccctgtggctcgtcctcggacgccaagccactccgcgccccaatccggaagcgccgccgctgccgccgatcgaccggccgtcgacccatgctccgcgcggcactcttccgctcagcccccgggctccgccggtctccggcgacggcccacttatccaccgccgccgcagcgtggctctccaacggccccgcctccaccccgcctagggtgcgtctcctcatcggcggggagttcgtcgagtcgcgcgccgacgagcacgtcgacgtcaccaaccccgcgacacaggaggtggtgtcccggatcccgctcactacggccgatgagttcaaagctgccgtcgatgccgccaggacggccttccccggctggcggaacacgcccgtcacgacgcggcagcgcgtcatgttcaagttccaggagctcatccgggctaacatggacaagcttgcagagaacatcactacggagcaggggaagacgctaaaagatgcttggggcgacgtgttccgcggcctagaggtggtggagcatgcttgtggaatgggaacactgcaaatgggcgaatatgtatcaaatgtttctaatgggattgacaccttcagcattcgggagccacttggtgtttgtgctgggatatgcccatttaattttcctgctatgattcccctatggatgtttcccatagcagttacgtgtggcaatacttttgttcttaagccatcggaaaaggacccaggggctgctatgatgcttgcggagctagcaatgggagctggtttgcctaagggtgttttgaacatcgttcatggcaccaatgatgttgtcaataatatttgtgacgatgaggatattaaggctgtatcttttgttggttccaatacagctggtatgcatatttattctagagcatctgctgcaggcaagcgtgttcagtgcaatatgggagcaaagaatcatgcaattatccttcccgatgctgatagagatgctacattgaatgcccttattgctgctggatttggtgcagcagggcaaaggtgcatggcattgagcactgctgtttttgttggcggttcagaatcatgggaggatgaattagtcaaacgtgcaagtggccttgttgttagttcaggaatggttaatgatgcagaccttggtccagtgatcagccgacaggnaaaggatcgtatctgtaaattagtccaaagtggtgttgacagtggtgctcgtatattgcttgatggaagaaagatggtggttcctcgctatgaagatggaaattttgttggcccaaccattctggctgatgttaaaagtgacatggagtgttacaaggaggaaatatttggtccagtgcttctcttaatgaaggcggagagcctagatgatgccatccaaattataaacagaaacaagtatggcaatggcgcttccatatttacaacatctggcgtctctgccaggaaatttcaaacagacattgaagctggccaggtgggcatcaacgtgccgattccagtccccctgccgttcttctccttcacgggcagcaaagcttcattcgcaggagatttgaatttctacggcaaggctggcgtgcagttcttcacccagatcaagacgatcacgcagcagtggaaggagtcgccggtgcagcgggtctcgctctccatgcccacctcgcagaagtgagacgtcaaaggacgctcacgccactctccaaagcttcacctccactccactcctctggacatagacccacgcatgggccacaagagaaggataattggtaggcatggcgacactccatgcacggccatgatactagtgtgtgctcgctttgctcttttgtctggacatcttgcatgcgcattcagaacatccaatgacgaaggtttagatatatgtgagcgctgcccattctgctgttagcattactgtaaaagccccaggtcctttgatcgggtgtcatgtgtaaacccacaataagaggagaaataaaaatgtcgccgtgctggtttgtggcatctctcaaaaaaaaaaaagcggccaactcgagacctcgtgc

SEQ ID NO: 16186 - DNA, 7875 bp, Zea mays
gttttatataaactttagaaaattcgaaggcataggtgtggatattattttgttttaactttaaaaaaactcaagggaatttggttctgttcaaaaataaacttttatatttctaggacatacagaacagagtattgaaggatatacttgttgtagcggtgagagttgtctctgtagcggtgagaccgtgttgagtcaccagcctccggtattgaatctctgcaccaaaaggagtatacgtttataagaaaaataataataatacgtatgtataaagcaaagtccaaagataaggacatggaaaactgtcttgatgtagcacacgcaagcagaaagtttaaacaaggaggtaagcctttgcaacttctgcgtgcaaagtttatgctttcttctcatgaccaagaaatggaacaatactaatcctgccctgaaagataaggatgatttctaggttatttttaaactcagagctgctagtctttgtctctaaggcatacttatgtgaaataagatcaaatggtgtggaataacagtagcctatacatttgtttgttccggaaaaaaagagaaagatctttgtttttgttattgaccaaggatcaatgttacctcagcatctatggatggttaaattaaataccgaagaagcttggcatagtttggcccctgtaggaacgacttggggctggcgtgcatgcagtagttagaaggtttattccactgagagactggagggatgatgagatcttttcaatagaaagcaagaatgcagggagcaccaagaatcttgtgtctttcccttagcttttttccccctgactggtgcttttatctgtgacaaacagtgcaaacaggcacgctagtcgcacagacttcattgagtaaaaagtccattccagctggaacaaaccattcggttcaatctgtgaagaagaggaataagaaatgggatcaactcacgatctaaatatagttgttggagttcttgattaattttagtttcaaaaataaataaaaaaatagagctcgatctcaatcccattactgattcgaagccccagatggcaggacggtgcgaaacaatgtggtcgcccgaaccgtctgtgttgcttccatcttttatccatgccatgtttgatcaatcgtgtttttttcctgcgttgataaaaaacctgtactgtttttatgcgcctttgattcatttatggctcatttagaaacttcattttcacaagtaatgtttattttccaaaaaaattagtttatttttttaggaaaatgaaaatatcttgataaaatgatgttctcggactagtccttaaaataattagttttccgggaaaaaaaaaactggggaccgtattttgcatagggctgcaattcaactgtgccttgttgccgtccccgcgacgtgccgtggccctggttgcccgagtacaccgtacacacggccgcccggcaacacgtgtgtgggtccgggacggagacgatggcttccgcctcccgcccctcgccaagtcgccacggcggcttcggccgagatccccggcgccggcgcgtgtactactactactacctccatggcgcaagccccgcaaaagcccatctgcaggccgcacccgcattgaactcgccgtcgcggcccagttcccggggagatatatatatcagatatatacgtcgtcggtgtatctggtctggccgcagcatggaactggaagccccgggccctgggctcacgtgtccgccccgccgcgcggccctggctccacgtgtcagctcccgctcgtcgccgatggacaccgcgtcaccggctcaccgcctgccgtgaccgagaggccacgtcgtctcgtccgtctactgtctggggcagccgggcatgcacgcagaattgcaggggcaccaaaggtagctggagcaggacgagccccgagatctcgcctcaggattgatgcatcattggcgactgcactgcacttcttcgccatcgatcctgtgggtcccctgattctccactccactatggcgccactaatccactccactccatctaatcaatttccagtgtatcgccaaaacacgcatgctttccttcctcgccatgccaagcatcgcccgcccgccctcgcacaagagagcatgccatggcccatggcctccgcggcgcgccatgccatcctcatatatacgacgaacatgtgctaagcttgccgccgcgtgcgaccgcgcctctccctccgctcaagcaagcaagcaagctagctagctaccttccttttccttgtgatggatcggaggcatcgtccttagcttgccttcacagccagccagccaaaccagctagctagctagccatgcccgccagtgccgccaccaccacaaccacctcctccgcggctccctctccctcgttgttgccgtgcttgcatgtccatgcacacggcagggcctcggctgcggcggcctgctgcctactcgtgctcgtgactttcctggtggtggccgcctgctggtgggaccccaggacgcgagatccgtccccctggttcctgtcgccgccgcggtctgccccctcttccttctcgtccttgacgagtgccggtggagttggcggtggtggcgagcacctattggccaccgccagctcgtactactccgccgccgccggcttcaggaacagcactggcaaagaggtgcaccaggaggtccggggtcatggtggtgatgatcgtggcttcctctccttcgtcaactccagcttcggctatgacgaagcgccgccgccatccgcaccggctccggcgtctccagtgacggtagtactgcgcatagcccgtaactagctggttaattgcatgcacgcacacccactagcagttaattggtcgtgcgacttactggaggaacgttttacagaacagcaggaactctgtttaaaaatgcccgttgagtcacgactgcacttgcaactgccaaattcactggtggtttacacacgtggaattcatggcgtgtctcctatctagtactcggactactactaccatcatgccacctttttggcagaacatatataatccaatgatgatgtaatccttgtttttttgttacagggaggctcagatgaggtgataatccaggccacgccgccacaggttgagaggagaagagacgacgtgaaactggagcgactagagcttggcctcgcgagagcacggtccgcgataatggaagccatcaggaagaaggacaaggtatctccgttgcctgacaaggactacgtgccgatgggaccggtgtacaggaacgcccacgcgttccacaggagctacctggagatggagaggcagctgaaggtgtacgtgtacgaggaaggcgagccgccggtgttccacgacgggccgtgccgcagcatatactcgacggagggcaggttcatccactccatggagacggagacggaggcggaggagggccggcggctgcggacccgggacccggcccgcgcccacgtcttcttcctcccgttcagcgtcgtcaagatggtgcagacgatctacgagcccggatcgcgcgacatggccccgctcaagcgcaccgtcgccgactacgtccgcgtgctctcctccaagtacccctactggaaccgcagcctcggcgcggaccacttcatgctctcctgccatgactgggtgggtagtaaataaattaaagctcttccatgctttgcgcgacatccatcatctcgctcgtcgagctgccacaggccacagacacagccatgacttgttggcttgttgcctctaattctctgtacgtactgtcgtcgtcatcagggcccgtacgtgtcgtcggcgaacgcgcagctgttcggcaactccatccgcgtgctgtgcaacgccaacacgtcggaggggttcgacccggccagggacgtgtcgctgccgcaggtcaacctgcggagcgacgcggtggagcggcaggtgggcgggccgtcggcgtcgcggcgcccggtcctggccttcttcgcgggcggcaaccacgggccggtccggccggcgctgctggcgcactggggccccggcgggcggcgcgggggaggcgacccggacgtgcgggtcagcgagtacctgccccgcggcggcggcgcgccgtcgtacgcggacatgatgcggcgcagccgcttctgcctctgccccggcggctacgaggtggcgtccccgcgcctggcggaggccctgtacctgggctgcgtccccgtcgtggtggacgacggcgagtacgcgctgcccttcgccgacgtgctcgactgggacgccttcgcgctgcgcctgcgcgtcgccgacatcccccgcctcaaggagatcctggcggccgtgtcgccgcggcagtacatccggatgcagcgccgggtgaggatggtgcgccgccacttcatgctgcacggcgggccgccccgccggtacgacgcgttccacatgatcctccactccgtctggctcaggaggctcaacgtcaggatcgcaacagctgaatgatgcacatgactgactgactcactgaccaatgtaacgatggatcttgcttacagtttgcaggcgtcatgcgtgtctgatctttgagtctagcgtgcgttggttgcattttgacacgaaggttggaggaatcttggtgtgcaagtggtttttgtaccctgtattatacactactaattaatacacacgctgtacgatcagaggaagtgcgtatggtggtttttgtaccctgtattatacactactaatccgttttgtatttttctagtctcttactctcatcatcaccattatccggaggaggggaatggtgatgcacgagacgacaggaggctcaccaccgtcgtcataataaaaaatagctttacgttgaccgttcatgggtgagaaagacaaggagacgatttagtttctcatcatcatgcatcaatctcttagctagctactttatcattgtccatatgatcggttctacagttgaaatgagaggattaagatagattgtgacagtcactcatcaaatatggtgccctattaacatacgatggcctattgtcaacccgaacgagcaacagtagacctccctcaaatgatatatatgcgacatagacattgtattagtcttttataaaactaatctctccacaaccagccgatctcaacacgcaaatcattcgtacattctaatcaaatgatatatatgcgacatagacattgtattagtcttttataaaactaatctctccacaaccagccgatctcaacacgcaaatcattcgtacattctaattgcaagctatctgtatacttccaattactcaattgatcctcgaagaaaagagggcatatctagtgcacatgaaagattgttacacataatacacatattaaattatcaccgctcattttagatataacgtctctagttaattatttaatttataaataacatctttcaccactacacaccaccacgttggaaatatagcaaacaactagagacgttagattaaaaggagttgtgatgatttagtcgtgcttaacgttcggcaacgtcagctcgcacttcggctgattgcaaattctgataggcacgacaccgaccgactgacgcactgcacactcatcacgctagccgccgtctcgtcaccactaaccacgatctctatctctctctgccaggtgggtcccagagacgccggcgccgccgctagcacgagaccatgaccctcgaggccggccgggagtcacccacgagcccaacaaaccactcccacccggtggctcgtcctcggacgccaagccactccgcgccccaatccggaagcgccgccgccgccgatcgaccggccgtcgacccatgctccgctcggcgctcttccgctcagcccccgggctccgccggtctccggcgacggcccacttatccaccgccgccgccgccgccgcagcgtggctctccaacggccctgcctccgccccgtctagggtgcgcctcctcatcggcggggagttcgtcgagtcgcgcgccgacgagcacgtcgacgtcaccaaccccgcgacgcaggaggtggtgtcccggatcccgctcaccacggccgatgagttcaaagctgccgtcgatgccgccaggacggccttccccggctggcggaacacgcccgtcacgacgcggcagcgcgtcatgttcaagttccaggagctcatccgggctaacatggacaagcttgcagagaacatcactacggagcaggggaagacgctaaaagatgcttggggcgacgtgttccgcggcctagaggtggtggagcatgcttgtggaatgggaacactgcaaatgggcgaatatgtatcaaatgtttctaatgggattgacaccttcagcattcgggagccacttggtgtttgcgctgggatatgcccatttaattttcctgctatgattcccctatggatgtttcccatagcagttacgtgtggcaatacttttgttcttaagccatcggaaaaggacccaggggctgctatgatgcttgcggagctagcaatggaagctggtttgcctaagggtgttttgaacatcgttcatggcaccaatgatgttgtcaataatatttgtgacgatgaggatattaaggctgtatcttttgttggttccaatacagctggtatgcatatttattctagagcatctgctgcaggcaagcgtgttcagtgcaatatgggagcaaagaatcatgcaattatccttcccgatgctgatagagatgctacattgaatgcccttattgctgctggatttggtgcagcagggcaaaggtgcatggcattgagcactgctgtttttgttggcggttcagaatcatgggaggatgaattagtcaaacgtgcaagtggccttgttgttagttcaggaatggttaatgatgcagaccttggtccagtgatcagccgacaggcaaaggatcgtatctgtaaattagttcaaagtggtgttgacagtggtgctcgtatattgcttgatggaagaaagatagtggttcctcgctatgaagatggaaattttgttggcccaaccattctggctgatgttaaaagtgacatggagtgttacaaggaggaaatatttggtccagtgcttctcttaatgaaggcggagagcctagaagatgccatccaaatcataaacagaaacaagtatggcaatggtgcttccatatttacaacatctggcgtctctgccaggaaatttcaaacagacattgaagctggccaggtgggcatcaacgtgccgattccagtccccctgccgttcttctccttcacgggcagcaaagcttcattcgcaggagatttgaatttctacggcaaggctggcgtgcagttcttcacccagatcaagacgatcacgcagcagtggaaggagtcgccggtgcagcgggtctcgctctccatgcccacctcgcagaagtgagacgtcaaaggacgctcacgccactctccaaagctccactcctctggacatagacccacgcatggccacaagagaaggataattggtaggcatggcgacactccatgcacggccatgatactagtgtgtgctcgctttgctcttttgtctggacatcttgcatgcgcattcagaacatccaatgacgaaggtttagatatatgtgagcgctgcccattatgctgttaggattactgtaaaagccccaggtcctttgatcgagtgtcatgtgtaaacccacaataagaggagaaataaaaatgtcgccgtgctggtttgtggcatctcacaaaaaaaaaaaaaagcaaaaaaaaaacccctagggcc

SEQ ID NO: 16187 - DNA, 2753 bp, Zea mays
tggagaacatttttttgttcacttcttaaatttaagatttagagagttatttagagaactattggagttgctcttgtatgcaacctgctgctgacatagagggtgaggtgcccatgtggcgatgtcccgtcaactcggcaagcaaaaagcaaacaaacccctcttgcaagaaaggaagcgaagaggatttcgcacggacacacggcatctactagtagtactagaagatgcgccacgatgccctctccttcccccttccccgcttcgacaagtctcgtcccccgcccccttattccattacgagcaactccgccgccgccgtaaagccatctcccccatccgccgccgccgccaccgctgctggtgggacgggccgtgcgtccgttccagcgaagaggagcagcgggtcggaggagccgccggcgaggtcgggccgcgggggatcgagatggtgctgtgggagctcacggccatcaccgcctacttcctcgggctgaggcgcacctaccgcctcgcgctccgcatccagcgccgcctcatcccgcccaaccaccccaggatccgggacttcgtctacaggtgctgccgtcgccgagccccgctgccgtgcgtccgcgctcaggacgccgtcgattccgactcaatccgtgtttggggtcgaggccgcctcgattcgatggtcaacatacaacctaggaaaggaaggggaggggaggtagatagctgattccgtgtctgcaacacacacatacacaacaggcccgcctatccgcagattaccacccgccactgattcgggaccaaatcctctcggcctgctaatcggcacgcacatttgcccgctccccgccctcacgatcggctactgatggcaatgtggcctgtgggtgccgctatacaatcgctcacgaaacattttgtcaccggtagccagtgccagatctagaaatccgccaaatggtatgcctgttggatctggaagtttgatatagggtactccgcgtccaaaaaattttattgtatatgtacaatacggtaaaatccatttacaaattcggtgaaaaaaactgtctagcaaatcggtattcgaagtaaaaactagcatactagtcaagtttaacagtttgtataaattgcccttcttctaatgcagataggaatgaaatctttatttcttagttgattgatctgtcagccttgagtgctgctcacaaaggtttcctagcttgctacctgatgccgagaaactaactaactccgtagcttctagagaatatcatgtagcttctagagaatatcgtatcatataagcttcagaagaaagttagacgagattgccattttgttcgtcgttgccaccagatcaaggcttctgcaagtctgagcctatgagtggacgagctagcgcctctgcaccaggcaatcaaaacagtgtggcgcctgtcgcttgggatcataactcacgaaacaagccaccacttgagattgagaggcagacggaacactgattttttttcatagtagtacgctgggctacaaggcattgccacggcttacctgacataccctgtagatccgcccatgctatggcagcttcagttttaggcaacatcctttaccttgccacaagctgctatgttggtggtgttgtgtccctacagcataataaacggggcctacaggaagggattgctggaagcgttcatatccttcaccttcgcttccccttgttccttcagtagtaagtaatcctatatggtatacgccaaggttttagtggcgaaccttatagagcaggaacacatattttcctgttaaatctatcttgtgcattcggtagttctgcattccattactcaaagtagcatacatgtaatcagggaacagatttacacaatgattccaatgcattttacatgaccaatcaaagctcgcatcattttttttccgccctccctcctcccgtcccccctctccgccgccaggcgcacacgggatgtcttcaacgtcgcagtgtcggtccacaagaacattcagcagagagacatagaggtcggccggaacctcggaaacgcgatccttcgctggcttgatcgcatgaagccatcagcggagatccgcccccgtcttccaggcccaccaaacggcagcacggccgagcagttcagacatgtatcgagcgcgagcaggggcgcgggggcacagaagacctcctcctcctccaaagcttcgccccacgactccagcgggaagatgctgttctcgcgcctcaacattgggcccaagcacttcccggttctgcccacgctagcacagcccaacaggatcagcgcgagcagccagtgcaggcgcatctcctactcctacgccccgttcccgtcggtcactgccaggaggaagggtgtcttccgcgaggacattgcgcagctgatggtgtaaggatctaaaatacttgccagcgatctcgtgtactgttttttttgtttttgggaactcggcactctggacttagtgatttgcccagatcagatgtctgatgtgtcttggtttaataataaagaagcgagcgagcgcaggggaaattgtcactgctgctgcggtttaggccattagatttgtaaccaaatgctcagatgaacagcatttcgtgtttggtaatgaacaccacaacatggccactggtttatgtgctaaaaaaaaaaaaattaaaaaaaaaaagaaaagggaaaagggcggcggctggcgatctagaa

SEQ ID NO: 16188 - DNA, 1218 bp, Zea mays
aaaaagcaaacaaacccctcttgcaagaaaggaagcgaagaggatttccacggacacacggcatctactagtcattgggtacctggcgcccggccgggtccttcccccttccccgcttcgacaagtctcgtcccccgcccccttattccattacgagcaactccgccgccgccgtaaagccatctcccccatccgccgccgccgccaccgctgctggtgggacgggccgtgcgcccgttccagcgaagaggatcagcgggtcggaggagccgccggcgaggtcgggccgcgggggatcgagatggtgctgtgggagctcacggccatcaccgcctacttcctcgggctgaggcgcacctaccgcctcgcgctccgcatccagcgccgcctcatcccgcccaaccaccccaggatccgggacttcgtctacaggcgcacacgggatgtcttcaacgtcgcagtgtcggtccacaagaacattcagcagagagacatagaggtcggccggaacctcggaaacgcgatccttcgctggcttgatcgcatgaagccatcagcggagatccgcccccgtcttccaggcccaccaaacggcagcacggccgagcagttcagacatgtatcgagcgcgagcaggggcgcgggggcacagaagacctcctcctcctccaaagcttcgccccacgactccagcgggaagatgctgttctcgcgcctcaacattgggcccaagcacttcccggttctgcccacgctagcacagcccaacaggatcagcgcgagcagccagtgcaggcgcatctcctactcctacgccccgttcccgtcggtcactgccaggaggaagggtgtcttccgcgaggacattgcgcagctgatggtgtaaggatctaaaatacttgtcagcgatctcgtgtactgtttttttgtttttggaacactggacttagtgatttgcccagatcagatgtctgatgtgtcttggtttaataataaagaagcgagcgagcgcaggggaaattgtcactgctgctgcggtttaggccattagatttgtaaccaaatgctcagatgaacagcatttcgtgtttggtaatgaacaccagaacatgtgcactcgtttatgtgctaaaaaaaaaaaaaaaaaaaaaaaattcttgtatttccggtgcgttgcattgcattgcatctagaaaaaaaaaaaaaaaaaaaaaaaaa

SEQ ID NO: 16189 - DNA, 989 bp, Zea mays
  misc_feature (26)..(26): n is a, c, g, or t
cctggggcaactccgccgtcgccgtnaaaccatctcccccatccgccggcggcgggccggtgctggtgggacgggccgtgcgtccgttccagcgaagaggagcagcgggtcggaggagccgccggcgaggtcgggccgcgggggatcgagatggtgctgtgggagctcacggccatcaccgcctacttcctcgggctgaggggcacctaccgcctcgcgctccgcatccagcgccgcctcatcccgcccaaccaccccaggatccgggacttcgtctacaggcgcacacgggatgtcttcaacgtcgcagtgtcggtccacaagaacattcagcagagagacatagaggtcggccggaacctcggaaaccgcgatccttcgctggcttgatcgcatgaagccatcagcggagatccgcccccgtcttccaggcccaccaaacggcagcacggctgagcagttcagacatgtatcgagcgcgagcaggggcgcgggggcacagaagacctcctcctcctccaaagcttcgccccacgactccagcgggaagatgctgttctcgcgcctcaacattgggcccaagcacttcccggttctgcccacgctagcacagcccaacaggattagcgcgagcagccagtgcaggcgcatctcctactcctacgccccgttcccgtcggtcactgccaggaggaagggtgtcttccgcgaggacattgcgcagctgatggtgtaaggatctaaaattcttgtcagcgatctagtgtactgtttttttttgtgttttgtttttggaacactggacttagtgatttgcccagatcagatgtctgatgtgtcttggtttaataataaagaagcgggcgagcgcaggggaaattgtcactgctgctgcggtttaggccattagatttgtaaccaaatgctcagatgaacagcatttcgtgtttggtaatgaacaccacaacatgtgcactcgtttatgtgct

SEQ ID NO: 16190 - DNA, 1838 bp, Zea mays
gcacgctctgctgagacgctcctctcgcccgcgccggcccccgcctcgccttcctcgtccccgcccccgcaccggcgcgcctcatacgcgccgcgtgctccttcacgcgctccgcacgtgggatgcgcaacctgctcctgccccgttgcctcctctccgcccccaccaccatggctcgtgcttccgtctccggttccgctgcggtggccaaagcactgatccctggagctccccgcggtggcggccgccttccttccctgcttcctgcgcgcctccatgtccccgggagcagccgcgtgctccgcggcgcctcgctccgctgctatgccgccgccgccgccgctgtggccgagcagagccgcatcaaggtgcagaaccccatcgtcgagatggacggggatgagatgacgcgggtcatctggaagatgataaaggataagctcatcttcccatacctggagttggatgtgaagtactacgatcttggaattctcaatcgcgatgccaccaatgatgaggtcaccgtcgagagtgccgaggctacattgaagtataatgttgctgttaagtgtgcaacaattacgcctgacgagactcgagtaaaagagtttaaactcaagtctatgtggcggagtccaaatggcacaataaggaatattctaaatgggactgtttttcgtgagcccatcttgtgtaaaaacatcccaagaatcctttctggttggaagaaacctatttgcataggaaggcacgcctttggtgaccagtatcgagctactgatatgattattaatggtccaggaaagctcaagatggtatttgtgcctgatggagctgaccctatggagctggatgtttatgattttaagggacctggtgtggcattatcaatgtacaatgtcgacgagtctattagggctttcgctgagtcctccatggctatggctctttcaaaaaagtggcctctttatctcagcaccaagaatacaatcctcaagaagtatgacggcaggttcaaagacatcttccaggaggtatatgaagagcaatggaaggagaagtttgaagaaaactcaatatggtatgagcacaggttgattgatgacatggtggcctatgctgtgaaaagtgatggtgggtatgtttgggcttgcaaaaactatgacggagatgtacagagcgattttcttgcccaaggttttggttctctgggtttgatgacttctgtgctgttgtcttctgacgggaaaacattagaggctgaggctgctcatgggactgtcactagacatttcaggctacatcagaaaggacaggagacaagtaccaacagtattgcctccatattcgcttggacccgtggacttgaacacagggcaaagctggataaaaatgatagtctgctggatttcacacacaaacttgaatctgcatgtgttgaaacggtggaatctgggaaaatgactaaggaccttgcgcttcttatccatggccccaaggtaacaagggagttctacctgagcaccgaggagttcatcgatgcagtcgcgcagcaactgcgaggaaagattcaactaccaactactgtgtaatcctgaacctgaagcctgaaaccgaacgaactggttcattgtgcattcggcgcacattttgatagggatggcgagatggatcagatctcaaaacattctttttttttttgcttcagccaaacatttcatggttgggtatataatgacccgttgatcaatgtattcagagcgatattgagttaaattattactagtcggtcgtcgtatttttcattttccaaaaaaaaaaaaaaaaaactcgagtgc

SEQ ID NO: 16191 - DNA, 1553 bp, Zea mays
cacgactctcggcaacggatatctcggctctcgcatcgatgaagaacgtagcaaaatgcgatacctggtgtgaattgcagaatcccgcgaaccatcgagtttttgaacgcaagttgcgcccgaagccttctggcggagggcacgtctgcctgcgcgtcgccgcgttggccgccaatcgcagtatcggcaccgttcttccccgcttctccagtccagctcaccagccgccccccctccgctgctgacactgcgaagtgcgaatcaaagccaccaccgcgcacaaaccatggcaccggtggaggcggagcagcaccggcggagggcgttggcgctcgcggcgcacgacgcctccggcgccgtctcccccatccgcatctcgcgaagggacactggagatgacgatgttgccatacagatactgtactgcgggatatgccactctgacctgcacaccatcaagaacgagtggaagaacgccaactaccctgttgtccctgggcacgagatcgccgggctgatcaccgaggttggcaagaacgtgaagaggttcaacgtcggagacaaggttggcgtcgggtgcatggtcaacacatgccagtcctgcgagagctgcgagggagggcacgagaactactgctccaagatcatcttcacctacaactcccacgacagggacggcaccgtcacctacggtggctactctgacatggttgtcgtcaacgagcgcttcgtcatccggttccctgatggcatgcccctcgacagaggcgcgccgctgctctgtgcagggataaccgtgtacaaccccatgaagcaccacgggctaaacgaggcaggcaagcacatcggcgtggttggactcggggggcttgggcacgtcgccgtgaagttcgcgaaggcgttcgggatgagggtgaccgtgatcagcacgtccccggggaagagggaggaagctatggagacgcttggtgcagacgcctttgttgtcagcggtgatgctaaccagatgaaggctgcgaagggcacaatggatggcattatgaacacggcctctgcaagcatgtccatgtacgcttaccttgctctcctcaagccccagggcaagatgatcctgcttggcctgcctgagaagcctctgcagatctctgccttctctttggttactgggggcaagactctggccgggagctgcatggggagcatcagggacacgcaggagatgatggacttcgcagccaagcacgggttggcagcggacatcgaactgatcggcaccgaagaagttaatgaggccatggaacgcctcgccaagggcgaggtcaggtaccgcttcgtcatcgacatcggcaacaccctcaacgcggcatcactagggagctcgccggtcccagctctgtagctgcggcacttgttgatcaacaaatgctcacataaacatattgttgtttgtcgatatatcgtgcgataagcaagtatatttggaataaaaaggaactcaatttaaacgcaagtaatactgtttgtcttaggtcctatttggggctttggtttac

SEQ ID NO: 16192 - DNA, 1572 bp, Zea mays
  misc_feature (1562)..(1562): n is a, c, g, or t
  misc_feature (1565)..(1565): n is a, c, g, or t
cattgggtacctcgaggccggccggcatctctacccacatctgctgcagactcgaggcgatcgaagcgtcattggcggcggctgcggcaatggcggggctgtcgctactgtgcggtgactgcggcgcgcagctgcgtagtgtggaggaggcgcaggcgcacgccgaggccaccaaccacgccaacttcgtcgagtccaccgaggccgtcctcaacttcgtctgctccgactgcggcaagccatgccgctcccagaccgaggtggacctgcacaccaagcgcacgggccatacggagttcgcggacaagaccgcggaggcagccaaacccatcgatctcgaggcgccgcttaagccggcctccgaggatgtcatggacgtagacacgtcggcttcggcgagtggggagccacaagagatggttgtcccggaggtgaacaaggagatgctcacggaccttgagggcatgggtttctcgacagcgcgcgccaccagggcgcttcacttctccggtaatagcaccattgaaggtgctattaactggctttctgagcaccaagaggacatagatattgatgagatgcctctggtaccagccaactcaaaaacggaggataacaagcccagcctgactcctgaggaaatgaagattaaagcacaggagctaagggatcgtgctcgtaaaaagaaagaggaagaagagagaagaatggaaagagaaagggagaaggaaagaatacgaattggaaaagaacttctggaagccaaaagaattgaggagcaaaatgaaaggaaacgcatgatagaactgcgaaaacttgagaaagaggaggagaaaagagctagagaaaaaatccgccagaagttagaagaagataaggctgaaaggagaaggaaactaggactgccaccagaagacccagcagctgccaaaccaagtgcaccgcttcctgttgaagagaagaagagtgcattgcctgtccggccagctacaaaggctgagaggatgagggattgcctaagaaatcttaagcaacagaacaaggatgatgatgccaaagtgaagagggcatttcaaacactccttacttacattggaaacgttgctaaaaatcctgacgaggagaaatttagaaagatcaggctaaccaatgctacatttcaggagagggttggaaatttgcatgtgggcatagagttcctggagctctgcggatttgagaaacttgaagggaacgagtacttgtttttggcaagggaaaaagtcgacaaggctatcctgaacacagctggagccgagctgaattctgccatcaccaatcctttctttggggtcctttgagtcgtaaaaaaccagtacaatgtatactcaaaactcttggtttctcactttgtttgacatcaactgggcgccaactgtagatttgtaagtctgtggtcggtatctgatttcatgaattattattgttgcatacagactagtacttgcgtgcatcgctgaggcaatatatcttccattctgttttcaaaaaaaaaaaaaaaaaaaaaaacagggcggccgcanaanaaaaatt

SEQ ID NO: 16193 - DNA, 1887 bp, Zea mays
cctcgaggccggccgggccgggcttcactctcggcaacggatatctcggctctcgcatcgatgaagaacgtagcaaaatgcgatacctggtgtgaattgcagaatcccgcgaaccatcgagtttttgaacgcaagttgcgcccggggccccccggcgccggcccggtgcggcggcccgggccggcagataaccaaacaccccaaactgcctgttcaccattttcgccccaaatctgccgaggggattagccgatcgaagcgtcatcggcggctgcggcaatggcggggctgtcgctgcggtgcggcgactgcggcgcgcagctgcggagtgtggaggaggcgcaggcgcacgctgagtccaccaaccacgccaacttcgtcgagtccactgaggccgtcctcaaccttgtctgctccaactgcggcaagccatgccgctcccataccgaggtggacctgcacacgaagcgcacgggccatacggagttcgcggacaagaccgcggaggcggccaaacccatcgacctcgaggcgccgcttaagccggcctccgatgatgccacggacgtcgatgcgtcggcctcggcgactgaggagacacaagagatggttgtgccagaggtgaacaaggaggtgctcacggaccttgagggcatgggtttctcgacagcgcgtgccactagggcgcttcacttctctggtaatagcaccattgaatgtgctattaactggctttctgagcaccaagaggacgcagatattgatgagatgcctctggtaccagctaactcaaaaacggaggttaacaagcccagcctgactcctgaagaaatgaagattaaagcacaggagctaagggagcgtgctcgtaagaagaaagaggaagaagagagaagaatggaaagagaaagggagaaggaaagagtacgaatcggaaaagaacttcttgaagccaaaagaattgaggaacaaaatgaaaggaaacgcatgatagaattgcgaagacttgagaaagaggaggagaaaagagctagagaaaaaatccgccagaaattagaagaagataaggctgaaaggagaaggaaactaggattgccaccagaagacccagcagctgccaaaccaagtgcaccacctcctgttgaagagaagaagagtgcattacctgtcaggccagccacaaaggcagagaggatgagggactgtctaagaaatctgaagcaacagaataaggatgatgatgccaaagtgaagagggcattccaaacactgcttacttacattggaaacgttgctaaaaatcctgacgaggagaaatttagaaagatcaggctgacgaatgcaacatttcaggagagggttggaaatctgcatgggggcatagagttcctggagctctgcggatttgagaaacttgaaggcgacgagttcttgtttttggcaagggaaaaagtcgacagtgctatcctgaacacagctggagccgagctgaattctgccatcaccaatcctttcttcggagtcctttgaatcgtaaaaggctacaatgtatactcaaaactctcgggttctcctttgcttgacatcaattgggcgccaactgtagatttccaagtctgtggtcagtctcagattccatgaattattatcagaccggattccgtacattgctgaggcaatctttgaagcaacttgctgcgcatatatgcttgggatctttccgatctcatcgcttcgctgaccttgatgcattttacaatgttctagcaccaaaaataagtgatgtactctgatgtatgcgttttacaacgacttcacttgttaatgacaacccgatcatctttaattaaacaaaaaaaaaaagaaaactcgagggggggcccggta

SEQ ID NO: 16194 - DNA, 2491 bp, Zea mays
ctgaaaaagctgtaggagccatttccatgatgttcagccattgacgttgagatttttgtaaccacatgcttattttttgcgacaggatgatgatgccaaagtgaagagggcatttcaaacactccttacttacattggaaacgttgctaaaaatcctgacgaggagaaatttagaaagatcaggctaaccaatgctacatttcaggtgaaaaaaaatcttgatcttttttggtgactgcttgctttgctgttgagcttgttcaagaataatgagatcgataaattctttgtttatgaacccaccttgcaggagagggttggaaatttgcatgtgggcatagagttcctggagctctgcggatttgagaaacttgaagggaacgagtacttgtttttggcaagggaaaaagtcgacaaggctatcctgaacacagctggagccgagctgaattctgccatcaccaatcctttctttggggtcctttgagtcgtaaaaaaccagtacaatgtatactcaaaactcttggtttctcactttgtttgacatcaactgggcgccaactgtagatttgtaagtctgtggtcggtatctgatttcatgaattattattgttgcatacagactagttcttgcgtccttcgctgtggcaatatatcttccattctgttttcatcgctctcccggcctccctgcattttacaatgctctagcaccaaaaacaagagcggatgttttttttttttttttacagcaacttcaatcaattcttagttatatgctagtacagtacaacatatcatctgaggacggagagagtcggcgaatcccccagtcatcatctttaatcaaagctgaacctggcgcccgtgaatccagctgaatggcgcgaactccggatccttggccttgttgtcgtgcgccctctcctccagcctcctgaaccggggccccagctcgcacacgaactcctgcgcgcggcggccttccccggacagccccgtgagttcctggacgccccaccggcggaccaggaactcgaggatgtcgacgtagtccctggccgtgtagacaccgatgcgctgcgcgacagcgctgaagcgcgcgaacagcccgtcgtcctggccgtcgtacatgaggtgggcgggcatggccaccttcttcctcatggtgtccgcgaaggcgcgcaccgtgtagtccgggtccacctcgaacagcttctcgacgatccgctcgtacgccgactcgtggcgcttctcgtcggcggcgattgtgccgcagatctgcgccagcttggtgtcgccgtaccgcctggcgtggcgcgccgtgttgccgtgggagatgaaggtggcgcgctcctggaacgacgtgtagacgaagcccatgtacgggttcgtctccgtcttgggatccatccctgaggcgatgaggtactggacggtcttctcgatctgcctcatgtccaccctccccgtcaggaagaggtatttgttcatgaggtcgccgtgcctgttctcctcggcggcccacgccctggtccacaccgcccagctggtcgagctggcgccggtctcgtcgcggacgccgccgtccagggtgttgagcatggtctggtacgtcggcagcgcctcctcggtgaccatgtcgcccacgaagcagacgaagtagtcgtcggggatctcccgggcgcgctctcgcagctcccggacctcgtcgtcgaaggactcggaggcggcgtccggcaggtagtctgcggctgccaggacctctccacgggcttgaggagcaccaggatgttgtccgccgcccacgactcgagcgactcgaagatctccgcttctgcgggggcagcgagtgcgccacggggcggtgtacctcgcgaggaggggcgaagggcttcctgctgggagctctcaccggggctgcggaagccatggccaccaccgaggagaaggctctccttgtactcactaggcaaggaggggcgaaggcgccgcaggaagggaacgccgccaccgccatgcccgccgccacttgtaatctccgcgatgctctagctagctacagtacataacaatgcaatgagcgagcgaccggcaattcaaactccaatgccgtatgtaatcggtactacgagaactggccgccggccgggcagtatagcgtggcccgtgtctgcagctgcctgagaagctcaaactggtcaccgtcgccatgaagaatgcatgatacgcatgctgtcgtgtccgctatccttctgtacgcccggggaaaagaacgaacaagaggatctgcaaacttgcttctgcttacagggccgcccgttactccagcccagataccagcgccatttacaggcctgatgcacattatattctgcatcgtgcaaacatttaacagacaaccaaatacagaatcttagtaagctgcaaaataagaaaagacaacttgatcgtgtccaacaacataaacctttctaccgagcatcgtcag

SEQ ID NO: 16195 - DNA, 1753 bp, Zea mays
aactatttacattctagatgttgtatatattatatgttttttgtacggtacacttgcattcgttcctatttcactctccctcccactggttttttcgaatattttgtacgtggttgcaaattaaattaagagcaactacctactaatctatagttacctcggcgccgccgggggtagtagcctcgtagggccaacatgaccgaactcaaaatgtgcagcccacctccaatcccgtagaagatagtgctgccctgccgaatgccgcccacctccaatcccgtagaagacaaagagagagggagagaactggacggcggcggcggcggagacgacgatgcagtggtacttggtggccgcgctcctcaccatcctcaccagctcccagggaatattgaccaccctttcccagagcaatggcaaatacaattatgattatgccacaattccttttttagctgagctcttcaagttatctgtctcaggcttcttcctctggaaggaatgccattcttcatctccaccaaggatgacaaaggaatggaggagcgtgcgactatatgttgttccttcagttatatacctcatccacaacaatgtccagtttgcgacattgacctatgttgacccatctacctatcagataatgggaaacttgaaaattgtcacgactgggattttgtttaggcttgtcctaaaaaggaagttgtccaatatacaatggatggcaattgttttattggctgttggtacaactacaagccaggttaaaggatgtggagattcaccatgtgattctcttttctcagcaccattggagggttacttgcttggaatactttctgcttgtctttcagctctagctggtgtgtacacagaatatttgatgaagaagaataatgatagtttgtactggcaaaatgtacaattatatacgttttggagttatctttaacatgggctggctaatttatggcgattttaaagctggatttgagctaggtccatggtggcagcgcctttttaatggttattcgatcacaacatggatggtagtgttcaatttaggatctactggtcttctagtatcatggttgatgaaatattctgacaatatagtcaaggtgtactcaacttcaatggcaatgcttttaacgatggttttatctatatatcttttcagtgtgaaagctacaattcagctcttcttgggcattatcatttgtataatttccctgcagatgtattttatgcctgtgcacatgcttattgagttgccacaaactttgcctgtaacatcaaagtaggttcatggcattgttagctaacccattgatcagctgagggtagggcactgttgattgagtggttaattgactatctgcagcccagctctatttgagtcatatatttggagatttatggttgtaatctcaacagctatggatatagacagctaggttagtttcatgttgcaggaaaggtgaatcaactgtcaagtgagcatgtaatgccaatacaaatggattgaaagttaacacctacatgccttccaatttttatccaggtaaaagatggaggctgattagttttgttgcctagggaaacgaaatccattcaaatgcaagttttcttaaaatagagcaaaactactcattcaccttgtatccacagttttgcattaatggagtcgatatggaactgacaagtacaatgagttatggcttcattacaaaaaagtacacaattttgctcc

SEQ ID NO: 16196 - DNA, 1642 bp, Zea mays
cattgggtacctcgagccggccgggaaaaaaacccccaattgcttgcttccatcgtcctcgtcgcctcgtcggcgtaaccccattccttgttacgtcgctcgtcatcgtcggctcatcgccgtgccgatggcggacgccgccgacaacagcatggcgctggtgcactcaagcctggcagactccgtgctgacgtcgccgcggacgttgaggcaggggcagaagtgggaggtggagtatgcgcgctacttcggtacgccgcggcgggaccccaccgcggctccaccatcagggctccgctacatcatgcggggcgtccaccgccaccagggaacctggatccccgcctcatgccccgcttccctttgcgtctgccaccctagcctcccctccgcggtccccgtcctcaccatctccatcggcgacgtcgtcttcgaggagcactttgtgtcgattctcaacttctcttggcctcaggttacttgtgtgacgcagtgccccatcagaggtagcagggtggtattcgtgagcttctgtgataagtttaaacagatccagaagtttgctgtacgtttcccacagccctgtgacgcagattcgttcttaagttgtgtggaatgctcatgcggaagcagcggaaccatggacatcataccatttggaaatgattatgtgtgtgaagattcatcagcatctgaatatattgcttctaatggacttcatcacaggctggatgatgcttcaaaccttgaggagcaatgttctgatcacacaatagatgaaccaccaatgaactaccacgaggaaacagaccagcctgttcttgaacctctcagtgctagcaacactagtaacaactctgctttccctcctagtttcaaccaaatgctgaaaaagtgttcaattgattatgaccaagaggaaccctgtccattggctgcatcaaaccatgtcattcaagaggtgtatgtggatacttctcatgctgttgccaatgaagaaaggactgctggtaaaggaatggatgctgctgagggagttgatgccagtatattaacatatgacctaatggcacggataaagacatatatggctgatgaatcctttaatgatatgttgctcaagcttgataaagccattgatgaacttggtggtgacatgtcgctgtagatagcaaaacctcttctgcggtgaaggaatgcaggcgtgcttcgtggcaccctacagcacatttctcaaaagttcagattgtgaagcaacagtatagttacttatggttatacatagtagatagatagtgtctatatagattacatgcaaagataaaaattcagtactatccactgctttttgccaataatttgcaatacatgcaaagttcaaaatacagacattttgcaaccatgctcatgtttatctagatgattaaacagtagcaggttctttcattgctaaatgcttggcaacaggtgatcacacatcgaaagaactgcctcaaagagtactcccaactatatccaagctgctgtaagtacccttgttgatgcacatgcacctttatgtaacggaaaagtatggtccttacagctacggtggatggaaaatcggaaagtgggtaaattcctttgctatagtgttaataat

SEQ ID NO: 16197 - DNA, 2630 bp, Zea mays
  misc_feature (671)..(671): n is a, c, g, or t
  misc_feature (755)..(755): n is a, c, g, or t
ttaactgatatggcttgggttcacgatcttcgtggtacggtcactactgtggtcatcgcggagttcattaacttagcggaagctgtttcagaggtattgttgttgcccgatacccctgataagcatatctggagattctcaagctcgggccagtattccgctaagtctgcttatgtgatgatcttcatgggctcaatcactttcgagcattgtgatcttatttggaaaagttaggcgcctccaaagtgtcgattcttcttatggctggttgcccacaaccgttgctggacgaccgaccggttggctaggcgcaaccttgaccatcccgacgcttgtgtcctttgtgaccaggaggaggagacgatcaaccacctgctgctgtcttgcattttcgctcgacaattctggtttattctactctagaggattgggtttgctggtgtgacaccgcaaccgggtaaagaggacttcatgacatggtggaaaggcatctccgctcccttgggggggtcttctcaggttggccttaattccctagtgatcctgggggcgtggtgtctttggaagtatcagaatgattgtgttttcaatgggatgagtccaaatctttctgctgccttagccatggttggaaatgatattatgctatgggagctggctggtgccaacgntctgtcgctgccagataatagcccccttgggtactgtagcgtatatataggcagaccataatatatgggccttaatgggccttnacaccccctgtcaaactcaaggcggaagtggaggatttgaagcattgagtttgattagatgaaactgatgttgtgccttagtttgtgcttttgtgaagaaatccgcaagctataattctgagggcacatattgaagatcaatggtcttctggtgacaatgagatctagtgaatgagacatcaacaccaatgtgttttgtgagttcacgcttcactggatcatgacaaatttgtatagctccagtattgtcacagcgaagaagtgtaggcgagtcacaagaaacgcctagatcagccaagagccaacgaatctagataatctcagcagtagtagtagccagggctcgaagttctgcttcagtactagatctagatacagcggcttgcttcttggatttccaagcgacaggggatgatccaagaagaatacagtaaccagtgatggagcgacgatctgtaggatcactggcccaggtagcatcagagtaagcatgaagctgaagtggggaatttgagtcataaaataaacattgtgtttttgtcccccgtaaatatctaagcacacgaagtaagtgcccataatgaactgatgtaggagcagagacaaactgactcaagatctgaaccgcatgagcaatatctggcctggtgacagtaaggtaaaccaagctgccaacaagatgtctatatcgagatggatcctccaaaggtgtcccatcagtcggacgaagagataagtgaagatccataggtgtggcaacagtgcgagtatcactaagaccagaacgatcaagaaggtcttgtatgtacttggcctgagaaagataaataccattttgagtctgcaaaacctcaatgcccaagaaataactgagtgcccccaagtcagacatttgaaattccttactcagagacgccttcacatgagcaatatggtctggatcatcgcctgtaatcaacatgtcatcaacatatagtaatagcaacgtgcgtcctcgtgaagaaacatgaatgaacaatgcaggatcatgatcactagaatagaaaccacaagccttgatgacagaaacaaatctctcaaaccaagcacgaggagcttgtttgagaccatacaaggctcgacggagacgacatacatgccctgatggaacctctatcccaggaggtggatgcatatagacttcctcatgtaaatcaccatgaagaaaagcatttttgacatccatctgagagatagtccaagaagatgaggctgcaacagcaagtaaagctcggacagtagtcagatgggccacaggtgcaaaagtctcatcatagtcaataccctgagtctgttgaaaacctctggccacaagacgagctttatatcgctcaatagacccatcagatttggttttaaccttgaagacccatttgcacgtgataggtacagcaccagcaggtaacggaacaacatcccatgtacatgtgcgatgaagggcatttaattcatcagtcatagcaagctgccactcaggtataccagaagcctctttataagatgatggttcagcaatgactgcaccggcacgggaaaacccataacgttctggagctgcaatagtgccacggtcacgaagatgatacccctgattaaaaacaacatgagagtcaccattgttagtacaagtatcagcaacaggatcgtcatcaggactggccgtgggagtagagcgaggacgacgaatgtaagtctgagtaacaggtggtttggaatagtaagactgagatggtgtggaagtggaaggtggtgtgatgagaataagaacatccggtgtagaaacagtaggtggcaatactgatgaagtatcagaaatgggaggaaggctcagaagga

SEQ ID NO: 16198 - DNA, 1779 bp, Zea mays
cattgggtacctcgaggccggccggggcccccgcgtgcggagcgtgcttgcctcgcactgtcacagtcgtgcactccctgtccccgtggactgtggagagtttctgtcggtggtcgccccgcttcatctgtctcatcttccccagcgcagcccctcccccctgtagcctgtatccgccccccacactctgcgtctgtagtcttctttctcgcgtcggcagtcagcttggcagggccgaaccaatggcggtcgacccgcggcaggtggtggcgggcttcctcaccctctccatgttcgtcatgctcggcaacatgatcaagcacgaccacttctctcccgtcaccgaggagctgggcttcgaggcaacaggtgtggtgtcgaacacaaggaagcttgacaacgatgctgaaatgagcagcgtcgatacggctggagtggaggacctgatggacgctgtcgaggaagttaaaccttgctggaccaaaccaagtccaaaaaatcagccgtctaatggttttgttacattctccttgactatgggccctgagtatcacatctctcagatcacagatgctgtggttattgcaaggtatctaggtgcaacacttgtactcccagacatcagaggaaatgaattaggaaataagcgaaaattccaagacatgtacaatgtggataagttcgtgaggagcctggatggtgttgtcgaagtaatagaggatatacctgatgaagtgagtgctaagaagccagcagtcatcagagtaccgaaccgtgtgactgaaagcttcatcacaggcaccatccagcccatcttccaaaaaaacaagtacttaagactagcggtcattttctcttccgtaagtttaaggccaaaggagacgaacaacaaggacatggacgcaactgcttgccttgcgatgttcggtggcctcgagctgaagcacgaatattctgaggtggccagaaaaatgctggataggcttcaagaattaagcaagaagtcagatgggaaggtcttggcgatcgatttgcggaccgacttgctggaaaagaagagttgcaagacaacccgcggcgctcgaagaaaaggctgttatagccctgatgaggtcctggctttcctgaggagtgttggcttctctgctaacacaaccatctacttgacagagacttcgtggcacaaaggcctggatgttctgaaggaagaattcccaaacacttggtataagggtgacattatgccagccgagaacaaagctgaattcctgaaatccagcaatgcagacctagcaagggctctggaccttgagatctgttcgcagagcgacgtgttcgtccctgccgtcgctggcctgttctacgggcatgtcacgggtaagaggatcgcgtccggacgcacccagatccttgtgccttcccagtccagcacctcgacacatgcttcagacttcatctccacctacatctccaacaagaaccaccttgcctacgcgtgctactgctaagcatccttttgtacggccgttaataagatcagctgaagggaaagtgctctgggtgcatatacaagtacctctcgtggacatgaatgatgttgtacactagctaatgttttgttatgaggaatattagcatacgactgtgtgttggttacttgtttggatattaaactctgaaacagcagcaaggagcatatactgcacgttcctgttggcgcgcaccatcaaaaaaaaaaaaaaaaaaaaatagggccctcgagggagggccgcgggtacc

SEQ ID NO: 16199 - DNA, 2469 bp, Zea mays
gccggcctgggcccggtagaagaagaagcagaagtactcaatcccgagactaacgccgagccgtgttgcggtctgcggagcgtgcttgccacactcacagtcgctcactccctgtgcagctgtgctcctgtcggttgtcgccccgcttcatctgtcgtctcctccagtgcagtccctcccccccctgtctccgccccaactctctccagtctcctcgcgtcggcagtcggcctggcagggctgaatcaatggcggtcgacccgcggcaggtcgtggcgggcttcctcaccctctccatgttcgtcatgctgggcaacatgatcaagcacgaccacttctctcccgtcaccgaggagatgggcttgaaggcaacaggtgcgcgatccaacacaatgaagcttgataacaatgctgaaatgaacagtgtcgatatggctggagtggaggacctgatggacactatcgaggaagttaaaccttgctggaccaaaccaagtccaaaaaatcagccatctaatggttttgttacattctccttgactatgggccctgaatatcacatctcacagatcacagatgctgtggttgttgcgaggtatctaggtgcaacatttgtactcccagacatcagaggaaatgaattaggaaataagcgaaaattccaagacatgtacaatgtggataaattcgtgaggagcctagatggtgttgtcgaagtaatagatgaaatacctgatgaagtgagtgctaagaagccagcagttatcagagtaccaaaccgtgtgactgaaagcttcatcatggacaccatccagcccatctttaaaaaaaacaagtacttaagacttgcggtcattttctcttcagtaagtttaaggccaaaggagacgagtaacaaggacttggatgcgactgcttgccttgcaatgttcagtggcctcgaactgaagcatgaatattctgaagtcgccagaaaaatgttggataggcttcaagaattaagcaagaaatcagatgggaaggtcttggcaatcgatttgcggaccgacttgctggaaaagaagagttgcaagacaaccagtggcgctcgaagaaaaggctgctataaccctaatgaggtcctggctttcctgaggagtgttggcttctctgctaatactaccatctacttgacagagacatggtggcacaaaggcctgaatgatctgaaggaggaatttccaaatacttataccaaggatgacattatgccagctgagaacaaaggtgaattcctgaaatccagcaatgcagacctagcaagcgctttggaccttgagatctgctcgcagagtgacgtgttcatccctgctgtcgctggcctgttctacgggcatgtcacaggtaagaggattgcatctggtcgtacccagatcattgtgccttctcagtccagcacctcgactcatgcttcagatttcacctccacctacatctccaacaagaaccacctagcctacacatgctactgttagcatgcttttgtactgccattaataagatcagctgaagtgagccgcagggtagtgctctgggtgcatatacaagtacctctcgttagtcgttaacatgctgttgtacactggttgatgttatgttatgaggaataaatattagcatatgttgtgtgttgtttacttgtttggatattaaactttggaacaacagcaaggagcataatgactgcttgtatgctgtaaaatgaacccgaggttaggcgtgtgaaaagagtttgcttcatgtaccttgattcatcaccttctgtctgctcaccaattgatgtagtaattgctccggaagtctccatggaagcaatgtatagatgtgcgtgagatttgttaatctgctgtgtggacgccgaattgtgactcaagggcattgtaatttggagccaattgcgactcaagtcgtttggcagagcttttaggctgaatctaagctgttaaactgtcctttttacagaggtgattttcttaaatgtagtgattttctgaaaataaatcagctggttggaagctggaaaaggtaaattattcttgattcgctctacacataattactttttacttgaaatttatcctagagaattataaacaatcttctcttccttgtaaaaaaacatgacttgtcactttcgtagagaatcaggagctatcaaacagcctccgatttccatcgatggtagcgaggtatctgccagggcatgttcaaactggccgtgcgttttgtggacgagcgagggagctccgcgcccacgagggcacgaagtcctgctcccctgtccggctgtcccagatgcgtcgtggcatgggcgttgggctccggccccttggactgggagaaggacgtcggagtcccggtcccaccgtttagcgcgtgtttggttagcgggttgatgcgggttggaatgagttaaacccacatcaattc

SEQ ID NO: 16200 - DNA, 4222 bp, Zea mays
  misc_feature (9)..(10): n is a, c, g, or t
  misc_feature (2386)..(2386): n is a, c, g, or t
tcgggcttnnagtgagtggaggaactaatgcctatattcagtgttggagggccgttgaaggcaatggtcaattatttcacatctctggaagtggtaccgaccagaatgcggagtttcgcctctggggtcatgaaggtcctgtgacttgtcttgccctggattcactgaggatttatagtggttcttgggacatgactgttcgtgtttgggacagagaccagatggagtgtgtgcaaaagttcatgcatgcagactgggtttgggatcttgctctgcgtggaaatactgttgccagtactgctggtagagatgcatatgtatgggatatcagggctggcgagttaacaagcttaatttccaatgcccatgttggtagcgcatattcaattgcttggacacacctgccagatgtgctgtttactggtggagaggatggtgctattcgattgttcaatgtttctgatgtctgtgatgatgagggtgacattaaaccagtggcaacttgggtgccacattcaggtcctgttcattctcttgcttttgagtatccatggcttgtgtcagcctcgagtgatggcaggattgcacttattgatttgaggaagcttctgtcctccaaaagttcatcaaagggtctgcgtgttaagagagttgatggaagcgcaatagagcctccacagaggatgcttcatggcgttggatgtgatctcttctccatcgctattggtgcagataggattgtatgtgccggtgaggatggttctgttagagtctggaacttctcagaagcattggagattgagaggagggcacaggctctaaggagtttgaggcaggagaaccgcatcaggcggaggaaatcacaagcggagatgaatacaaatactagaaggcctgaccagtgttcaatagccatgaaaaagaaccaactgaagggtgataagagcgcaacttggcacaacaagcgtgccattaatgagaaggccaagtcttagattaggattgtcattggtagccgttcactgagttgcagtctatcgtggccatacattgccatcactgggtactttcttgttggtcgtacttgagattttattttcactgaagccgggtctagtaacacgttttcaacattgacacattcaaatgttcaactttatgtggttatacaattaccaacttaatatatgcaaatcttctatgcctagcatatattgatcaaaaaaaagataagttccacaaacctttcgagttctgaaagcttttggtcttttagctttcatgttactgtaaaagaatatatttagttttcagtgtccgggtatttgtactgaaggcccttctcccttctataaattagtgttcttcatcaagaaaaatcatgtggttgtacgccaccatcattgtcaatggtaggtttgcatttcatagtaaactgctaatcggacagtgccagagtcgtaataagtgttactgtacctgaggcgggctatcgcatgagtacggtcttgataaatcgaggcaacctttctctttgcaaatgcagagaggccgcttgaaacctgagatgcggtgagtcatgaaccagctaatgagccaagtgttacgtattatacttgaatcagataaaatttaaatgcatatatacatatgtttttctgattttcagatgtatatatattactacggtatagcacatttacttgtgagagcgtttctgctgtaatgcgcttgttggcggtccagaaattcagtttatttattatgtgtttggttcgaggataaagtaggatgaggtgggagcgacacatttctctcgattttttgggatcacgctgccacctaaaattgctctggtgtttattctgccctcacgtaacactaaaaaaaaatgtggtcgcccctttttatcccttattgtatgtctaaccaaacacacaattagtgtcttagatattgcgagctttgtgaaggcctcaacgaattggatgccaaggactcgtttggaatgggggaagttctcttatgcctatgtttttcttctcctataaaattaagctgattcatgtgaactttatgcatcatccttgggaaattaaagcatttcgggcaggcccgaacttttgtctttttggtggtgccatattttcaagaattcagtctcagcagtcagcagcactcactctgatgtctgggctttgccgctctgggcactgggcaatctaacccagcgttctgaatcattggcgatgtcaggacgcccaattttcaatgcgtatcttgttaggctaagggtatgtttgggaacaaggattgaatgagctaaaattcacttgtttaaaattgaacggctgttgttattcaatcgagtgtggccacgtgtttnagtttcagcatggttggacggttggaccgtacggtggggtttttgatcgcacggctgggtctatttcgatggccattacttggtgtggatattatataggtacgctggtacggtacgaacggatagtccgagtccaccagaaattcaccgttccatacatatatcgtcctcgtcaggacgatgcgccgacgaagactacgaagccgcccgtgccgtacgagcgtttgggactccagggccgtaggtacagccagagccgctcatcctgtcgtgaacggctgcggcaccggcacggcggtcagaaaaccgtcgacgggtgtggatccagggccggctccagtttcagtgcttcacggaacgcttcacattcctccgataggttataaaatacaccatccgatgcttttagggttatgcaaactctaactcttccatgccttcgctttcgccaccgctgtagtttccgtgagcgtcctacgcggacgccgtaatccttccgcgattggtttgttcgacaaaccctagcttgagctcctgtcgagcggtaaaccttcgaccatagtcgggcaacatcctcgtgagttcgagaaatatggaataatggcaaccagacgggtacaacgtcgtagtagatttcaaaaaaaaaaaaaatcaacatatttcttttgttcaatttagaattacatcctcgactccatatttttccaaatccatatgatgcatgttaccaagatatctttgttttccacaacttataacttaaagcggatttgtaccagctcagctaaaatcaaatttcgagaaatctacctgcaaaacgagcgttgagtcaatgagtgactcacgaccgcgaaaggctctgtcgcggttacttttaccgcgacgccaacctgccgtacatccttggcgtaccgccgccggcggcccgtgctgctggtgcttccacgataggaacgcacgcacgcgctcgccgtcccccgtccgcggactttttcccgcccgccgtcgttttctgcacgtcatcctccctccgttcgcgtccgaggctggggcagtggggcctggcctctcgcgcgcccggtcgagctcgccacgtcacgtctctacgccacgtagcctgtcagcgccttgccggtctcgttgccgcgcaaacgggggcccacgcgtgttgcgacggcgacgacgacgacgtacggtgcggtcgtcgtctcgtccccatattggacgacgatttctatacggccggccgggctcgggcacacgaaagcacatgcacgctcactcgtttccgttgcctactgcctagccgcttttttgttcgccgtgaccgtgtggtgttttttctaactaatactcctacttcatttgcagcgagtctgcgaccgtggttttttttaaagtacgtggcagaagaaagaagcatgcgttgggggaccgttgatccttttttattggagaacaaaaatcaagcctaatgtgctaattgccagatgctagctatagcaatcaggtttggtgtggctgtgtacaatctagttgtgtagacgacggaatatcactcgatatgatcgactaagattaacaaagcttctttttttttccaaaaaaaaggtatgaggtttgatatgagcaagatttggcataagattaaacatatagtagtcctagactggatacttctaatgactaggtcgaacctgcttattacacacgcacacacaggatcctatatgacaccagtggcggagcgctcggtattgcgagctatggcgcttctcataccttactcgatcgctgggagccgaatcttggtagcgaggcagacgtggacggaaa

SEQ ID NO: 16201 - DNA, 2111 bp, Zea mays
aagtccgcccccggcgtcaacacgacgtttaacggcggcgcagagcgctaatccagcccaaacacgatatataacggtccgcgcctcccgaagacgccaagaacagcctcaggttactcgcagaaaagatttattagctcgctgcgggggtcgaaccgaggctcctagctgatcgcgcgcgcacagggcgagcggacaagaaagcttgctttgtgctcaccggcggcacggaccccctgcgatggaagccgtcggcgtcactcctgcccccgtggcggcgccggagaagaagaagctgcttgacctcaaggaccccttccccgccgccgcgaacggcggcgccaaggcgtccccggcggcgaagtgggcgatgaagaagaagctggtgggcggcgacgccggctacgtgctcgaggacgtgccgcacctcacggattacatgccccagctcccgacatacccgaatcctctccaagacaacccggcgtattcagtcgtcaagcagtatttcgtcaacccagacgacaccgtcacgcagaagattgttgttcataagaccagtgccaggggcacccacttccggcgtgccgggccacggcagcgggtgtacttccagtccgatgaggtgaacgccgccattgtcacctgtggaggcctctgcccgggattgaacacggtcatccgcgagcttgtttgcggcttgtatgatatgtatggcgtctccagcgtcgtcggcatagagggtggatacaagggtttctattctaaaaatactgttgcgttgacaccaaagtcggtgaacgacatccataagagaggcgggactgtcctcggaacctcaagaggagggcatgacactgccaaaatcgttgattgtcttcaggaccgtggcattaaccaggtctatattatcggaggcgacggcactcagaaaggcgcttctgtaatttatgaggaagtccggagacgcggcctcaagtgctctgttgtcggtgtcccaaagactattgataacgacatcgcggtgattgacaagtcgtttggattcgacactgctgtggaggaggcccagagggccatcaatgctgctcatgtcgaggctgaaagtgcggagaacggcatcggtgtcgtgaagcttatgggccgcaacagcggttttatcgcgatgtacgcgactctagctagccgtgatgtggactgttgtttaatcccggagtcacccttctacctcgaagggaagggaggactcctcgagttcgtcgagaggcggctcaaggacaacggccacatggtcatcgtggtggccgagggtgctgggcaggacctcatcgcgagaagtatgaattttgtggacacccaagacgcttctggaaacaagctgcttctggatgtcggcctttggctatcccagaagataaaggatcatttcaagaagaagcccagcttcccgataaccctcaagtacatcgacccgacctacatgatccgcgccgtccggtcgaatgcttctgacaacgtctactgcactctgctggcccacagcgccctccatggcgccatggcggggtacaccggcttcacggtcgctccggtcaacggcaggcacgcctacatcccgttctataggatcaccgagaagcagaacaaggtggtgatcacggaccggatgtgggcgagggtgctgtgctcgacgaaccagccctgcttcctgagccacgaggacgtggagaacatgaagcacgacgacgacgagcaccaccacatgcacaacacgcagctcctggaaggcgggagctcgccggtgtccaaatgcaatggctcggcagcggcagtgtgaggggcacgagaatacgcaaggatatagatatatatagtattaagcatgtagctatggatgttttttttccttttgcttttttgggtgctggcgttgtagagagtatttggtaataataatataatgcttcgctgagattaaatctcaaaaaaaaaaaaaaaaaaaaaaaaccaaaaaaaaaaattaatctaactcgggaataaaaaaaaatataaaacgggggggcggcgggggggggccacatttttttttcttgtaagaaaaaaaaaagggc

SEQ ID NO: 16202 - DNA, 1380 bp, Zea mays
ccttggggtccctcgaggccggccgggaagaacagcctcaggttactcgcagaaaagatttattagctcgccgcgggggtcgaaccgaggctcctagctagctgatcgcgcgcgcacaaggcgagcggacaagaaagcttgctttgtgctcaccggcgggcggcggcacggaccccctgcgatggaagccgtcggcgtcactcctgcccccgtggcggcgccggagaagaagaagctgcttgacctcaaggaccccttccccgccgccgcgaacggcggcgccaaggcgtccccggcgacgaagtgggcgatgaagaagaagctggtgggcggcgacgccggctacgtgctcgaggacgtgccgcacctcacggattacatgccccagctcccgacatacccgaatcctctccaagacaacccggcgtattcagtcgtcaagcagtatttcgtcaacccagacgacaccgtcacgcagaagattgttgttcataagaccagtgccaggggcacccacttccggcgtgccgggccacggcagcgggtgtacttccagtccgatgaggtgaacgccgccattgtcacctgtggaggcctctgcccgggattgaacacggtcatccgcgagcttgtttgcggcttgtatgatatgtatggcgtctccagcgtcgtcggcatagagggtggatacaagggtttctattctaaaaacactgttgcgttgacaccaaagtcggtgaacgacatccataagagaggcgggactgtcctcggaaccctcagaggagggcatgacactgccaaaatcgttgattgtcttcaggaccgtggcattaaccaggtctatattatcggaggcgacgggactcagaaaggcgcttctgtaatttatgaggaagtccggagacggggcctcaagtgctctgttgtcggtgtcccaaagactattgataacgacatcgcggtgattgacaagtcgtttggatttgacactgctgtggaggaggcccagagggccatcaatgctgctcatgtcgaggctgaaagtgcggagaacggcatcggtgtcgtgaagcttatgggccgcaacagtggttttatcgcgatgtacgcgactctagctagccgtgatgtggactgttgtttaatcccggagtcacccttctacctcgaagggaagggaggactcctcgagttcgtcgagaggcggctcaaggacaacggccacatggtcatcgtggtggccgagggtgctgggcaggacctcatcgcgagaagtatgaatttcgtggacacccaagagggggcgcggacccgtcatggccaagaccatcgcgggcaccatgctcctcgtactagtctctgcttctacagcgtcgc

SEQ ID NO: 16203 - DNA, 2104 bp, Zea mays
cgggaaccttctatcctcccccttttgggttcggtcctcctccgtccgtcgccgtcgtcaaacctcaagcgcgacgtgtgtaaacggcggcgcagcgcgctgatagtcctgtaaataacggcccgcgccggccgcgggcgccaacaacagactcagactatactcgcagcagaaaggttagttagctggccgcgcgcggggggtcgaaccgagactcttcgtcgcgcgcgccgcagggccagcccagcaggcggcggacgcgaaagcttgctcagctctgtgttcaccggcggcacgggccgtcccggcgatggaaatccttcggtgtccctcctgcgcccgtggcggcgccggagaagaggaagaagccgctcgacctcaaggaccccgtccccgccgccgctgccaacggcggcggcgccaccaaggcgtccccggcggcgaagtgggcggagaagaagaagctggtgggcggcgacgccggctacgtgctcgaggacgtgctgcacctcacggattacctgccccagctcccgacatacccgaaccccctccaagacaacccggcgtattcagtcgtcaagcagtacttcgtcaacccagacgacaccgtcacgcagaagatcgttgttcacaagaccagcgccaggggcacccacttccggcgcgctgggccacggcagcgggtgtacttccagcccccccgcgtccgcgccgccatcgtcacctgcggcgggctctgccccgggttgaacaccgtcatccgtgagcttgtctgcggcctgtatgacatgtacggcgtcaccagtgtcgttggcattgagggtggatacaagggtttctattctaaaaacacggtcgcgttgacaccgagatcagtgaacggcatccacaagagaggcgggacggtcctgggaacgtcgagaggagggcatgacactgccaagattgttgactgccttcaggaccgtggtattaaccaggtctatattatcggcggcgacggtactcagaaaggcgcctctgtgatttacgaggaagtccggagacggggcctcaaatgcgctgtggtcggcgtcccaaagaccatcgataatgacatcgcggtgatcgacaagtcgttcggatttgacactgccgtggaggaggcccagagggccatcaacgctgctcatgtcgaggctgagagtgcagagaacggcatcggtgtcgtgaagctgatgggtcgcaacagcggtttcattgccatgtacgctactctagctagccgcgacgtggactgttgcttaatcccggagtcgcccttctaccttgaagggaagggagggctccttgagtttgtcgagagacggctcaaggacaacggacacatggtcatcgtggtggccgagggtgctggacaggatctcatcgcgaaaagcatgaattccgtggacacccaggatgcttcgggaaataagctgcttctggatgttggcctctggctatcccagaagataaaggatcatttcaagaagaagccccgtttcccgataactctcaagtacatcgacccgacttacatgatccgcgccgtcagttcaaacgcttccgacaacgtctactgcactctgctagcccacagcgcgctccatggcgccatggcggggtacaccggcttcatcgtcgctccggtcaatggcagacacgcctacatcccgttctataggatcaccgagaagcagaacaaggtggtgatcacggaccggatgtgggcgagggtgctgtgctcgacgaaccagccctgcttcctgagccacgaggacgtggagaacatgaagcacgacgacgacgagcaccacctgcacaacacgctgctcctggactcgccggaaaactcgtccaaatgaaatggggcacaagacttgttttgcttttttgggtgctggcgttgtagagattagcgaccgctatatgatagggttggataatgtgagcattttgtaataatataagcttcctgaagtaagctcgttttggctgttcgtgtattaatttcggttgcatcctacgtgtattaacttcgtcagttgagagcaatgcctataccgatctgttgacgctt

SEQ ID NO: 16204 - DNA, 1189 bp, Zea mays
ttttttttttttttttattggaagagaagtccttagtacatgcaacagtttattgtgtacagaatgggcatgtatataaggagtcagtatctgcagtctttgcctgtgcgctgcatggtataatctataataatgttaatgtacagtgagattgcttgctgttgctggcccgtatggcgatggcgagggggggtcttggtcatggagatggcctggcaaggtactgcagccacacttcagggaggccatggttcctcttgagcgttctgaacgcagattttgtcaagggcacagccatgatatcgtactccttgggcgccctgggcatcttgcgcagcttcatgtttgcctgctccagtgtcttctgccccttcctggagttgcatcttgcacaggcagtcaccaaattctcccattcccatttaccgccacgcgagatcggaataacatggtcaattgtcaagtcgtcaccacaagaacaatattgacaggtgaagtcatccctgtaaagaatgtttttacggctaaggctctgcttgacccttcttctctttactacctgcagcaactgtggaaccctcaaaactgcagggatgtagaaggacccgctaggcgaagagacggtctggtcgtagtactccaacacatgggccttcccaatgaactccaggcagatggcgcgcctccagcacaccacgttgacaggcctgtaggagagatcaagaaccaggcccctgaaaccggacagctcgtcggaggcgtactcctcctcgtccccggcgtcgacgatcaccacgtcggcggcctcgtcctcgtcctcctccgctgtctcgtccctggacgcgccccgcccgccgccgccgccgccgaacctgttcctcccgcgcgcccgcgccgcgagcagcctgctgccgccggcgccaccgctccagtacagcacccccggcagccctgtcccggtcccggtcccgctccggcagccgcccggggcaggacggccgagcgggccacgcacgtcgcggcggaacgcgagcggcgaagccaccgccttgggccgccattggtcgtcgggcgctcgatcgctcgactcgagtctagttgtgcgatcgcgagatcgatcggaaccgagtgggccgtcgagcgagcggaggccgtgtgatctttgctgctgtgctgtttcgttttgttt

SEQ ID NO: 16205 - DNA, 3883 bp, Zea mays
aattcggcacgagggcctactacccattcgcaaatcgcaacctcaaggttcgagaccttgactcgcggacgcgttttctgttcgccgagcgctgcagccgtcgagcgggagtgcgggccgcgttactgcgttagccgccccccgccgtcgcctgcctcagcggatccacgctcggcaggttactgacgccgcccgcctaacttccaccggtctggtggagtggtggggagatctatctgccttggatcgattattctctactacttggtagaagagagtttatccacacaggcagctatgttggaaaagattgggttgccgccgaagccgtccatgcgaggcgccacctgggtggtggacgcatcccactgtcagggttgttctgttcagttctcgttgtttactaggaagcaccattgccaaagatgtgggggcttgttctgcagcagctgcacccagcagaggatggttttacgtggacagggtgattcacctgttagaatttgtgatccttgcaaaaagcttgaggaagaagcacgccatgagttgagatatgggcacaaaaatagagctacaagagctaccacaaaatctgcttcgaaaccagaggatgaaattctaagtgaaattcttggaggtggagagcgtatccaatctctggattctttgcttcctgggagaaccacaagcagtgccagtacctccagacgaacttcttctaacctcagtacggacgcaaaaggagatgaaagcctttctgctgaagcacacaattatgaacttaacaataccgcatctattttcaccccagaggagttgcgccaacatgctgtagaagagaagaaaaggtacaaaactttaaaatcagaaggtaaaccagaggaagcactgcgggctttcaagcatggtaaagaacttgagtgcctgcctgcagccctggaattagaattgagaaggactaggagaatggctacaaaagcgactaacatctcttctgctgttggtacttcgatgactgctggttctgatgaggttgaaacaaaaaggtcttcaactgggaaaaagattaagaaagaaaagaatgatcttgcctctgagctcagagatctaggctggtcagatgcagaccttcgtgatgaaacaaaggctgcccctatgagtctggagggagagttgacacagattcttagagaggtggcccctaaaccattggagggcaagagaacaggtggtatcgataaatctcaggttaatgctctgaagaggcaagctttactgctaaagcgggaaggtaggcttgctgaagcaaaggaagagctcaagaaggctaaaattttggaaaaacaacttgaggaacaggagattctaggtgaagcagaaaactcagatgatgatttggctgctattattcggaacatggacgacgataagaatgatgacatatttatagatgattcaaagttcccagctttcaactttgaacaaattatggttgcctctaatgatcttgccactgatggtcactttgacgttacagatgatgacatgaatgacccagatatggctgctgctctaaaatcatttggctggagtgaggaggatgacaaacagttggaaaatctcgaacctgtttcttcaaatcaagaggggctaaaggagcaagtactttctctaaaaagagaggctgttgcaaacagaaggtctggtaatgttgtagaagccatgtcattgcttaaaaaggcaaagctactagagaaggatctcaaaactgaagagccagactcaaaggttccttctctagaaaggcagaaaactacacatgcagaagatgccacttatgcagggacgaatgtccgacctataccaacaccaaaaagtaagcttgcaattcagcgagaactgttggctctgaagaagaaggcactagctttgaggagggaagggaaggtggatgagtctgaggaagagctgagaaagggtagtgttcttgaaaagcagcttgaagagcttgaaaattcttccaaaccacctgtagcaaaggaaaccaggagctttccatctaatcccccgtacaaagttgaacccccaaatatcaatcttgctgatgaggtatatgaacctgaggttacagacaaggatatgcaggatccagcattgctgtcggtgctgaaaaatatgggatgggaagatgctggttcagattctgtggaaacaactgacaaagcatcattttctgcacatgtagttcatcataaatcatcaaaaactaagggccagcttcagaaggaattgcttggtataaaaaggaaggctcttgccctcagaaggggagggaaaaacactgaagctgaggaggaacttgagaaggctaaggtgttggagcagcaacttgcagagatggaagaatcaaataacttgagtgctagtcaaggtgttactactgctggcggggacgaaatattgctagtgcatgcatctgaatctggtacgccagtggttactctgtgtggttctccaagtaaaccgcagattgagacaaccaatcctaatcaaggtgatgtgggagaagaaagtagagctggaaggtctccagccttgtcgcagccagcttttactgatccgttgggatctgaaaaagggtcacattcaccttctgtagtacatgatcgtaatgagcatcagaaaacacaaggagatgatactcttaaagatgagatattacttcataagagaaaagcagttgcctttaagagagaagggaagatggcagaagctagagaagaattgaaactggcaaaacaattagaaaagcaccttgaaggtgctcaacaagacaccatggatggtgtgggtgactccattactcctgctgtggaacagaacagtttggtccaacaacctgctagctccagcaatcacactgacgacataacttctccccctcctgcacaagcgagcaagcggactcaacctcagaaagcaatgtccagccgggaccgtctcaaaatccagcgtgaatccctggctcacaagcgcaatgccctcaagttgcggagagaaggaaagactgcagaagcagatgcagaatttgaactggccaaggagctagagagccaactggaagagtcagacaaccaaagctcgagctccgggggaaagtcaagtgaaccaaacgacgcaagcgtcgagaatctccttgatcctcagatcatgtctgccctaagatccattggttggagtgacatggatttatccatgcaatcctctagtgcacaacctctgaaacctgtgcagtcctcaagttctcaacctccgcaaaaagtggaagccaagtcatctgttgccgcgaccagcaaacctcagagcgagagaagtcaacttgaagaacagatcaaggcggagaaactgaaagcgcttaacttgaagcgggaagggaaacaagcagaggccctggaggcccttcgctcggcaaagcgactggagaagaagttgaactcagcttaagccaatcacaccctcccagattgctcttgttcttttgtcaattgttcgttttggttacctgacatcccaagcgttccagctagaacagagaatcatatcgagtcctatggccctgattggcacagcttgtgagctttgagcaccataaacttatgtcctgtttgtgttcgagctatgagcagtccctttcatgtatgtataaataaaatctgatggacggagattattttcacgaattcgtgtatacacaatgttaggggaatgtcaattaagttggaatctgaacatttcatatgttagtcatttgataataatgttttccaagctcaaaaaaaaaaaaaaaaaaaaaaaaaaaaaaaaaaaaaaaagaaaaaaagaa

SEQ ID NO: 16206 - DNA, 2657 bp, Zea mays
gaaattcccatgttatcattcatgatcaggagtacaagagtgggcttacaactgtacagttactccgcggaaaattttctgatatttacatacactcatgaatcactccagggcaggggttcacacttcacaccaagaattaccctgaagacaaaaaaaaaaagaatcctggacccagaaaaaaggaaacgcaagaattaccctgaagacacaaaaaaagaagaatcctgcacccagaaaaggagggctattctacaacagaaggaaaacgttgctgtcgcgcgttaattaagagaaataccaagaaaatcgatatttttcaataagtttatgagggctccatgtcaggagacaaagtaacctttatatgtgaagaaagcaccggatggcttctcattagtacgagaaagaaagccatggatgctgtagtgcttagtcagctgtaggtcttttcctggggttaatttgcagcagataagacagaaaatcgacaaactctgaatcaggacattgtatgtgttgtcgcaaggaggatttctccgggatcaaatactttagctgatctgtctcctcattctcggtaaaaaggtcataatcatcagtgaaatacttctgtgtctcctgtcccaattctagcatttccatgtcaattgggccggttatcccaatcatttgagcaagcattacggacacaggctcgttaggaacgaatacctgttatatgtaaaggaaagaagatatagttccaaggaaaagaagcacccaaaccacccattccacaactctccagctcgcatgtgcttacaacattaataaaaaagattaatttctaattctggttggagttatacgttggtatggcattcatacaagaaaagaggcctcaaagttttgtcaaaataatactaaagaccagtttcaatcctacaagccaccaagcatttcaattaaataaaacatacttacttcaccagtatacaattcagaaaggatgcaaccaagagaccaaatatcaatcctctgattataaggtaggcctagaatgacctcaggagctcgataagagcgtgattggacatagagacataagttgtctgtcaagaagcaactacttcccagatcaatgactttaatttcacatctactgtagctcttgataagaatattttctggctttaggtcacaatgaatgatcctcagacggtgcaagtaaaccaaggcctccaaacattgccgagctataacctacaacaaaggcaaagtttcaaattgctagaactttgtaactttctgaatcaattttgcgaaggctaccatttcaggatatcaaataagtttgctcatttacagctcaatggttaaacgactgtttaaatgtgtagcaggttagaaaacttttgtctaggggctgactacagggtgaattgcaaatgctcattatatacaagtatgatatcattataagtagcagtcatggtcccggggagaacatctcagtgaaggacacagaacatacctgtatcctaggcaaagtaaaatacacctcaccaccagattcttgattatatttctgaaactcgtatagatttgctcgcagtagttcagtgacaataaaaaggtgttcctgtcaatatttgcttgctgtcagcaccatgcaaggccatgagaattgaaaaatccaactaaaatctgccaccgtacatgcatgaagcaattcaagtacactggtagaatactacagttgatcctttttaagataattgcaatattgctcaagacctagtcacctggattatatcctttcagatgccttcctaggaagttaggatccaaacaacttgaatcaaagggagtacacttaaccagaagtctctcttacgaggcatatacctgatggtaaaagtagtcatagaggcgcaacacatggtgttcatctagtggatcatatttgttcacgaacttcagaagttttatctcatccaagctctggtcgaagaagtccttatcatttttaattattttaaggcaaacatccattcctgtacgaagatcatgtgcttgcacaaccttgctgaatgcagctgagcctagatattcagtgatataataccttccagcaacaaccgaatttaagacgatggggaaatctttgttttcttcaaatccagtcctgcattacatgcctatagtataagtacgaaaatggatcaaccaacacacaatttaacaaaaagaatacaaagtaaaaaagagattgtgaacctgttcttgcggtggataattctcaattcaaatacctcatattctcagtgaaaatcagagagagcaagatcaatatttgtctcggcatcttcctcagctttaagagcagtagaatgttgaacatctgtatttaatgatccaacatgtcgaaactcatcagcttcatcaagatcaccactttcagggaatggctgtatcctatgacctttcggatattctttatgaatgctgcttttcagatttttgtcacagctgccattgagctcaccattttccgtgaaatcatatggtaccgtgatctatgaaattcatgaagagaattagaccagcacataagcaaaagatagcctctaaccaggaccaggacaaatggacaactgatactaaatactcac

SEQ ID NO: 16207 - DNA, 1133 bp, Zea mays
aaactgcaggcctaaaaaagaagattaaaccccgccccgcccgcccccgccgcccccgcccgaaccgaactcatctcctttccgtttgggcgccaaaacagcatccgccgcgcgacgcgtctcgtcagcgccgccagccccgtcagaatgtctaagaagagggggctttcgttggaggagaaacgggagcaaatgcttcaaatattttatgagagccaggaattctttctgcttaaggagctagagaaaatgggtcctaaaaagggagtgattagtcagtctgtgaaagatgtggtgcaaagcctggtggatgatgatcttgtcttgaaggataaaattgggacttctgtgtacttttggagtcttccaagttgtgctgggaaccagctgaggaatacttacaacaagctggaatctgacctttcaaactctagaaagcgttacatggaccttgttgaacacagagataacttgaaaagaggccgggaagactctgaagagagggaagctgctttggaggagctgaagactgtagaactacaccataagaaactcaaggaggaactggctgcatatgcagatagtgatccagctgcagtagaagcaatgaaggatgctactgatattgctcattcagcagctaacaggtggacagacaacattttcactttgcaacaatggtgttcaaccacattcccagaagcaaaagaacaactggaacatatgtacagggaggttgggatcacagaagattttgagtatttgcagtgatgtccaacagcctattacagcgtcgaaaatgtgccacggaatgttggatcgaccacagatgcaagtttatcatgttggtgctgtgagttatctgcagtaaatagattttgtatatttcacatgcttggcaacaatgaccgatatggccacatgcatgttagggactacttttcctagatgctaccaagtggctagactataccgaaggctcctgctatgcttgaaaactttaccgaaggctcgattttattggatgtagtggctagactatatcatgaaatgtatatttctttgctgatggaaagaacaacaatagcttgccatctggaaataaaaatactgccctaaaaaaaaaaaaaaaa

SEQ ID NO: 16208 - DNA, 2091 bp, Zea mays
gccccctctcatccacatcggacgtcggcgcgtcgacgcgtcgtgccgtcgtgctcgttctcgtccataccctgcttggctcctcagtcctccccaccttccccctggccttaaccagcaattcccatatcgcccctccaccaaaacgggagctcagcggcggcggccgcaacccctcccctgaaccctacccccttctacccggccaccaccccacaacatggccctctcccgccgcctcctcccgctcttcctccgccgcggcgcccccatccccgcccgcgctctctccacggctgtcgcacctgcggcggtggcctcggaggaggacgaggcggccgtcaccgtcaagggcgtgcgcatctcgggccgcccgctctacatggacatgcaggcgacgacccccgtcgacccgcgtgtcctcgacgccatgctccccttctacctctctcgctacgggaaccctcactcccgtacccacctctacggctgggagtccgacgccgccgtagaggacgctcgcgcccgcgtcgcctccctcgtcggcgccgacccgcgcgagatcttcttcacctcgggcgccaccgagtgcaacaacatcgccgtcaagggcgtcatgcgcttctaccgcgagcgccgccgccacgtcatcacgacgcagaccgagcacaagtgcgtgctggactcctgcaggtatctgcaacaggagggattcgagatcacctatctcccagtgcgcaaggacgggctcgtcgacctcgcgcagctcgaggacgccatccgcccggacaccgggctggtgtctatcatggccgtcaacaacgagatcggcgtcgtccagccgctcgaggagattgggcgcatctgcaaggagaaaggcgtgccgttccacactgatgctgcgcaggcgctggggaagatcccgattgatgtgaacaggatggggattgggctcatgtccttgtccggccacaagatttatggccccaagggcgtgggggccctctaccttcgtcgccgccctcgcatcagggtggaaccacagatgaatggtggtgggcaggagcgtggcatccgcagtgggactgttcctacacctcttgttgttggatttggggctgcctgtgagattgccgctcaagagatggattatgaccacaggcgtgtcagtgctctgcagcagaggctgcttgatggcatacgtgcgcaggttgatgatgttgtcatcaatggaagtatggagcaccgttacccaggcaatctaaatttgtcatttgcttatgtggaaggggagagcttactgatgggtctgaaggaggtggctgtgtcaagtggtagtgcctgcactagtgccagcttggagccctcatatgtgctgcgggcacttggggtggaggaggatatggcacacacttctattcgtttcggcatgggtcgctttaccactgacgaagaggtggacagagcaattgagcttactgtgcatcaggtgaagaagctccgtgacatgagcccactctatgagatggccaaggctggcattgacctcaagagcatcgagtggtcacaacattgaggcagttttcatgacaaacggtcactcgaaagcgtacacggatcgcatacataggcttatggtgctgctggtgagtacgttcatgtggtgctcctacctctgataggattatcacacttttttagctctcacatggggcccgagtgtattcacgagtgctttctaagttgagtatcttgacctcaaaataaggatacttcaaatacttggtaatgtatcgtctgaaatacagtttgaagtagtattgaagcggtgacaatgatgataacctattttagtgctgacaaaaatgttgttataatctccggttgttacaattcctgcatatgtatttattgtatgcttgatctgaaaaaaaaaaaaaaccaatgttttccccccacttcttgctcgcgtagttgcggacttgctttaccaaggactttagtcggttgtactggttcttctctctttcatggcgaaatgctcgagcttaccttctaggagctctatcttggtgattttgtcaccctcat

SEQ ID NO: 16209 - DNA, 1428 bp, Zea mays
cactgagtaataagtttttataattgtgctatatttagtatttgtaacttgcatttaaatatttgatgtgacataaactaaacttcacccttctaggcttgtctaggagaagaggatatatggggctaaaatcatttgctatttaaaatcccttcaaggctattcaaaatcccttgaataaaataatttgggccccattaatccctccaatcttcttgctcgcaaacaagttattaataaatcaaactagtttaataccctaatgttcgcttaagccatttcctctatgattatataatctacattttgaattatataagagtatgtttgtttgagattataatctatatagattatataatgtaactaattttaaattaacaatttgaccatattatataatataattaatgttgaatgttgattcaaaactagttagattatataatttggagagattataatttcaaataaagataccctaagcacataataagctgtttatagaatatcctaatatagatatctagattatataacctatttaataatttgttgcttgtttgacttttaatttattttaactgaattatatattttagaggttaaacaaaccaatcccggctttaccgcacccggcgctccccggggccggcccccacgaggaccactccaccaggcagcaggcaccaacttcgcttgactcgcttccccccaaacggcgatagccaaccgcgatcgatagatgttcaagcgcaccggcggcaatcgacgaagggtgagcccatgtactcaagcagcacgccgtagctgatctccccatcgccgttttttcaggtcacccggtacgatcctttcagattttgtctctctcttctccccatctcgatctcgtcctatcatccctgcggcttacaccgacgtctacaccgatcaatggatctcatctgcaatgatctgttctctttggcgtcatccgatcttccctggcttgttgaatccatcgacccatcacaggatgccctttcacagatctggcttagacgcggactgtagacacgcaaatgtcagattaggaggcatcattagatcctgtagtggccgtggttctttgcatagttgtgagttgtctcttcgctattgggatttgtggccttttttaaatgatttggaacttcgacgtctgatgtttgtgaatactaattggacgtcacattcgggatgctgaactgcctgtttgtggctggcttgcttagtctcatgggaggaacaaagctgtaactcatattagctcaccctcatgggaggaacaaagctgtacctcatattggtatgactgcttttagcattcactgtatggtgcagcaagagtattgtcattgagatgaagaaatgattagtatatcaaataatgattttgttgtcgga

SEQ ID NO: 16210 - DNA, 1823 bp, Zea mays
ctcgaggcagtcccgagcccggcccggcccggaaattcaccctcaccccttcggctattcctcgcccccttcccttctcgaggattcgcgtaatcgtcaccatgcgccgcccgtggaggcactcgggcccagggtccgccgtcgcggcgcgccacggcgccgcggacctctgcctccgcgaggtcggggacctcctgccgcgacgcttcgcccgccgcgcggccggttccgaggaccttgtaatgcggctccagattcaccggaagcttgacaggcacacgggctgcgtcaacacagtgggcttcaatgaggtcggtgacaccctcatatcggggtctgatgatcagaaggtgatgctgtgggactgggacactggcaccgtcaaattagagtttcattcaggacatggcggcaatgtgttccaggcacggttcatgccctgctcagacgatcggaccattgtcacttgtgctgctgatggcgaggtgaggcttgccaagatacaggatgctggagacgtgtccacaacattgcttggtgaacatgagggaagggctcacaatttggctatagagcctggtagtccttacattttctacagctgtggtgaggaaggctttgttcaacattttgatctcagaacaaacacagcctcaaaactatttctttgcagaaactccactaaatcagtatactcatctcttgttcacctaaatgcgcttgcaatagatccgaggaacccaaatctttttgttgttggaggaagcgatgcatatgctcgtgtgtatgacattcgcaagtgcaagtgggatggatcatctgattttagtcacgcatctgactgctattgcccaccacatcttgttgacaataagagtgttggaataacagggattgcattctctcacctgagtgagttgcttgtatcttacaatgaagagaatatttacctattctctaaggatggagggctgggacctgaccccaaaaaatctgttaggattggagcaattgaagggtgcaaatcaacaatgctagcatctggacatgatgtttctcaacctgcacctcagacatacgtcggtcatgttaatcgtgaaacggtgaagcgtgtgtctttcattgggccaaatgatgaatatgttgccagtgggtcagactgtggccggatctttatttggagaaagggagatgggaagtttctacgagccatggagggtgatgagtgcattgtgaattgcattgagcctcatcctcatgctatggcaatcgcgagctgtggaattgataatgatgtaaaagtttggactccctctgcgattgagcgggcacctatgatacatgttgatgagctccagttgagacctcgcaagagaagagccaagctctggcgctttggcatacgagacctgttgatccaacagatactggtatcggaaaataggcaacagtcagctgaagaaggctcatcagaggaccatgaggacaacatagaattacttgatctagtgctacaggctgcagttgaaggtgtatcatcatcatcagacgaggaggaggaggacgacgacgacggcgataatgaggaggcggcggcctctgatggctctgaatagtagtcaaccgatctttcagggttgtttcaaattgtaaatatacaataataagccatcactcttctcatgtattatataatagaactatgatttattagcttgtcatttctatgttataaatctgcttttagtatgctactttaatgaaaaaattgggctaaccaaattgtgtgctatgttatgaaaatctgaaatggtgttgcgtct

SEQ ID NO: 16211 - DNA, 3524 bp, Zea mays
  misc_feature (3349)..(3349): n is a, c, g, or t
gccggccgggtcgcgacccgcccccgccctcgtattcttttcggattcgttccacaccccccatgcccgtgcccacctcaggctgcatcacatcgtcgcccacgcccagcaccaccagcggcggcgcaccaccggcggcgccagcaccagtgccagcgcaggcggaggcccgggcgacgcggactggcctgctcttcctcagcggcgtcccttcctgtaaggtcttccggcgaggaggtcacgtgcaggttaccgatgggtctggataatacttatggcgagctatctggcatgttctatggaggcctgtcttatgatggctacgcagaccacagcagcgcaagtgattatttcaggtttgccgatccacttcctgcagttgtgccccagatggcagcagaagcctgttcaaatccttcctccactgtgtcgagggccaacactgaagctgacaacccggaggattgggaattcatctcagatgagtccctcaactatattagccggatgctcatggaggaggatattgatgagaaagttagcatgtaccaggcggagtcagcggcactgcgtgctgctgcaaagccattctacgacattcttgggcacaagtttccaccgtctcctgaccggcaggtgatgccttggcccatggacagccccagtgagagtagcggtagcatttgcacacaatctgtggcaagtgctgtcactagcagcagtgttggtggcacagtggatagcaaccggtgctacgatgttggacacagtgagcagctggaagcttttcgaggcttgtgtggtcagtcttctcatccactttgttggtgcatcaagtgatgcttccaatgcagtgggtgagctagaagacattttgatcacgaatggtgggatccctgagtatttgtttgagagccttccaacttgggatttcaggagaggtattgaggaagcccagaagagtcttcctgttagcgataaactagtaattgatttagaaactggtggtattgcaagaccccaagaagcaaggaaagatgttcctatgaatgccaaaaaggacgatgtattgaaggccaagaaaaatagacagagtgaagaccttgacctgatggaaggccggaacattaaacagtctgcattttgttccgatgaacctggttggattgagatgttcgatgatctgcttcgccaaactgagaagaaggctacagttctgcgagagctgatgcgtagtgaagcatccaagaattctcaggtcactcagatgaaaggaccaagtggtccacggccacggggaaggaaaccaacaaagaatgatgtggtggaccttaggaccatcctcatccactgtgcacaggctgtggcagcagatgaccgcagaactgctaatgaattgttaaagcaaataaggcaccattccaagccaaacggcgatggaacccagaggttagcacattgttttgcagatggtctcgaggctcgcttggcaggcacagggagtcagctttaccgcaagcttatagcgaaacgtacaactgcctcagacatgcttaaagcctaccaccttttccttgcagcaagcccgtttaagagactttcacattttctttccaatcaaacaatcttgagtttgactaaaaatgcatcaaaggtgcatatcattgactttggcatttattttggattccaatggccatgcctaatcaggcgtctctccaagagggaaggtggtccacctgttctgcgcatcactggaatcgacgtacctcagccaggtttccgccctaccgagagaattgaagagactggacaaaggcttgcagagtatgctgagaagttcaaggtgccttttgagtatcagggaatagcgtcaaagtgggaaagcatccgagttgaggatctcaaagttggcaaggacgaagttgtgattgttaattgcctatacagattcagaaacctgattgatgaaacagttgctgtagacagtcctaggaatagagtgctcaacaccataaggcaagtaaacccagcgattttcatccatggaattgtgaatgggtcatacagcgttcccttcttcatcactcgtttccgtgaggcgctgttccatttctctgcactgtttgacatgctagagacaactgtcccacgggatgatgcacagcgtgcgctcatagagagggaaatgtttggccgagaggcactcaacgttattgcatgtgagggctcagacagagttgagagacccgagacatataaacagtggcaggtgaggaacctcagggctggatttgtccagtctccgttaaaccaagaaattgtgatgaaagccatggacaaagtaaaagacatttatcacaaggacttcgtcatagatgaagacaacggatggctcctacaaggctggaaaggaaggatactctatgcaatttctacatggaagcctaagaataactaggttcttggtctcacgcgtaatctctcctattccatcgatggtggcagctaattaatcagtcctgctatcttataacatttgggccttgacctgtgaacctgtctgatcaaggtaagcagtaagctaagtttgatgcaatgttaaacaaatcaagggtgtagttgtacacttgtaccatatagcatttgagcagaacttcgacaatgacaccaaatgttttaatctacaggcaatggcttgaagccggacaatgatcaacatggaggtttgctagatttacatctgtccagccagtactctgataaactggaaaagagcagctgtagacgtctctaacttggtgttggtaccatcacctttatttaattcgtagttttcttctttccatttacttctatgaccggcctggcgtcctattaccaacaaccagatcaccgcttctagttcaaaatggctaggcaaactacctactatcttgagcttaatatttttgacttgtatccatccatgtcaaacatcagttcggttttcagcacctgcagatcagaaattccccaacgagtaagcctaaagcatcaaaatttgttatacgagaacggacgctgctgtttgtgtggaatgtagcatctcatggagtgctttatctttgaattcttcgtttatttatttcatctgttttgtagcaagtgacgctgctgtcacaaaaacgagtccttaaacttgagtggagcactagtttgagaatattactagaaagtggtgctacagatgaacatatatatagtactttgcttttggcgacgactagagcgaatggcgcctccacaaggcggcatgatatcgctggaacgcgaccactattagagtatcttcattcgataacttctngggttggctgatcctttcattgtcataggcctgatttttttggcaacccagagcatctctaacaatgtcttaaacaggtgtcatctctaccaatgtcttaaacatgtgtcttaaattctcgaaattggtgttttaaattgaatcgatggtgttttaaattgaaatataagaattt

SEQ ID NO: 16212 - DNA, 3063 bp, Zea mays
gagcagagcacaccatcctcgcattattcttttcggatttgctccacccctccacccccatgcccgtgtccatctcaggctgcgtcacatcatcgccgccacacccagcaccagcaccagcaccagcggcggcgcaccaccaccggtgccatcgccagcgccagcgctagcgccggcgcaagcggaggcccgggcgacgcggactgggcgaagttactggccttcttttcgtcagcggcgttccttgccatcaagctaaggtcttccagcaaggttacgtggagtttaccaatgggtctggataatacttatggcgacctatctggcatgttctatggaggcctgtcttatgatggctacacagaccacagcagcgcaaacgattacttcagatttgccgatccacttcctgccactgtgccccagatggcagcagaagcctgttcaaatccttcctccactgtgtcaagggccaatactgaaactgacaacccagaggattgggaattcatctcagatgagtccctcgactatatcagccggatgctcatggaggaggatattgatgagaaagttagcatgtaccaggcggagtcagcagcactgcgtgctgctgcaaagccgttctatgacattcttgggcacaagtttccaccgtctcctgaccgccagctgatctcttggtccatggacagccccagtgagagtagcagtagcatctgcacacaatctgtggcaagtactgtcactagcagcagtgttggtggcacagtggatagcaacaggcgctatgacattggacttagtgagcagctggaagcttaccgaggcttgtgtggtcaggcttcgaatccacttgttggtacatcaagtgatgcttccaatgcagtggatgtgctagaagaccctttgatcacgaacggtcagatccctgagtatttgtttgagagccttccaacttgggatttcaggagaggtattgaggaagcccagaagtttcttcctattaacaataaactagtcattggtttagaagctggtggtattgcaagaccccaagaggcaaggaaagatgttcctttgaatgccaaaaaggcagatgcattgaaggtcaagaaaaatagacagagtgaagaccttgacgtgattgaaggccggaacattaaactgtctgcattttgttccgatgaacctgattggattgaaatgtttgatgatctgcttcttcaaaccgagaagaaggccacagatctgcgagagctgatgcggaatgaagcttccaagaattctcaggtcacccagacgaaaggaccaagtggaccacggccacggggaaggaaaccaacaaagaaggatgtggtggaccttaggaccatcctcatccactgtgcacaggctgtggcagcagatgaccgcaggactgctaatgaattgttaaagcaaataaggcaccattccaagccaaatggtgatggaacccagaggttagcacattgctttgcagatggtcttgaggctcgattggcaggcacagggagtcagctttaccgcaagcttatagcaaaacgtacaactgcctcagacatgcttaaagcttaccacctttaccttgcggcatgcccatttaagaggctttcacattttctttccaatcaaacaatcttgagtatgactaaacatgcatcaaaggtgcatatcattgacttcggcatttatttcggcttccaatggccatgcctaatcaggcgtctctccaagagggaaggtggtccacctgttctgcgcattactggaattgatgtacctcagccaggtttccgacctactgagagaattgaagagactggacaaaggcttgcagaatatgctgagaagttgaaggtgccttttgagtatcagggaatagcatctaagtgggaaaccatccgagttgaggatctcaaagttggcaaggacgaagttgtgattgttaattgcctatacagattcagaaacctgattgatgaaacggttgctgtagacagtcctaggaatagagtgctcaacaccataaggcaagtaaacccagcaattttcattcatggaattgtgaatgggtcatacagtgttcccttcttcatcacacgtttccgtgaggcgctgttccatttctctgcattgtttgacatgctagagacaactgtcccacgggatgatgcacagcgtgcactcatagagagggaaatgtttggccgagaggcactcaatgttattgcatgtgagggctcagacagagttgagagacccgagacatataaacagtggcaggtgaggaacctcagggctggatttgttcagtccccgttaaaccaagaaatcgtgatgaaagccaaggacaaagtaaaagacatttatcacaaggactttgtcatagatgaagacagcggatggctcctgcaaggctggaaaggaaggataatctatgcaatatctacctggaagcctaagaataactaggttcttggtctcacatgttacgtttcctattccattgatggtagcagctaattaaccagtcctgctatgttatagcatgtggaccttgacctgtgaacctgtctgatcaaggaaatggcttgaagacggataatgatcaacatggagctttgctagcttcacatctgtccagccagtactctgatagactgggtgtagacctctctaccttggtgttggtaccattacttctattaaatttcgtagttttcttctttccatttacttctatgatcggcctggcgtcctattagcaataaccagatcactgcttctagttaattggttagccaaactacctactatcttgagcttagtatttttgacttgtatccatccatgttgaacattatttggttttcagcaccagcagataaaaaattccccaacgaggaagcatgaagcatctaaatttgttatacgagaatggacgctgctgtttgtgtggaatgtagtatctcatggagtgctttgcctttgaaaaaaaaaaaaaaaaaaaaaaactcgaggggggagaccgggtaccca

SEQ ID NO: 16213 - DNA, 2338 bp, Zea mays
aattcggcacgagggtggatagcaaccggtgctacgatgttggacacagtgagcagctggaagcttttcgaggtttgtgtggtcagtcttctcatccacttgttggtgcatcaagtgatgcttccaatgcagtgggtgagctagaagacattttgatcacgaatggtgggatccctgagtatttgtttgagagccttccaacttgggatttcaggagaggtattgaggaagcccagaagagtcttcctgttagcgataaactagtaattgatttagaaactggtggtattgcaagaccccaagaagcaaggaaagatgttcctttgaatgccaaaaaggacgatgtattgaaggccaagaaaaatagacagagtgaagaccttgacctgatggaaggccggaacattaaacagtctgcattttgttccgatgaacctggttggattgagatgttcgatgatctgcttcgccaaactgagaagaaggctacagttctgcgagagctgatgcgtagtgaagcttccaagaattctcaggtcactcagacgaaaggaccaagtgggccacggccgcggggaaggaaaccaacaaagaatgatgtggtggaccttaggaccatcctcatccactgtgcacaggcggtggcagcagatgaccgcagaactgctaatgaattgttaaagcaaataagacaccattccaagccaaacggcgatggaacccagaggttagcacattgttttgcagatggtctcgaggctcgcttggcaggcacggggagtcagctttaccgcaagcttatagcgaaacgtacaactgcctcagacatgcttaaagcctaccaccttttccttgcagcaagcccatttaagagactttcacattttctttccaatcaaacaatcttgagtttgactaaaaatgcatcaaaggtgcatatcattgactttggcatttattttggattccaatggccatgcctaatcaggcgtctctccaagagggaaggtggtccacctgttctgcgcatcactggaatcgacgtacctcagccaggtttccgccctaccgagagaattgaagagactggacaaaggcttgcagagtatgctgagaagttcaaggtgccttttgagtatcagggaatagcgtcaaagtgggaaagcatccgagttgaggatctcaaagttggcaaggacgaagttgtgattgttaattgcctatacagattcagaaacctgattgatgaaacagttgctgtagacagtcctaggaatagagtgctcaacaccataaggcaagtaaacccagcgattttcatccatggaattgtgaatgggtcatacagcgttcccttcttcatcactcgtttccgtgaggcgctgttccatttctctgcactgtttgacatgctagagacaactgtcccacgggatgatgcacagcgtgcgctcatagagagggaaatgtttggccgagaggcactcaatgttattgcatgtgagggctcagacagagttgagagacccgagacatataaacagtggcaggtgaggaacctcagggctggatttgtccagtctccgctaaaccaagaaattgtgatgaaagccatggacaaagtaaaagacatttatcacaaggacttcgtcatagatgaagacaacggatggctcctacaaggctggaaaggaaggatactctatgcaatttctacatggaagcctaagaataactaggttcttggtctcacgcgaaatctctcctattccatcgatggtggcagctaattaatcagtcctgctatcttataacatttgggccttgacctgtgaacctgtctgatcaaggcaatggcttgaagacggaccatgatcaacatggaggtttgctagatttacatctgtccagccagtactctgataaactggaaaggagcagctgtagacgtctctaacttggtgttggtaccatcacctttatttaattcgtagttttcttctttccatttacttctatgaccggcctggcgtcctattaccaacaaccagatcaccgcttctagttcaaaatggctaggcaaactacctactatcttgagcttaatatttttgacttgtatccatccatgtcaaacatcagttcggttttcagcacctgcagatcagaaattccccaacgagtaagcctaaagcatcaaaatttgttatacgagaacggacgctgctgtttgtgtggaatgtagcatctcatagagtgctttatctttgtattcttcgtttatttatttcttctcttttgtagcaagtgatgctgctgtcacaaaaacgagtcctta

SEQ ID NO: 16214 - DNA, 2770 bp, Zea mays
  misc_feature (143)..(143): n is a, c, g, or t
ataaatcgtatgactttaacgtcacgtgtcacgccacttaccttaagatcttaaagccgtaataataccaaatacggagtatatatggtgtaggcatgaaattaaaaaaactgcaatattatttaaaaagtgtcggtctaatngttcattcttaaagtaccataaatatttactaataacaacgaagggtctcatggcacaatggcgaaggccacttgttgatagtgctcccgcggggacggcagggttcagtacacacgtatgtttagtggtattgcatgttcacaggcattagagttctagacctcttaatttattcttagcttgtaaaggatgcgtatgtgcagcagtgtgagctagtatcgttcttccttgtaccctctaaaaaattcttactaataatagatttgttagttttaataatttggtatcgtcgtttattagctttataagcagtttatttaatattcgtaattgaatttgacgtgacatgagtattgatagtactagccgaggagaggagtacgtagacagagggcagcagtgagtggcgtaggctgacccatccccatcacacagcgggcgacatctgccatcaatgcggccctccacagcctaccccgctcgcattcattgcacatcttgtcctcatacctctcctttccaacacctaattaatggcgccatgtttgtacttcgatgctggctccaaaccccgacccttttcatccctccctccctccctcgtcgtctcctgactttgctcgccggccgccccgcccacaccctcctcctgcgctaccactgtcagcaagtgcacacccttcgaggacagctgctgtcgccgccaaggccgcaaccggccgtcgctccatgctgcggtagaatttagaaacgagaagggagatggcggccgaggcgctggggttcatggcgcggggagccaacggtgggagggcggcggagctcgtcacaagggactttctcggcgggtgcgccgccaccggcgacgccagggacgcgtccgccaggaatggcaccgtggtaagcccctcggccccgtgctgtgtttgaatttcctctgcctccacctctgttttccgattcggatcggatcggacccgctcgcgcggtttccttctggccgcgggtttgctccctctgtacatgatgacggctggccaagaaatcgagcgatgtgatcgatccttcatttcttgtgtagtgacaagttgtcaaattggtagcgacagatgtttgattgagttgaaagaggcaccttgacccctaggtgtttttttttaagaaaaaggaaaaacttatcgctactaattcccatcgtagaatgtttttttttcctccaagctactaattggaaaaccattctacactttacgagtacacagtttgtggttcggtggttccaagtggttactaccagtatgatttttaaaagtcatttattctccaagtccaaattccattccccttgtgattacagttagaccctttctggaactctgttttttatatgaagcaggggttctaccagaatccttaaacattcccactaaactactttccgtacgcgaagactagagttccccaaattaaaattgaagaaaacaaaatctgtacttgcacatgctctcttattgtgtatcatttattactagtatagacttgtttagaagaattgccagcatcagtagctgcattagcttatgcttatacaaaatcatgtcagtaatgttttgtgtgcccacgtgcagcccgggagggtggctcagcagaagcacgcgtgcccggcaacgccgatggacctcaacctgttaacaataaaactctttcatacctctcttcattaaattggtatatcatatcatcttggtttgcttacatgtcattgtatttaatgagaatgaaatttaggtgacatacccactaagaatggtcttattcatttccagccagctaaaaaaaacaaatgtacacttaatgcaaattaacgttgtcagcttactactttgaacccaagattaaaaaatgtttttaattgacaagctaagggtccctttggttagatggaataatctttagttcctggtttttagtccagtttaatttctattttgctaaacagaagggctaatatatagactaatgacacttcgctgacattttttgatatttatgccctctttttccatttattgggtagcatttgtaatgttgtcaggaagatatctcttgtgttcttcagcttgagatacatatattgcagtcgtcaatcattgtactagggatcaaaaaaaaaaaaaacctgccaataattctgccgatacgatcgaacccatgcgagtccacatgcacagccacatgctccgtctgatttggaccaaccaactctctaaggcataccctatagtatatatgccatgatctgcgaataaataagacagcatttaatgacgcgtgtaaataagagcgacgtccacaggaatcgcaggcacacatggagggagggcgaggtcacgcttgcagttgcaggcacatgccgcatctacctctcctacccagagcgacaagggtcctgtcgccaatcccccaaacggtttgattatggcgtctagagatgtcaatggagaattctccaccaagttatagcatcttaaatctatccctaacatgtttgatccattcacatatcgatcctcatacctataataggtgtaaaacttatctcatatccatcctcattcggatttcg

SEQ ID NO: 16215 - DNA, 945 bp, Zea mays
tgggaccctgtccagcaccgaattaatggcgcgcccatacgtgcctgatgctggctccaaaccccgacccttttcatccctccctccctccctcgtcgtctcctgactttgctcgccggccgccccgcccacaccctcctcctgcgctaccactgtcagcaagtgcacacccttcgaggacagctgctgtcgccgccaaggccgcaaccggccgtcgctccatgctgcggtagaatttagaaacgagaagggagatggcggccgaggcgctggggttcatggcgcggggagccaacggtgggagggcggcggagctcgtcacaagggactttctcggcgggtgcgccgccaccggcgacgccagggacgcgtccgccaggaatggcaccgtgcccgggagggtggctcagcagaagcacgcgtgcccggcaacgccgatggacctcaacctgttaacaataaaactctttcatacctctcttcattaaattggtatatcatatcatcttggtttgcttacatgtcattgtatttaatgagaatgaaatttaggtgacatacccactaagaatggtcttattcatttccagccagctaaaaaaaacaaatgtacacttaatgcaaattaacgttgtcagcttactactttgaacccaagattaaaaaatgtttttaattgacaagctaagggtccctttggttagatggaataatctttagttcctggtttttagtccagtttaatttctattttgctaaacagaagggctaatatatagactaatgacacttcgctgacattttttgatatttatgccctctttttccatttattgggtagcatttgtaatgttgtcaggaagatatctcttgtgttcttcagcttgagatacatatattgcagtcgtcaatcattgtactagggatcaaaaaaaaaaaaaaaaa

SEQ ID NO: 16216 - DNA, 764 bp, Zea mays
tcggagtttgccgctctcggcagacctcgttcggcttcctctctcctctttcctgcctatcagcagtcagtttctctcgtctgtgctgatggcgtccaactacgtggacaccggggcggaggaaggcaggttccacggccacggccacggccacggccaccaccaccaccacagcacgacgccgaccagcgcggcggcgtcgcccaagacgctgcggaggagctcgtcgtccgcccacagccacggccacggcgccccgcccaagtgcgtgtgcgcgccggccacgcacgcaggctccttcaagtgccgcctccaccgcagcagctcccacggccacggccacggcagcaacccggcgtcccctcccgcggccgcgtcctcctcccgcaccgtcgcggcgcagtgacggcgccccaagaaacgccggcccagcagcagtgaagggaggagaagagaagagagaaacggcaaaagggaaaaaaaaggaaagcacactctctctgttattatgcgacacgagaaagggagcttatttgttcctcccttcatcttcacgtacgccaacggcagaatttcccatttcctttcacttccctccttcggtcagaagaaaccctccctggttgtccgtacttgtactaggcaatgcgcatcctgctcgcctcctctggctgaaatggaaagcgtatgtgtgatggtgacagtgattattaccatttcagtaaatccatgcttcttgcaaaaaaaaaataaaaaggccccta

SEQ ID NO: 16217 - DNA, 2041 bp, Zea mays
cgacctgcagagtctctctcagttttttgtgtgtggcttttgttgaggtgcatggtgtggccagtattattttgcactgcttttattatcatcgtcccgtccgtctcttggtccgcgacgcggtcatgcgggagacgagccgactagtggagcaggagcagctgcctgcgaccacaaatggacgagtgtaccacacgcgaacgccgcccacgcgacggagggacgaagaagcggaactctgtctgagagtataatattgtagtatagtgttacgttggcgcggcgcggcgcggaggaagtcgtcggatgactcggatcgtcgaatcgaatcctctacgacactaccacaggcacccacgcacgatgtatctatcaatcgctcaaggtttccaaggccgaacgtgtctggaccagcgcacatagattgggaaacgatttgtatatgaaaaaaaaaagatttggatagagcggcagcagccagcggattcattctagaaccgtccgcgcgtggtcccgttggcgtttgctcgcgaccgacgcgacgcgatccgcacgcaccggcaagccagctgcgcaacccgccaagctccacagcccatcgtttcccgccacctcaaagaaaccgcccccctttttttctaatcagaagagaaccgcctgggcgctgggccggccggaacgagggcacggccgtcggcgtcgtcactttcatccctccagttttagagctctaaaaacttcaaaatactttagcttattttaaaacttcacctagccagagcttctggtctaaagtttagagatctgataatgttttaagaaagaaagccctaatccgctggcgcctttgcttaaaaaaaaaaaaccagtgggctaggctagtagatggggcggggtgggtccacgaggccagtgagtggggtcaggaggaatcctgggcagcggtcctgcccgcgggcagtgccgtgccgtgccacccccagcataaaagcgaggacgccgcccgcgccgcggtgccgcagtttgccgctctcggcactcgttcggcttcctctcttctctttccggcctatcagcagtcagtttctctcgtctggtaagctccttgggacgccttcctcctatccctttactactacagttcttaactcctacctaggagaagagaacttctcgttctagatccactcagctttttataagaactttttgttcattggagcctgtgctgcttgtggaggtacagtgctgatggcgtccaactacgtcgacaccggggcggaggagggcaggttccacggccaccacagcacgacgccgaccagcgcggcggcgtcgccgaagacgctgcggaggagctcgtcgtccgcccacagccacggccacgggcccaagtgcgtgtgcgcgccggccacgcacgcaggctccttcaagtgccgcctccaccgcagcagctcccacggccacggccacggccacggcagcaacccggcgtcccctccctccccggccaccttcgccgctgcgccgccgccggccgcggccgcgtcctcctcccgcaccgtcgcggcgcagtgacggcgccccaagaaacgccgacccagcagcagtgaagagaggagaagagaagagagaaacggcaaaagggaaaaaggaaaacacactctctctgttattatgcgacacgagaaagggagcttatttgttcctcccttcatcttcacgtacgccaacggcagaatttcccatttcgtttcacttcctcctccccccctcgtcttttaaccttttttggctgagatatccatcgattctcgctggaatggtcttcccctccttcggtcagaagaaaccctccctggttgtactgtactaggcaatgcgcatcctgctagatcgcctccgctgaaatggaaagcgtatgtgtgatggtgacatgaagttcacttgtgtaattattaccatttcagtaaatccatgcttcttgcaggaaaaaaaaaaaaaaaaaacaaagaaactcgaggcgagcaaagcaacacat

SEQ ID NO: 16218 - DNA, 912 bp, Zea mays
  misc_feature (890)..(890): n is a, c, g, or t
  misc_feature (912)..(912): n is a, c, g, or t
ggtacccccccgggcggccgggcccgcagtttgccgctctcggcactcgttcggcttcctctcttctctttccggcctatcagcagtcagtttctctcgtctgtgctgatggcgtccaactacgtcgacaccggggcggaggagggcaggttccacggccaccacagcacgacgccgaccagcgcggcggcgtcgccgaagacgctgcggaggagctcgtcgtccgcccacagccacggccacgggcccaagtgcgtgtgcgcgccggccacgcacgcaggctccttcaagtgccgcctccaccgcagcagctcccacggccacggccacggccacggcagcaacccggcgtcccctccctccccggccaccttcgccgctgcgccgccgccggccgcggccgcgtcctcctcccgcaccgtcgcggcgcagtgacggcgccccaagaaacgccgacccagcagcagtgaagagaggagaagagaagagagaaacggcaaaagggaaaaaggaaaacacactctctctgttattatgcgacacgagaaagggagcttatttgttcctcccttcatcttcacgtacgccaacggcagaatttcccatttcgtttcacttcctcctccccccctcgtcttttaaccttttttggctgagatatccatcgattctcgctggaatggtcttcccctccttcggtcagaagaaaccctccctggttgtactgtactaggcaatgcgcatcctgctagatcgcctccgctgaaatggaaagcgtatgtgtgatggtgacatgaagttcacttgtgtaattattaccatttcagtaaatccatgcttcttgcaaaaaaaaaaaaaaagccccgagggggggccccggaccccattcncgcctatagtggagtctattan

SEQ ID NO: 16219 - DNA, 1907 bp, Zea mays
aaaaaaacccaaaaaaacaattggcagcgcaaccgcccacagctcgtgacgaggcgacccaacccccccgtagcggcggcggcggcggcgagcaatcctccggtccggccggcggaaacactagcggcgggaggcagagcgtccaatggcggaggacgggggcaaggccgcggcggcgactgcggcggaggcgggaggcggaggagccaaggagggcggcgaggagaggaccgtcaagctcttcgtgggccaggtgcccaagcacatggccgaggccgacctgctcgccttgttccgcgaggtagccgccgtcgacgaggtcaccgtcatcaaggacaaggccaccaaggtctcccgagggtgctgcttcgtcatatgcccctcaagggaggaagctgacaaggcggtgaatgcctaccacaacaagcaaaccctctctggggtatgcgagcatactactaaccttgttctggcatcaagtcctttgcaagtaaaatatgctgatggagagttggagaggcttgaacataagcttttcattggaatgcttccgaaaaatgttacggacactgagttgactgatttgttttccaaatatgggaatgtcacggatttgcaaattttgagaggttcacaacaaacaaacaaagctggctgtgccttcattaaatatcaaacaaaagatcaagcattggcagctattgaagctctaaacgggaaacacaaaatagagggttctagcgtgccgttggttgtcaaatgggctgatacagaaaaggaaaggcaggctcggaaagcacaaaaagctcagtcacagctatctcatatacccaatgcaagtccaatgcagcagcactcttcagtatttggtgctttacagatgggatatatgcctcaatacaatggatttggttatcagccaacagggacatacggacttatgcagtaccctctatctcctatgcaaaatcaaggccccttccagaatatggtccaacctcttaatcaagggaactcgataagaggagtcaatcctgaagtgtctcccagttcagttcaaaggtcatttaatgcaatgcagctaggcagcccttatcctgctatgcctggtatgcagtatcctggatcatatcccggtggtcccatgggcaaccgtcatttgggaaattctcacaatccgattaaagttccaaattcgaatgccaattccactgtttcttctagtcccagcagcaatgctggtgggcaggttgaaggtcctcctggagccaacctatttatttatcatatcccacaagaatacggtgaccaggagctttccagcgccttccagagtttcggaagagtagtaagcgctaaggtgttcgtggacaaagcaacgggcgtgagcaaatgcttcggttttgtgagctacgactctcctgcctccgcgcaggcagccatcaacaggatgaacggctaccagttaggcggtaaaaagctcaaggtacaactgaagagagaaaacaacaccaagcacagtagtaaaccgttttgacagacaaggcagcagccgtccggtacccggtacatattaattgaccatcaacacattgcagcagcagcctcagggcctggggagggaagagacccgtgtacccctctttgttcacttcaacattcttggagattcgtcagtcagctcagctcgtgtaattcattgcagcagacataggccgtagcagcagtttgtaccatgatcagatcacttgtacacatgattcattcaattgttactgacagccggctttcatcctagaataattcgctgtgacaaccttatcatttgctgacgaatgaagtcaggtagacttgttcatctatggaatgatggcaactttcgagcaaaaaaaaaaaaaaaataacac

SEQ ID NO: 16220 - DNA, 1763 bp, Zea mays
  misc_feature (222)..(222): n is a, c, g, or t
gggggaaatttttggaaagggggaatgtgtggggccctttttgttttaaacccacttgggaaaaggggatttttttcaaaaggatttaatttggggaaccccaggttttttccattcccaagtttttaaaaaggggcccagggaatttatttttgggcccccaaaaaaaaaattttaccttgccaacacccgttactaaaatttgaatctcctaaaaacccnccccccctttttttttttttttttttttttttttttttttttttttttttttttttttttttttttttttttttttttttttttttttttttttttttggccgcgcgttttttttttttttttgggcccccacaatattccatcttatttaccaccaaacggtgtatcccaagtagcaaaataataatgtgttattacatgattaagaatagcaatcttctgcacttggatacaacagattcccctgccttggaacaaaaaatacttcgaattggtgtggtgccataacatcaagtacaattgccccccatcttaacaaattattgtgcgtgtttcaaatgctttgacgatggtattcaattcatgtgaataccaccacataagaaagttgggaggcttcatgatcatctatctggctagaagctggcgtcctctgttgtcggccgcctcaagaaatagcgcaagctattagaaagaacctgttgtaaagcctcggtcagtgttctgcccctgtagctgacatggaattttgctttagccaggagcccctcagtgtcaaactctccagattggacattaatgctgatgtccgagatgatcttaacaaggtcaaccagtaaccctggacgatccgctgtttccaccacaagtaagcttctttcagggccatcatcatagatatctatgtgggttgctatatccacatcaacctcttccgtaggggcttctggcccaaaagttgcccccatagccaattgactgctggactccggatgatactgtatcatgttgttaatgatcgtcagtcgaactgcttctaacaactctggatcatcaattttacggccagtgaacgctctagttatagcaaacttgatatgcttgccagtagaatcgagacagacactagctttaacaacatttagccccaagttctttagcgcactcatcgtatcaaggagatcgccaagacgatcacccaaggttatttctacaatggttgcatccggatctgagtcttggtctattataactttcgggatagggactatatcagtgttgctcccatcctcaaccgccgcaggggaagtagcccttggaaccctcacagctggagagaacaatttcaagttggcgggcgccgctggtgcaagaggcatccaccgaccaagaaccgcagcacggcgggcgccggggcacgtccggagggtgcttttggcggccgcgacagtcacggtcatttcggccatctctgctccaagaaacgggcagagagatccagtccgatctagcaacccgagtgggacgaaataggggggcggatggacgaggaggtagtgctacaaaggcgaaggcgagagcgatgggatcatgacgataatgtctgcggctgtcgcggccgctctatccatatctttgttgcggctggcggcagtagaggagagggggcgggtgagaagtggggatggctagcggcaccggcacggcagcagagggaggagcggatgcggagcgcggagggtggtgtcgagtggccgagt

SEQ ID NO: 16221 - DNA, 1031 bp, Zea mays
aagaagaaaaacaggcgcaatatagcatcctgcatccaatccacagttggtgcggctactagctagctagtctgctccacgctgcagggcttttagcttcatggccgggctaagcgttctcctggagaaccacagcaagagctacaccgggaaggcggcggcggcgcagatcatcagcaaggccaccctcgtgacgacgacccacggccccaaccaccagcaccagcagaaggtccctgtctctgcggcggctgcgggctccttcctgcagcgctgctgcctgtgccacaaagagcttgccgagggcatggacatctacatgtacaaaggcgaccgggcgttctgcagcgaggagtgccggtgccggcagatcttcatggacgaggacgccagcagcagctgctgcggcaacggcaacggcgcgggcgccgccgccgccaccgtgcgcggcaggcggcgagtcaagacaagacaaggatgggaacgtgaatgggagacgtagcttagctggtgcaccagatgaccagatcttcttcatggaaacatggatgggagacggagacaagacaaggatgaagatgatgagcacagtgtggaagtgtctgccagctcatcccccgtggggcccgtcgccgtcgcatgcgcagcacactagtagtacgtgcgtggcatcttgctggacccactggataagatggccgcacgacttggagccgctctttgggccccacctcatgaattggatcaggatctgaccgagtagttagcgggccgcttctttgcttcttttccttttttttgtcacgtcaaatccactccccttgaaatgcagattacctcacgcacgcaaaccttaaccgcattcgtcaacgcaacggtggatcactgagcagtcagcggagttgatcccgtatgggcgcgcggcggtatctgctggaaatgattttgtttttttcttccacttattgtatccggttctgtattatttctatattgtgcgacaatgatacagttgctgtactccagtcctc

SEQ ID NO: 16222 - DNA, 847 bp, Zea mays
  misc_feature (796)..(796): n is a, c, g, or t
gggttccgcccggcaaaagaataagaagaaaaacaggcgcaatatagcatcctgcatccaattaatccacagttggtgcggctactagctagctagtctactccgctctgggcttttagcttcatggccgggctaagcgttctcctggagaaccacagcaagagctacaccgggaaggcggcggcggcgcagatcatcagcaaggccaccctcgtgacgacccacggccccaaccaccagcaccagcagcggaagatccctgtctctgcggcggctgcgggctccttcctgcagcgctgctgcctgtgccacaaagagcttgccgagggcatggacatctacatgtacaaaggcgaccgggcgttctgcagcgaggagtgccggtgccggcagatcttcatggacgaggacgccaccaccgtgcgcggcaggcggcgagtcaagacaagacaaggatgggaacgtgaatgggagacgtagcttaggtggtgcaccagatgaccagatcttcttcatggaaacttggatggggagacggagacaagacaaggatgaagatgatgaacacagtgtggaagtgtctgccagctcatcccccgtggggcctgtcgcatgcgcagcacactagtagtacgtgcgtggcatcttgctggacccactggataagatggccgcacgacttggagccgctctttgggccccacctcatgaattggatcaggatccgaccgagtaattaccgggccgcgtcttcgcttcttttcctttttttgtcacgtcaaatcccactcccttngaatgcagattacctcacggcaccaaaccttaaccgcatttcgtcacgcaa

SEQ ID NO: 16223 - DNA, 2476 bp, Zea mays
actatagtcggaaatataactattctgtagttttaacaaaaaatataataaagtgatgtattgcctaatttttaagatttagtacacaaacaactctttttcatcatccatattagttagtgtaattataacatttgttttttgcttattcattcatttgaacacaacaaaagtatataacttaaataaattatatgctagatctatcccatattatataaaacggtagaaaacggtattagcgcgactcggaaacgaaaaatacgaaaacgattgaaaaactagctaaatcgttttatcgtttttaatcggttcccgaacaattcgaaaaacgatcggtaaaaaaacagtattcgaaacgggacggtacgggaatttcccgtcccgttttcatccctacggcaatacgtggatgcagccaattgtctggccctactactgacaggtagacccacagaacacagctacgctattcgggcccggcagtcaagtacgcacaaaccctgcagtcaacgaagctttttcttcattccggagcaaaaacaggacaaaaaaaccattctccatggctccatgcttggtttccccaaccccaacaatgcaatctacgtgaggcaatctagcaattcccgagacccggacttctactagttcattgctgaatctcatccgacgccccccgattcgcccagcggcatcggagaacaagtccatggaagcccatccgaccggcgccgccatcccttcccccgtggcggcaccacagccgccgccctcttccaccaccaccccgcccccaaccgctacaccacaggagcaagccgccaccgccgtcactgctgtgcgctctccccaacccgtgcgtttggcattcctcgtcgtcgccgtgctcatgtccgcgtcgtggttcgtcgagccgttcagcgcagcggcggcggcggccgacctccgcgtgccgtggcccgctgtcgtggccactctcgtctgcttcaccgcgttattctgcgcatcagttctcctcttcgggtccttcttcatgttgcggccaccgctcgccgccgccgtcatggacgcacagtggaagggggtcagggccttcgccgccgtcttcgccgcggtggcgattggagttgccgcctgccttgttggcgccagtggatccgcgtatggttctggcggtatgcaccagctcgttgctgaatagcgtggatgctggctagatactgcactactgtatatcgtgcccgtactgttgctgttatctgcatcacgtgctgcattttgctcttcgtgtagtatactactgttatgccacacgtatatcatgtctgtatcgttcgtgtagagtctacaggtataatgtatgtcatacataaactatgcatgcatatatggtttgtctgaagaaattatggaaaagatagagtaaaataaaatgttctctttgatgagttcaccatgtggattatggatattttttttacttcgatctgctatgcaaccagagggatccatgttgggcccaactattttcagggaaccggatcattgaaaattaggcagggttttatggtcgaatcatttaggagggtacttaaccatgtttgagaaattgtaatgttgcttttatttggcacaattatcaaataggaaaatgaatctgagattgacacaataaggatctgttcagtttcctgtttgttgattatcttcatctcctcactaactactgatcatactgataatttcataactaaccacatttctcaaaacataattaaaattaatgtatgtgcaatactgagacatcatctagaactttggtgcttgtaaccaggttagtattgtctcttttccaatcaggatataactgtacaatcaatacatggtctggcaaaatgaattgctccattccaagatagttgccactatggtattcgtgctggtcaaagtttttgaagtttggttagatttgtagtaaatattagcaacatttgtatctccaaataagtttattatgaaaatagattcaaagttctatcttatgatactaattatgtactgtaaatattaatattttcttatacatatgtggtcaaatataaaaatggttgactcctcgaaaagtgagaatgactactgttttgggccagggggagcgagtcatttgctgtatggtgtgctactgaaagttcttgtgttctagaaaaaatggtgttactgaaagtttggtaaaggctctgtttaaacaaaagggcaattcatataatctcttgaatattttatcaaactgctgaataaactaactgtacattcatttgaaggtttttataaagggccatactacagttcctaatcatatttactatcttctttaatgtatacgatatctattgaagaatttgttggacacatgtatgtggctaattggtgactcagaggtagcagcagagcactcctatttgatgaaaaagaa

SEQ ID NO: 16224 - DNA, 2855 bp, Zea mays
atcccccagtacgagtacgacaagaatgtgcccaagaacgtgtcgagctggcacgcgtcgctcctgtcgtcggtgtgcgacactgccaaggaggtcctagaagcggacccgaccgccattagccggctcatctactcctaccgcaccgtcgtcaacggcttcgccgcccgcatgacgccggaggagctggacaagatgtccaagatggagtggttcgatcgagccctccccgagcagacgtttcacctcctgaccacgcgcacgccgcacatgctcgggctcatgggcggccgacggcacggcggcctgtggaacacaagcaacatgggcgagggcgtcatcatcgggatcctcgacgacggcatctacgccgggcacccgtcgttcgacggggccgggatgcagccgccgccggccaagtggaagggccggtgcgacttcaacaagacggtgtgcaacaacaagctcatcggcgcgcggtcctacttcgagtcggccaagtggaagtggaagggcctccgcgacccggtgctcccgatcgccgaggggcagcacgggacgcacacgtccagcaccgcggccggcgcgttcgtgcccaacgccagcgtcttcggcaacgggctcggcacggcggccggcatggccccgcgcgcgcacatcgcgttctaccaggtgtgctacgaggacaagggctgcgaccgggacgacatactggcagcggtggacgacgccatcggggacggcgtcgacatcctgtcgctgtcgcttggccacgaggatgccatcgacttctcggacgaccccgtctcgctcgccgggtacacggcgatcctcaacggcgtgttcatctgcgccgcggcgggcaacaccggcccgtcccccgcgaccctcgtcaacgaggcgccgtggctgctcaccgtgggcggccaccaccaccgaacaggaggttcttggcctccgtaaagcttggggacaccgtccagattgacggcgagtcgctcaacgaccctaacaccaccatgggcgacctggtcccgctggtgcgcgacgtgtccgatggcctgtgcgtcaacgggaacgtgctgaaggcacaaaacgtctccggaaagatcatcatctgcgaagccggcggcgatgtcagcaccgcgaaggccaagatgctaaagggcatcggcgtggtcggaatgatcgtggtgaccccggagttgttcggtccggtaatcatcccgaggccgcacgccatcccgacggtgcaagtctctaacgcggcggggcagaagatcaaggcctacatccacaaggcgcggggcccgacggcgacgttcgtcttcaaaggggcagcgttcaacaccccaaggtcgccgatggtggcgcccttctcctcgcggggcccgaacaggaggagccgtgggattctgaaacccgacatcatcggccccggggtgaacatcatcgccggcgtgccctcgatcgaggacgtggacctgctgcgcaacgcggaggtgcccaggttcgacatcaagtccggcacgtccatggccgcgccgcacctgagcgggatcgccgcgctgatcaagcacgcgcacccgacctggtcgcccgcggtcatcaaatcggccctgatgacgacggcggagcctaacgacaacctccggaagccgatccaggacgtcaacggcaggccggcgaacttggtcgccattggcgccggccacgtgaacccgaagaaggccatggaccctggcctcgtgtacaacatgacggccatgggctacgtgccgtacctgtgcgggctcaactacacggacgacaaggtgagcacgatcatctacccggagccgccggtgtcgtgcgccaagctgtcaaggctcgaacaggacgacctcaactacccgtccatcaccgtcatcctcaaccagccgcccttcaccgcgaaggccaaccgctccgtcacgaacgtcggcgcggccagctcgacgtacaccgtggaggtgaacgtgccggcgtcggtgacagtggaggtgaacccgccgaagctgactttcaaggcgctggaagaggtcctgaactactctgtcacaatcaagtcggccaacggccaggcgcttaccggccctgtcgagggggagctcaagtggttgtccggcaagtacgtcgtgcgcagcccgatcctcgtcactaacgaagccgggccctcgccggcggagacacgcaaaccgtaaccctcgatagcagctggcaaatgcctacttattacgtacatggtaacgattagtttgccatttgagccagcgcttgaaatcgatgggattgtgagcttcattcacttttgattcggtagactaaattaggcatgcagatgcagagcaaatccctccatttgtggtggaagtgagagatacataattacctccttgttttttatatatttattattaagaaattcctgacgaatttattacaagtttaacaacatcgtggttctaccattaacaatgtcgagtaattcatattttatattgcatgaccagcgttggtcacaggctatggggcaaagccgggtacgaaaaccaaatgtatcctcatttaccaattgtggtttatccggtttttatcataacatgattaattgaacacgtgcgtcttctcttttgatactattcatttttaaatgtatcctcatttaccaattatggtttggccgattttgattagaacatgattaattgaacgtctgattctgttcattttaacatccgctaggatacacaatttgagctcggtaacaacttgacgagtcattctcttctactgttctgactttctgactttgagagggacagtagcctgtagcc

SEQ ID NO: 16225 - DNA, 2612 bp, Zea mays
aactgtgtgagctgtgtatcagtagcatcttgggccatattcggacgccgagacagggccgtctgcaactcgattttcacaaactttgcctgtactgaatacgaaactgcaatcccaaccaattttgtcaaggccttctgctgccactgtgttgacagtctctgatcgtcgagatgggtcaagctttggtgatcagtctgaataataaactctccatgttgcaagtatggtctccattgctccacagcaaatagtatggccatgcattccttttcatatgtagacaatcccaagtttttttgacccaaagatctactgatataggcaatgggatgtcctccttgctgcagaactgctcccactccacccccactagcatcagtttcaatgataaatggcttagtaaagtctggaatagctaaaaccggagcttgtgctaaggctatcttcagtgccttgaaagactggtctgccagctcggtccagacaaatagggtgtccttccttagcagcgttgtgaggggcttgctgattataccaaagtgtgccacaaagtttctataataaccggccatgcctagaaaactcctcacctccttcacacatgtaggtgtaggccaattctggattacttccacttttttgggatctgtagttactccagcagcacttacaatatgtcccaaaaattccagttgcgtttgagcaaacaagcatttggattgtttcagatataactgttgttgactgagcaactcaaatacttgccttagatgcttaacatggtcatctaggttggcactatacaccaaaacatcgtctaggaataccacaacacacttccgaagtagtggtgccaacagtttgttcatgaagttctgaaaagttgcatgtgctccagtcaaagcaaatggcattacgcgatactcgaagtgaccatggtgcgtttgaaacgttgtcttgtactcatcgccttccttcagacgtatctgatgataccccgagcgatggtcaagttttgagaaaatagctgcacccccaagctcgtcaatgatttcatcgaagatgggcattggatatctattctttaccgtatgagaatttaatctatggtagtccacacatagacgccaatccccatcctttttcttgactaggagtattggagaggcgacaggactagtactgtgttgaatcacaccactgtctagcatctctttgacttgtttctctatctcatccttctgctgaggggtgtaccgataaggtcgaagcctaaatggttgtgctccaggtaacaattcaatggcgtggtcaacctgtattttcggtggcaggctgtctggccggagaaacaagtgctgatattgttccagtaattgctgcacagcttctggggtatttttaacagtcaattcagttacagtctgcaattccaaccaatgctgcactgcttcttgctttatcatgaaacccaactgttccccgttcaggccgtaacaggtctgaacctttggtaacacaccctgcacgtgaactctcttcttatcataatcaaactccatccattttgcagcccagtgaactgacataggacagtggcgttctagccagtccatgccaagaatcatgtcgtaaccccctagggcaatgaatttgaaatccgttgtaaaagtggtgcctccacacaaccatttgcagtttggcaaccagtgttggctccaaagaattcccccatctgctactttaacttgcattggcttggtcaacagctcaatccctggtaagacattcatcaagtgacttcccagaaaactagcagagctgcctgaatctactagcaccagcaattgttgacaataaactgaagcccaaagtcggatagtcctgctgccctcaccaccctcagcagcagcagcagacaatgctagcacactgtcttcattagtttccttactgtccccgatacagtcctccagcttctcctcttcattgacaaccaattcccacatttcttccaccaagtacagaggaacattagttgagcagcggtgttcatagccccatttgttcccacacttgaaacacagtcctttagcctttctgtacgccttcagagctgatagcttgccctcatctcttctgccttgttgtggtccatggcctcgacgttcttcagtgttgctcaccgccctgttgccccccaatggtggtaagggtagtggcataggcgttggcttaactgacggtcggctggaataagcaccaaattcagttcttcgaccatctcttcgccccgagtgcagcagcacatcctcctgcaataaagccagggatccagcagtatcccaatcggatggacgctgaataattacagcacttttaatctcgtctttcaacccatctacaaaccgaccagtgatcatagtcgaagtgaggtggttctcatgggctaataattgatgcataagctggtcaaattgttctacatattcagctactgagttggtttggtggatgtgatagaagtgtctaataagcaggttatgctgatctctaccaaacctagtgttcagcgtagcacagagcgcttcccaactcagttccctgat

SEQ ID NO: 16226 - DNA, 1617 bp, Zea mays
cccattttctcggcctgcctcgcgcaactcgtcccagcacaccgctgtggcgctgtcgtcctcgctcacctcgtccgtcctcgtgagctccgcctgccctccatctggacagctccagcctccagccatctccccccacctgtacacagttacaaagcttggcacttcgcagttcgcactcgcatgctcttcgcccctcgcgcttaccgctgccgcgcctcccgacttgccgcctccgcctagctccgggctctccaatggcctccatgctcgccatcctcaggccctccgcgccggccccgctcgcggggcgccgggccagggctgccgcgccggcgaccgcgagggtggcgctatcttccagatctaggtattcgtcagccagggtgtcgctcggctccgaggttgcagtgggcgccgacgcgctcttcgccgactataagcccaccaccgctttcctcttccccggccagggtgcccaaaccgttggaatgggggcagaagctcagagtgttccagcagctaccaaattgttcaaccaggcaaatgaaatccttggatatgacttgctggatctttgcaccaatggaccaaaagaaaagcttgactcaacaatgatcagtcagccagctatatatgtcaccagccttgcagcagtagaggtactacgtgcacgcgatggaggccaagatgtgattaactctgtagatgttacatgtggtctcagtttgggagagtataccgctcttgcatttgccggtgcttttagctttgaggatggactgaagcttgtcaagctaagaggagaagctatgcaggatgcttcagatgctgccaatagtgcgatggttagtgtgattggtctggattcagaaaaggtgcaagaactatgtgatgctgctaatgacgaagtagatgaaaacgatagagttcaaatagcaaactttctgtgccctgggaattatgcagtttctggtggtgtaaaaggtattgaagtagtcgaagccaaagcaaagtccttcaaggccagaatgacggttcgcctagctgttgctggcgctttccatactagcttcatgcaaccagctgtttcaagattggaatctgcgttggctgccactgagattagaacacctagaattccggtcatctccaatgttgatgcgcagccccactcagatcctaacaccatcaagcagattttagctcagcaggtaacctctccggtgcaatgggaaaccactgttaagaatcttatgggcaaggggcttgagataagttatgaactcggacctggaaaggttatagcaggtattctcaagaggatcaacaaaggcactagcattgagaacatcggggcttaaacgtctgggatctgaagaactcttgatggaaccaagttacacagcagaggattgaaacatgccattattgtggaacgatgtttccactcagagttaccgttttttttaccttagtggttgaattttgatcttgatgtaaaattgacatgaaacacatggttaatgattttatgaacagtgtagttttcacagtttgaacaaaaaaaaaaaaaaaactcgagactagttcgctctctccctcgctcccgcgcct

SEQ ID NO: 16227 - DNA, 1166 bp, Zea mays
ccagcatgttaaatctgctgattttgattcattaagatattaggatggatgaagtcacacaagctgttgaaaatcttaagtgaggatggggccaagcagtttcacagcttgacgagaacattactgcaattgaatcatgtggaaaaacagggaaagggacagaggaagcaaattgtcttccaaggttgaatggttctgcacaggatgctctgcagttgctgaagtcactgcagttccagcttgatcttctagcacagcagcttcccacttttgatgaggtgcagtctggtcaagcaaccttgaagtcatgggatgaacaatacaagaagtaagatattcttggagacttggagtttgtttacttttgttatcctttttagcctactttttttatataaaccttgaacatttttgcaggcttcgtattagcttgaggaatgctaacttagaagcaaaagacaacattagacaagctgctgaagaggaggtacgtgattatgcctggactttgatgatattgatccaagtgatgagctgtctgagtggtacatgcttctagggctcatttggatggctcctggccggagctgcctggcccaggaatccatcccaggcgtccgattttggtcgcatggggctaggatggttgcctggccggcgagctgcctggcagggtagcaaccaaacaggcccctagagtgtcaccaatcaccaatgcaatgtgaaagattaagaattcatgttaaattttaaggacctattctttatatgcagtatgtcttctcagaggttttttatgtactcatttaagttcaaaagcaccattgaaactaatgctgctttagttttttgcaatttccctggcaaaattagcaagaaaatgacctgtaggcaccctaccacctttttagagcatcgcaggtgccattataacttggctatcggtttctaattgacttttctctagagggcacttcttctaggcggtggtgaagagtctaccatccgtaggcgtaatctccagtaagttgatttcaatgaggtctctttcccttaagacaatatatatgggtgggatatttaaggagcttttataatttaatcagttacatgtgtatcccatccatctggtttcatcaaattcaggttacctgaaattaaaaagc

SEQ ID NO: 16228 - DNA, 1137 bp, Zea mays
cattgggttcatcaatttctcctccaccaagttcctcctcccttcgacttcctctcccccgtctggccgtgcagccccggaggcgtcactgggcaaggaggctggggtggggacctcaaacgccatggatgtgcagccctaggcaccagatattaggatggatggagtcacacaagctgttgaaaatcttaagaaagaatggggccaagcagtttcacagcttgacgagaacattactgcaatcaaatcatgtggaaaaacagggaaagggacagaggaagcaaattctcttccaaggttgaatggttctgcacaggatgctctgcagttgctgaagtcactgcagttccagcttgatcttctagcacagcagcttcccacttttgatgaggtgcagtctggtcaagcaaccttgaagtcatgggatgaacaatacaagaagcttcgtattagcttgaggaatgctaacttagaagcaaaagacaacattagacaagctgctgaagaggagagggcacttcttctaggcggtggtgaagagtctaccatccgtaggcgtaatctccagacaaaggctggaatgacatctgctgctgaaagtatcactgagagcctccgacggtctcgccagatgatggttcaggaagtggaaagaagtgctagtaccttggcaacatttgacgaatcaacaagtgttctccagaaggctgaaggtgaatatcaaggacatcgctctttgctgatgcgtacccgtggtttgctctccacaatgcaacgacaagatgtttttgataggatcatcctgactattggtttcaccattttctccttggcggttctttacgttgtctcgagacgtattggtctgttggctctgcaaaggaaactggccgatgccatcagatcaggttctttatcagctgaggacattgtcgcgaaagcccaacatggacctgccccggcaaatgttcctgctcctgctcctcgcgtttacaatgaattatgaatcgcttttattttccgttttatgaaatgtttgaccaggagagattgttaaggtaatactttccacaagtaagctattaagatttcttatctgtagtcccaaaaaaaaaaaaaaaaacctggcaacgtttg

SEQ ID NO: 16229 - DNA, 881 bp, Zea mays
ttttttttttttttttatttttttttttttttttttttttttttttttttttttttttacagtaaacagcgcgaaaccttttattattgtaatcagacacatacaaacagcttgctcgcgtcgctctcgtcactagagccatggcctgcgggctgcggcgcacaactgccaacagattcactagtcagcgtgcgacccaggcgcacaaaacgctaggagtccgttcatttttacagcaggggctcgaggaggaagcgccagtggcggtctcggaagatttacacagccccggtcgtcaaggtgagaggcttcagaatgtggcgagcttttccgttcaggtacctgtggtggtggccgcggcccgcagcgttcggtcaccgagctagccttcttctcgcttggttacggttccaggagccttgaaactgtctctacgttatcaggggctgcggtggtctcgctgggtggtctcacattggaatggttcttcttgtagaacctgatggagatcagactgctgtgtgccctgactgaggactcgggcgatccatggaaactcaccgccgactcgtgtcccgagaagaaaccttgccacagtatgacgatgcagaagataatggtaatgatcagggggcacaaattgccacccgaggacccttgcttggcattcttcatcttcttcaaagccttcatccgctcaatccttgcccgtttcaacaccgcaagctcactcagttcgttgaggagcttctggtcagaaacatccaacggcgtaggtgtcagcggccttggcggcccccgtgccttcttggaccgcttcttcttcgtcttctcccctcctgagctgtccataagcttctcctccccctcagacttcggtc

SEQ ID NO: 16230 - DNA, 1489 bp, Zea mays
ccggccggcgcagggaactgaggaaacgtctcgaatggtcgaacagtagtttgctcgctattatccatggcgacttctacggctgctgccactgcactgctccgccccaggccggcagttccagccaagttggcgcagaggaggtgcctccatgcggttgctgggtggacgacgatgaggaggaggggagctgcaggggtcgtgcgagctttcttcaaccctctcggggatgagcgcatcctccgagaagccatcaaggagccagtagcattcatgggtggtgtgtttgctggcctcttgaggcttgacctgaatgaggatcctctcaaggaatggataagtcggacagtggaggcttctggaatagctgaggaaaacagctctgaagaatcaagtgaggcagatcaaaatgatgcacctcagcaaattgagattgagtgaggtgcattgtctacttttgtccacttgtcacttttcccttgtaacttatcctgaatatatgtgacacctgattcatcacgtgcttgtcaaaaaaaaaaagttggccttataacgtttttaattcaaatattgtatcaacctcaaaatatcaaaccttgggccctggttttattctacaactcctgtttcataatatggagccccagtcctctagacatgattttaaacttggccataagtataactagagtgtattaccagtaaatggaaagttacgcttttgaatgaaatgcatgttcaatggtattctttgacagctaactctacatatgaatgcaccaattcatttctcaatgtttgcaaactttgaccctttgtgatgtgttagggcatcatatagttaaatggaggcactcgttggaccacaataaaattaatttcactggtacatgtattaggggatagttggatgaccaaacattatttcgcctttctacattatggtagacctgaagtcggttcttgcctgcagtgctgctttattttaaaaaatgatattttttgtccttctgttgctgatattagaacagtatattgttggcctcatgtatctattggcttcaagtgaagttttgagttacatcagttgaatatttgaaatgtaagagactaagaacaaccttcaatggacatgtagaaaagatattgcaaggctttttggacatcacatccgaatttggagcatgtcttactgaaagtgcagtgtattaattcatgaactcagaatgttttgcacagcgtttatgctatactatctagccttcaaaataatagaaaaaagaaatcagctttgtgtgttccatataaacaacttctatggagccctgctgcttgtaagcagctttggttgcatactacaagaaaaataagaaatacataatttcttcagcagatcttaaactaaacaaaatttaaatatcttggcatctccattacatgatttagatagaatttgtcaacaatatagccaaaatctttgagtaaacaa

SEQ ID NO: 16231 - DNA, 2717 bp, Zea mays
gtgtttttttttcgtgcttcggaccggcccatcaggcccgggccaaatgtacacctatactcgtgatgccccctagccgcaccccaacaaacgttgcaaatgcctcgctcacggtgccccacccctgcgcgatgcccgcccccattcccgccccgacagatcgtgttcgtcctctagatcgctgagacgaccgtcgtctcctccttgccccgctcgcgcaaagcccgggccctcccacccgatatcgcaacagaggtccaccccgcccctctgtttaatcccgcgtgacatgcatcagatgcagatgcaacaccgccacgacgtcgaacggcgatagtgagatgtcccacgccacctcctcctctgcgctccccgttccccaggtcgcgcgcacctgctcccgcaccggagaacccaccgcacgttggcctcgtcccgacatgtcggcgacgctgtgcttcatgggggttgcgagggagtctctgtctctggacgcgcccgtcgccgcccccaagctcgggagggagcggcgctcggccctcgcgagcgcgaactcggggccacaatgctggaggtggaggaggggcctggcgatgcgctgccagacggggtccaccgcagcgcccttcctcaggacggaggaggcccccgcggccgcgtcgggggcaaggaatgcccaggcggggttcaccatcgtcatgaagttcgatggctcgtcgctcgcttcagtcgagcggatgcgggaggtggccggcctcatccttagtgcaggggaaaggacacgccttcctctcgaccgcacggaagggaagattcataccacagccgacagagtcaggcgcaagatggctatcacagaaccgatatagagattgatgtgtttgccgtgcgctccggcagcagcgattccgacaggccccacggcggtcgcaacccagccagcggcgagaaccctgggacaaggacaattactagcgtcggcgctacagcaagcggatcaggccaagaggacctgcttgtggccaccaatattacagaggcgtgtaagagtgaatccagtctcgctgctccgccatcgaagccgtctgtatctttttgttttgttttggtcggagtttatttgctctagagagaccagtcacctggtatggaacatctactaatttcagagaattttgcatgttcgtctcggtgtgtcgttacgcaatttgcggatgatgcaacgacactgaagcctgcgtagaggtgacgggcggcgaagaagctagccaagctgtgaaaacggacatagacatatggtaggttatcctgtatccttttcaatcgaatgtaggattggatacacataattataaatcgattgtttcaggtatgttgttgtttgctccactctgctcttggaacgcctcagctgttcctcttgctctatcatgaatgcttctgttagccatacaacgtgagctcagggatatctttttccgaaacagtgcaaaacccaattagttaaatgatatttttagtggaaatgtagatactagattttactaggactacgaactcggctctcagtccatttctgtataacagtaattggatactcattctgttcacagactcttcaagagtaagagagctctcatgatttcgttcatcatggcttgttgatgctaagagagcactgtgcaaatcttggcacttcacctgttctcacattgcctccttctgttgacaatcacagatgcccactagaaaatagtaatcctcttggatcatcttagtcagctatttggaaatcaaacaggtgcatatatctggtagtgggtttgaacaagtctatcctatgtcttatgaaatcgtagttttggggcaaaacatgaagctgtactgtactgttcatcactccatcgtctcaatacacacgagaccagaatccaggaatgggctgcagacttgcgtgttactttatttagtagtttaggacttctgatgttggtttctaggggattatgtaatagggttgtttgctctattctaagaattttaatctgcatgacccaacaatcaccctagaaattagtgattcgggacagttgaggttctcgatatttggcctacttgccaattaatttatttttcttgtggtccttgtaggggtttgtgctagaggatgctaaaggtctatcacttaatggggacctcaatgtgcatccagtgattgcaaggtcttttcccctacacatccaatctttttggtaagatggtgaaatggatttgcccactttaagattgagcatactgaggtgtatgtgtgtatttatgtttgtgtttacctcctaatttttgtcctatatatttttatttttttgcatgataactgggaattgtatgttgtgtcacgaccatccaacagtttatgaactatactcatcaagtcttggtggtgttcctaatgcaaatggggattcaatgacaacacgagtagctgttgatcaccatatgcatcaagatttttcaaccaacaagtaaaagttcagacatgtctttcagtcacattattgctctggtatacattctgctttattaatgatctttcaaaacaattcagattaaagcatttaactttggcacaactacataatcagccaaaatatgaagcttagtttctcacgataaagaccttggtaggatgtcaaggagcaccctgtcgtcatctatat

SEQ ID NO: 16232 - DNA, 3670 bp, Zea mays
  misc_feature (3084)..(3084): n is a, c, g, or t
gacccattccatttcctatactagaaaaaaataggcggtgggccactccataccttaaccaaacattcccatggtctctttcctggattaaatcatggtttaatattgaacaaacttggcaatgccttatcatgtttaggagtaacaagtgaattaagtcacttcaaatgtaggaataacaagtgaatgggtggagcatggactagttcttcaaaataatttttagcactaatttactgttcaacttgtataaatcagtaatgacttattattattatgttgattctgatgggctgattaatttattttatgtgtttgagcaggatatcaaggagcaacttgtgtctacagattgtgctgactgtttgatagagatcgagactgttgatgcacagccatcccatgtggatggtgtgatcattttggttgctggatattttacaacggctgttgtgaaacagaagtttatacaatcattttttctcgctccacaggaaaatagtggctattatgttttgaatgatacattcagacttactgggatttcattcgaggtgaaggtagttgcagctaaccatgataacaaaagcacacagattaccaccctgcccaatgagccaggtgatgaaacatttactagtttaaatctgtattattatgtatatattcactgacattttgatttttatatttgatcagaaatagattcatttaagcggtcggccaggtgtaccacctgcaggaaacattctcgtcaatgatggagttatcagcacctctgcaaatgttgtttctccagttaagaatgaccctgttgttgagacatctatgaaagtggttaacgaggatgttgtgaagatacctgtagccgctccagcttcaactcctgttacagctgaggaagttgttaacaaggattttgtgaagattcctgagtctgctccggctctcccttcatcagttgagaaggctgctccagcacctcccgcatcagttgagaaggctgctgcagcacctcccgcatcagttgagaaaggtgctccagctcctcgcgcaccagttgagaaggctgatccagctcctagtgcacctgttgagaaaggtgctccagctcttcgcgcaccagttgagaaggctgatccagctcctcgtgcaccagttgagaaggaagtaactaggaagacttatgcatcagttgttaaaatcccgagggaggtaccttttgccgttgcaagtaactaatgtctccaagttatcatagtgccttttttcaattatctggaggattgcatgttggcataatattgtctgttgttggtgacttgtaggttaaaatcccgagggaggacacacagcctgccccagctgccagaccctccaagcccaacctaaatataaagatggttcaaaatacggagaaaaatgtgtcctcaccatcgaaacctgctcatgctactgttaatgccctaccgggcgataagggtgttcctaaaaacaaatcacctgatggtaagtttctcttctctactttggttccttgtttaatgaaacaagaaaagaatggggcttattctgatttgtagcactactttgttttgcagagccagggtactcaatttttgttaagaatttaccttttgaagcaactgttgaatggtcgaacaagagttcagcaagtttggtgctattaaatctggtggtgtacaagtcaaatgccaggttagcttaagttgtaggtttatgggtgtttggatttgagggttgatgcatcattaggcgattctatgaattttggtgggatggccctgttcatcatgtttatactaactatgtgcaaaactggaatgaagtgatgacagatcaactcataacttttctcaaaccaaacaaaaaattgacgagtgggatgtgctttggtttctacacttgttgacattttcttcatgttgttgcagcctgatcagttttgctttggctttgtcgaatttgagtctcagcaatccatgctagcagcaatcgaggttcgttcgccttcttttctagctgacttatttcagagcatgcttcacagttaaattgttctgttgcattcatacatttgactgtttttttacgcatctgtagtctgtaagctacatgattcaagtattggttagccggagagcatttatctatgtattttgactcatgctgaaggctgtgcatgcacagtgggtttataaagtttcaataactgaacgatagctcacagtatttacaaaataatgtttatattttttttaggcttctagggtttattccggcacaagagaatcatatgtggaggagaaaagaactaaaacacgaggtgagcaaacattttgatctgcataaatctaggcaaatgagcatgcttttattcataactgttggcattctgacttaaaagtaatggcaccctatcctgctttaccgtataagcattgggtacctggacctgtcaacttggatgatattttttgctacaagttctgaattatattccagagaagtcatgattgtgttcgttagcaataattttttattagatatttgtatacctggctaaatattttcatacacagcggactagctcgtgggtaactccctatttttctttatagttaattaattgaaattctacgaactagcagctacttaccattattggaccttttcagtggcctaacctttgacaatgtaattatcttggccttgtgcctgagctcgactgtgcctatgttattttttgtttgaattcaactgacgtgcttcttttcgcatatttgtttcagttgttgatggtgttatcacccgtggggatgacaatggcaacggcggtggcggtcggttccattctggcagaggtggtggttactatggggacggctacaagcggcagtggggcggtcagaacaacggctactacaacggcgcggataacatgaggaacgactactcaggtcgtgtccgtggaccgcaagggaacggccaccctcagaacggccacggctaccatcagaacggccacggctactactctgggaatggctaccaacagcgacnccccaacagcaatgggaacggactgagggtcgagcgcaacaatggcttcaggcagcaaggccctgcatctgcctagaccttgtcatttttgcagtccatccttgatacgaaagcagtggggatattttgatgtctataggtagatactttgtcatggctgaattttgttgtcgcggttgataagagcaatcgtgcgtcctttgactggaactgtaatgaggagtggagtcagtcgtgtcgcaaaggggaaaaaaacatctatcgaaatccctgctactcttttgtcgtgctgtcctcttcaagctgtctgcgtgtacatcggtttttctgcttagcaattggactgggcggagacaagcttctctccaattctcacagcttttgccgtgcaagcttcgccaagcaccacaagcatccgtttccttccgagcggcgctgtcatgcatgggcatcaaatccgcttggttccccggcgtcgacacatgttcccaactccgtggttgcgtttgcctcgcgcggtcgcgctcgtccatgagatatttcgcggatgccgtcgatgtgacaccacccacatggccacatgacc

SEQ ID NO: 16233 - DNA, 2247 bp, Zea mays
ggggccccccgggcccggcccggccggcctcttggctcttttccatctcgctataaacccttcacgccccggcgtccgcggctcgctcctgttcgcgccgccgactcgcctcgcgtcgcctcactagggtttgcagttcccgtcgcgggcgaaggcggcgtcgtctcgtggcggcgccgtctccgtgtgccttcccgctcccaagcaatggccttggaagatgggagcccagctacttttactccacaagtgattgctaatgcatttgtcaaacaatactatcaaactcttcgatatgccagagaggatgcctataaattctataatgacaaaagtattcttggtcgaacagattctaatgggaaaatgatttgtgtaaccacaattgatgatatcaaggagcaacttgtgtctacagattgtgctgactgtttgatagagatcgagactgttgatgcacagccatcccatgtggatggtgtgatcattttggttgctggatattttacaacggctgttgtgaaacagaagtttatacaatcattttttctcgctccacaggaaaatagtggctattatgttttgaatgatacattcagacttactgggatttcattcgaggtgaaggtagttgcagctaaccatgataacaaaagcacacaaattaccaccctgcccaatgagccagaaatagattcatttaaggagagtgaagtgccaggtgtaccacctgcaggaaacattctcgtcaatgatggagttatcagcacctctgcaaatgttgtttctccagttaagaatgaccctgttgttgagacatatgtgaaagtggttaacgaggatgttgtgaagatacctgtagccgctccagcttcaactcctgttacagctgaggaagttgttaacaaggattttgtgaagattcctgagtctgctccggctctcccttcatcagttgagaaggctgctccagcacctcccgcatcagttgagaaggctgctgcagcacctcccgcatcagttgagaaaggtgctccagctcctcgcgcaccagttgagaaggctgatccagctcctagtgcacctgttgagaaaggtgctccagctcttcgcgcaccagttgagaaggctgatccagctcctcgtgcaccagttgagaaggaagtaactaggaagacttatgcatcagttgttaaaatcccgagggaggacacacagcctgccccagctgccagaccctccaagcccaacctaaatataaagatggttcaaaatacggagaaaaatgtgtcctcaccatcgaaacctgctcatgctactgttaatgccctaccgggcgataagggtgttcctaaaaacaaatcacctgatgagccagggtactcaatttttgttaagaatttaccttttgaagcaactgttgaaatggtcgaacaagagttcagcaagtttggtgctattaaatctggtggtgtacaagtcaaatgccagcctgatcagttttgctttggctttgtcgaatttgagtctcagcaatccatgctagcagcaatcgaggcttctagggtttatttcggcacaagagaatcatatgttgaggagaaaagaaccaaaacacgagttgttgatggtgttatcacccgtggggatgacaatggcaatggcggtggcggtcggttccattctggcagaggtggtggttactatggggacggctacaagcggcagtggggcggtcagaacaacggctactacaacggcggggataacatgaggaacgactactcaggtcgtgtccgtggaccgcaagggaacggccaccctcagaacggccacggctaccatcagaacggccacggctactactctgggaatggctaccaacagcgacgccccaacagcaatgggaacggactgagggtcgagcgcaacaatggcttcaggcagcaaggccctgcatctgcctagaccttgtcatttttgcagtccatccttgatacgaaagcagtggggatattttgatgtctataggtagatactttgtcatggctgaattttgttgtcgcggttgataagagcaatcgtgcgtcctttgactggaactgtaatgaggagtggagtcagtcgtgtcgcaaaggggaaaaaaacatctatcgaaatccctgctactcttttgtcgtgctgtcctcttccagctgtctgcgtgtacatcggtttttctgcttagcaattggactgggcggagac

SEQ ID NO: 16234 - DNA, 2603 bp, Zea mays
gctcggtcctggtggacctatcgagtcgacctgcagaatcgtaaaataaactctctgattacttgcatatttaatactactactccaagagagaacctctcttgagccccccatcccatgattacgcaacagtatcatgtgggcagctgtgcctgtgagggccaatcatttcaaccagccaccaaccaaaattatgcaaccggaccggatgacctgtgctgctacagatgcggcaggcttcaacaacacaacagaatagaacaggtactactcgttttgcagttatgtcctgccctgcaattatgtaactggtaaacgagggataaaaagtgaaattataaatgagggataaaaagtgaaattaatatagtttagtttcttttagttattttttatgggactaaagacaaataatttagtccatactttaattctaccgtttagcaatttagagataaaatagaactaaaataaataaacatcctctatttcaaatattttgctagctaaaattcaagaaaataatggctccctaggttgactttgtagggtgcgataaggaaagagataggacaaaaaaaaagtaaattatagaaagagatgctcttatagtatgtttggtttcttttgtccagagactaaagtttagtcgctatcttgtttagttctaaggattaaaattattcaaaacacattaaataaatcataggaaagactaacatacttcttatcattaaatgaaatataatatattttagttttttttagtcacctgttaagaaactagagactaaaaattagttccttagaactggagccggcaccggcaatacgtatttcgaatctagtgttgctatagcgatttcaggagcacatggaccacaaccacattgcgacgaaattagttccaaagtagctttcgttcaccaaaaagaacaagtttggctcccaatgaactagctcaaaagtagctttctttcaccaaacgcaactacagtatgcggtaacaatcaggtgcggataaaatcacacaagccagcctcgggagcacgaccccgtgtctccgcattcctcggatgaagcaactcacgacgagcagcttcggtttgtagagatggtcacagattgcagttgctgcaatagcttggccatctacacgccagcagaggcattccaacagggcccccagggcgtgtgctcttgcaattcatcagtgaagcacttccatccagcaagagctacagattttccaaggctgaggtacaggaagtgacgatggacgatactatcttcctctgcaggtctttgtagtccgatgcaagcttcacatcccaactggcgctctccctgcagggaatcggatgaactagagcgggtaagtggtgatgacggtgtatggcatcaccgcaaaaaatgggtttgagcatgaagcagcaccggttgggatcatcttgctcaggcaacaacgcttcaagcatgggactgaatatggacaggattgtctccagcaccaccttgtcgctttccttcatctgaaagcacaacgagaaagatgtgatttttagatgacgaatatgtcgatcgaacgatgtggcctgtaccgtgattcatgggaccatcacagcacccttacatcagcctctgcagcgggttcgtctacctcacagcctagagcagcacggagataggtcagcaagggctggggcaggccatacgtggggaatcctccggatgtcgacagccatgtcccacgaaccatatgagttgtttggcttgtagtcgccgaagactgagctgtgatgtcctcgtcatccgcggatgtgtcaagatctgcatgcatgtaatcgtgcatctgttaaataaagggtgcacaaaatctgttgatgtcaaacggggaacctgctgttcatggaaactgtgcctagtccctgatcaattgaaatggctatgctggttggacagaaatcgagatagccagactgaactactgtaacaggtaaaagttacgttaggtatttcaaatctaggccaaccgacatttcattggcaagaacagagcaaaagtaacctctctacttgctgatctacatgcagccaggaatacaactgccgtaacagattacctaaaggtataacatcataagggttgtctcctcttggtaggaatccatagaacgtaagaagatgcgaccctggatgtttcccataactgagaaagcattgctcccctgcatcacagggtcgagacaagggaaacttcaacgattttgtagcttcatctactcgaccatagttcaagatatgaggggataccttgagaaaaaaataggaaacagaaaacatgagagacaaacctgaagactaataaaagaaaacttccaggggggcagaactacagaccgagtggttcagaagtccagcgacaggaaccaggcaagtcgataatttcccactgcttagaacaatcatcatactgttcgaataccactcgtcccatgcccacagaaaatcgtcccatgtgcacacatccttccggaatatctcagggaaatttgtgcatagcaagggaaataattcatcatactgctggcgcaagtgctgca

SEQ ID NO: 16235 - DNA, 1791 bp, Zea mays
ggcgcacgggcacgttctggacggccagcgcgcacatcatcacggccgtcatcggctcgggagtcctgtccctggcctgggccatcgcgcagctgggccgcgtggccggccccgccgccatgctgctcttcgccttcgtcacctactacaccgccacgctgctcgccgagtgctaccgcacgggggacccggacacgggcaagcgcaactacacgtacatggacgccgtgcgctccaacctcggcggcgccaaggtcgccttctgcggcgccatccagtacgccaacctcgtcggcgtcgccatcggctacaccatcgcctcctccatcagcatgcaggccgtcagcagggccgggtgcttccacaagcgtgggcacgccgtcccctgcaagagctccagcaacccctacatgatcctcttcggcgccgtccagatcctcttctcccagataccggacttcgaccagatttggtggctctccatcgtcgccgcagtcatgtccttcacctactccgccatcggcttgtccctcggcatcgcgcagactgttgcaaacggtgggttcaagggaagcctcaccggcatcagcatcggcgccgacgtcacctccacgcagaaagtgtggcacagcctgcaggccttcggcgacatcgcgttcgcctactccttctccaacatcctcatcgagatccaagacacgatcaaggcgccgccgccgtcggagtcgaaggtgatgcagaaggcgacgcggctgagcgtggcgacgacgaccatcttctacatgctgtgcgggtgcatggggtacgcggcgttcggcgacaaggcgccggacaacctgctgacggggttcggcttcttcgagccattctggctgatcgacgtggccaacgtggccatcgtggtgcacctggtgggcgcgtaccaggtgttctgccagcccatcttcgccttcgtggagcgccgcgccgccgcggcctggcccgacagcgccttcgtcgcgcgggagctccgcgtggggcccctcgccctcagcgtgttccgcctcacgtggcggtcggcgttcgtgtgcgccaccaccgtggtggccatgctgctccccttcttcggcaacgtggtggggttcctcggcgccgtctccttctggcccctcaccgtctacttccccgtcgagatgtacatcaagcagcgccgcgtgccccgcggcagcaccaagtgggtctgcctccagacgctcagcgtcgcgtgcctggtcgtctccatcgccgccgccgccggctccatcgccgacgtcatcgaggcgctcaaggtttaccacccgttcagcagttaattcttgctgctgtggatgtgctgggtggggcctggactggcctgggtttggacgtatgtgcatgcagcattcattgcgttgcgttcaactgtggtcaacaagggagggagacggatgcagatgcagtgtgagatgtttgcatggaggcccctatagaaacaagtgaaatgtttaggcgcccttgtgcacataatggtcgcattccttgcaagaataccaggggtggggccagaatggcatgagctgggtgtttgttgtgatgacgagtctactgtaggtgtatgaagcagcaacaaaaaaacatgttcctttctaactcttccttcttcttcttcttcttctcttcttctttatttacaattttcttttatgtgttttcgtctaattaaggttctggttttgtagttctaccgtgcaactcattgtacctggaaaagaatatatgaacaggaaattccat

SEQ ID NO: 16236 - DNA, 1517 bp, Zea mays
cacattactcctctttcactcactaacggccgtgcttgcactcgcagcgcatcacttgctactttggtagtggagagcagaaagaacagagctagattattcccaacaagctacagcaaattagttgctcttcatggccgtgtcacacaacgttgggagcaagcacggtgtcgcgccgctggaggtgtcggtggaggccgggaacggcggagccgccgagtggctggacgacgatggccggcctcgccgcacgggcacgttctggacggccagcgcgcacatcgtcaccgccgtcatcggctccggggtgctctcgctcgcctgggcgatcgcgcagctgggctgggtcgccggccccgccgccatgctcctcttcgccttcgtcacatactacaccgccacgctgctcgccgagtgctaccgcacgggcgacccggagacgggcaagcgcaactacacctacatggacgccgtgcgctccaacctcggcggcgccaaggtcgcgttctgcggcgtcatacagtacgccaacctcgtcggcgtcgccatcggctacaccatcgcggcgtccatcagcatgaaggccgtcaggagagctgggtgcttccacgcccacgggcacgctgatccctgcaacagctccagcaccccgtacatgatcctcttcggcgtcgtgcagatcctcttctcgcagatacccgacttcgaccagatttggtggctctccattgtcgccgccgtcatgtccttcacttactcttccatcgggctctccctcggcatcgcacagaccatctccaatggtgggttcatgggcagtctcactggcatcagcatcggcgccggtgtcacctccacgcagaagatctggcatacgcttcaggcattcggagacatcgccttcgcctactccttctccaacatcctcatcgagatccaagacacgatcaaggcaccgccaccgtcggagtccaaggtgatgcagaaggcgacgcgcctcagcgtggcgacgaccaccatcttctacatgctgtgcgggtgcatggggtacgcggcgttcggcgacaaggcgccggacaacctcctcaccggcttcggcttcttcgagccgttctggctcatcgacatcgccaacgtcgccatcgtcgtgcacctggtcggcgcgtaccaggtgttctgccagcccatcttcgccttcgtcgagcgccgcgccgccgcggcctggcccgacagcgccttcgtctcccaggagctccgcgtgggccccttcgcggtcagcgtgttccgcctgacatggcggtcgtccttcgtgtgcctcaccaccgtcgttgccatgctgctgccgttcttcggcaacgtggtggggttcctcggcgccgtctccttctggccgctcaccgtctacttccccgtcgagatgtacatcaagcagcgccgcgtgccgcgcggcagcaccaagtggatctgtctccagacgctcagcgtcagctgcctcctcgtctccgtggcggccgctc

SEQ ID NO: 16237 - DNA, 2221 bp, Zea mays
cattgggtacctcgaggccggccggggcacatccctccccatcccgtgcccccgtctccatccccactcctccaacggccgcgtcgttctcgttcgcccgccggcatcccattcgctcgtctcctcccctccgccggtcgctgtcaccccgcgtcgtcacgcgcccccggccgccgccatcactgtcatcgttccccctcctaaagccacccgtacgccagccgcaatggatttttgcaccgcatctgcatcctctcgccatggcgccgccgcccgcgtcgcctgctgactcggcccctgatccaaggccgaccgccagcgcgcccgtgcccatcaccgtgccgagcccgcgtgaccacgcgcaccaccaccacctggtagatcgtcgggacacgccgcggggccgcgcgtgggaaccggagcggaaccggcgcggagaggcgatggacggtgctgcagcggtcaagctggtacccggtgaggccgggtacgtcttagaagacgtgccgcacgtgtcggactacctccccgatctcccgacctactcaaatccattacaagataacccggcatactctgttgtgaagcagtactttgtaaacccagatgacaccgtctgccagaagattgttgttcacaaggatgggcccagaggtaaccatttccgtcgtgctggacctcgccaaaaggtatattttgaaccggatgaggtccacgcatgcattgtcacttgtggaggattgtgccctggacttaatactgtgattagggaaattgtatgtggcttatctgacatgtatggtgtcaccaagatacttgggattcagggtgggtacagaggcttctatgctcgcaataccatcaccttgactccaaagagtgtaaatgacattcacaaaaggggtggaactattcttggatcatctcgaggaggtcatgacaccgtgaagatagttgacagcatccaagatcgtgacataaatcaggtctatgtaattggtggagatggtactcaaaggggtgctggagtgatattcgaagaagttagaagacgcggtctcaaagtttctgttgctggcattccaaagactattgacaatgacatccctgtaattgacaagtcatttggtttcgacacagcagtcgaggaggctcaacgtgcaataaatgctgctcatgtggaggctgtaagtgctgagaatggtataggtcttgtcaagctaatgggtcggcacagtggttttattgcacattatgctactctggctagcagggacgtggattgttgcttgatcccagaatcaccgttctatttggaaggcgaaggcggactttttagatacatagaaaaacgtttgaaggacaatggtcatatggttatcgttgttgctgagggtgctggacagaaacttattgctgaaaccatgcagtcaattgggaaagatgcttcaggcaacgagctgcttcttgatgttggcctttggttatctcagaagataaatgaacatttcaagaaaaacaagatgaccattaatctgaagtacatagatccaacgtacatgatacgtgccatcccaagcaatgcttctgataacgtctattgcacactgctggctcacagcgtggtccatggagccatggctggatatactggttttaccattggccaagtgaatggtcggcactgctacatcccattctataggataacagagaagcagaacagagtttcgataaccgacaggatgtgggcaaggcttctctcgtcgacgaaccagccaagcttcctttgcaacaaagtcgtcgaggaggcaaagaaggaacatgaaagagcaacgcgacttttagatggctcgccttcccatcgaaaaggttgacgtcgagaaggttgcggcttccaacttgggtcctactaccaactgaggtcgactgccgctgatatgtgcggcggatgaaccttttgcttaccacggtttcagtagctacggcgaccggtgtttctctcactccagttttttctatcaaaaaggaacacattatccctttctaataatttaatagtgttaaatactatcactatgtacagtttggctggcacatgtctgactataataacatgccattttcattgttgttcaagtatattcttttgtaattttgtgtaacaataagttcatagacccccaaagaaagttattataattttatgacagaaatccaa

SEQ ID NO: 16238 - DNA, 690 bp, Zea mays
ttttttttttttttttttttttttttttttttttttttttaactctaaacagctggtaacaccacaaagaccaatctaccgcgagtccacaaagagcagcagtatcaaaatatgaatgtcgtcttcaacttcaacatgcaagcaaccgaagcaacagcatatccagtgctgttgacgttttacagaatttattcattcacaaagctgaccatcggattcggatacatgcgaaacgtgattgccttccaacagcgccatgccaatcctagctaggtagatccctcggccttcttgtcggcgtcggcgggcttggccttgtcggagtcggccttctcctgctcgagcctcttcttgagcttctcctgccgctccctctccatcttctggatgtagacgctctccttggcgcgctcctcctcgctgagcacgcgccccttcccgtcgctgaggaggcgccggccgcccgtcgccgcggggggcgcaggagcgcgcaggcgcgcggggagggaggtcagcgcggttcgcatcgccatctcgtgctctcgtcgtgaactcgggtcgaatctggctgggctgcgcctgcgctgcgtgtcttgggtgctgccttgcagttgctggctggctgggtggactgaagtctgaagtactgactctgcccagctcgccctaggtgggcagcattactagtct

SEQ ID NO: 16239 - DNA, 654 bp, Zea mays
  misc_feature (32)..(35): n is a, c, g, or t
  misc_feature (38)..(41): n is a, c, g, or t
ccgccctttttttttttttttttttttttttnnnnttnnnnccccccctcgagtttttttttttttttttttttttttaccgcgagtccacaaagagcagcagtatcaaaatatgaatgtcgtcttcaacttcaacatgcaagcaaccgaagcaacagcatatccagtgctgttgacgttttacagaatttattcattcacaaagctgaccatcggattcggatacatgcgaaacgtgattgccttccaacagcgccatgccaatcctagctaggtagatccctcggccttcttgtcggcgtcggcgggcttggccttgtcggagtcggccttctcctgctcgagcctcttcttgagcttctcctgccgctccctctccatcttctggatgtagacgctctccttggcgcgctcctcctcgctgagcacgcgccccttcccgtcgctgaggaggcgccggccgcccgtcgccgcggggggcgcaggggcgcgcaggcgcgcggggagggaggtcagcgcggtccgcatcgccatctcgtgctctcgtcgcgaactccggccgaatctggctgggatgcgcctgcgctcccgggcttggctggctgggtggactcaagtctgaagtactgactcgcccagtcgccctaggtgggc

SEQ ID NO: 16240 - DNA, 1700 bp, Zea mays
agctaatatttttttttatttgaagcagtgaacgatgaattacaaagaatttttttataggaatgagtttatttttacataaaaacatacaaacaagaaaaagaaccacttttcaaaaggaccttacttttgttttttcttcgagataccctccagcatcttttcctccgcgccggccggggctcggtcccctcgacggttttgcatgattggctgattgcatcccgcctccgccttaaaccctaaaccatgacctctcgcgccgccgcggaggccgccctcctccttccgctccgcctccactctgccccgctccgcctgcgcttcttctgtacctccgcctcccggctccgatgggcgtgttccgcggcggcgctgcttgccgtcgtttcgctcgtcaccgccatctgcgctatgcccgacgccggcgccggcaccaacgttgaagccgatgccgacgctttgcggttggagattgaagcgctcaggctaaaggtcgcgcggctggaatctcttctagaggcaaattcgaaggcattagacattaaggctagtatcttggaggaggacaacaaactcaatgaagcaatggaacgtgaaatccagcttttaacgaatggaccagacagaactaagaactcccaaagcaaatcatattctgctggcaatattaaatctatggaagatgaggtgcggcaacttcagcacgagatcattaagataaacagcaattcttacaccgttgaatcattagcacatgatactgagaaaagggtggaagctttgagcttggaggtaaaaaagatagaggatatgactgcagaacaatggatccaaattcgacaacttgaacaagcatttgtgttaaccaagatgatgacgtcaaaagttcatgagagaagtaggccatcagatacagtttataagtggcctggaaaagaaataattgttaagtatgtcaggaatatcaagcttgatggtatttatcttagaggggcgtcatacgtgaggtcctgtttttcacatacatataaacagtccagaagttttgtacaagcaataagcagatgctaccatgagatttctcggttccgcaaagcaattcgtcacaggtatacatctgatattaacaagcctgatgtgttctttttgggtggtaccatttcaagatcaaacatttctcttccatataaccaattcaagattttcatctcattggcacggaagtttcattacaaggcccaatgttttatacgtgatgtgatggaatccaacaaatatagttgtggtttgtcgaacgagccagttacatttatcttggcatatcttgttgtcatttctccattgtggatcgcttggttcctttattcaacatggttcagctcaaggaagtgacaacttgttggaaaacaggaacgttgcagtcatgggttctttttttttcttcttttttaggttcaaaaggtatacacgtgtgacggaagacaaatatgtggaaaatttgcaatcaccaggacttctaagaaatataactgttatatatatatagaactaacttatcgtatataagtgtattatggactaggggtgggcaaaacacatgtccaatcgctgaccccgaattattacgccaacctggacttaaaatacctgcataattttggatattaactataaaaaactgaatttaatttggttgt

SEQ ID NO: 16241 - DNA, 760 bp, Zea mays
  misc_feature (421)..(421): n is a, c, g, or t
gcacgagcttggccgcacgcccgccctaaaccctggcgagccgcggctacggtatagccaccgcaacaccgcatctcaagcgcaagacctcctcgcggctatggcgaagcgtctgatcccgtcgctgaaccgggttctggtggagaagctgctgaagcccagcaagagcgccggcggcatcctcctcccggagaccaccaagcagctgaacgccgctaaagtcgttgctgttggccctggtgatcgtgatagggatggcaagctgatccctgtatctctgagcgaaggcgacactgttctgcttccggagtacggtgggacagaagtgaagcttgcagaaaaagagtaccttcttttcagagagcacgacatactggggaagctggaggagtagctctggtctctggaccgttaaaatggnaggtggttgaaaggaggtatgccagaagttttgccacggcttatctttctttttttgtgtgtgcggggggaacaaatgagaaaccccacccattgtgagaaattcaataacactgcctcattcttgacatcatcatttggggatgtcaccatgcttcatctgattataatgtcttgaagtaattacggtcgtaagatgggttgtgctggcctggacctacagctgactgtccacaatggcgggcctttggtgttgcatgaggtccgcgaaggctggcagggccaatacgagttctatctatagtaatcagcaatttcagtctgcactgaaatctgcagc

SEQ ID NO: 16242 - DNA, 1012 bp, Zea mays
gggtacctcgaggccggccgggccggggaacaggcgatagtgttcttgcccccgtcccttcctacccttggccgcagtcaaaccctaaaccctggcgagccgcggctacagtatagccaccgcaacaccgcatctcaagcgcaagacctcctcgcggctatggcgaagcgtctgatcccgtcgctgaaccgggttctggtggagaagctgctgaagcccagcaagagcgccggcggcatcctcctcccggagaccaccaaccagctgaacgccgctaaagtcgttgctgttggccctggtgatcgtgatagggatggcaagctgatccctgtatctctgagcgaaggcgacactgttctgcttccggagtacggtgggacagaagtgaagcttgcagaaaaagagtaccttcttttcagagagcacgacatactggggaagctggaggagtagctctggtcgctggaccgttaaaatggagttgtttgaaagtaggtatgcaagagttttgccacggcttatcttttgtttttgtgtgtgcggggggacaagcgagaaacccaacccttgtgagaattcaataacactgcctcattcttgacatcatcatttgggatgtcaccatgcttcatctgattataatgtcttgaagtaattacggtcgtaagatggttgtgctggcctggacctacagctgactgtccacaatggcgggccttggtgttgcatgaggtccgcgaaggctggcagggccaatacgagttctatcaatagtaatcagcaattcagtctgcactgaaatctgcagcgaactcctttaagccttgcccttggcggcctggcttgaactattgttgtgtccagcagatagatatatggccgtgtaaaacactattttgcattgtaaatagcgctgctgtgctcagatagcctaaacccaggtggcgccctctgcttgacaagaggaagcagaggttttttgtggcaaaaaaaaaaaaaaaaaaaaaaaaaa

SEQ ID NO: 16243 - DNA, 981 bp, Zea mays
gtccagcccaaagataagccccgcgcccgccggcggcctcacacagattccttcgattcccgctgacagcgaagctgaggagaatcccaagaaacagagctggtgaaattgcattgtcgcaacaggcaagagaagaggagaagaaagaaatggctgcaatacctgcagcgatcccgggctgctgctcttcgtctcgcctgcctcagcttgctggcctccctgcctccacaagcagaaggcgcttcaaggtcacggccatggcgcccaaaaagaaggtgaaccgctacgacgagaactggtcgaagcagtggttcggcgcgggcatcttcgcggagggcagcgaggaggtgtccgtggacgtgttcaagaagctggagcggcgcaaggtgctgagcaccgtggagaaggccggcctgctgtccaaggccgaggagctgggcctgacgctctcctcgctggagaagctgggcctgctctccaaggccgaggacctgggcctgctcagcctcgtcgagaccgcggcggggacgtccccctccgtcctcgcctccatctcgctgccgctcctcgtggccgccgtcgccgcggtggtcgtcgtgcccgacgactccgtcgcgctcgtcgccctacaggccgtcgtcgcggcggtgctcgcggcgggagccgccgggctgttcgtgggctctgtcgtgctcgctggcctgcaggagtcggattgatgcattgatctgcagctgcgcaaggtagaaccaagctgtgtacgtacgtcgacagtaccgccttgtgtagtaggatcgatcttgttagcagagcagaactcgttactaaaaaaatctatagtgtctgtaatataatataatactttagctttttggtaacttgccgtgcaaatgtggtaacatattatgaagaaaattgcgatcaaatggacggttaactcggattcaaccagacacttttacaaccaatgcaaaaaaaaaa

SEQ ID NO: 16244 - DNA, 1624 bp, Zea mays
cgcttcctagagtgtgtttggaagcaaattatttttttgctaagggaaaaccatggtattggagaatatgatagttttttttgctaaggggtgtttggctacattataaaaaaatctgttttaaatatcatggttatgtagatactatgatatttttggagtatttgaaactctacttcaatccaaagtttttgtctatgactagtctggtacatgtataatacgtactatggtttgagatactttatcttcaaacatatattgctaagtgtaatgtaaaaagtactatgacatcttaaaactatagtgaatactttatttccaaacattatgtgttggtgccaattctgtggcctgtgtgtagaccggtagcggtagggaacatcgccgcgactgcgcgacatatctgtggctgggtttcgcgcaccgtgcgcccgtccagcccaaagataagcccctgaactaccagtggccacacacagattccttcgattcccgctgacagcgaacctgaggagaatcccaagaaacagagctggtgaaattgcattgtcgcaacaggcaagagaagaggagaagaaagaaatggctgcaatacctgcagcgatcccgggctgctgctcttcgtctcgcctgcctcagcttgctggcctccctgcctccacaagcagaaggcgcttcaaggtcacggccatggcgcccaaaaagaaggtactagttggtctctcagctccacccaccttcccgaactccgcaactcgattctattctttgcacaaaaaaaatatatatagaaagctcagcatatgcatggtcgtgttcgtggtgcaggtgaaccgctacgacgagagctggtcgaagcagtggttcggcgcgggcatcttcgcggagggcagcgaggaggtgtccgtggacgtgttcaagaagctggagcggcgcaaggtgctgagcaccgtggagaaggccggcctgctgtccaaggccgaggagctgggcctgacgctctcctcgctggagaagctgggcctgctctccaaggccgaggacctgggcctgctcagcctcgtcgagaccgcggcggggacgtccccgtccgtcctcgcctccatctcgctgccgctcctcgtggccgccgtcgccgcggtggtcgtcgtgcccgacgactccgtcgcgctcgtcgccctacaggccgtcgtcgcggcggtgctcgcggcgggagccgccgggctgttcgtgggctctgtcgtgctcgctggcctgcaggagtcggattgatgcattgatctgcagctgcgcaaggtagaaccaagctgtgtacgtacgtcgacagtaccgccttgtgtagtaggatcgatcttgttagcagagcagaactcgttactaaaaaaatctatagtgtctgtaatataatataatactttagctttttgataaaaaaaaaaaaaaaaaaaggcccatattatgaagaaaattgcgatcaaatggacggttaactcggattcaaccagacacttttacaaccaatgcaaaatatggatgccaatccagctctatgtacatcatcgtatacaaaatagcgaagccgtaaaggacatgtatgatcgctgcaaattcaaaagtttca

SEQ ID NO: 16245 - DNA, 1281 bp, Zea mays
  misc_feature (578)..(578): n is a, c, g, or t
  misc_feature (591)..(591): n is a, c, g, or t
tctccacccaaactagtgcagtaccatggaagtgagctgagatatcaaaggagcaaacatactcgtgggtcctaatggtgaagtcaagctggctgactttggcatggctaagcatatatcatcttttgctgaaatacgttctttcaaaggaagtccttactggatggctcctgaggttataatgaactgtaaaggctacagtttatcagtggacatatggagtctgggctgtaccattattgaaatggcgacggcaagacctccttggcaccaatacgagggggtagcagcaatatttaagatcgcaaacagtaaagatatacctgaaatcccagacagtttctcagaggaagggaaaagtttcttgcagctttgcttgaaacgtaaccctgcatctcgtgcttctgcagtccagctgatggatcatccttttgttcaggatcaccctgcagtgagagctgcaaaatccagtgtattgagaaacacaccatcttctccagcagatggcagacacacaatgtccaacagggagttgccatctcggaaaattataactcctctgaaggatattggactgngcatgagagattntactggattttccactactgttccttcaccacacagcagtcctattccgggaagagcaaacatgtctacgccagtttcaccatgctcaagcccgctgcggcagtttaagcaatccaatgtgaggggcatgcgttctccacctcatccaatgctctcccctggtcttggcaacacagtaagttacacccaaaatcagacaagacgcaatccagctcctgccatttcagatccttggatggatgttggccagatgaaactccaaagccccaatatttcccccagaaggttctgagaacgatttaaatataaaaaaagagaatcatgggcgcaatatatccatgacaagttagttattaagagatgttcagtaaggaacttgtttgtgtagttactacaatacgacactcaccagagattcagtacagcgaaatggggctcttgagaatttgtaacaggaagttctgtatatccttaggttttaaggtttgttgtcgcccttgctatatgtagttatacgtgtacacgtcctgatgtaaaggttcacaaaaaatcttacagatgaccacgggatgtaaattcgaaagtttgtgcaaactggtatttctgtgtagtagttaggacttccatggcagaagtaactatgcacttccgattgaatcgagtacaatgtccagtttcatttccctttcc

SEQ ID NO: 16246 - DNA, 2252 bp, Zea mays
gcggccgccgctgccggtgacggctgctcgtccgcggaggagtctagcgtgtgctcggccgcgtcgttggacgagccgcactaccaacatgggtttaggcccatggatccggctgcttttgcgagggaaagaaatatgccttctgattcagataggatcttaaatgaagacaagcgtttcatgtcttgtagtatgccacgggagcatcagaagttctttgatgttcctgcggctagtgttagagaacttcatttgcaaagtgatgcaccttcaacgagtgaagccaattgttcacgtggaagaatgatatctggagatctttttgctccaagaacaaggagtctctctcctatcccaaaaggccatgcattcgctgtgagcaatggaaattctagagaatttggtttcagcccgaggtcaccagtaagaaagatggatggtttgaggagcccaccacatcccttgcctcttcctccagcttctggtgcatgctcgcctcttcatccagcttctggtgcatgctcgcctcttcatccagcttctggtgcttgctcacctcttcttccaacccacagtttttgctcgcctcttccttcgtctcccagttcctgcccacctcttcctgcatctcccgctaactgctcacagtcccagtcacaatggaagaaagggaaattgctagggagtggtacatttggtcaggtttaccttggatttaacagtgaaaatgggcagttttgtgcgattaaggaggttcaagttattatggatgatccacattcgaaggaacgactcaaacaattaaaccaggaaatagatatgcttagacaactctcccacccaaacatagtgcagtaccatggaagtgagctgagtgatgaatcactttccatttgtcttgagtatgtttcggggggttcaatccacaaattattaagagaatatggctcttttaaggaacctgtgattcgtaattacactgggcaaattcttgctggccttgcctacttacatgggcggaacactgtccacagagatatcaaaggagcaaacatactcgtgggtcctaatggtgaagtcaagctggctgactttggcatggctaagcatatatcatcttttgctgaaatacgttctttcaaaggaagtccttactggatggctcctgaggttataatgaactgtaaaggctacagtttatcagtggacatatggagtctgggctgtaccattattgaaatggcgacggcaagacctccttggcaccaatacgagggggtagcagcaatatttaagatcgcaaacagtaaagatatacctgaaatcccagacagtttctcagaggaagggaaaagtttcttgcagctttgcttgaaacgtaaccctgcatctcgtgcttctgcagtccagctgatggatcatccttttgttcaggatcaccctgcagtgagagctgcaaaatccagtgtattgagaaacacaccatcttctccagcagatggcagacacacaatgtccaacagggagttgccatctcggaaaattataactcctctgaaggatattggactgggcatgagagattttactggattttccactactgttccttcaccacacagtcctattcctggaagagcaaacatgtctacgccagtttcaccatgctcaagcccgctgcggcagtttaagcaatccaatgtgaggggcatgcgttctccacctcatccaatgctctcccctggtcttggcaacacagtaagttacacccaaaatcagacaagacgcaatccagctcctgccatttcagatccttggatggatgttggccagatgaaactccaaagccccaatatttcccccagaaggttctgagaacgatttaaatataaaaaaagagaatcatgagcgcaatatatccatgacaagttagttattaagagatgttcagtaaggaacttgtttgtgtagttactacaatacgacactcaccagagattcagtacagcgaaatggggctcttgagaatttgtaacaggaagttctgtatatccttaggttttaaggtttgttgtcgcccttgctatatgtagttatacgtgtacacgtcctgatgtaaaggttcacaaaaaatcttacagatgaccacgggatgtaaattcgaaagtttggcaaaaaaaaaaaaaaaagtagtagttaggacttccacggcagaagtaactatgcacttccgattgaatcgagtacaaaaa

SEQ ID NO: 16247 - DNA, 1758 bp, Zea mays
ggcagaggtgcgcttccccgtgagccgggcaactggtgggtgtcgtcctcctctttgcgcagcagagtaatggattaatgctttaagcaaggtaatgaaatgtaccagaagtgacttatggaaaggaaggagcttgttcactgttctgaatgaggaagtttaatctgatgcagtctcaaaagagcagagttttgggagcaatgtcatcctctttgcctattctgccaaatcctttgaaagggagcttcccaaggcctcataacccccagcatattcctatgttgaggcagcttcctgatgactctatgcccttgtgtattgacacacatcagtctgttagtttgcacccaagagctggtgttatcggggtaccatattcaggctacactgctagtccacttgattctgtgtctaaccttgatagccagacaatggctgcaccctttatttctcagtcatccaattttgaagctctccagtctctatctgataataccccagaaacacacactaaggcagcctggttcacatcttctatggatgtttcaccactcaacacagataatattgctgcttctgatgttaatcaaatccatagtatacgtcctgctatgacatctgatgagagtgctacacaaaatgattggtgggcagatataatgaatgatgattggaaagatattcttgacgcaacagctactgattcccactcaaaagccatgattcaaatttccaactcagctacatcactacctgcagtaaatcagtcagcttcatctcatagtagggagatttgtcctgttgctagtcctcccaatagcagcaatgcttcagttgccaaacaacggatgagatggaccccagaactccatgaatgttttgtagatgctgtaaatcagcttggcggtagcgaaaaagctactcctaagggtgtgctaaagcttatgaaagttgatggtttgactatatatcatgtcaaaagccacctgcagaagtaccgcacagcccgctataaaccagacctgtcagaaggtacatcggaaaaaaggacagccactgaagagctggtcctggacctgaaaacgagcatggatcttactgaagcgctgcgccttcagatggaagtccagaaacggcttcatgaacagcttgagattcagagaaaattgcagttgcggattgaagagcaaggaaagtatctgcagatgatgtttgaaaagcagagtcaatcgagcacggagaaagtccaggatccatcctcaagggatacaacagctaaaccgtcatctaatcagagccagtctacaaacaaggatagtggtgcaaccatggacccaaatggaacaggagacatcgcacggactgcagaactgggagaacgttcgtctgaattaggtgtaaaacagaaactcgtagagatcgaagaatctggtaccgaagtagccacaggcgacagatctaagatctcccaagagaagcggcgcaaactgcaagatagttaacatatcggttgcactattcagacatagctgttcaaaccgtttgcttggtgaaaaattggtaatctgtgtgtcgaattcgactattgatccgtgagtccattggtgagttgtaccgctcttcagttagccatatatatttataaaggatccaaaggaggaccaaaggagaacttcctggcagccgtgtttataacattagcaataagagctatccccgaagttatggggtaaaataaggtcttgaaatttagctttc

SEQ ID NO: 16248 - DNA, 1793 bp, Zea mays
ggacctcagcggcgggtgcattcgagattggagtgcctcatggagttttcatgacacatgctgcggcgcactgaccagctcactggcctctgggtcgtgtccatcttctgtggccttatctggttcatcggcatctgccatggcctcttcacaaacaggcccagcagctcgtcacccaccaccgcattcgagcccaacttcttcaccaagctcagctacagcatgaccctcctccgttacccgcaggccattggcagcctggttgcggtgttcctgtcctctttcgccacaatgtgcatcttcaccagcggcacgctctatgctatcggtggtgtctgcatcaagccggtgctcgtgcttgcgctatggatcctctactttctgttccccttgatctcgctcccgctcctccacccgatccagatcataatccgcgcggacgccgtgcgcatgcagctgctcgggttcataatctgcctgttcgtgtccggtgccgggttctacttcaagagccacaggtggagggctgcccacatcatcgtcatcgccctggtccagagcacccccaatggcatactgtacgcgttcggccgcatcctgctcctcgatgcctcgccgccggggaaggagggtgcgttctcggtctggtgcgcgtttgttcgtgtcaccggtgccatgatcggcttcgctgcctcctccgctggccctgggcgcgcgggagggtcctttgctgctgcgttcctcgggagcttcctgggcatcatcgtgctgatcttcggcaacgtcagcaacatcggggcgctgaaggcggccgggcacctcaaggggatggacgacgagaagaggatgggcggtctcgggatggagaagggcgagggcatgggtagcgccgtcgctgattctggcgagagcaggggaagagtatgatgatgactattcgtgacagtgaattcctgggaggtgggggagaaaaggattgcgttctgtggaggttgttgtgcttgtgagaaggatttgttctctctcttttttctttcttgtttctttggccgtgtttcagtgacactgttgatggatcccagtgctttgcccgtttgatgcatcatggtggtggtggtgatgatggatgacatagtggtagggggtgtgtgctagttgttaatgtgttatttattcttttgcttgcaagacaattgtaactgatgatcgttagatcatatggttcttccttcgttcttcacccgcccccaaagtctcttgcagtaaagcttcattcatgattcagtctgtgtccgtgtggggaaaaaatgtgatggtggcattgtgtagacagaagtaaaacatctgtaaactcacttgtagtgatcattctgttctctctgatgccagatgctcgtatgcatttgaatccgccgcagtgccgacctgtgttcagagcttcaaagttcatgtcatgccccatccagtttctaaacgctcttgaactgtgaagcatacgatgaaacgcctaaggcttgttttcaaacaaacaacgacgagtgatttcaacagcatgcgacgtaattccttctgactttatccgctcgtgacagactgcgctgtgctgcccttttagcacaacaagctcacagcctcacaacggctataaaacagcatcatgacgccatttcatttcttttttttcccgcttgccttgtcctcacctgtcacctgccccgagaatctctggcctcatcagaattcagaagtcaagagacgactccgaccaaaaccaaaaaaaaaaaaactgcagg

SEQ ID NO: 16249 - DNA, 4012 bp, Zea mays
ctcatgaacaccaacaactagtgtagtgtgtagttgtgtgcacgctggcttggtccccgtagcagagaaccccacccccataaaagctcctctccattggccgaacgccgagagcaccactccctccctccggctcccaaccccagcacagcgcagcagcagtcctctctcctctcactctactcctccagctccccgcccccctcccgagcccgcaggtcactcccaggtttcaaatccgccaccttttggacacacaccacacttgcctacccccagagctgagctagctagctgctctctctctctcttttcacctaagcgagaacagagcccaagaggcctcaaaagaaccactgcacttcctccgcatagctcgtcgccctctctctcctatcagtcctcccagctccagctaccacagcagccctctcgcttaaaggaggagggagaagagggcggggcgagcaatgtcggagcagcagcagccattgccgcagcctcggagcagcatgcgggaggctctggagaaggaggacaaggagaaggcggcggctgctgcggcggccaaggagaaggcggccgtccccaagaacggcaacggcaacggcggcaagaatggcggcggcgccggcagcggcaacggcggagcgcccccgcagtccggggaggagacggcccgcgagatccaggtggtcagggaggcgtaccgccgcgagacggccgcgccggcctacgtcatacccgaggagccgccggccgtggtcgagctcgtcggctggtacatctacggcttctgctcctacttcatcacccacctgctgctgccggtcctcttcccggccatcatcacgcaggtcgccttccccaactccgacttcacgcccgaccccaagtacaccctcaagggcgtcacctgctccgtccacgagatgtccatgtaccagaggcttaccaagcactccattgtgatcgatggatcccggatgtcaccattgggctggagtggactgtcgtgggcaatcggcatcctcatcgtggcgccgctcctcacccagaccgctcaccatctcgaccgtggccagtaccagtcgctgatcctcattgccgccacgtccttcgggtccttcttctgcctgctaacaggcttcttcaagacggtctgggtgttcctgttctacatcctcttcatcgctggctcgatcatcgtcgctgaggcggtgcacacccgcaaccttgggctgatgatccgtggcctggctgcgcatgactcgggcaagcaccttgtccttcgccgccgcgctgctgccagccagctcagcctgtactgcactgccataggaggcattggagctgccctcatggcagctttcatgtaccacatgctgcggcgcactgaccagctcactggcctctgggtcgtgtccatcttctgtggccttatctggttcatcggcatctgccatggcctcttcacaaacaggcccagcagctcgtcacccaccaccgcattcgagcccaacttcttcaccaagctcagctacagcatgaccctcctccgttacccgcaggccattggcagcctggttgcggtgttcctgtcctctttcgccacaatgtgcatcttcaccagcggcacgctctatgctatcggtggtgtctgcatcaagccggtgctcgtgcttgcgctatggatcctctactttctgttccccttgatctcgctcccgctcctccacccgatccagatcataatccgcgcggacgccgtgcgcatgcagctgctcgggttcataatctgcctgttcgtgtccggtgccgggttctacttcaagagccacaggtggagggctgcccacatcatcgtcatcgccctggtccagagcaccgccaatggcatactgtacgcgttcggccgcatcctgctcctcgatgcctcgccgccggggaaggagggtgcgttctcggtctggtacgcgtttgttcgtgtcaccggtgccatgatcggcttcgctgcctcctccgctggccctgggcgcgcgggagggtcctttgctgctgcgttcctcgggagcttcctgggcatcatcgtgctgatcttcggcaacgtcagcaacatcggggcgctgaaggcggccgggcacctcaaggggatggacgacgagaagaggatgggcggtctcgggatggagaagggcgagggcatgggtagcgccgtcgctgattctggcgagagcagggggagggtatgatgatgactattcgtgacagtgaattcctgggaggtgggggagaaaaggattgcgtcctgtggaggttgtgcttgtgagaaggatttgttctctcttttttttcttgtttctttggccgtgtttcagtgacactgttgatggatcccagtgcttcgcccgtttgatgcatcatggtggtggtggtgatgatggatgacatagtggtagggggtgtgtgctagttgttaatgtgttatttattcttttgcttgcaagacaattgtaactgatgatcgttagatcatatggttcttccttcgttcttcacccgcccccaaagtctcttgcagtaaagcttcattcatgattcagactgtgtccgtgtggggaaaaaaatgtgatggtggcattgtgtagacagaagtaaaacatctgtaaactcacttgtagcgatcattctgttctctctgatgccagatgctcgtatgcatttgaatccgccgcagtgccgacctgtgttcagagcttcaaaattcatgccatgtttctaaacgctcttgaactgtgaagtatacgatgaaacgcctaacgacgagtgatttcaacagcatgcgacgtaatttcttctgactttatccgctcgtcattttctttctttcatgctacgagcatctgacacagactgcgctgtgctgcccttttagcacaacaacaagcccacaacggctataaaacagcatcatgacgccattgcatttcttttttgtttttcccgcttgccttgtcctcacctgtcacctgccccgagaatctctggcctcatcagaattcagaagtcaagagacgactccgaccaaaaagaaaaaaaaatgcatccagtttacgtcggaactaaaaccaacacggatgctggtatagatcaatggtgcatacatacagtgcacggtggcaagcaagtagactgaggtctacggagacgtctacatccaggccgcctcgacgtccacgccccggcgcagtgcaggtctcgccgtcagcgctacggcatgtaatcccatttctaatctggcttgtgctgcgaagggtcaactgaactgccagttcgtcatctcagaggcaagcgaaccgagcacggttttctcatggcctctgcagaactccagtggccgtcaagaaggaagaaaccggcgctgaatgaattttatggagggggcgtgctggatggataaggtgcagtactagcagttggaatttgaggtgcacaaggtgcgacttctttttttttctctctctctccctttgcacgcgctaataattcagttgctgatgctttttgatggggtggtggtggttggacttttggactctcgatgatgtgtttacaaagactaaaaaagtacaggttaagagggctagtggcaccataatatggtgtgttctttcctttgtcaatgggggaaaaagagagtgtgatgtggtaggttttgtgatcttgggtgggtgggtgggatggtatggtctccggaaagcgtttactttggacactttttcaggttgatgttttgagcaaatatgctgatgcgaactcttagcttgtccatctgttcttcaaccgcattcaaactcctgcacctaccatccctttagacatactactatgtaagccgtaaccacatctacattaaatccactagaaactacagcaaacaagccgtggagcaagaaaaaatctggagaatgttcctatccaccacgtggtctaagttgtatccactggatca

SEQ ID NO: 16250 - DNA, 774 bp, Zea mays
gaacgacagtcgtatttattagtagcgagtagcgactattcacactcccaagttctccaaaacaagaaacttttggggtttgacagtttgagaggtaaattctgtatacagacacgtacgtaggccggacatataaatccatcgtctagtacaactctacatgatttcaatcgtgcacgattacgcatgcatacacagccacctctcctctcaccgtcgtcgagctgtcgccgtggagaccacgtgcacagcctccgatgcgtgcaccgaggcaggaaagagccgtcgtgccaccgtggtgggcgtcgacgacgacgagcggcttttgggagatggcgacaacgttggcggtgcaacagccggagagcgctccctggcaaaccgcccggcagacgtggagccgaaggcccttctcgcggtcggttgctggtgctccggcgtggtcggctccgacgataccccgggcctcctagacggcctgcgcaggcttctgtccggtgtctctagttttggggagacccctttcaggacggcgagcttcctctcaaatgagttgccaaccatatatgattgcttcgaattgtcccagtcgaagaagctggtgaaaaatccaggctcgtccccttctgtgacagcatacactgtcgtttccattgaccttccaccgtgaacagcatccttaaggaacatcttgccaacattgagagcttgctccttggatgtaatatctgagtgtaggccaacccagacgtagatttcttcattgcagtccag

SEQ ID NO: 16251 - DNA, 1869 bp, Zea mays
gcactttcaattaggtacattatttccccacaagttgctatgcttttaataccctccacctctggactcaacatactgaatctaaagggaaatgattattaaaaagttgcacctttagttgtacagcaaaacaaaacagacagtcactaatggagctagcatgacaatcactgttggaaaagttagcctttagccttttaaaccatctatccactgatcgacgcgatgtgcacatacagagatggacacgtgaacacacacacacactaattgatggctgaagaaaactatataaacatgcatggtaaaatacaagacagaatcatgacaagaatcacgaaagctaagcgaatcttatttgattgattaattaccctactcagagataatttagagcaccactagagcactaatcaattagtatttcccgcctccggccttgtgtcttttagaataatgcaactgagaaaagcaaagatgggtgtgtgttaatgtatataatcgaaagtagcgggccttccccacgatttccagtatggattaaagtgatgcgttttgggccagttttaatttccatcatcagcggaggactcattatatatatggcagcatgcatgctgcatgcatgtcactacactactactagtagtaatgatttgtacagtcaagcgtgcggttctcggttatggaactcaaaagacatcaacactacctggtggtgattattggaatatcctccatctttcaacttaatatatatcgaatttagaggagaaatgttggacgtaattattaaaaaactgcgacctttacctctgtaaagtaccctgtgatgattcgagaacacagaacaattttgcagcacaacatgcagtaaaccaattaaaattcgtatgctgtgggatacaagctaataatcctcgaaaataacatatttctaatgcctaaaccattggcaaaatatattattggattatacgtaacttctatatgcgttgagttacctgacaacatgaataccatatggaatgcatagctttttggcaaccggtcaaatccagcttcctgatcttaactctggcgcagcatctgacgttcgagttctacagagccaaggcacctgcggaattcagagcagcgagctggaggcgcagaacggaggcaacgaggggccgccggcgttagggaagacagcagcggaaattttcaaaagaaacaaaataaaatgttaaacggaaaaaaaaaacacaacaaaagatagatgcaattgacaacatctccttttcatgaaattcagcacaagaacacacaagatccatgcgtcaattcaccacaagatcatcagaaattgtggaaaagccaatttatagtcatataaactaatacccggaatctcatttctcgtattgtacaccggattaaatgggaagaaaagggggcagtgcactacatattgttcaactcattatacatcaggagcggcctgttgaactgctgcgcctggaaaattttcgcctgcaggaaaactggggaatgcagcatcagtcccctgcaaaggttggccagttggtatgccgccaaagctgttgtcattcccaccgcatatcaacggtgcagcagctggctggactacgccaccaggagacattggtgacattgaagatgtatcggccagtgattgttgagctgcgatagcaggaacaggtggtgctgctggtccaggtacgggcgcaggtgcaggtccagcagctccagttgcaggaggcagcacatcaaaaccagatcttgcccgaggcctgcgctctggtgctgcaccatggtcacggctattgcttctgctgcgactccggctactgcttcggctccgac

SEQ ID NO: 16252 - DNA, 1383 bp, Zea mays
  misc_feature (1056)..(1056): n is a, c, g, or t
ccaacaaaaaccacgggaaggagacgagacggggggaaaaacactgcgcaggcacaggcagggagagacgtaaagccgccgcttcgtgcgcgtcgacgtcacctcgccgccggggcccgtctcgccgcggggtcccttagagctcccttccgtcgccggacggatcgggaagcgacgacctgaggggactggctgggatggccgggaagaagcgcaaggcggaggcggcacgcctggaggagacggaccgggcgctctacggggccttccggggcgccgccaactcgctctcgcagctctacacgctcggcatgggcgcgcagaaggcctccttccacgccggcgaacgccacgccatggaaaaactttatgaatggatcctgaggcagcacgaaaatggtttgaggctaacagttgctgatgtagcctcccatatccagcatgagattcagtatggaggtgacaatgcatcagcctctccaaggtcacaataccctagccaaagcactgcaccgacaatgcacattcccaacacaagcaaccagcaaccatcgccaagcttatttgctccaggaaaccctgggttgacacagtccaagaattccatggtcttttcaagcgcattatccagccccatccggcggagcctgcaaccttaccacctagagcaggacggggatgcagggtacttcgcgaacggtgcaagccgcgacgtgaaccccacggcttcgaatgattcgtccatggacatgcactcggacagcccagctcatgactcttactgagcagctcccaccaaccaaccgcaagagcagcacttcaagtggaagaagtctgctgtcacagccttccgaggcctagtagtaatattcaatttaacaccttccatagcctctcttacactaagcgtgtgatgtcttgtgttgttactactacttaccacttgttgctttgcgagaattatgtaatttgcatgtactatactatactgtaccatttgatttatctgtgcatattactgctgttggtacgtgacaagtgcaggaaacaaaccanctggaaagaattaacagcttggacagtttgtgaggtgatcttgatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaagaaccaaagtttacttccccgggattgcaaggtaatagtttttttttggggcccccaaaataaaattaacgggccgggttttaaaaacgctggggattggaaaaaccttgggtttcccaaattaaatcgcttggaaaaaaatccccttt

SEQ ID NO: 16253 - DNA, 676 bp, Zea mays
  misc_feature (593)..(593): n is a, c, g, or t
aaaaaaccacgggaaggagacgagacggggggaaaaacactgcgcaggcacaggcagggagagacgtaaagccgccgcttcgtgcgcgtcgacgtcacctcgccgccggggcccgtctcgccgcggggtcccttagagctcccttccgtcgccggactgggcggtcgccggacggatcgggaagcgacgacctgaggggactggctgggatggccgggaagaagcgcaaggcggaggcggcacgcctggaggagacggaccgggcgctctacggggccttccggggcgccgccaactcgctctcgcagctctacacgctcggcatgggcgcgcagaaggcctccttccacgccggcgaacgtcacgccatggaaaaactttatgaatggatcctgaggcagcacgaaaatggtttgaggctaacagttgctgatgtagcctcccatatccaggtaagtttgcaatcgttccttgatatgtttctatacaaattgacaatacaaactcaggtaaaaaacctgcatatattgccatttcataggtcatggttagttctaaattgtgtgctactgacttgttgcctttatgaacantagtttatgacaaatgagatgagatgaacttgttgttcctgcagactttacttcgatcctgttcctatcctctgattattttc

SEQ ID NO: 16254 - DNA, 1226 bp, Zea mays
gcggcgccgcgacgccgtgaagagcgaggagtaagagaaaccaaccaaaacccacgggaaggagacgagacggggggaaaaacactgcgcaggcacaggcagggagagacgtaaagccgccgcttcgtgcgcgtcgacgtcacctcgccgccggggcccgtctcgccgcggggtcccttagagctcccttccgtcgccggactgggcggtcgccggacggatcgggaagcgacgacctgaggggactggctgggatggccgggaagaagcgcaaggcggaggcggcacgcctggaggagacggaccgggcgctctacggggccttccggggcgccgccaactcgctctcgcagctctacacgctcggcatgggcgcgcagaaggcctccttccacgccggcgaacgtcacgccatggaaaaactttatgaatggatcctgaggcagcacgaaaatggtttgaggctaacagttgctgatgtagcctcccatatccagcatgagattcagtatggaggtgacaatgcatcagcctctccaaggtcacaataccctagccaaagcactgcaccgacaatgcacattcccaacacaagcaaccagcaaccatcgccaagcttatttgcttcaggaaaccctgggttgacacagtccaagaattccatggtcttttcaagcgcattatccagccccatccggcggagcctgcaaccttaccacctagagcaggacggggatgcagggtacttcgcgaacggtgcaagccgcgatgtgaaccccacggcttcgaatgattcgtccatggacatgcactcggacagcccagctcatgactcctactgagcagctcccaccatggaaccagcctcaagaacagcacttcaagtggaagaagtctgctgtcacagccttcccaggcctagtagtaatattcaatttaacaccttccatagcctctcttacactaagcgtgtgatgtcttgtgttgttactactacttaccacttgttgctttgcgagaattatgtaatttgcatgtactatactatactgtaccatttgatttatctgtgcatattactgctgttggtacgtgacaagtgcaggaaacaaaccactgaaaagaattaacagcttggacagtttgtgaggtgatcttgatttatctgttgccactgctgtcattcgttttttgttgagacggaaactgcataaatgtagctgctg

SEQ ID NO: 16255 - DNA, 1130 bp, Zea mays
gatataggatattaggagaaaaaaaccaaccacggggtcggggaggagaggaaaggagacgggaaacaaaaacacagcgcaggcagagagagacgtaaagccgccgcttcgtgcgcgtcgacgtcacctcgccgccggggggccagggctgtctcaccgcggtgtcccgtagggctcccttccctcgccggactgggcgggcgccggacggatcgggaggcgacgacctgaggggactggctgggatgaccgggaagaagcgcaaggcggaggcggcgcgcctggaggagacggaccaggcgctctacggggccttccggggcgccgcaaactcgctctcgcagctctacactctcgccatgggtgcgcagaaagcctcctttaacgccggcgaacgccacgccatggaaaaactttatgaatggatcctgaggcagcacgaaaatggtttgaggctaacagttgctgatgtagcttcccgtatccagcttgagattcagtatggaggtgacaatgcatcagcctctccaaggccacaataccctagccaaagcactgcacctacagtgcacatccccaacacaagcaaccagcaaccatcgccaagcttatttgctccaggaaaccctggtctgacacaatccaagaattccatggtcttttcaaacgcattatccagccccatccggcggagcctgcagccttaccacctagaacaggacggagacacagggtactttgtgaacggcgcaagccgcgacatgaaccccacggcttcgaacgattcatccatggacatgcactcggacagcccagttcatgactcctactgagcagctcccttcacggaaccggaagaacagcatttccagtcgaagaagtgccaggcctagtaggaatattcaatttaacaccttccgtagcctcttacactaagcgtgtgatgccttgtggcgttgttgctactacttaccacctgttgctttgccagaatactgaaatttgcatgtactatactgtaccatttgatttatctgtgcatattactagtgttggtacgtgacgagtgcaggaaacaaaccattggaaagaatttacaacgtgaacagtttgtgaagaaaaaaaaaaaa

SEQ ID NO: 16256 - DNA, 4111 bp, Zea mays
gccgaccttaccagcagcttctgcacagcgtccccagtaaaatgtaccccgaaaacccccacctccgcttcctcctcttcctcgccgtcgcggcagttgccgccggcggggctgcggcgaacaccaccctcaccgcgtccctctccggcaaccagatcaagatcatctggtccggactcccggccccggacggcctcgactacgttgccatctactcgccgccgtcctcccgcgaccgcgacttcctcggctatctcttcctcaacggctccgcctcctggcgcggcggctccggggagctctccctcccgctcctcccgacgctccgcgcgccctaccagttccgtctctttcgctggcccgccaaggagtactcctaccaccacgtcgaccacgaccagaacccgctcccccacggcaagcaccgcgtcgccgtctccgccgacgtctccgtcggcgaccccgcccgccccgagcagctgcacctcgcgtttgcggatgaggtcgacgagatgcgggtcctgttcgtgtgcggcgaccgcggggagagggtcgtcaggtacgggctgcagaaggaggacgacaaggagtggaaggaggtgggcacggatgtgagcacgtacgagcagaggcacatgtgcgattggccggccaacagcagcgtcgcctggagggatccgggattcgtcttcgacggcctcatgaagggattggagcccggaaggaggtacttttacaaggttggtagtgacacaggaggatggagtgagatatacagcttcatttcacgtgacagtgaagccagtgagaccaatgcttttctatttggtgacatgggaacttatgtgccttataacacctacattcgcacacaatctgagagcttgtccactgtaaagtggatccttcgtgatattgaagcccttggagataaacccgcctttatttcacacattggggacatcagctatgctagaggttattcttgggtctgggatcatttcttcagccagatcgagcctattgctgccaatactccataccatgtctgtataggaaatcatgagtatgattggccatcacaaccctggaaaccatggtgggctacatatggaacggacggtggaggcgaatgtggaataccttatagtgtcaagttcagaatgccgggcaattctattctacctacaggtaatggtggcccagacaccaggaatctttattactccttcgactcaggcgtggtgcatttcgtctacatgtcgaccgaaacaaattttgttcagggaagtgaccagcacaacttcttgaaaacggaccttgagaaggtgaaccgaagtagaacaccgtttgttgtttttcagggccaccgccccatgtacacctcgagcgatgaaaccagggacgcggctttgaaacagcagatgctccagaatctggaaccgctgctggtgacatacaatgtgaccctcgcgctatggggacatgtccacaggtacgagaggttctgcccgatgaagaattcccaatgtgtcaacacttcatcaagcttccagtactctggcgctcctgtgcatcttgtgatcgggatgggcggccaagactggcaacctgtatggcaaccgaggcctgatcacccagacgtccctatctttcctcagcctgagcgttccatgtaccgcggtggcgagtttggatacgccagacttgtggcaacaagggagaagctaacactgacttatgtggggaaccatgatgggcaggtccatgatatggtggagatattttctggcctggtatcccccagtaacagtagtgttgctgaggcggtggatggaaccaaacttggcacaggagtcagcaccgtgcggaaaatttctccgctgtacttggaaatcggaggcagtgtgatgtttgcgctgctcctgggattttcctttgggatacttgtcaggagaaagaaagaagctgcacagtggactcaagtaaagaatgaggaatcgtagtagtgttgccaataccgtgagcctggtgcagtggtggtgatccaaacttgtgtgggtgtaattactggagtagaacctaacaaagtgaaggcatttctgacttcttggggggctccgcgtcctcttggtacaactagtgtattgatagtcttgggaaatgaaggttctgatcgcatatctgttgttgtaatagttcaatgtataagcatgtaataagtgatataatgttcacattgctttggttgacacaagtgtgtaacatgtgctaccacaagtgattctgggcgtcctttgtagttgaaccatatttgttttatgatcctgcttttctgtatcatctgcctgcttttgttagcagatgtacggaatcttctgtacttggagtttatacctaacaacatacttatatatttatattacaaacctgtctgatacagcttcatgagctattggaagctgtggagctctctttttcaaaacagttttatagatgaagctcttcatttacgcttgtacaaaggaatgaagagaggtagttgaaaaaaagcaacttttttacatctctgtcttatttttatctttcagccatgcatgaaattgttggtgaagctgttttgcaaaatatttttttcccaaaacagtttaaattcatcttagaaagctactcaacagcttcatggatgaaactgatgagattttgcaaacgggtcctacacattcgaaatatctaaatgagcggtcaagcatggtttctttggacgatgttgaagacttggatcagaaacgccatccgggacaccgtgaccaggtccggcggcgaagcgagatggtgtcatccaagaaagtgtgcgtggtcggcgctggcgtgtcggggctggcgtgtgcccgcgagctgctccgcgagggccacgacgtgacggtcatggagcagagcggcggcgtcggcgggcagtggctgtacgacccgagggcggacggcggcgacccactcggcgctgccggcgcgcacagcagcatgtacgcctccgtccggctcatcagcccgagggagctcacgggcttctccgacttccccttcttccccagagacgacggcaccggcgactcccggcggtacccggggcacgctgagttcctgaggtacatcagggacttctgcgacgcgttcgggctcatggacgtcgtcaggctcaacaccaaggtcctgcgcgtcggcctggcggcgccgcgtgccgctgatgacggtgacggcatcaagcggtggacggtgagttggtctagacatcgtggctgcgatggcgaggtggtcaccacggaggaggaggtgtttgacgccgtcgtcgtcgccgtcggccagtacacccagccacggctcccaaccatcagaggttggttccgaccgaatgcgtcgttgttcatgcccggcctgttgctcaactgatggatgctgctcgtataggcatggacaagtggagcaggaggcagctgcactcccactcgtatagggtccccgattccttccacggcgaggtggtggtgatcgtgggcttccgtcatagcggcgtggacttcgcgctggagctctccaaagttggcgagggaggtgcacgtcagcgtcaagtccatggaggcgctcactcccgccgtgtccaaggccgtcgccaggcacagcgacctgcacctgcacctccaggaaaggaaaccgtgcagctacaaatctatgctccaatattcgctggttcagaatctgatccagcaatccaggtacggacggtgacctgacaaattaaatgtggcttgcatatcgcagatcgagtgcttgcgcgaggatgggcaggtaacgttcgccgacggctcgcgtgtcgccgccgactccatcatctactgcaccgggtacgactgctcgttcccgttcctggacacgggaggcctggtgaccgtcgacgacagccgcgtcggcccgctgtacgagcacacgttcccgccggcgctggcgccgtcgctgtccttcgtggggttgccgaggatggtgctggtgccgcggttctacgaggcgcaggcgaggtgggtggcgcaggcgctgtcgggctggcggccgctgccgc

SEQ ID NO: 16257 - DNA, 2130 bp, Zea mays
ctgcaggcgaactgttctgttccggtagggaattcaccgcaggcgagaacgcggccggctgcaaagcttggcgagtacggagtaaaacttattttttgagggctgccgcctttggacaaatccagtaaacccaccgagcttcggaaatgtgggactgagaagggacggcgatcccagatcacacagaggacaggggaaaacgaagccaccgagcccccacacgtcgccatccatcgccgtaatcgatcaccgccgtctcctcccccacacacccaccggaaccgtcgtcctgacctctcgccagcgataagcaaatcccctccccactttatcgtccacaaagccttcttcccgccctcccgaatcgctccctctctgtccctccgctccagccgccgccgccgcctccgccctccgaatcccaatggcgtccgcggccgctcctccaacctccctctccctcgcggcccgcgcggccaccagggcagccgccgccgccgccgccccgctgcgcaggggaggcctcgccacggcgtgccagccggcatggtctctggctttcgcggcgggcgacgcgcggctcgcggtccacgttgcgtcgcgatgccggcaggcgttctccgggcgtggcacgcgggccatggccaccatggcgaagaagagcgtaggggaactcacggaggccgacctcgaggggaagcgcgtcttcgtgcgcgccgacctcaacgtgccgctcgacgagaaccagaacatcaccgacgacacccgcatccgggccgccatccccaccatccagtacatcctcagcaagggcgccaaggtcatcctctcaagccacttgggtcgccctaagggttttacacccaagtttagcttagctccccttgtaggacggttgtctgagcttcttggcattcaggtgcaaaaagccgacgatgttattggccctgaagttgagaagctggtggcggccttgcccaacggtggggttctgctgcttgagaacgtaagattctacaaggaagaggagaagaatgacccagagtttgcacagaagcttgcctccctagcagatctttatgttaacgatgcatttggaacagcccacagggcgcatgcatcgaccgagggagttaccaagtttttgcagccttctgttgcagggttccttctgcagaaggaactcgactaccttgtcggagctgtttcaagccctaaacgcccttttgctgccatcgtgggtggttcaaaggtgtcatccaagatcggggttattgagtccctgttggagaagtgtgatatccttctcttgggtggtggtatgatcttcacgttttacaaggcacaaggtctccctgttggtgcttcattggtcgaggaagacaaactcgagcttgcgacgtctctccttgcaaaggctaaggaaaagggcgtctcccttatgctgccaaccgatgttgtcattgctgacaagtttgcccctgatgctaacagccagattgttccagcatctgcaattcctgatggttggatgggcctggatattggcccagattctgtcgcttcattcaacgcagccctggatacaaccaagacggtcatctggaacgggcccatgggcgttttcgaatttgacaagttcgccgtaggaaccgaggctgtggcaaagaagctggcagaactcagcggcaagggcgtcacaactatcatcggaggcggagactccgtcgccgccgtcgagaaggtgggagttgctgacgttatgagccacatttccacgggaggtggcgctagcctggaattgttggaaggaaaggagcttccgggagttgttgcgttgaatgaagccgccactgtgactgtatgaagcatgctttcattttgtttcgtcttcgtcttcacgtgccgttgtatacttgctacattctcgcttgcacctcctcagccgctcgctcgaaatgtaagagaccaatgttttatagagctaatggaaatcgtttgaacaacgacgaccctaatagtatgtgatttaccgagtgatctttcctcggtaacgtaactagtgatataaaaaacattcaaaggcaatcttggctattcactttgtgcaccaaaaaaacggacgcgtgg

SEQ ID NO: 16258 - DNA, 1715 bp, Zea mays
ccggccggggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgccgccgccccgctccgcaggggaggcctcgccgcggcgcgccagccggcgcggtcgctggcgttcgcggcgggcgacgcgcggctcgcggtccacgtcgcgtcgcggtgccggcaggcgtcctccgcgcgcggcacgcgggccatggccaccatggcgaagaagagcgtcggggacctcacggaggccgacctcaaggggaagcgcgtcttcgtgcgtgccgacctcaacgtgccgctcgacgagaaccagaacatcaccgacgacacccgcatccgggccgccatccccaccatccagtacctcctcggcaagggcgccaaagtcatcctctcaagccacttgggtcgccctaagggttttacacccaagtttagcttagccccccttgttgcacggttgtctgagcttcttggcattcaggtgcaaaaagccgacgatgttattggccctgaagttgagaagctggtggccgccttgcccaatggtggggttttgctccttgagaacgtaagattctacaaggaagaggagaagaatgacccagagtttgcgcagaagcttgcctccgtagcagatctttacgttaatgacgcgtttggaacagcccacagggcacatgcatcgactgagggagttacaaagttcttgaagccttctgttgcagggttccttttgcagaaggagcttgactaccttgtcggagctgtttcaagccctacacgcccatttgctgccatcgtgggtggttcaaaggtgtcatccaagatcggggttattgaatccttgttggagaagtgtgatatccttctcttgggtggtggtatgatcttcacattttacaaggcacaaggtctttctgtcggtgcttcgttggttgaggaagacaaactcgatcttgcaacatctctacttgcaaaggctaaggaaaagggtgtctcccttatgttgccaaccgatgttgtcatcgctgataagtttgctcctgatgctaacagccagattgttccagcatctgcaattcctgatggttggatggggctggatattggcccagattccattgctgcattcaacgcagccctggaaacaacccagactgtcatctggaacgggccccatgggtgtttttgaatatgacaagttcgctataggaactgaagctgtggcaaagaagttggcagaacttagccgcatgggtgtgacaactatcatcggaggtggagactctagtcccggctttgagaatgtctgagttgctgacgttatgagccacatttccaccggatgtggttccagcttggaaatgttggaaggtaaggagctttcaggagttactgcattggat

SEQ ID NO: 16259 - DNA, 1403 bp, Zea mays
atgccacgccgcccagtgagctaatcgcctggcaggtcgtgccctctatagccctcgcggggccccccaggccggccgggatgccatttccctgctgacgctcccacgccatcgctctccctcctggcgtcttcccccttcctctgccagcgcaggagctccaagctcccatgccgccgagcttctcccatggcggcctccctggtgcaccagccctggacaccaggccacaggccatagcttctgcgcgcttgtccgcagccaggttcgtgtagccaccgtggagctcgatcatccttcttccccaccgtgatgcgccggatccgagctcccttggtgcaggcgccccttccccccatcagatccatggcgccacatctcccagctggcctcctctgcccagcgccaccccttcctttccctaggcgcagaaagctcttccccacgcagtccatctccaggccagatccaattcgcccaacccctgctcgcccagagcttcttcgccccaaatccggccatccccgccatgtcgtgaagttcctcgtgcagccccacctggccgccatcctccccaggtcggcctcccctttttattttgtgcagttcgccatccccttggaacacgcactgtcttcctctgctcctgtttggttccatggagggcagccgaaccctttctccatggccaccaatcgtcctgctcctttcccctggtgtgctcgacgcctggtgcttcgacctcgacagcttccccctgcaagcgacacctctgctcggctccctctcccggcagcgagctcctctgtcggcgccggaccacagcagcagggagcctcccatggcgtttgtttccccaacgctcgccccgtcaatagtcgtcaacctcgcgcagcagccgcgacgccagttcgcgcagccacgtggatctcccttgcgtcgtgccctcggcgtgctcgatgtaatgccaaagcagcagtagtagcgacgccctccgttgcgtcgtgctcgctagatcgggccacccgccgtcgatctgtgcagcccctacgtgccgtcgtcaaaacccatgcccttgtcgacatcacgcctcgcgcatcgctcgtcggcaaagatcccaaactaatggcatgcatgtgcgacgcgagtcggtcaggttgttcaccttgaatgattcgtgatttattttatttacgtattcggtcgatgatgtgcctgcatgtgaatatgtgcgtgaaaatataattgtatgaatggacgcgtgtagagaagaaactaaagtagaaaagaactcagacatttttatattttgataagaaagatgtgtgatgcgttgtttgatgcaaaaaaaaaaaaaaaaaaatgcggactatattttgggaaatgcaaaaaaaaaaaaaaaa

SEQ ID NO: 16260 - DNA, 879 bp, Zea mays
  misc_feature (804)..(805): n is a, c, g, or t
  misc_feature (843)..(846): n is a, c, g, or t
  misc_feature (855)..(855): n is a, c, g, or t
  misc_feature (879)..(879): n is a, c, g, or t
ctcgatctccactccactccactccacctccgtccctctccattattccatcccggcggcggcagcgcgcgcgcggcgtgcgtgtcagtcactgatcagtatccccgcgggccgtccttcccttgtccgatccgccgcgcagcagacggcgcacggcatggccagcaggaacaaggtggcggcgctgctcctctgcttcctgttcctggccgcggtcgtcgcctccgccgccgagatgatcgccggcagtgggatcggcgacggcgaaggtgaagagctggacaagggcggcgacggcggcggcggccaccacaagcacgagggctacaagaacaaggatggcaagggaaacctgaagccgtctcagtgcggcggggagtgccggcgccggtgctccaagacgcaccacaagaagccgtgcctcttcttctgcaacaagtgctgcgccaagtgcctgtgcgtgccgccgggcacctacggcaacaaggagacctgcccctgctacaacaactggaagaccaagaaaggagggcccaagtgcccgtgagtcgtgagaagatggcggcccaatacgcggttttcccggcggctatgcgggcgggccgccggcccatcgtaacctaccaccgtagttggaagcgtcgtaggataggttaggaataaataatagcctctctttttttttttgccttgtttcggtgtttgtttgggccgggccggctgccgcttctctggtctctggtctaaaaagttcccgaaaaatattatatatttaataagaagaagaaggaggggaaaataaannaaaaaaaaaaaaaaaaaaaaaaaaaaaaaaaaaaaaannnnaaaaaaaanggaaaaaaaaaaaaaaaaattttn

SEQ ID NO: 16261 - DNA, 1621 bp, Zea mays
cctcgatctccactccactccacctccgacctctctccactatttcatcccggcggcggcagcgcgcggcgtgcgtgtcacactcactgatcagtatccccgcgggccgtactccttcccttgtccgatccgccgcgcagcagacggcgcacggcatggccagcaggaacaaggcggcggcgctgctcctctgcttcctgttcctggccgcggtcgccgcctccgccgccgagatgatcgccggcagtgggatcggcgacggcgaaggtgaagagctggacaagggcggcggcggcggcggcggccaccacaagcacgagggctacaagaacaaggatggcaagggaaacctgaagccctctcagtgcggcggggagtgccggcggcggtgctccaagacgcaccacaagaagccgtgcctcttcttctgcaacaagtgctgcgccaagtgcctgtgcgtgccgcctggcacctacggcaacaaggagacctgcccctgctacaacaactggaagaccaagaaaggagggcccaagtgcccgtgagaagatggcggcccaatacgcggttttcccggcggctacgcgggcgggccgccggcccaacgtaacctaccaccgtagttggaagcgtcgtaggttaggttaggaataacagtctctctttttttttctctccttgtttcggtgtttgtttgggccgggccggcggccgcttctctggtctgaaaaattcccgaaaaatattataatattcaataagaaggaggggggaaaatcagtgtgaccttttcgctggaacgagggatggatgagatggggttcggacgttcggtgtcactgacctgtagcagcagcagtagcagcgcccaccagcagcagccaccagcacggcgccccggccgattggacgcgaaccagaaacagacacgacggcgtgtccatcgaccgatctcctcgcgccaatggcagacacgctggccctgcccaccaggccaccaccaccaccaccaccaatggatccagagcgatttgacggcagccgatccgatcctcagcctgtacctgtacctgtacgtgcgcacagcacacaagtggcggctggctggctggctggaaaagatccacccacaggagagagcagcagagctagcagaagaagagaaggcaaggcaacagctccaaactccaaccaagtttgcggcgctgggagccaattcgcgcagctggccggaaaggaaagcggagagagggcttcaatggcactgcacgcgactcctcctactccgatccccatcccatcagtccgtccgtcgcaaacggtcacgcgcgccagccagccaactccatcacccgggcggtggtgtgcgtgcatacgcattcatcaaccactgttgcccacacaccacacccacaggccacatgaaatgaattggagccaacgattggtaggggacctcagcaccgggccctagtacgtaccgggtcttgccatccatctatctatcagcccccgccttcttcttcttcttccatctcatagctagagtacgtagcactagtagccaaggtgaaattttttttatacgcatgagcatgacgatgaactagctaagctgcag

SEQ ID NO: 16262 - DNA, 944 bp, Zea mays
  misc_feature (925)..(925): n is a, c, g, or t
ttgggaccctcgaggccggcctgcagaggttgaatggcggcggcttatcgcatgcggctggctggctggctggctgatgttccctcagtcacaagccaaatagtggttgctgtgcaatcagctagtagctaggtagtactacgcatatatacagttggctccccgggggccggcgttgaatcgaaagtggtggttcagccgttcaggagctaccaccggcactctccttcactccttccattattttatcggtgctcgaggttcaggtttcacgcagtgcggcgagagctggcagccatgaagagggggagcccatggtcgctgcggctgctaatttgctgcgcggcaatggtggccatcgcgcttctcccccaacaaggaggccaggccgcttgtttcgtgccgacgccgggtccagctccggcaccgcccggctcctccgcgacgaacacgaacgactcctccgctgctcctcggccagccaagcccagcgcattcccacccccaatgtacggtggtgtcacccccggcagtctccagccacacgagtgcggcggccggtgcgcggggcggtgctcggcgacggcgtaccagaagccgtgcctcttcttctgccgcaagtgctgcgcggcgtgcctgtgcgtgccgccgggcacctacggcaacaagaacacctgcccctgctacaacaactggaagaccaagcggggaggccccaagtgcccctagtagccctccctctcggtctacttgatgagatcttctgttcaaaaaatcaaaaggaataagaatctgtttaaccatctttagatttcacaaataaaacaggtttcaatttatctttgtagtgaaacgcttgcaactcatgtgtgaatctcatccaatattagtgacaaaaaaaaaaaaaaaagattgattactaatnattgatctgacgagagtcc

SEQ ID NO: 16263 - DNA, 1178 bp, Zea mays
ccctagtcatactcatatatagacttttaatatctttctataatttaattgaatttctcgattaagcctagcccaggaatccaacggttccctcggtcacaagccaaacagtgcaacagtggttgctgtgcaatcagctagtagctaggtagtactacgcatatatacagctggaaacgatggcttcaatgttgaatcgaaagtggtggttcagccgttcaggagctaccaccggcactctccttcactccttccattattttatcggtgctcgaggttcaggtttcacgcagtgcggcgagagctggcagccatgaagagggggagcccatggtcgctgcggctgctaatttgctgcgcggcaatggtggccatcgcgcttctcccccaacaaggaggccaggtcgatctgtccctctctcgtattggcatggcacaacagatcgagcacatttgtttcttggtctcatcacatcaatagttctaccgtgattcgcagctgtttcttgctcatgtgcggtgggtttcttttccggacgttcatattcaggccgcttgtttcgtgccgacgccgggtccagctccggcaccgcccggctcctccgcgacgaacacgaacgactcctccgctgctcctcggccagccaagcccagcgcattcccacccccaatggtgagtgagtactaccgatagtacaatcaaaacacagaatcaacaccgatccaatgaatgtgcctctgattttctgcagtacggtggtgtcacccccggcagtctccagccacacggtccgtaccgtacgcgactttagctaaaaagagagcagcacctctctgaagtctgaaccgcacgtcgtcgtcaattaataaaggtttcgctgtgctgcgtgtgcgtgtttgcaacagagtgcggcggccggtgcgcggggcggtgctcggcgacggcgtaccagaagccgtgcctcttcttctgccgcaagtgctgcgcggcgtgcctgtgcgtgccgccgggcacctacggcaacaagaacacctgcccctgctacaacaactggaagaccaagcggggaggccccaagtgcccctagtagccctccctctcggtctacttgatgagatcttctgttcaaaaaatcaaaaggaataagaatctgtttaatcaaaaaaaaaaaaaaaaa

SEQ ID NO: 16264 - DNA, 1871 bp, Zea mays
aagcgtttcaacagtaatctctctgtgcctgcgacgacgactaggtgggttaccgccgtcgcgccgccgccgccgccgccgtcatactacaggtgcgaggccttcatcggtatcttaacaggcgacgaacaccaaccagccccctccctgccctgcggaccctgccccagtctgcactctacgatggcggcgcctccggccacggctgccgcggcctcccggtgtctctctggtgccaagtcgtgccgggctgctgagcggagctccagctcgtttgccgtctcggcgccttctactggcctccggcaaagtaggagccgcgtcctcagcgtccgtgccaaggttgccactggcgtgcagagagccagcactgtggatgatggagcgaaaaggccgtggaagctcagtgatgctcgtcttgtcctggaagatggttcagtgtggagggccaagtcttttggcgcttcaggaacacaagtcggtgaagttgttttcaacacatcactgacaggctatcaggagattttgacagatccaagctatgctggtcaatttgtcctgatgaccaatccccatattggtaacactggcgttaatcctgacgatgaagaatcaaaccaatgttttcttggtggcctaatcataagaaatctaagcatatgtacttccaactggcgatgcaaagaaacacttgaagagtatctgactaagaggaacatcatgggaatatatgacgtggatacacgtgctataacacgaagattaagagaagacggcagtcttattggtgtcttgagtactgatcagtctcagacagacaatgagttgttggaaatggccaaaaagtggaaaattgttggagttgatttgattagtggtgtcacatgtgatgctccatatgaatggttggacaagactgactcagaatgggagttcaagagggatcagtcaagtgaaacttttcatgtggttgcctatgactttggtatcaagcataatattttgagacgattggcatcatatggatgcaaaataacagttgttccagcaaattggcctgcttcagaggtactcaatttgaagcctaatggtgttctttttagcaatggtcctggagatccagctgcagttccctatgctgtgaagacagtacaagaaataattggaaaggttcctgttttcggcatctgtatgggccaccaattgattgggcaggcgcttggtgggaagacatttaaaatgaaatttggtcatcatggtgggaatcaccctgtctgtgatctccgtagtggacgtgtagacataagtgcacagaaccataactacgcagttgacccagaatcacttccagaaggagcagaagtaactcacgtcaatctcaacgacaatagttgtgctggccttcagtacgccaagatgaagcttgtgtctctccagtaccatcctgagtcttccccaggtccgcatgattccgacacagccttcggtgagtttatagagctcatgaagagcaacagattgtgagggaggggagtactggcaaaggtcaataattgtcttggtgctctcttgcagcaagctcaaaagaatttgtttcattttagtgtttttctttgggatgttcatgtacttgaattttgggtccataggacatagcataagatgctctgcaactgtaccatgaattgaagtagtgaactggttgaatttcttgagaataacatgttatcaaattgcacggtacagtatactcagattatgctcgcgaatttctggccggcaagcaaaaaaaaaaaaaaaaaaggccccgtgggcctagagataaaggatggccatgaaggctggtcagtggatacttctgttgttccaag

SEQ ID NO: 16265 - DNA, 2036 bp, Zea mays
cctcgaggccggccgggcccaagcgtttcaacagtaatctctctgtgcctgcgacgacgactaggtgggttaccgccgtcgcgccgccgccgccgccgccgtcatactacaggtgcgaggccttcatcggtatcttaacaggcgacgaacaccaaccaggtaacttcgtcggtatcttcacttcaccgacggcgacgagcacgaactcgaaccttttttttccccaaaaattagccccctccctgccctgcggaccctgccccagtctgcactctacgatggcggcgcctccggccacggctcccgcggcctcccggtgtctctccggtgccaagtcgtgctgggctgctgagcggagctccagctcgtttgccgtctcggcgccttctactgacctccggcaaagtaggagccgcatcctcagcgtccgtgccaaggttgccactggcgtgcagagagccagcactgtggatgatggagcaaaaaggccgtggaagctcagtgatgctcgtcttgtcctggaagatggttcagtgtggagggccaagtcttttggcgcttcaggaacacaagtcggtgaagttgttttcaacacatcactgacaggctatcaggagattttgacagatccaagctatgctggtcaatttgtcctgatgaccaatccccatattggtaacactggcgttaatcctgacgatgaagaatcaaaccaatgttttcttggtggcctaatcataagaaatctaagcatatgtacttccaactggcgatgcaaagaaacacttgaagagtatctgactaagaggaacatcatgggaatatatgacgtggatacacgtgctataacacgaagattaagagaagacggcagtcttattggtgtcttgagtactgatcagtctcagacagacaatgagttgttggaaatggccaaaaagtggaaaattgttggagttgatttgattagtggtgtcacatgtgatgctccatatgaatggttggacaagactgactcagaatgggagttcaagagggatcagtcaagtgaaacttttcatgtggttgcctatgactttggtatcaagcataatattttgagacgattggcatcatatggatgcaaaataacagttgttccagcaaattggcctgcttcagaggtactcaatttgaagcctaatggtgttctttttagcaatggtcctggagatccagctgcagttccctatgctgtgaagacagtacaagaaataattggaaaggttcctgttttcggcatctgtatgggccaccaattgattgggcaggcgcttggtgggaagacatttaaaatgaaatttggtcatcatggtgggaatcaccctgtctgtgatctccgtagtggacgtgtagacataagtgcacagaaccataactacgcagttgacccagaatcacttccagaaggagcagaagtaactcacgtcaatctcaacgacaatagttgtgctggccttcagtacgccaagatgaagcttgtgtctctccagtaccatcctgagtcttccccaggtccgcatgattccgacacagccttcggtgagtttatagagctcatgaagagcaacagattgtgagggaggggagtactggcaaaggtcaacaattgtcttggtgctctctcgcagcaagctcaaaagaatttgtttcattttagtgtttttctttgggatgttcatgtacttgaattttgggtccagaggacaatagcatatgatgctctgcaactctaccatgaattgaagtagtgaactggttgaatttcttgagaataatatgttatcagattgcacggtacagtatactcagattatgctcgccaatttctggccggcaagcaaaaaaaaaaaaaaaagtagactagttagtatagagataaaggatggccatgaaggctggtcagtggatacttctgttgttccaagctaatcagatgtgcacaacgttgttgccagctttttaaatgactgatggaaaatcaaaaaaaaaaaaaa

SEQ ID NO: 16266 - DNA, 838 bp, Zea mays
attgggtacctcgaggccggccggggaacaaaaccccggacggctaccgttcagtggccagcgtttcaacagtaatctctgtgcctgcgacgacgactaggtgggttaccgccgccgcgccgccgccgccgcccccgtcctactgcaggtgcgaggccttcatcggtatcttaacaggcgacgagcaaccagtctgcactctacgatggcggcgcctccggccacggctcccgcggcctcccggtgtctctccggtgccaagtcgtgctgggctgctgagcggagctccagctcgtttgccgtctcggcgccttctactggcctccggcaaagtaggagccgcatcctcagcgtccgtgccaaggttgccactggcgtgcagagagccagcactgtggatgatggagcgaaaaggccgtggaagctcagtgatgctcgtcttgtcctggaagatggttcagtgtggagggccaagtcttttggcgcttcaggaacacaagtcggtgaagttgttttcaacacatcactgacaggctatcaggagattttgacagatccaagctatgctggtcaatttgtcctgatgaccaatccccatattggtaacactggcgttaatcctgacgatgaagaatattatcagtggggtggggattagagctagcttggtttcaactttttcatctaatcataacatatatatatatatatatcaagagagagagggataagatatggatcggattccatattttttgccagatttttttttttgggaattttggttaaggtggcaattaattactttagtgactgctagttgtagatactgtactat

SEQ ID NO: 16267 - DNA, 1857 bp, Zea mays
gtacccgcgcgggctgccccccggccctcacttaaaaactagtccccttgcgaaaaaattggtccgtccctgcctcagtctgcactctacgatggcggcgcctccggccacggctcccgcgaccgcccggtgtctgtccgtcgccaagtcgtgctgggctgccgagcggagctccagctcgtttgtcctctcggctcctgcgactggcctccggcaaagtgggagccgcgtcctcagcatccgtgccaaggttgccactggcctgcagagggcctgcattgcggatgatggagcggaaaggccgtggaagctcagtgatgctcgtcttgtcctggaagatggatcagtgtggacggccaagtcttttggtgcttcaggaacacaagttggtgaagttgttttcaacacatcactgacaggctatcaggagattttgaccgatccaagttatgctggtcagtttgtcctaatgaccaatcctcatattgggaacactggcgttaatcctgatgatgaagaatcaaaccaatgttttcttggtggcttaatcataagaaatctaagcatatgtacttccaactggcgatgcaaagaaacacttgagaagtatctgattaagaggaacatcatgggaatatatgatgtggatacacgtgctataacacgaagattaagagaagatggtagtcttattggtgtcttgagtactgatcagtctctgacagacaatgagttgttagaaatggcccaaaagtggaaaattgttggagttgatttgattagtggtgtcacatgtgatgctccatatgaatggtcggacaagactgattcagaatgggagtttaagagggatccgtcaagtgaaacttttcatgtggttgcctacgactttggtatcaagcataatattttgagacgattgacatcatatggatgcaaaataacagttgttccagcaaattggcctgcttcagaggtactcaatttgaagcctaatggtgttctttttagcaatggtcctggggatccagctgcagttccctatgctgtgaagacggtacaggaaataattgggaaggttcctgtttttggcatctgtatgggccaccaattgattgggcaggctcttggtgggaagacatttaaaatgaaatttggacatcatggcgggaatcaccctgtctgtgatctccgtagtggacgtgtagacataagtgcacagaaccataactacgcagttgacccagaatcactcccagaaggagcaaaagtaactcacgtcaatctcaacgataatagttgcgctggcctccagtactccaagatgaagcttatgtctctccagtaccatcccgagtcttcccctggtccgcatgactccgacacagccttcggcgagtttatagagctcatgaagagcaacagattgtaagaaaggggatcaggggagtacttgaaaaggtcaataattgtattggtgctccctcgcaccaacctcaaaagaatttgttgtatctgtagtgtttttcttttggttttgggacgttcatgtgcttgaatttttgggtccagaggacatagcataagatgctctgcgcattgtaccatgaaatggcctggttggatttcgtgaagataacatgtcatcaaactgtacggtacggtacactcactcggacagcgcctcgcgaatttcttaacggcaggtaaagtcgtcagtggatggccatgaaggccggtcagtggatgctttacttttgttgttccaggctaatcagatgtgcacgacgttgttgtcatctttattaaatgctttcatcatccaaaaaaaaaaaaaaaaaagaaaacaaaaaaaaa

SEQ ID NO: 16268 - DNA, 7040 bp, Zea mays
  misc_feature (6103)..(6103): n is a, c, g, or t
gtctaatcagtacgcatcatctgatttggcttttatttcagttcttctgatttggtcatgatttatattcggaatttaatttagaatttgtctaatttattcaacaataacaagtgaagaaaacaccgatcaagctgtcccaaacgagaggatgaaggcatggctcctgaatgaaacatatgttgtctacggttgatgttgaaaccgatgcacttgaaaggagtaacagcgtgtcaaatccatatagctatcttttgttttgttctacggcaggatggagttgatccaacaagacgaagaagaggggcaaatatgcaagaggtatggccgcctgtctcatggctagatatctgcatcatggcttcaggataataaacccagcccaaccccccggggggagagttgcttccgctgcttgatgccaaccatgtatagcttgcgaagcgaatgtgtttcttttcctttttgtttgttcgttcacctaatcataggtagtgtagaataggacagtggtaacgatgcgtatgcgatggccatcaccaggcattacagactactacatccggttctctcagatgtatcacacctttgattttttttaaacttttaccactcatctcagatatattattttttgaataagatgagtaatcaacgtttttttaaaaaaaataatagtatatattatatttatgaacggagggaggaaatactactaacaatacagtgccgtgtgctgcagcagctgatgacctgacgaagcacgtacgtacagactgctgctatatgtatatcctatcctatcattgggccatcgatatcgattacgcaacagattttcaatctgtccgtcctactactccatgcggtgggtagcgtctccgggaggaggactagcaggctagcagctggccggcgccgtttcctggtttgtactcccggtggagcccttctttggttttctagtctggagttctccagtctgtctacatatatactacacacggcgcccttgcttgctgttgctgaatgctgaatgcaatgcactcgtcgctgggcaaggcggcagcagctagctagagctagaagctagccagggactagcaggaggcaggcaggcaggaccatgcatgccccatgatccatggacttttgtggttgggggtggcctagctgggcacggaagggaaagggactgaccgagccaatgcaacgccaacgcaacgcacgacggctgacttttgtgacctacatggagtatttagaacactgctgctgccgtgtgctgctctccgttcttcgtccatccatggatggttacacttgctagctgccagcttggctgacgagaaagccctctccattcaatacccttctatctcgccttgctgcatatgcaaacgtgatctgcccgtgtgtcgcctcctcggacgcgatgcgcaccgccggccggtcttacaattgcgtgcggggctcagtcaccaacatgtctccatccgtcctcccaggtcccagcaggcagcaggaccaggcggtcatcaccccggccggtgtacggccacgcatggcatggcgagctggcggcagccggcaccgcgcttgctgttcctcttcgcgagcaaaggcaagcctgtccgtgtccgtacgtccatgctttgctatctgctccggcggccaaggccagccaacccggccggttgctttgctttgcgtccgccgcccgccagccatgcgtgttgcgtccgcggctgtacacgcattcaattcaattcaaaccggggaggcgtgcagaatcagcccgtccggccgcggccggtatggatcgcgatctctctctctctctgctctccactgcgattgccgccgctgtctcctagacgccgtgccgtcccgccccgccccgcccgacccgacggcgacgccgacccctgcgtcttggcttcacgaacggtgctctgctactgtccaatcattcagtacggccttgacttccccgacgctgacgagctgttagcgactactagtaataaaaccatgtccggttactgtcatctgcgctgcggtgcgtgccaccaaggtccgtgccccccaacaactctactacgggaccagtctgaactccgaacttctttgagttcctcctcctcctcctccaccacctcctcctccatggttgcgttcaacagagacggcggttggtttctccgagctgagctgtcaggattcaggaatcaggagcgagagtgcgagaggttcctgttcctccgatgctaattgctggtgctgtctggtagctaaccagtcttcagtctttttcagatgctgctaaccaccagtgttttttcttgtttatttgacgccagctgcttacgtgctactagtggatgcaatgcaattggagcagcagctacctccatgtggtgcgcagcgcacacacaaaggtgatctcacccgtgcgtcatgaccacttgccggcgtctcgccgcacagcacatggaggagcagtaacggaacggagaatcacgcctgcaacgacgcatccgcctccggctattatttgctcaaggacagtggcgtggcggccggggtggaattggaattcccaccaaatctttcgtcccgtcggaagggattattcgctgggatttgatgcaaagcgagagcccaggcgagatgcctctcgcacgaacgtctgtttggatggactagagtcctggcagtggcagtggcggcgcgcggcaggttccttattccggtgaggaagaagaaaggcccctgaagaagagaggcatctctgctctacatctactacgccgcccctcttggcagcaatgagtgagcgagtatatcaggaggaaccttatcgacgtctcctttttctgcatcctcctaagtgcactgctctttctggcctgcctttctctcgtcctcacgcctctgctcactgctcagctcgaccttccctttcgtgcctgggtgattcttgcgttgtgtacatgccctgccctgctgttccttgcactcggtcgctgaagccactcaggttgttggggcatcagttccttgtggagcttggcttgcttctgtttctgcttggcttggtttcgtcactcgctgcctgccagttggcaacaagccatttggtttggttggtttcgagcatcagcaaagcgaaatgcatcacaagcacagtacatggtttgagcgagtgagactgtgttttgcttctcaaagcaagattgaagaagatttgaacgagcaacgcgtttgtgggagaaccttggcacagcaggaaatggcggtcggttgctggaagggaactgattgattttctcgctaattaacactctggattcgcgacgagctccagcaacaacataacatggcagcaaagcgcttagcctttttatgatgttgttgtcggtttgttggagctcaagcttcttctctctattgattgctactagggactgagactgagagggtgctacggcaattaggacacggcgcccgtgatttggtcgacgggcgggctagccaactcttgtttcttctagtcggtctcaattagaggaggcgacgctgcagctgccactgatcccttcgtcgccgtcatcgtcctggccgatggtcccggaggcgtcggtgacgcacgacgacgtggacgacgcgctctccaccgccgcgtgctcttcttcttcttcttgcgcgtcaccaaggcgggcgcggtgggctggcccgccccccctgaaaatgcgacagaccacccagtcggccgccgccgcgccaccgccatgggagctcacctggattacagattcatcaccatcaaaacagcatattagccgcccgcctggtcatgatgcacgagctacggtgagcgcgagctttacatacattagtgggcggaggcgcgttggcggcgcagccgtggaggtggaggccggcggggaggaggcggtactcgtgcatgacccagtcggtgcgggcgccgccgccgccacggcggcgcgggcagaagacgagcgtccgcttggtgccgacggggcgcttgcagcgcggcgacacgacgacggtctccttcccggacggcctccagacgccggcgccggccgccctggccgcgccgcctcccctgcgccagcaccgcgtcgccgggcggtggaagaagaagtgctccccgctggcgtcgtcggcggctccccccgcagctgcacaggttcgaaatcgatactctcgttcaggtaaaggacgcggatggagcgggggtgggggtggggatgggtggtgtacgtggtgcggcggcggggaggaggaggtccgacgggtcgaggcgcgcgaggtcggcgtccgggatgacgcccgccgggagcgggcaggccagcgccttgcggcggaggtagtgcagcagcagctcctcgtcggtggggcggaagcggaagccgatgggcaggcccgcgacgggcgcgccggggccccgctgctgcaggcgccacgcgccgggccgggcctccatcgccgccgccgccgatcgacgggatcggatcaggattcggttttggatttgtttgggtggcttgcgcgcgatctgcctgggtgatcgatgtcagacggtaggcggcatcggcgacctggtttttgtggcctggtgggggatggggggattctcgtcgtcgtggggaggagcggaaaacaggggggcgtcggctccgccgttttataggtgcagcggcggtggcgtgaaatggactcaaccccgtccaaactctcatcaactgccatgctcgtgcccgccggcctattcattcagcttttctcctcctcacaaaataaaaacttttttccgctctttgtggagcctctggagtactagcaccaccagcagtcttctctgctccgacaaggccgcagtcaaatactctggatccagtcaaatacttattaataattttgttcctagtaattattgtctttgcgtttgaccggcagtaatttgaatctctactgtactagtagtacgataacgaaaaagggagtgggcatccatggcagtcacgtctcgtgtctgacggtggttgagttgagttccgtgccagccctctcggtttcgggatccaaggcacagcaagcacggcaacggtgcggttcctttccgggctttgcttgctcgcgagcgctgcgcctccgtccggcgtccgctctgccttttccgccccgacgacattcctttccttctcgtccgtgggtctctctctctctctcttcctcgctcgcaagcacaaggagaagcttccacgccatggccaccgcccctcctcctcagccatcacctgacgcgccgcctaccaacattggatccccacatttttcaccctgcgatctactagctacaaagcttgtttagcacgccgcgcgagagcgatgaagaaatgccaaagccaggcggtatgaacaggaacagcgaggcgtgcgcgccgtgaaatgtcagcgcgtttgacctgcagctgcagcttcgtccaccgaccaccggggaaacgtggtcggcactgtaaggctttgtttgggtacagagggattgaagttgattaaggtgtattgaaggtgattaaaagaaaatttagtttatattacacttcaatacaccacataccacctcaatacactctaatctgagattacccaaacaaatcctaaagagcctcgataaaactgaagcctgggcacgacgggtgagagtgaaagggtggctttccacccctttctagtttggaaaaaaaaatatttacatactagatataaagaatcttttttacagcccctcatatacaccagctactggttcatataaatggaagaaaaacaaattactaaagagttattttgtaaattttgatatgtgtttgtggacctctgagtggtgggtgtgaggagctgtaaaagataatatttacattcggtatgtacataatttttttcctctagtttctgcacgagaagatataacataaaaaaagtcgtcattgaggaagaaccagtgactgactacatttacgaggggaataaaagatgggaaatcaccgctcagcctgtcagccatccacgngactgagcttgctggtcttctccccacgactcgctcctgttggctgctagtctgctctccgtgactcctccgcccacgccccggcagtcgctgcacccctaggcccgccacctccccaatccaccccgttcagtctgccggccgcgctctgctccgctactacctaccgccgccggcggagcccgggccctggctccgctactagtggtgggcgtatccgggcgtcgtcagaaagaaagccacccacggccacgaccgtcaggccaacggcgaaggcgcagcagctgcggttctcgctcacggacggacggacaactaccgcccgtcactgcatggtgccgtcacgtgcgctggtggccctgggcggtggccgctgcgtgcgtccatccccattgactgcgctcgccgatgacggatcgatcctctcctcctgcccaagtgccaacaagaccgcggtgccgtcccggcaagtgctacccgcggccccgcgacatacggagccaggagcgcccacacgggcgcacgtcgccggcggtggcgctctgtccgctgggatgcatgggcaaggcagcgggggtggtccggtggcggaagctacagagcatggccgcccggccggaggacggtgccgtggcgagggatgcccgcccgcgtcactgcacgcacgcatcgtccgtagaccgtactcctacgcgcctatggacatttccgcgcgcgccaccaccacgtcccgacgccgcggtttgcatgcacgcagatcgagcacgtcttgttgcctcctcctcctccacctccaggctccagggctccaagcctctgcacctgctcgggtccgtccggggtggtttgcttgctttgctggcacggaagcgaacgacgtgcctgtactgccacccctaatccgtctcgttgccgtcgcaccttgctgtggcctgtg

SEQ ID NO: 16269 - DNA, 1336 bp, Zea mays
atccgcgcctccgctgggcgtgcaaaaaaacaaattagatagagctcgccgagcaagcaagcaagccaactcggccgtccgaacgaaagcgaagcgcggccaaactcactcgctaaacgctcccgttctcctccgcctgcccccaccggctccccttgtacacgagcgccggagacgccatggcggcggcgcagccgaagccggccaagaggctgggcggcatggcggaggcgctcgccatcgccgccgacctcggattccccgcctctaccacgcaggaagatcagactagctccgacaaaagcgatgatttggtgaaggttttgagggaactgactgtcgtgcagaggaacattgccaacttgcaagtggagctacagggaagaaaggatgataaaaacattgctcatttgactcatgtgagtgagatggaaaagaagtgcgagtctttggccagaatgactgcaattttgaaagatgtaattcagaacaaggatcgtattattgctcggctgcaacagccttattcccttgactgcataccagttgaagctgaataccagaaacaattctcggagctacttctgaaagcagcaagtgactatggggcattgacagcatcagtcggcgatttccagtggagccaaaactttagggaatcaccagctgtctggggggaaatgctgcgaccgattcctgctgcacttgcttcctgcacccggttcttcgaggcaatgtctgcgatgagggaatccttttctactcttcagaaactacgcgttggccattcctctctgtcaataaccccaagtgactccagcgacgattcaaagttcttgacgccacctcagtggagagacggctcgatactcgatagctggaagcaaatggatgacatcaacctggagagcagtggaattgacgccatgaatcagaggaggttgtcttggccctccatcaagagggacccgtaggtcgcaggtcacccattggatttaggttcccatgttacataaataggattccaccttgtgtagttggcattgattctctgtatttttaatccgatcacctgcacccatttggcatgttcgacttgtgagagatggtctataagttccttaaatcaatgtcgtggcaaaatttgatatgttttaggcccctttggcagggcaacttttgctctaactttgttattgtttacataagccgtactaaacagtatttttaaaataacttttcattaattatattttttgttgtttattattaaaaaaaaaaaaaaaaaaaaaaaaaaaaaaaaaaaactcgagactagttctctctctcctcgtgc

SEQ ID NO: 16270 - DNA, 2130 bp, Zea mays
cattgggtacctcgaggccggccggcaacgtgcggggagcgcaatacgccgggccgccggctaagcgggaggcaaaggcgaggatgttggggtcgcgccggtggcagtctccggctgatgctcctgcggccaccgatgacttggaggaggacactggtggcgtcggcggcccgtccaggcggcctctgcgccacgggctgcaccgcgcgtcgccctacggtggtgccccccgccggtggctctccaagctccccgtgacttcgaggatattccccaccatgccacgcgaccgcgcggcctcaggcaataatcaagaggttcattgtgaaccactagaagttattcgtgaaagacactccacagaaccaaacatcaatgctgcagctattctaccatcaagacctgtgagcaatacatttaacctgcttctggaaggtgacatgaatccaagtcatggcaatgggcttgctgaaatagagaacataatcaaccagagatatttttctagggatgagacactacgtcttatagagatcatgcggtcaaggacttctgattttactgttgaagaccagagacctccagtatctactgcaaaaggttttgaaacaacattttttacacctgctaaactgatcgaggctcagccatcttggaggactgatatcgttccatcatccaatgtgcatgatattggttcttcgccagttgaaattgccaaagcttttatggaagcgcagacctcagcttctgtacacgagtccaaaaagcggaaattcagagctttgagtcatggagttgcggttgacaattcgacatcagaagttttccctacaataactactgattcttctgtaagatggcctggttcagttgttcaaggtggtcccaattatcttacaccacaaagtaataaaggaaggactctgtctcagcctctttctcgcacaccatacaatagctcagttattcgaagatatattaagaacagcaggcatggtgatatacacaataatggacagacacaatttcccactccattttctattggaagtaagagaatactagaggataaacaggtagcaagtggtggtatagcgcagccatcatcttccaggggacagatagatgtttttggttctattccaagagaaggttcgactgcaataaacaatgttgcattcaacctgcaagagtcagatggtaaaagcatgacagaaagcagaacaacttttggacgtgcttcaggtgtagacaatatctcaagggttgcttcagtatctgttcatcccaagtcaagcgaaacagcattcaaaatacttaagcaacttgacagaactattccttcccctacatcaaagccactagggctgagacagacattagccaagaaaaatactttttctgttgctaccaacagacagattaaagagcctgatatcattatcggtaatgataataaacagagcagcattaatgagagtggtagtgctagctcggagactacatatggaaaaaaggttcagcaacctcaaagcagtcctatttcaggagagtcaagtgaaaaagtccagagaagcggagctaactcagatgtttatgaagcaggcacttctcagcgtcctctgaaatcaaatctaacacccacttcagtcgccgaggtcttggataataaaaacaccagcaaaggtttcagcttcacatttcctattcctaaagctccaagctctctacttgaaccgcctcctacaccaaccatggcctcgccaccaaggaccttgccaatcactaacgaggatgttcccaagttcacctttggctcatccagcacggccaacaaactcgttttctccttcaactccacaagcagttctcctgttgctggtggaacagacccaaccttcaaatttggatctgataataagcgagagcttgtgttttgatacagttggcaaagatgcagttttttttttgatagacaccatgcccgcggatctgaaccgtaccactctatctattcttggtgtgttgatgaaagacgtcttaagagagttggagtgtgctacttgagctacacaacatgacattcttttcattcattagcatattcaaacattacatgagaaaaag

SEQ ID NO: 16271 - DNA, 4115 bp, Zea mays
  misc_feature (2535)..(2535): n is a, c, g, or t
  misc_feature (2899)..(2899): n is a, c, g, or t
  misc_feature (3132)..(3132): n is a, c, g, or t
catttatgtatacacaaagcagtgcatgttagatccttgtgtagaaaccaatcacctctaccaactgttgttttttaatagaagtaaagacaaatttgatgtattttactgtcgtcatgatacacacatgtctctttgcttcatgaaaaataagaaactctggacagatttaagcccacatatttgcattatatgttggaactatttgtgcaagttcgtaatagctaatcaaaatttattctgccttgtatgtgattcagtgatattgttctccattcggatggttgtaaaacctgattgtgttcgactataagtaattcctgcaattagtgcacagcatcccaaaaacttcgaataatgaccgacaactagaaatcagttataacttcgtttgctatgtttagaccttaaatgccatcacatttggagggggggggggattattgtacagatgtatggccatctgttccttttcatctaataatattcttctttggtttatagagaatactagaggataaacaggtagcaagtggtggtatagcgcagccatcatcttccaggggacagatagatgtttttggttctattccaagagaaggttcgactgcaataaacaatgttgcattcaacctgcaagagtcagatggtaaaagcatgacagaaagcagaacaacttttggacgtgcttcaggtgtagacaatatctcaagggttgcttcagtatctgttcatcccaagtcaagcgaaacagcattcaaaatacttaagcaacttgacagaactattccttcccctacatcaaagccactagggctgagacagacattagccaagaaaaatactttttctgttgctacctacagacagattaaagagcctgatatcattatcggtaatgataataaacagagcagcattaatgagagtggtagtgctagctcggagactacatatggaaaaaaggtatactcccatttgcattatctagcacaatctactgtactactgtttactaattgtacatgttatatgaatcatgtttggacataaaatcaattgctactggattactgaaaatttgctatatgcacttttagttgttgcgttgcaatgcagaacaatgtttttttcctgaccacttattttagtttgttctctactgctattttcagtcgaccaccaatgcagattagatcagttaatcaatttagcagattcctaacagcgttaaactatagatacaccactaatcggttgctcgtgttccaccttgtgtaggttcagcaacctcaaagcagtcctatttcaggagagtcaagtgaaaaagtccagagaagcggagctaactcagatgtttatgaagcaggcacttctcagcgtcctctgaaatcaaatctaacacccacttcagtcgccgaggtcttggataataacaacaccagcaaaggtttcagcttcacatttcctattcctaaagctccaagctctctacttgaaccgcctcctacaccaaccatggcctcgccaccaaggaccttgccaatcactaacgaggatgttcccaagttcacctttggctcatccagcacggccaacaaactcgttttctccttcaactctacaagcagttctcctggtgctggtggaacagacccaaccttcaaatttggatctgataataagcgagagcttgtgttttgatacagttttttttttgatagacaccatgcccgcggatctgaactgtaccactctatctattcttggtgtaagacgtcttaagagagttggagtgtgctacttgagctacacaacatgacattcttttcattcattagcatattcaaacattacatattttagacgtcctgcgttggcaggacatttcccccagtgctttgcacccgtggctgtgtcattgggcatcagttcgtttagcctattatttggaagcttttcatagctgaatggagttccattgccctttcggtccaaggtatgtgatatgtcaatgtcactgctgatataatccgttgaaaagcgctgctttcttggcaaagcgcgtttgaaaccgcgcatttttttttggcgcatgaatgcaccggcccgttttctgataacaaaaggcacgaggatgacctggttgctaaaagacgggagtcgagtccgagtcatgagaacgacgggtggatgcagaaacagttgcctgattgcatcgcatacacaggctggagtcgcctggagtgttgtcgccactgaaccgaaaggagataatggtgtcatacaccgatacacgtaacccggtacgtgtggatatctggatgatacttcacatcaatcttcgctgctgtggtagacagttgtttttccccccgtaaaaatagattctttaatggaacacgggaaaaataaatattccttttcgtattccgttatccaaagaatatatgtttccagattttaaatttaaagaatatttgttggggatacaagatactccctcgggtttttttatatttaacgttggttaangtaaaattgaagcgtcaaacgaaaaaaaattgaaaaaaatggaggtagtaattttcaacttctattttaaactccaccatctaaagtgcaaaaatgcaaacaatattttgcaccatcatattcgcaacgcgtctcgtcgaatgcaaacaatattttgcaccatcatattcgcaacgcgtctcgtcgtcggttgttgggagacctgaagaatcggtaagggcttgtttgggagtaagggtaatagaggggattggaggggttagaatctcccactattcaattttaaatagtgggggattatagcctcctcaatccccttcatttcacttgctctcaaacgagccctaaagaatctagcccgtcngtcggtccgtgcattattctcttattccctgcactgcgggtactgtaactgagcattgaaggaagcgtcagatcgtccgattagctacgttccacctactattactaaaataatcactcgtccaggactgggccaagcaggcttaagctagagcgtcggtgcaggctcttctgcatcgtgcaggccagtaccagtactagctaggaacgtgtcctgactggcatcactcgaanacacaaacggggaagccggagaccagctcggcccggccggtgggtcagcagtcattcactaatgacgcgttgctatcgcgcaacgatgccctgtatctctccccgtagctgcagaggatccagcgtcgctctctccgccgcgggccccgcttgacgggcacgagattccggtgtacccatgcaacgcagcgcaggccatggatcagagactcatcaggcgcgagcattgtggggggtggggccgtggggggaccaggcccgcgatcctgtgacgccaccgcagtcgcggctgggccctccgctggagaaagctccgcgcgatgccatgccatgcggtcgccgtcacgcaactggccaactagggtttcgcaactgctggccgaccagtcgaccacccgccctctcctggccgggacgtcgtcgacgacgacgacgacgacgtgacggcttaccaggcttttccgtcctaacgcctacggttaggactttttctcggctacgttacaaaaaaaactttcttttgtttatacctttttgttttgcaaacgtcttttgagggcttctttgcaaaattaggctcgtagttccctttctggaggagtatatatttacaggctttcgtcagtcggtcaatggcgaggtcttcgatcggatgccagtggcaaagcagcagcatctgggaaaaagaactttgtggtagtgagtgccatgtcatctgtgtgatgaccactcttaaaagcaccacatcaccctggcatggcaagcttttgggcacctaatgactattatacattgcactgtcagcactaaggcaaacgtatataaaaaatggcgatgtttgagcatattcaacaacaaaccctaaaatagtcctaacattcataatgtttaggatctcaaaaaaatatttactccaacagtcgtgccttaaataatgctatttagaaaataaatcatgttattagaaaataaatggttagaaa

SEQ ID NO: 16272 - DNA, 2416 bp, Zea mays
tgggtattgttgtaagctgttggaacgcataggcaactgactagtatggtatgtatggacgagctcagctatatcgttaaacttgctcttacaagctaaaagtttcagcgaaacaaatatgcactgagctatagctccaaagtaaagcaatggaggtatcctaaaaagaccaagaaaaaaacaataatatgcgaaagattacacaggaggaaaaagaaatcgtagcaccggtaaacgtggtggaggtgggggattcttcggcgcggtgcgcatcacaaaaacgcgttcgccaagaaatattttttaccgggcgaggccgatggagcctatccgttctgtcgagaggagatttggatttggtccaaagaggacctcgccgtcgtctttaatttcctcacccgatttgggccctcgcgctcgcgcaccaccaccacctactgtgtctcctctcctccctccccgtctccctccgctgcccctgcaccgcctgccgggaagagaccgcaccagccaccagcgcctccgcgagttcgacccccaatccccacagcttcccgcaccaacaaatccgcccaatttgcgggccactcccggcggaaattcgtgacaaagccgcggggggttttttttttttcccttttttctttcgctcccccgcccccgttttcccttttgactccgccgccgggtctgctcctttattgctgcgcctgcctgattgtcttttctcgtcggaacgcgcggtatcccgagggcggcgatcgcggattcgcctccggaagcggcgatttggtccccagtacagtccgccatgattccccaattttgctccatgcggtgcggcgttcgatttgttcaggtggcgaagggatgatggatttggggagatttctctagctagcgtggttctgatcggggacctgtttgtgggcgtattacagtacagtccgccatgattaagcaaatcctcggccggcttcccaagaagccgaccaaggccggcgagaaggagctggccggcgcgggcccgtcgctgcccagcccgacgtccgacgcgagaaccaccaccgatctgaccgcgtctagcaggcttgtcagccccagcaactacgcctccgcggcaacaaatccaggccagagctacgcgcccagggccgccgggctcggcgccggcgccagcaacgggttcccgcgcgcgccggccgggtacgaggcgctgccgagcttcagggacgtgccggcgtccgagaagccgggcctgctcctcgggaagctggccatgtgctgcgtggtgttcgacttcgcggacccgaccaaggacgtgcgggagaaggaggtcaagaggcagacgctgctcgagctggtggactacatcacctccgccaccagcaagttcccggagcccgtcgtgcaggaggtcgtcaggatggtgtctgtgaatctgttcagggtgcccacccctgccccgagagagaacaaggcgctcgagtcgttcgacatggaggaggaggagcccgtcatggaccccgcgtggtcgcacttgcagatcgtgtatgagctgttcttgaggttcattcagtctcccgagacagacgcgaagctggccaagagatacattgaccacggattcattatcaggcttcttgatctctttgactcggaggatcctagggagagggagtacctgaagacgatccttcacaggatatacggcaagttcatggtgcatcgccccttcatcaggaaggcgatcaacaatatcttctaccggtttatattcgagacggagaagcataatggtatcgcagagctgttagagattctggggagtataattaatggctttgctttgccgctcaaggaagagcacaaattgtttctagtccgagcgctgattccgctccacaaaccaaaatgtgttgccatgtaccatcagcaactgtcctactgcgtcactcagtttgttgagaaagattgcaagcttgctgatactgtcataaggggggtactccagtattggcccatcacaaatagctcaaaggaggtgatgtttttgggtgagttagaggaggtgctggaagctacacagccagcagagtttcagaggtgtatggtgccacttttccgtcagattgcccgctgtttaagcagttctcactttcaggtaagaagggatagcagtgctcactaaagttctcatcttcaaattatcattgatttctggcttattgcttgggacatgactctatcatttattcatttataagggcaagtcaactaagatgtagcaaacgataagtgtaaagtgcatatactattccgttgatgttaatacataagtagtcggattgaccattctaggctgccacttccacatgatggaatattagtactgtgggaacttcgtccggtgccc

SEQ ID NO: 16273 - DNA, 2190 bp, Zea mays
  misc_feature (11)..(11): n is a, c, g, or t
  misc_feature (1313)..(1313): n is a, c, g, or t
  misc_feature (1338)..(1338): n is a, c, g, or t
  misc_feature (1781)..(1781): n is a, c, g, or t
  misc_feature (1857)..(1857): n is a, c, g, or t
ggtaccctccnggtttggccgggtatattcgagcacggaaagcatagtggtatcgctttgctgttcgcgtccccccgcggccgacttaatggctttgctttgccgctcaaggaagagcacaaattgtttctagtccgagcgctgattccactccacaaaccaaaatgtgttgccatgtaccatcagcaactgtcgtactgcgtcactcagtttgttgagaaagattgcaagcttgctgatactgtcataaggggtttactcaagtattggcccatcacaaatagctcaaaggaggtgatgtttttgggtgagttagaggaggtgctggaagctacacagccagcagagtttcagaggtgtatggtgccacttttccgtcagattgcccgctgtttaagcagttctcactttcaggtggcagagagggctctctttctatggaacaacgaccatatcgagggtttgatcaaacagaacaacaaggttatactgcccataatcttcccagcgttagaacgaaacacgaaaggccactggaaccaggccgttcaaagcttgagtctaaatgtccggaaaatattcatggaccatgatcccgcgctgtttgaggagtgtcacaagaagtttgaggaagaggaagcccaagaagctggcgtaaggtcaagacgggaggctagatggaggcgcctagaagaaatcgcctcgtcaaagtctcctcagtgaagtagcgcgtcctcctgaggctgtagttcttcatcagtagagttcttctagctatcttgtcttggggacttgcatattagcagctcttttggacaggatcaagtaaatgctgatgatgtagttgctggatgtcttcttgccgcctgttacttgtgaccgaacgttctacaggccgacatgtaaatacgaggcacatgatgggctgtgaagcttcaacagagcctcggcgggttctctttgccgtgtgatccactgatgacagtgtcggtttcatcatcataggacaaaggaaaggaggtaaaatggtctttttccgggtcaatgtcttgatccaaggactgttaggagcacttgaaagacgaggaaggaggcaggtagcacttgctcttgctgatggtgattttgctgaaatgtaatactatgctttatgtatgatgcatggtaacttgaagccatgtctggtgataatatgtaatcctggtgtacatgtcttttccttcctttgatgtatacagaaatttggaatgaagccctgattgaaggctgttttctacaaaaaaaaaaaaaaaaatgcgggctgtctttttttnaaatcaggtgtttagggtcaccggnagggaggggctcctgaataggtgcaagatcagggatgcgtacgccaagtttggtgtcatgaaccgaatgtaatgttgagcttgcatcatggtggggggtttcgtttgggataactgtaatgctgcctaaaaatacaaataagagtgatatatttgtaaactgcagtgttgcccaaaaacgcaaataaaaatgtgaatatatttgcaatgatacgtttcaattggtatatacgttttgttaccgtaatttttacccattattatgctcatctctttgaactacgcaaccactaccgtgtaccagctattttctgagcaagctgaagcattcgggggcactcaagcagagttagccggtgatcaggttcagcacaattctggatctgccaacggaaagagcctattatgcctccctaaactatatttgtagtctcattttccttnactctaaaaccagatatcttaccactcgatactcttgaaaccattcaaattatctctctggtttggggtggttttnaatttggttttgtacttttttgtcaaaaaacagtaaatagttgataaaaggtttttaaaccatagaaaatgtctctacactttaaaaaaaatctaaaaacatgaagatagattctgatactccaaacccaaataaaatatttaggccccatgaaaatacatttatctgctttagataagtagttttatctctagaaaaataaaaacaatccaacaaaatacaaaaaaacattctaatcggcgtataaatatgttttaaaaatgatgtggcatataaacatgttttcaaatacaaataaaatattatgttttcatttgtagttctcgtatactc

SEQ ID NO: 16274 - DNA, 1324 bp, Zea mays
gccacgcgtccgaccacgcgtccgtccacgcgtccggccacgcgtgcgcgcacgcgttcggggacgcgtgggcgcacttcttacatttggagagccataatgcatttgggctttcagacagtgaagaatcacaggaacctaccaagcgacgcaatagactgggttcagcaggccttgcaccgcattacgccaatatcatcagtcagatcgatactcttggttctcgttcaagctctgttccttcaaatacaagggatacattataccaaagtttgccaccaaccataaagtcatctctccgttctaagctacactcctttggagtcaacgaagagccttctgtttcccgtatctcggctgaaatggagaagaccccccgccgggttgtccctattgcaagtaacaccaccaaggctcatcatggtttcggttgggttggagagtgggcaagtaccggatgtgaactgcaagccaactgggcagctggacctgacccgaattgagacactgtaccatgctgacaaggacaagactgaagcatatatcctcgagcttgttattaggcttcatcatcttatcagtcaaactaaaactgctaatggtgagaggtctccaatcaagtctcctgtccagtctcctacacaaagaggggcctcaatcacattgtctccaaacataaaaaacagcaattcatcacctcttctgacgcaagaagaccaagacatgctaagtgatgtcaagtacaggacatttatccctggtataagcaaaagccaagagttttacactaaggaaatacatcataatcaaagcaggttaagcaaaagtaacagccattcaccaagcagtggcaaccggaaagaggcgctatcgatcaggaggctgcttcctgtgatcgactttgagatcgaccggacaaaagcccttgatgtgattgatagagttgacgatctgagagtacaatgatgaacctagattaaccaatgccaaagtctgaaaaatgcaccctcagtctatgatccacaaaatcaagattgcttgaaggataccagtaatcgctgagctaaattggcatgctgtcagagtggagagtcagtattgcagcaaggtgcctgcttgagataaccggcatcatggtgccagtttgatggcaccgttagggttagggatggtggccatgggcgcatgtcctggccaactttgtatgatatatggcagggtgaataggaaagtaaatttgtattgtaaaaagggatttcttctgtttgttaaagggatttcttctgtttgttagctcatgtccaaggaatgcaagttttgagcg

SEQ ID NO: 16275 - DNA, 1194 bp, Zea mays
  misc_feature (17)..(18): n is a, c, g, or t
  misc_feature (29)..(29): n is a, c, g, or t
  misc_feature (31)..(31): n is a, c, g, or t
gccggccgggttccgannagcatacccgngnagctcgctctctctcccacctccccctccctccccttttgaccctccctcccagctgcaaaaccgcgggccgcatcccgcccgcgccgcccaccggcggccacagccgcctacataaaccactattcgaccactcgccgaaccaagccacccacccaccacccaaagggggaggccgccaagaacggggccgccgccgcggatggccacaagcctggcccggtgccattcttcgccgcggggattagttcggtgcttcaccccaagaacccatttgctccaacattgcattttaactaccgttactttgagacggatgcaccaaaagatgcacctggtgcaccaagacaatggtggttcggcggtggtactgacttgactccttcatacatcattgaagaggacgtgaagcatttccattctgttcaaaagcaagcatgtgataaatttgatccaagttttcacccaagattcaaaaaatggtgtgatgattatttctatattaagcaccgtaatgagcggcgtgggctaggtggaatattttttgatgaccttaatgattacgatcaagaaatgcttctcaactttgctacagaatgtgcggactctgtacttcctgcgtacataccgatcatagaacggcggaagaacactccgttcaatgaggagcacagggcatggcagcaattgcggagaggtcgttatgtggagttcaaccttgtctacgaccgtggtaccacatttggcctaaagactggaggaaggattgagagcatacttgtgtcccttccgcttacagcacgatggcagtatgatcataaaccggaagaaggaaccgaggaatggaaacttctggaagcctgcataaacccgaaggattggatctgattagccgtcattcttgagatcttttgttagagttttcccttctgtagggctaagaccacgtgcagtttcattatttctttttgcatctgtagaatcgtgaataaatatgatgtagtaatgctgtagctgtttgtatctatctgctgttttttccccatgtgaatgagtgaaccattggcttctgtatttacgaaggattcaggtttctaaaaactatcatttcgctactactaaaaaaaaaaaaaaaaaaaaaaactcgagagaggggcctggtac

SEQ ID NO: 16276 - DNA, 759 bp, Zea mays
gcggggggcttggtggaatattttttgatgaccttaatgattacgatcaagaaatgcttctcaacttcgctacaggtgaaaccatttgctagagtgattggatggaattatttgtattcagaatgtgcggactctgtacttcctgcctacataccgatcatagaacggcggaaggacaccccattcaatgaggaacacaaggaatggcagcagttgaggagaggtcgttatgtggagttcaaccttgtctacgaccgcggtacaacattcggcctaaagactggaggaagaattgagagcatactcgtgtcccttccactcacagcacggtggcggtatgatcataaaccggaagaagggactgaagaatggaaacttctggaggcgtgcataaatccgaaggattggatctgattagccgaagtttctttattcttgagatcttttgttaattttcccttgtgtagcgctaagatatcagttcacgtgtagtttctttatttcttttgtatatctgtaggatcgtgaataaatctgatataattctgcagctgtttgtatctaatctgctgcttttcccccatgtgaatgagagaatcattgccttgtgtatctacaaaggctacagtttgtccagtttgttgccggcctgtcgcttgaaattcgtagttacagtgtgagcggagtttggacaggccgtctctatattcttgtgtgaaaagtaactggaatagatacattgggctgatttgggattgt

SEQ ID NO: 16277 - DNA, 1293 bp, Zea mays
cctacgataaccaaagtgattttgtctctacagaatgtgcggactctgtacttcctgcctacataccgatcatagaacggcggaaggacaccccattcaatgaggagcacaaggaatggcagcagttgaggagaggtcgttatgtggagttcaaccttgtaagcggttttaggcgactacagccagtgtcttgcttggatgcctatcttctggctttaacatgctcgtcctttgaaggtctacgaccggggtacaacattcggcctaaagactggaggaagaatcgagagcatactcgtgtcccttccactcacagcacggtggcagtatgatcatgtaagctataatactgtttgcactcggtacacatcaccatgtcttagtttctccaccagagaatgctcaataattcttggaaaaaagcaaaatgctgctgtgggcctgtggggggagggggaagaaggtcatgtatttgctgatgatgatcatgtatttgctgtgcatcctttgacttgggcaactttagctcaacactagcatggaacttcatttgcagaaaccggaagaagggactgaagaatggaaacttctggacgcgtgcataaatccgaaggattggatctgattagccgaagtttctttattcttgagatcttttgttagttttcccttgtgtagcgctaagatatcagatcacgtgtagtttctttatttcttttgtatatctgtaggatcgtgaataaatctgatataattctgcagctgtttgtatatatctgctgcttccccccctcccccccccccccatgtgaatgagagaatcattgccttgtgtatctacaaaggcttcaggtgtatcatttacctcctgcctattggaaatactcactgatgcaggcaggtctgtatatacccatagtgcttgatgttgtgcatcaacagcaacaaatagtttaaattgtttagggccacaaaacatttacagtttcaacaattgagccttatcatattattaggaaataaatcatgttatttaggatataaaaggttatgaatagttacaaattgaggatatggcttcagtatatgagatactatatttaggacttgagagactgagctctataatcatttgatgaatttttgtaaaatagggtcactgtttggagcatgtttttagtgttagagtcttatattttaaactaggaccatatttagggctcttatggagatgatctaagagaccttaatgcattttgtgagtttagagattgagataataccaaagttcag

SEQ ID NO: 16278 - DNA, 1764 bp, Zea mays
cattgggtacctcgaggccggccgggatccctttcgcagaatctgaaaatcgcgagagcgccgaacccgaacaaacatgatccgtttccttatccccttggtgcggcgcgcgggcagcatagcataacccgggagctcgctctcgctcccacctccccctccctccccttttgaccctccctcaccagctgcaaaaccgcgggccgcatcccgcccgcgccgcccaccggcggccacagccgcctacataaaccactaatcgaccactcgccgaaccaaaccacccacccacccaaacccaatggcgtccaacctcctctccgccccgtcccgaaccctagctccgtcgccggcgccggcccccgcgggcctccgcgggcgtgtgccggtgcaggcgcacctcccgcgcggcggcctcggcctcgccccccgccgcagcagccgcgcgctccgcgtgcgcgcgtcggtggcgatcgagaaggagacgccggagagcgagccgcccccgacgttcctccgcgaggacgggcacgggtccgggtccgtgcgggcgcggttcgaggccatgatccggcgggtgcagggggaggtctgcgccgcgctcgaggaggccgacggcggcggcgcgcgcttcgtcgaggacgtctggtcgcgccccggcgggggcggtggcatcagccgcgtcctgcaggacggccgcgtcttcgagaaggccggggtcaacgtctccgtcgtctacggggtcatgccgcccgacgcctaccgcgccgccaaggcggaggccgccaagaacggggccgccgccgcggatggccacaagcctggccccgtgccattcttcgccgcggggattagttcggtgcttcaccccaagaacccatttgctccaacattgcattttaactaccgttactttgagacggatgcaccaaaagatgcacctggtgcaccaagacaatggtggttcggcggtggtactgacttgactccttcatacatcattgaagaggacgtgaagcatttccattctgttcaaaagcaagcatgtgataaatttgatccaagttttcacccaagattcaaaaaatggtgtgatgattatttctatattaagcaccgtaatgagcggcgtgggctaggtggaatattttttgatgaccttaatgattacgatcaagaaatgcttctcaactttgctacagaatgtgcggactctgtacttcctgcgtacataccgatcatagaacggaggaagaacactccgttcaacgaggagcacagggcatggcagcaattgcggagaggtcgttatgtggagttcaaccttgtctacgaccgtggtacaacatttggcctaaagactggaggaaggattgagagcatacttgtgtcccttccacttacagcacgatggcagtatgatcataaaccggaagaaggaaccgaggaatggaaacttctggaagcctgcataaacccgaaggattggatctgattagccgttattcttgagatcttttgttagagttttcccttctgtagggctaagaccacgtgcagtttcattatatattttgcatctgtagaatcgtgaataaatatgatgtagtgatgttgtagctgtttgtatctatctgctgtttttcccccatgtgaatgagagaaccattggcttctgtatttacgaaggattcaggtttctgaacactatcatttgctactactatgggcggccctcaccgatgcagccccataggtctgtct

SEQ ID NO: 16279 - DNA, 902 bp, Zea mays
gaacaatggtaataaccaaacaaggccttatttagaacggagggaatatgtacaattacttgactcaaagcaccttgtgcggctgaaaaatccaggcatgttttttacgttactcgaaccgttttatttttcgtacgtacaacgtttactcccattcttttttccccctctaaacccaaaattcataccctatattagaagggaaaagggcatgttgagatgggttaagatagcacaattatcaaaaaagaattgtaaggaaaatcgaatgcagccgagcctattaaagtatcttcttgatgactccccatcttaaaccataatcgagtggacagtgagttatcgccgacccatacactcgtattcctcccaggccccagagccagggcttcaaaaggggtcaatccattcccttcagaaattcctccgggccttggtcctccagcctttctgccgtctccaaaaccatgtccctcagatcatcctggtacttagttaccctgtcctggagctcaggatctcttgcagccagaatcctagctgccagcaaacctgcattttctgcattcccgatagcaacagtcgcaacaggaataccttttggcatttgcacaatagataggagggaatcaaatcctgatagtgttgaagtcttaatgggaactccgattacaggaagaggagtcaatgaagccaccatccctggtaaatgagctgctccgcctgcacctgcaattatgacctcgaaacccctgtctttagcagacttcgcataatcatacatccgctctggtgtacgatgtgcagaaacaatagttacctcacaaggtatgtcgaactctttcaaaaccctctcagcatctttcatcacaggaagatcagattggaccccattataatag

SEQ ID NO: 16280 - DNA, 2609 bp, Zea mays
ttgggtacctcgaggccggccgggattttatgattcaactactcagctaacttgatgaactcgttgtgtatggaaaagatagccttgataacctgcagaaccttgttgaaaataagttttgcgatattagagatgttgggaggaagccattttcatttcctggtcatccatgtacacctgaacatctccaggtccttgtcaaagcagttcccattaaacaagggcacactttgaggtccttatttccaatcactcccaatatccgttgttacaaagaaggcccttgcaagtacattagccatctgattggtcatgaaggagaaggatctcttttttacgtacttaagaagttgggatgggctatgagtttggaagctggtgaaggggattggagtcatgatttttcattcttctgcgttgttattcagctcacagatgtaggccaggaacacatggaggatactctcggactattgttcagatatataaagttgctgcagaactctggaactcctaagtggatatttgatgagcttcaagctatctgtgagacaggattccactaccgagacaagagcccccctatcaattatgttgtaaatatttcttctaacatgcagatttttccaccaaaagattggttgattgcgtcatctgtgccatcaaagttttcaccagatgctattcagaatgttttaaatgaactgactcctgagactgtaagaatattctgggaatcgaaaaagtttgaagggaaaacaaaattagcagagccatggtatggtacatcatattctgtcgaagttgtccctccatcaatcatacagaaatgggtagggaaagcccctgaggaagatctacacctgccaaagcgtaacatcttcattccaagtgatctttcactgagaagtgtagaggaaaaggtaagttttcctgccatgctgaggaagacacaattttcgagactctggtacaagcccgatacaatgtttttcacacccaaggcttatatcaagatggattttcactgtccactatctcaaagctcacctgagtcggcagttcttactgatgtattcacaaggttgcttatggattatttgaatgattatgcttatgacgcccaagttgctggcctctattatgttgttaagccaaatgacactggttttcaggtaactatggttggcttcaatgacaaaatgagaacccttttggagactgttattggaaaaattgcagaatttgaagttaaggctgaccgtttttctgtgataaaggaagctatgacaaaggagtatgagaatttcaagtttcggcagccataccaacaagtcctatattattgttcgctaatactggaggaccaaacatggccatgggatgaggaattttctgcactttctcaccttgaagctagtgatctgggaatttttttgccccatttgctatcaaaaaccttcatcgagtgttattttgcaggtaatattgaacccaatgaagcaaacaatatcgttcaacatgttgaagatgtcttattcaatgcaccaattagtgcttgcaagccactatccccatcgcagcatcttgccaagaggattgtaaagcttgagaagggtttgagatactattatccagcaatgtgctcaaatcaccaagatgaaaattctgctcttctgcactatattcagactcatcaggataatgttaagcaaaatgttctacttcaactacttgctcttgttggcaagcagccagcttttcatcaattgcgatcagttgagcaacttggctacatagcgcttcttaggcaaagaaatgattcaggtgtccgtgggttgcaatttataatccagtcaacggtgaaggatcctgctaatctggatgccagagttgaaaattttctcaacatgtttgaaagcaatgtctacaatatgtctgatgcagagttcaagagtaatgtaagtgctcttattgatatgaaactggagaaatacaaaaacatacgcgaagaatcagctttcttctatggagagatttctgaaggaaccctcaaatttgatagaaaagaagcagaggttgctgcactgagggagctcaagaaggaagagttggtaggcttcttcaatgatcatgtcaaggtcaatgcaccacaaaagaagattcttagtatacaagtgtacggtggtctccattctgccgagtacgaaaccatagtgcaaaatgctccgccaccgccgtcgtgtgagataactgatatttatggcttcaggaggtcgaggcctttatatggatcattcaggggaggcgttggtcagatgaagctatagttcaacattttctcatcattctgtaaaattctgaaaaagagtcatctttctgttcaactgcatctacgttgattgttttttcattgcgaacactctagtaggccatttatctacggttttttcactatattcattaagatattatgagatttcacattgccttgtaaagacaaatctctagccatgtttggttggtctgagatacaccatatattagactaaaaaggaaaaaaaagaaatattcggttaaaaaaaaaaaaaaaaaaaaaaaaaaaaaaa

SEQ ID NO: 16281 - DNA, 1080 bp, Zea mays
ccggtccggaattcccgggtcgacccacgcgtccgaatgactcaactattttgttgtgcctctttggcttctggaactttgctggtcgtatccttggtggatctgtctctgtgcatgccggcaggtcagggatgcctccctcgtcctttctggatgatgtgcacacaaataatcatgggggcgacgttcctgctcttcgcgactggtcttcatagcttgatttatgtttcaactactctcctggggatatgctacggggtccaatttgctgtcatgataccaacggtctcggagctttttgggctaagggacttcgggctaatgtacaacttcatgctgttagtgaatccactcggtgcattctttttctcagctcttcttgctggctacatctatgacaaggaggcagcaaggcagcacccaggtgtactggagccttccgactgctatgggcctgactgtttcagattgactttctatgtctgcgccgtcgtgtgttgctgcggtaccctgttgggcgtgttcttcatatcgaggataaagccggtctaccagatgctctacgcaagtggatcgttcagacatcctcggagccaacagcagctccactgatgttgcatatacactacagtcatatgctaagaaatagtcctattgagttttgggaatgaaatcataatgttctggagtaaatcatctgctggatgccatgttccggtgctgtatcgcattaacggtgcttgatttgcccctgtttgtatcagagttttattctgatttcatttgtccctgctctgtaaggtcgccagcctagtagatataatatagcgggtcatcaatatatactggtaaaccagctgcctatttatatggcagctcgtgtgcatcagcaagtttgaggacgtcataaagcgaatgtatcttctttattctgttgttcctatacaatgggtttcctccattgagacgctgctggcttctttattctgttacttagggatggtacccgttcgttgcaacggtacacagattaatttaggtcgagccttatgacaccggtacaattccatcggtgctgca

SEQ ID NO: 16282 - DNA, 3193 bp, Zea mays
aacaatctcaattatctacttgtacatggtggtggcagtggcaagtttcgtgtcacaagttaagcaggcggtgtgataaatgtacatatatctggttctgatgccagctgctgtatttttttcgcaagtgagcaactcttgtaacctcgacggaagaggaaaaggggtgagaagagacgacaaaggagataaggttgcaaaacggataccgacgacgagggacgggacgcggacggtggacagacgcgagacgacgcggcacggcggcggggaggtgaacgaggaatatggagaacgctgttccttggtcggaaatcgatagtctgtctagtaagggcttgttcggttatttccaatccatatggattggaggggattgatacggattggaggggattttgacttactggggattgaaaccccctcaatccccctcaatccatatggattggggtagaaccgaacaagccctaagggagctagctcgcggacaccgcaagttattgagccccggtgtccttgtcctcctatgttggcaaccaaaacggtgactgagaaccgagaaatctggtagctagctgcctagctagcggattctcgcactagcggcggtggacaggtatggtatggcgtgaagtttgttcagtggacatgaggctcccccgattctcagccgacccgctcacccacatgaagagaggagcatcgaatctcatctgatcgccgagatgtcatgtgtgtgtgtgtgtctgctagcgctgtgccagcacacgacacgaactgaaggcaggcgtgtggctagcttcgcccaatggacgcgattgaagctcggcatctgatctgatgccgtgaattaatcctgtgtccgtttaccaacttgacctgtcggtgcgagatggtgaggacaacttcagatcgcgagcacatatatgggagactgtcaatctagctagccttgagaactgtttttttttcttctctctctctctctctctctttcggtaccgatcacatccgccggccggtttccagctgtacgcagatttactccctttctttttcttttttctatttctatatgaacatgctgcgtgtacaaaacaattcatctactcgatcggatgccgctactcacttctcacatggacacatggtgtttcccgatcttcaaaggcgctgcaatgtcgaaccgaccgctgttgaagccagatcaaatccgtagctggtcgaatgtagaccgcaacaactgtcaattggcgaacaagaaggcgagaaccagatgagggcatcgcgctctagcggtgcaggcgggaccacaaactgatcgaccttgggcgccagcagcagacaccttccccaggcaaacgtgtcaacgaatcatggcaggagcaggacagaccttccgccggaactgcctcgacctggtgccacaagcacgacgacgacagcatcaccacccctggagcacaacacaattccgccacgaacagttcagcagagactgcggtagggaactccaaatgagctatagcttcagttttgtgcaggcatgtattgatcgctagagggaaggtaaaaaagaaagagaaacaggtggggtagaccggtttttggtaaacagagaagtttttggtaaaaaaaatcgatgagctcgtaaaatcttggatcgggtgaaccacgaggtcgagccaccaccatgcaggaggagccaagcatcgccgatccttctccagaagccaccaccgccgccgcctgactagcgccttcctttccagtttccaatagcaataccaaactagaagccgcatcccgcgcacggcgcaccgccacgcgtggtttcgcgagagagtgtcgaatcgcatcggtcgtccgccgggcaccaccagtaccaccgagactggttcgctattgttaggcatctctgtaatattccctcagcatcttttccccgacgccgcccggtaccgtatatatataggccgcgggtacctcgaggccggccgggggctccaccgcaaacaaggtcctgacaacccacgccacgacgacacaacaaagcacaagcaccgcagctaaacccatggccggggtcgttgtggtgttcgacttcgacaagacgatcatcgacgtcgacagcgacaactgggtcgtggacagcctcggcttcaccgagccgttcgagcgcctcctgcccaccatgccctggaacacgctcatggacaccatgatgggggagctgcacgcgcacggcaggaccctggacgacgtcgccgaggcgctccgtgcggcgcccgtcgtcgcgggcgtccccgccgccatcaaggccgcctacgcgctcggctgcgacctgcgcgtcctcagcgacgccaacgccttcttcatcgacaccgtcctggcgcaccacggcctgctgggctgcttctcccagatcaacaccaaccccagccaccccgacgccgacgccgacggccgcctccgcatcgggccctaccacgacctgcacgggtgcggcgtcggcacctgcccgcccaacatgtgcaagggccaggtgctggaccgcatcctccgcgaggcgtcgtcgtcggccgccggcaggaagcgcgtcgtgtacctgggcgacggccgcggcgactactgcccggcgctgcggctggcaagggaggacttcgtcatgccgcgcaggggcttccccgtgtgggacctcatctgcgaggaccccgcgcggctgcaggcggaggtgcacccctgggccgacggcgccgagctggaggagacgctgctgcgcctcgtcgggagggcgcgcgtggaggaggccgcactgctgccgccgctcgactgcaagctcgagtccatgcccgttgccgcgcaggagggcatgggacccatcatgccgctcggcgtcaagcactgacgatacacgcagcagtgcagtctctggtttgctggttaatgctggtttggttcgggttggacgaacgattagtaagtagctcgaataattagtataactgtatcggctaattttatgtgtttgtgtgtgtgctgtgtggtgtatgcctccgcatcgagctgcctgtcactgctgaattggctctgcctcgctgtgtatcttattcttacctacagaaagagtaccacgagcaaattaaaaaaaaaaaaaaaaaaacgaaaaaggggaaaacaaaaaaaaaaa

SEQ ID NO: 16283 - DNA, 1206 bp, Zea mays
cattgggtacctcgaggccgggatccaccgcaaacaagctcctgacaacccacgccacgacgacacaacaaagcaccgcagctactaaacccatggccggggtcgtggtggtgttcgacttcgacaagacgatcatcgacgtcgacagcgacaactgggtcgtggacagcctcggcttcaccgagccgttcgagcgcctcctgcccaccatgccctggaacacgctcatggacaccatgatgggggagctgcacgcgcacggcaggacgctggacgacgtcgccgaggcgctccgtgcggcgcccgtcgtcgcgggcgtccccgccgccatcaaggccgcctacgcgctcggctgcgacctgcgcgtcctcagcgacgccaacgccttcttcatcgacaccgtcctggcgcaccacggcctgctgggctgcttctcccagatcaacaccaaccccagccaccccgacgccgacgccgacggccgcctccgcatcgggccctaccacgacctgcacgggtgcggcgtcggcacctgcccgcccaacatgtgcaagggccaggtgctggaccgcatcctccgcgaggcgtcgtcgtcggccgccggcaggaagcgcgtcgtgtacctgggcgacggccgcggcgactactgcccggcgctgcggctggcaagggaggacttcgtcatgccgcgcaggggcttccccgtgtgggacctcatctgcgaggaccccgcgcggctgcaggcggaggtgcacccctgggccgacggcgccgagctggaggagacgctgctgcgcctcgtcgggagggcgcgcgtggaggaggccgcactgctgccgccgctcgactgcaagctcgagtccatgcccgttgccgcgcaggagggcatgggacccatcatgccgctcggcgtcaagcactgacgatacacgcagcagtgcagtctctggtttgctggttaatgctggtttggttcgggttggacgaacgattagtaagtagctcgaataattagtataactgtatcggctaattttatgtgtttgtgtgtgtgctgtgtggtgtatgcctccgcatcgagctgcctgtcactgctgaattggctctgcctcgctgtgtatcttattcttacctacagaaagagtaccacgagcaaataaaaaaaaaaaaaaaaaaaaaaaaaaaaggggaaaccaaaaaaaaaaa

SEQ ID NO: 16284 - DNA, 853 bp, Zea mays
  misc_feature (748)..(748): n is a, c, g, or t
gggtacctcgaggccggccgggaagcagccattgtactcatcacctccttcccacgcagcgagaggatgacaccacgaggcaaataaacccagacgtagttcagctagccgcttctacctccctctccccccccgcctgcgcgctgccgcgagagctcgttcctgatggggaactgcgccggcgtggaggggaacgccgagatcaacccttccttcagtgcccccaattcctcagggaccgccggttctaagagcgtcagcaagaacgcggccgacaccagcaccttcggcaccaagacgtccggctcgtcgtcgtcggtgccgccaacccctcgtacggaggcggagatcctggagtcgtcgaatgtccgcaagttcagcttcggcgagctcaaaggctccacgaggaacttcaggccggacagcctgctcggggaggggggcttcgggtccgtgttcaaggggtggatggatgagcgcacgctcgcgcccgtcaggccgggcgccgggatcatcgtcgccgtcaagaagctcaagctcgacagcttccaagggcaccgggaatggctggcggaggtcaattacctggggcagttatcccaccctaatctcgtgaaactcatcggctactgcttggaggacgagcagcggcttcttgtgtacgagtatatgccgagagggagcctggagcatcatcctcttcaggaggggctcaacttccgccgctccatggacttacgcatgaggntgctctcagggtgccagagttcttgctttcctgcacggcgaccaggccaaagtatctaccgcgatttcagacctccatatcttcctcgactcggagtacacgcaa

SEQ ID NO: 16285 - DNA, 646 bp, Zea mays
ggggacacaaggatacgctgcccctgaatatcttgcgacaggccatttgacagcgaagagcgatgtgtacagctacggtgtggttcttctggagctgctgtctgggcagcgcgctctggacaagaaccgcccgcccggtcagcacaatctggtggtgtgggctagaccttacatcaccaacaagaggagggtcattcatgtcctggactcacggctgggttcccagtattcccttcccgcggctcagaaggtggcaaccctggcgctgcaatgcttatcgatggacgcacgatgcaggcctgccatggatcaggttgtgactgcattagaacaacttcaaaggccaagggctcactgaaaaagatgtccatctacctctgtggagtctggagcgtcctgctgtaatactttaggggagtaaaaaacagagaacggatgagggtttgagggctaagtggcttgtgaagagaatataatattgccttgctttgtgtacagctagttgcttcgtcgttgtaacttgggtctctacttatatattttatgtaccagcggttcaaagggtaagttcttttgttacagtttgctcggttcttgagattgtaaaaaatgcttcttaaaagaccgccgctgcaaattgcttgcc

SEQ ID NO: 16286 - DNA, 2025 bp, Zea mays
ttgggtacctcgaggccggccgggaccacccgcccgcctccctcccccccccgccctccctcgcaggcaggcaggcagccagagccagagccagccgggcaagcactgcagcagccattgtactcatcacctccttcccacgcagcgagcgagaggatgacaccacgaggcaaataaacccagacgtagttcagctagccgcttctacctccctctccccccccgcctgcgcgctgccgcgagagctcgttcctgatggggaactgcgccggcgtggaggggaacgccgagatcaacccttccttcagtgcccccaattcctcagggaccgccggttctaagagcgtcagcaagaacgcggccgacaccggcaccttcggcaccaagacgtccggctcgtcgtcgtcggtgccgccaacccctcgtacggaggcggagatcctggagtcgtcgaatgtccgcaagttcagcttcggcgagctcaaaggctccacgaggaacttcaggccggacagcctgctcggggaggggggcttcgggtccgtgttcaaggggtggatggatgagcgcacgctcgcgcccgtcaggccgggcgccgggatcatcgtcgccgtcaagaagctcaagctcgacagcttccaagggcaccgggaatggctggcggaggtcaattacctggggcagttatcccaccctaatctcgtgaaactcatcggctactgcttggaggacgagcagcggcttcttgtgtacgagtatatgccgagagggagcctggagcatcatctcttcaggaggggctcgaacttccagccgctcccatggaacttacgcatgaaggttgctctcgaggctgccagaggtcttgctttcctgcacggcgaccaggccaaagttatctaccgcgatttcaagacctccaatatccttctcgactcggagtacaacgcaaaactgtctgatttcggtttggcaaaggacggtccaagcggtgataagagccatgtttctactagggtcatggggacacaaggatacgctgcccctgaatatcttgcgacaggccatttgacagcgaagagcgatgtgtacagctacggtgtggttcttctggagctgctgtctgggcagcgcgctctggacaagaaccgcccgcccggtcagcacaatctggtggagtgggctagaccttacatcaccaacaagaggagggtcattcatgtcctggactcacggctgggttcccagtattcccttcccgcggctcagaaggtggcaacactggcgctgcaatgcttatcgatggacgcacgatgcaggcctggcatggatcaggttgtgactgcattagaacaacttcaaaggccaagggctcactgaaaaagatgtccatctacatctgtggagtctggagcatcctcctgtaatactttaggggagtaaaaaaacagagaacggacgagggtttgaagggctaagtggcttgtgaagagaatataatattgccttgctttgtgtacagctagttgcttcgtcgttgtaacttgggtctctacttatatattttattagtcttcgatgtaaaaaaaaaaaaaaaaaaaagaaccttcggcccgcggccccgcaagattccagtttgaatgttcttgagagtgtaagaaatgcttcttaaaagaccgccgctgcaaattgcttgccaattaaattatgcacatgccaattaccaaagcatactatgatgataaaattaacagcatatgcaaacttgatgtttataaatggcgctgtttgcacatccagttttacaggtttttcattgattaaacagttgtgccaaacggcagaacaagtgggatatgcttccttttattggcattttcaaagcaaatgtttcacaatcacatgtaatggcaatcagtgtcatttgaccatctctctgatgctcgaagctatagaagatgaaatgttattgctttcgagatcatattacatgaatgcagagaaaacggaaaagtcagtggtctc

SEQ ID NO: 16287 - DNA, 1741 bp, Zea mays
cattgggaccctcgtcctttttttccctactgtgccgcgcgccctcccttctctctaatgatagcatagggagagaaggcatactccgaggcatccttctcctttccctctccttccccaaacccttttcctctttccctcgccccaagaacttcatctcatctccaggcgccccttttgcgcttgcgcaggaggagctcacggggacagtgggcggagagctcgatcgctgcaccactacttcactggaggtccgcccactcccatggaggagatcacccaacactttggagttggcgcaagcagccacggccatggccacggccagcaccaccatcatcaccaccaccaccacccgtgggcatcctccctcagcgccgtcgtagcgccgctgccgccgcaaccgccaagcgcaggcctgccgctgaccctgaacacggtggcggccactgggaacagcggcggtagcggcaacccggtgctgcagcttgccaacggtggcggcctcctcgacgcatgcgtcaaggcgaaggagccctcgtcgtcgtctccctacgcaggcgacgtcgaggccatcaaggccaagatcatctcgcacccacactactactcgctcctcactgcctacctcgagtgcaacaaggtgggggcaccaccggaggtgtcggcgaggctgacggagatagcgcaggaggtggaggcgcggcagcgcacggcgctcggcggcctggccgctgcgacggagccggagctggaccagttcatggaggcgtaccacgagatgctggtgaagttcagggaggagctgacgaggccgctgcaggaggcgatggagttcatgcgaagggtggagtcgcagctgaactcgctttccatctccggaaggtcgctgcgcaacatcctttcatctggctcttctgaggaggatcaagaaggtagcggaggagagaccgagctccctgaagttgatgcacatggtgtggaccaagagctgaagcaccatctcctgaagaaatacagtggctatctaagctcgctcaagcaagaactgtcaaagaagaagaagaaagggaagctccccaaggaggctcgccagcagctccttagctggtgggatcagcactacaaatggccttacccctcagagactcagaaggtggcactggctgagtctaccgggcttgacctgaagcagatcaacaactggttcatcaaccagcggaagcggcactggaagccatccgaggagatgcaccacctgatgatggacgggtaccacaccaccaatgccttctacatggacggccacttcatcaacgacggcgggctgtaccggctcggctagccaccggtatctcgcttccatttcacaccccacggcctagctataaagactaatggttccaggtgtctgaagtactgaagacaggggggctagctatctaatgtttgtgccgcacgcatgagctgtaaggaggccatgcttaattattctgttgccgttgctactctatctatatgcgcctatgcctccgtgcatgaactatgctttaggtggttgctgctccacactgtggtggtgtgcttttgcttttgtgtggtcgtattgtatgcgtaacctgacagatggatccctgattgctacatgtttgaataatttgcatgatctagctagtttctgcctaaaaaaaaaaaaaaaaaaaaatcaagactcttaaagaaaaaagaaaaaaaaaaactc

SEQ ID NO: 16288 - DNA, 1612 bp, Zea mays
gctctatgcgatctcatctcatctctgtgccacagccagtcgaatctcacagccacggtgtggacctccttttcgtctccactcttcctgttcctctccttttatttatcccgaaattccactttactatactgtactgtagtactgcaaaaagatctcaaagccgaagcaaacaaatctctcgtgcttagccctagctagctactggtccttttcttctcctctcccgtcttcgttactcggatcacgaaatctatagctactaattactggcgatggaggatctctcggatcttggaggccacggccacccgggtgctgctgcctggcggcccgcggcgccatcattggcgtcctcttccaaggtctcggtgcaagtctacaccgtcccaagctcagctgctaccggccgtgaagcccgaggtcaaggtgttgcaccaatgatgcatgcgtctagcgtcgctggccatggcggccgcgctgctgatctagaccccgtcaaggccaagatcgtctcccaccctagctaccaccgcctgctcgccgccttcttggactgccacaaggtcggctgcccgccggaagcggccgaggagatcgcggcggtggcgcgggagcgcgaggcgtggcagcgtgcagccgcgggcgacgtcgcgcacacaaggccggacccggagctcgaccagttcatggagtcctactgcgagctgcttgtgacgtggaaggaggagctgacccggccgctccgggaggcggaggagttcctgacgacagtggaggcgcagctcaactccattaccaacaccgggccaaccatgggagctttcatctcttcagctgcagctgcagataaaactggagtcgtcgatatgtccgacgatgaacaagaagaaggcagcggcatggaggcagaagtagccctgggcatcgatccttgctccgatgacaaggagctcaagaagcagctcctcaggaaatacagcgggtgtttgggcaacctgagaaaggagctgtgcaagaagaggaagaaagacaagctccccaaggaggcccggcagaagctgctcagttggtgggagctgcactaccgatggccctacccctcggagatggagaagatcgcactggcggagtcgacggggctggagcagaagcagatcaacaactggttcatcaaccagcggaagcggcactggaagccgtcggaggagatgcagttcgcggtgatggatgggttccacccggccccgcccaacgccgccgcgttctacgtcgacgcacgcctcgtgggagcaacgccggcgatgttctacgcccggccggatcatggggctcatcatggcctctggcacaattgattcagcccacgcacgctaccatgaagtattgaagtgtgcgcctgaaaacctgcatgcatgccgtagcttaattagcctataaatatgaatgatctgcacaatgaactggagatcgagaaagaaccctactgcattactgtacccccgttgttgcaccaagaaactttacatgtcatgaacagcaaagactgtgcctccttaatgctacaggtttgcggcattttgcataaaaaaaaacaaaaaaaaaaaaaaaa

SEQ ID NO: 16289 - DNA, 3355 bp, Zea mays
  misc_feature (290)..(290): n is a, c, g, or t
ttatcagatgtgtatctataccactatataatccaccactttaaactttacaaaactcacccaaccaaatcactcacacccataacctccactaaaatctaccaaacaaattgcacccaggcttaacacattattaaaatcaatggttcaaatcgctggataacatcctttctcttacttactcaaatcaatgaaaaatatatttgaatcatacttcatcattcatttgtctccctctccctcctgctccatctcccggtccccaccacccctcctacccactcgtgtcntcgccgtcgtcacaaccgttaacctctcctcttaggctaccgtcgctgttgaccctccatctttagaatcgtagcgttagaacgaggtacatgctaggtatcatatatgttagagtcccatcacccatgggcgtgttctttgctttatttaccgtcggtcgcctcccgccggtccaaaaagcgccttcttcccggactctccccagcatctcgctccatgacaaatcccaccgcgggtagatcacagcacgccatgccgcttcacgcgcgcgtgcgcgcagctagttagctagcgaacaaacccagcagaaacagacgccgccgccgacaacaagcgatctagaagagcacaggaaggagcaaggtgttgctgaggaaggcgacaatggccgcggagcaggttcagctgtgcatctccgccgacagcggcggcggcgaaagcaagcgtgacgccatgccggtggcggtggccgtgtccctgtgcctcctccacgacgcgttaggcgtcgcgctgttcctcgcctcccacccgctccacaccgtctacctcctcttcttcgcgcgcggcctcctcaccctggcggccttcttctgtccgctcctcgtctccacgtcgctcctcctcgctgtgttcgtcaccgtcgggccgtacgtcggcggcgccgactggtccggggtcaagtccctcggtaggacctgcggcattgccgtcgcagcactctgcgccgagctccggcccgacggtgctccagcggggcttgtcgcgcagctgtgctccttcgtccttggtcccaccgacgctgcctcccttctccgcgtcgaggagatcatgggtgttacagcttcttgctttgtgtctgaggaggagcagagcttgttgttaattggtgagcctgcatttgcgctcccagtaatagattacatttctgacagaagcatcttggattttgagagttttggtgatttgaaggacaaaattgacgaaaaagttgtgatttccgaggatatgaaaggctctgatcctttggctgagcagtgttgctcccccagagatacattatttgtgcaaaaaatggaagcagaaggagagagcggcattcaggggcaggacttaattttgtcagccattgatgaggtcagcgatggtgttgaggagaagagattggagtgtgacccagtgtcagtagagatgaagaaatttgagccagtgcaattattggagaccaggaattgtcaggcaatgcaaacaatggagatcaagaaattggagccatcggaactaatggaagaagccaagaaaccggagatcaagaaatttgagccactgcatgcaattgagatcaagaaatccgtgcagatcaagaaattgtgagcctgtggtactgccggaaatcaaggaatgtgagacagtgcaggcagtacagaccaagcaattgccgtccacgctggagatcaaaaagtctgagccagttgaatcagtggagatcaagaaaaatgagccggtgaaaccacgttctttgattgctcagcgcatcaagctatgggaagcacaagtatctggcaatgtcaagccaattgttggggataaggaggaaaactcagaggaattcagtttgagaaataactcaaacaaggacgcaaagaaatgcgtgcggtttgaggctgcagatccttgtgtcgcacaacagcaagaacaagaagttaaggatgtcaaagagtatgtgcacttcgagactgaaacagaagccgaagaatgcagcgcagaggctgaacaagagcagctgctggagcaaggctgcaacgatgtgcaacctgagccagatttgcacgagctagagaacgagattgcgcaacctgaacaagaacctgaaggagtccaggtgtacaacgacaatgacgtggcacaatctccagccatgtggaatgacgagagggagagcccactcaagtcgacatcgatcgcaagcagagtgcactcgcggacctcgtcggggaacctcgccagcgaggggtcgtcgccgtcgcggaaggacaaggagtggaagaggacgctggcctgcaagctctacgaggagcgcatgcagctcaggctgtgccgcgaccgtgccgtggtggggggcagcgacaacatggacatgctctgggaggcctacgaggtgggcggcggcgggagcaagggcagaggcgggaagcgcagcggcagcggcagcagcagcatggtgaaaggaagcaccggcaaggtagaagatgccgctgaggaaggcgaggaagatggcgacgaggaagacggggacggggacgaaagttcagtgaggcatctttgctgcctgcaggccctcaagttctccaccaggaagatgaacttcggaggtggcaagcctagcctgtccaagatctccaaggtcctaaagaggatgaccgcgttgtcgaggatgggatcgcggcgcaaacagtctgaatgaaggtcagctggtgtgatcaatggatggatcctttttcttgaatgtagaaccgctgtactgtcaccgtacttgttatgctgttttttttcgattgtatttcttttttttttctagtctgtatatatatgtgatgtatacccaatggtttcagtgaggttgggggtaattacagggctgccacttggcctgcagaatgtaataaaccttgatctggtgtgtgtaattttcgtgctttcagtcaatgctatgtctccatgaacaatttactaaaaaaaaaaaaaaaacagtgaagacaagtgcgagtgcgacctttcagttgtaccttgctatgttttccctattctgacttctgaggcatatacaatgacagttcatcacaatggccaatcttcagaacaatgatgtgttcagagtcagtgctgaaacgattcgtttttctgcaaccataatcatcaattggtgcttgggtattctgcaaaaggcgtgctgcaccgtggagtttgtccctgcaatctttcacgaaaagtgagtctgacttaactagttgtgaatgtccaatttctgcactgaagataccttcgtctacaatttctgcatgcacgc

SEQ ID NO: 16290 - DNA, 1455 bp, Zea mays
gtcgacccacgcgtccgagaagactatcttggaaagtgtgggttgcatctggtttaaccgtaatgatctccgggatcgtgaagttacagcacggaagtaagttgtctttgaatgacaaacccatttattatgtagttcattttgttcagagaattactttgtcaggttgcgtgaccatgttcaacagccagacaaaaaccctctcttgattttcccagaaggaacttgtgttaacaaccagtacactgtcatgttcaagaaggtgaaccctacctccatttactctgtcatttgtgtgtgcgttggagggtattcttatatttgcttctctacctcggtcttcctagtagccaaacagtaatttaatgccagaaactagaagttagtcacagcatggcatttaattgcatagttgctgacttgctattgtttactatgacaatgtttttttttatttggtgtgttctgtagggtgcctttgagcttgggtgtgctgtctgtccaatagctatcaaatacaataaaatatttgttgatgccttttggaacagtaagaagtaaggaatacaaatgatgaaacaaatttatgtcatccacacttttctttggttaacatgattacctcacatgaaatgttttaggcaatcttttacgatgcacttggtccgattgatgacatcatgggctgttgtgtgtgatgtttggtacttggagcctcaatatctgagggagggagagactgcaattgcatttgctgagaggtaacatatatttttaattcattttattttccaagaaaggctgatggtactatgtctctttggagagaccataatatattatttcttgtatgattaattgcttcgaacagagtaagggacatgatagcagctagagctggtcttaagaaggtcccgtgggatggctatctgaaacacaaccgccctagtcccaaacacaccgaagagaagtgagtttgctccctcattccttcccccatttcccgagttgtgtagttccaaagtttctaaagtggtttccaatcttcaggcaacgcatattcgccgaatctgtcttgaggagactagaggagaaatgaagagacatcaaacactacaagcgcatttggttagtggtttaccgttcagctaccttgtaattcggttggcttcccaaaaaaaagtccgggacacgtcaagtgcccagctcagttttgttgtaaatttgttagaaatttgacagaattggtagtgtgaacttaccaagaaaggaagaatacccgcatgtgttgtggctgttcattctatgattggttaggaattgacacttgaaacacggtactctattcagaggctgtgtccgtatttatgaatcgacgatgtaatggtttaaattcatgtgattattgattcaataatatgagtagattacatccccaaaaaaccaaaaaaaaaa

SEQ ID NO: 16291 - DNA, 723 bp, Zea mays
tacacggtcatgttcaagaagggtgcctttgagcttgggtgtgctgtctgtccaatagctatcaaatacaataaaatatttgttgatgccttttggaacagtaagaagcagtcttttacgatgcacttggtccgattgatgacatcatgggctgttgtgtgtgatgtttggtacttggagcctcaatatctgagggagggagagactgcaattgcgtttgctgagagagtaagggacatgatagcagctagagctggtcttaagaaggtcccgtgggatggctatctgaagcacaaccgccctagtcccaaacacaccgaagagaagcaacgcatattcgccgaatctgtcttgaggagactagaggagaaatgaagagacatcaaacactacaagcgcatttggttagtggtttaccgttcagctaccttgtaattcggttggcttcccaaaaaaaagtccgggacacgtcaagtgcccagctcagttttgttgtaaatttgttagaaatttgacagaattggtagtgtgaacttaccaagaaaggaagaatagccgcatgtgttgtggctgttcattctatgattggttaggaattgacacttgaaacacggtactctattcagaggctgtgtccgtatttatgaatcgacgatgtaatggtttaaattcatgtgattattgattcaataatatgagtagattacatcatcaaaaaccaaa

SEQ ID NO: 16292 - DNA, 2077 bp, Zea mays
gcacgagaccattacctagaacatcctaatcaaaagaaccaaaagcgccggcatctcaaacccgacggcgctctcttctctatcctctgtcccctccaccaaaaccgacggcgacgtcgctctcctccaccggtgcttggagctctccctccaccagcggcggtccacggacgctcggcgagctccaccggcgggcgctggtcagatccgcttggcagtcatccacctggcacatcgggtagctcacgcctccgttggcagtcccaccgccgcctggccctcccccagtgcccccggtgatccggaccgcacccgcttgctcggcctaacgaccggctcctgccccgccgcagccgaagctcccagcgtcctcctgcaggccgagctgaaggttcagcgcgccggtggagttcgacgacgaaactccgtcacgtcatacctctccgcctcccgtcttccagacgtctccaatcggggctcccagcgtctcggagaagaggagcagcacggcacggcggctgtggcgaggaaggctcctgtcccatcccaacccagttagcagccgcccaaggaggaggagatccaatcggcgtgcgggcgtccgcggtccatccatcgatccaattccaatctgcagaagaagggatcaaggaacagcgaccagagaaaggctgcgtctgctgctgctcctacggctgctgatgctacgaacaagaggcccagggccagcggaagctgtcacagtcgtcgattttagttgttggagctggaggtttgggctctcccctggcattgtatctagcagcttgtggtgtcggttgcttgggcattgtggatggtgatgatgttgaattgaataatcttcatcgacagataattcataaagaagcatatgttggacaatctaaagtgaagtcagcagctgatgcttgccgtgagattaattcctctatcaaggtagtagagcatcaccatactctgaagccatgcaatgctttggagattgcacggaaatatgatatagttgttgatgcaactgacaaccttcctactaggtatatgatcagcgattgctgtgttttgctgaacaagccacttgtatctggtgcggcattaggcttagaagggcagttgactgtttatcatcataatggaagcccatgctatcggtgcctctttccaactccaccacctgtggcagcctgccagagatgctcagacagtggtgtccttggggttgttccgggagtgattggttgcttacaagctctggaggctataaaggttgcaactggtgttggtgagcccctatgtggaagaatgctactatttgatgcactctctgctcgtattagagttgttaaacttcgtggaagctctccagattgcacccattgtggcgaaaactccgttttcacagaagaagactttcagaagtttgactatgagagcttcacacagtcaccaatgtctgataaggcagcagcaagcgtgaacgtactcccagagagcgcgcgtatcacttgcagagagtacaagaaactggccgacgatggtgaacctcatctactgctggacgtacgacctgcgcatcacttccagatagcttcgatctctccgtcccacaacatcccgctctccatgctggaagagaagctgcccgcgctcgaagcctcgctgaaggaagcaggggaggggtcagccttggttgtcctgtgtaggagaggcaatgactctcagagagccgtccagcttctccgcgagaagggattcgccaacgcgaaggatatcatcggtgggctgcaggcgtggggacaagacgtcgatcctgatttccctgtgtactagcgagatggaaatggatgcactaccttgtaacagtttggatgccgctagaacgagaactctgatactatgatttgagtactaattttgccataccgtgtacttgcaaaaacaaatatacaactggtatggacacggtattgtgatgaataatgccatggacaaaataaaatttgagtgatatttttttgcaggtttaaaaaaaaaaaaaaaagaaaaaaaaaaaaaaaaa

SEQ ID NO: 16293 - DNA, 2618 bp, Zea mays
cattgggtacctcgaggccggcccggggttcccgtccagccgtttttcgcatccacgtgggccagccggccaggcgaccgccgccgccctactcctggtcccagctctgctgcacccttcgccggcgacgagcgtccaccgcggcaggtacacccacccccctcacttttgcccctccaaccaaaagcgccggcatctcaaaccggacggcgctctcttctctatcctctgtgtcccctccaccaaaaccgacgacgacgtcgctctcctccaccggtgctcggcgctctccctccaccagcggcggtccaccgacgctcggcgagctccaccggcgggcgctggtcagatccgctcggcagtcatccacctggcacatcgggtagctcgcgcctccgttggcagtcccaccgccgcccggccctcccccagcgcccccggtgatccggaccgcacccgcttgctcggcctaacgaccggctcttgccccgccgcagccgaagctcccagcgtcctcctgcaggccgagctgaaggttcagcgcgccggtggagttcgacgacgaaactccgtcacgtcatacctctccgcctcccgtctccaatcggggctcccagcgtctcggagaagaggagcagcacggcacggcggctgtggcgaggaaggctcctgtcccatcccaacccagttagcagccgcccaaggaggaggagatccaatcggcgtgcgggcgtccgcggtccatccatcgatccaattccaatctgcaggttatactcaaactgcacacagtagcatccttctggtacagtaacaaaggatttggaacccagccctctgttctccaccaccgcttcgaagatgccgcaggtaatggtggtggcacggaacttcatggatatggtggctgctcttcctgcgggcaagcttgatatgctctatgactcagcctttatctgtgaggcagtactcaggtcacttcccccactggcaaagaagtatgcactgcagatgttgtatgtgctggcaccagtgaccgctgcagcaatggaagagtgggtgcttgatgaatatgctgccaagcataaggttgccattgataagcttctacagctcagggtctttgttgaagtgcgcgacagacgacgggacgtgagctacaagatgaatcagaagttccagggaaacatgcagaagtatttggttgatggtggaagtttaccaagggaacctttaccattaagtgtcactggtcgattgcccacaccagcagatctggaagcctatgctcttgatcaatgggagtgcttcttgttgcaattgatcaattcatctcaagtcgaaaaagggtcaagttttagctcctccatgatgaagacgtttcagcgtggtcttctgagttcaagggatggtgaagcttcaaagttgactgaaaatggcttccaatttcttctgatggaaacaaatgcacaactttggtacataatgagagaatacatttcatctgctgaggaacgtggagtggaccctacggagctgatatcatttctcttggaacttagctttcataaattgggagcggcttatagcttgaacactctgactgatgtccagaggattgccatcagggatcttgcagaattaggactagtcaaacagcagcagggtcgaaaggatagctggttcattcctacccaattggctactaatctctcagcaagcttgtcagattcgtcatctaacaaagagggatttgtggttgtggagacaaactttcgaatgtatgcatactctacttccaagttgcactgtgaaattctacgcctttttgcaagggtggagtatcaacttccaaacctcatcgtaggagctgttacaaaagaaagtatctatggtgcttttgaaaatgggataactgctgagcagataatttcatttcttaggcaaaatgctcaccctcgtgttgctgacaagatacccgctgtcccggagaatgtcacagatcagattaggttgtgggaaactgacctcaacagggttgagatgattccatcgcatttgtacgaagattttcctagcaaggaatggtttgaacaatgctgtgattatgcaagggataatgggtacttgctgtgggaggaccccaagagaatgagactaattgtacgaggggagttccaccctgaaatgagggagttccttcgcaggcaaagatgaggaacgaccttgtacttgacggaccatgctatgcttctttgtagtgcatagaaacactgtatcgggtaatagttctcctttaaatatcaggaaagggtctagaaaagggctcagtttttgaattattttggtgacctgtgagctgtggaagcatatgaataatgtggtgttcaatggagcaaggcccaacatccttgatctgcttctaaatgttactagtgactgtaccctgtgctggtgtatggctggtggccaggtcctgttggaactcttaggtaggtagtgtttggttttggagtatgatgggatggagttgttatgctcttaatttgttgttatttggactgattctatataggacggagtgattctaaaaatgaaaaaaactcaaatgatgaatc

SEQ ID NO: 16294 - DNA, 1785 bp, Zea mays
caattttttaaagtacctattttactactcaaaatctctaaaaaacaatctaaacaatttttagagtacctatcactgccactagccatgataaaacaatctaaattatgatacaaaactaatatatctagagtttttttaaataaagctgctctaaaataaaacagagtcatataccagacacaccctaaaataattacttcgcctcgaggagcaggatatcgcccagccgcccagggcctaggccaccgtcagcgccgcccgcctccatctccgccccgagcggctgcgccccgcccgccgcccgcccgcagtccaccaggcgtcgagccccgccccggctcgcgcgcgtcgagcctctgtccggccccggctgcaacccactcactcagccagacctggcttctctgcagactgcaggttctcagtttctcttataacaggtatttgatctgattctttagtagcctacttttcttttgtgcttgttggaccgcagccagttaaagtctagatggcaatatcagtatgcttgcttatagcctctggggcagctggtcactgtatactgtacaagagtaaatttgtttgttcttcactagttttctttgtttgttgttcactagatatcggtgtttgtcgttataatttcaggctcttagactaagcacaatgagtgtctgttcttgtagtttatagtgagccttgagcaccatagttcctgtatcttatcgcgtcttatcgcggagaaaattgaatttatgtcattattgtaaaacttaagattcgctcaaatactattatagaaacacgtttagctaaaaaaccattatcaaacgttgtcttacaaataaaatatcatttaaaggttatttaaaacttaaccttatttaattatattggcagccagtaaccgcagtaaccggacacttttgcccttcgaactaaaagcgcctgcatctcaaacccggcgccgcgcgcttctctatccttctgtgtcccctccaccaaaaccgacgacgacgtcgctctcctccaccggtgctcggcgctctccctccaccagcggcggtccacagacgctcggcgagctccaccggcgggcgctggcggctggtcagatccgctcggcagtcatccacctggcacatcgggtagctcgcgcctccgttggcagtcccaccgccgcccggccctcccccagcgcccccggtgatccggaccgcacccgcttgctcggcctaacgaccggctcctgccccgccgcagccgaagctcccagcgtcctcctgcaggccgagctgaaggttcagcgcgccggtggagttcgacgacgaaactccgtcacgtcatacctctccgcctcccgtcttccagacgtctctaatcggggtcccagcgtctcggagaagaggagcagcacggcacggcagctgtggcgaggaaggctcctgtcccatcccaacccagttagcagccgcccaaggaggaggagatccaatcggcgtgcgggcgtccgcggtccatccatcgatccaattccaatctgcaggtgagcagctcggttagattcccaatcaacagctcgaatcgcctgctatcccatcctattgaatgaaactatgatatagaattggtttgcctagttattatctcgaattaatttataaagatctccactttggttcgatttgattgtttcttcgccgcctggcatattggtctggtctgcttcttacgtgattcaactatgcatattggttcgatatgaatatggccatttgc

SEQ ID NO: 16295 - DNA, 1765 bp, Zea mays
  misc_feature (1753)..(1757): n is a, c, g, or t
attgggtacctcgagtggcgagaccatttcggcggttgaggcgacacggcagaagtgagcaaagcgttcaggtgcggagccgcggagggatgggcggcaggagggaggccatagagcgggagctgaagaagcttcgggcagagcgggaggagctcgacggccggatacggctgctggaatcgcagctcgaggcagggcctgcgggattcaacggtgcggcggcggggaaaggagtaggggacgatgcgtgcggcgggagtggagcgtgccagagccgcgtgggtaacgagtttgctccggacggtagcctcccggcggatatgatctaccggtacagccgccacctccttctcccggacttcggggtcgaaggccagcggaagctgtcacagtcgtcgattttagttgttggggctggaggtttgggctctcccctggcattgtatctagcagcttgtggtgtcggtcgcttgggcattgtggatggtgatgatgttgaattgaataatcttcatcgacagataattcataaagaagcatatgttggacaatctaaagtgaagtcagcagctgatgcttgccgggagattaattcctctatcaaagtagtagagtatcaccatactctgaagccatgcaatgctttggaggttgcacggaaatatgatatagttgttgatgcaactgacaaccttcctactaggtatatgatcagcgattgctgtgttttgctgaacaagccacttgtatctggtgcggcattaggcttagaagggcagttgactgtttatcatcataatggaagcccatgctatcggtgcctctttccaactccaccacctgtggcagcctgccagagatgctcagacagtggtgtccttggggttgttccgggagtgattggttgcttacaagctctggaggctataaaggttgcaactggtgttggtgagcccctatgcggaagaatgctactatttgatgcactctctgctcgtattagagttgttaaacttcgtggaagctctccagattgcacccattgtggcgaaaactccgttttcacagaagaagactttcagaagtttgactatgagagcttcacacagtcaccaatgtctgataaggcagcaccaagcgtgaacgtactcccagagagcgcgcggatcacttgcagagagtacaagaaattggccgacgatggtgaacctcatctactgttggacgtacggcctgcgcatcacttccagatagcttcgatctctccgtcccacaacatcccgctctccatgctggaagagaagctgcccgcgctcgaagcctcgctgaaggaagcaggagaggggtcagccttggttgtcctgtgtaggagaggcaatgactctcagagagccgtccagcttctccgcgagaagggattcgcctccgcgaaggatatcatcggtgggctgcaggcgtggggacgagacgtcgatcctgatttccctgtgtactagcgagatggaaatggatgcactacaccttgtaacagtttgaatgccgccagagattctggtggtgttgcaagaacgagaactctgatactatgatttgagtactaattttgccataccgtgtacttgcaaaaatatatatatatacaactgctatggacacggtattgtcatggataatgccattgacaagattaaatttgacatacagaattactttaaaagccaaaaaaaagggcggccaaaaactagtagcatgnnnnncgggaatt

SEQ ID NO: 16296 - DNA, 958 bp, Zea mays
ccctaaccggctaaacctgagacaggcatcccgagtgcaccgtcggccgcaccagcaggcagcatcccgccgccgccgttccccagcaggcagcagcaggtcgccgccgttccccagcaggcagcaacaggttgccagctcgcccccgcgttttgcttccggtcagctgatgtcgcatgcttttcggcagcgctagtcctcgacggacggcgaccagcatcagccggcgccccagtcgaccaacatccacggcggcacgagcccacgaccagcagatcaacgcggtggcagatcaacgagcccacgactagtcagaaaatttttacagcagcatatccaccggatacccgatacccgacgggtacccggtgggcacgggtatgggtccatttttttacccgattggcttggtgcgtatggatatttgtaaagggtcgagtatgatatcgggtcgggtattatacccgaacacaacccgacccgctgccatccctaaacgcagctattctgtcaattccttaaatagagcagcactgagcatatccggcggagaatttagttcagtgccggtttccatttcacttcatatctgggcttaatcttgtgtcagcttacctacacattgcaattgttgtcacatagcttatgaatgaagcacggaaatgatcgagttatattagaactatctacaccgacgtattgtgttgaatttaagatgccatcgatgccttttaaatgtgtatagtgctttcgacagccttgtgtttgcatgcccgattttcttacaagtatcatacatgtatacccgactgtgaatttaggttatactcaaactgcacacagtagcatccttctggtacaggtacacccttccctcccggctgtgcgaagcaactccaccctaatttattttgcagaaaaagttatcggtccgcccttggttactgaaactgtctag

SEQ ID NO: 16297 - DNA, 1069 bp, Zea mays
gctgtgtttacaaattattacacctgcttgctgttgatcttcgtttcccgtgatcccgtccagccgtttttcgcatccacgtgggccagccggccaggcgaccgccgccgccctactcctggtcccagctctgctgcacccttcgccggcgacgagcgtccaccgcggcagcgaggaggtcggcttcctttctcctccggcgagctccacgagggcgccgacgaggggatggatgcgcagcctaactggagaggtggaccggcggcgactaggatatcgtacaagaacgccaccatcgtcatgtgcgcctttaacctcttcgttgcggccctcctcctccacaactactactcgtcctggacgcgtatcgccggaggcaacaagctcgattctgctcagcttcggtatatatgggaatctgaggagctgcgtcgtgctatggagcctgtggatttgattagaagagtgaaggaaattgagcaagaagcttatggtgagcatggcatggcgacagatgaagatcctaagcagactgccgctgttgatttatcaaaacggcttaaggatttgagggcagggaatgatggcagtagccaaaaagctctcgaagaatggcgtaaacggaagatggagcgtgcaaggcagcgagccatcgaaaagaatgggacttctagtgtgaaaactaaatgaggtgaggagtgtaatgcagcacaagggattttgttttcatgtgtctcggagctgctccatgatgcattcaagtcaatccgtccatcgtaagcgcgagtgtagctgtgatgacccatgtttttaaagtcacaggcagcggtgttcttgtagaaacgtgaagttttaatatttgtgattgtccatgttgccgtgttttaaccgccgtcatgtatcagtatcaactttgtttgttcatggaatcatccctgcaaatactttatgcttttgctaaaaaaaaaaaaaaaattggtttgacgagaagggtgaatgggatggggtcatctatggatttggaaatatgaatatgtatggtatctgtttggttgaatggatgaggcaa

SEQ ID NO: 16298 - DNA, 1560 bp, Zea mays
gataatttacctaactctatttagatgagtatatgtatatcttgctcaaaatgttatcacttatattacaattttttgcacgcgcgcaatccgcgcaccagctaccagtagcaaatcgttgaccatgtttctggaagacgaagtccctgacatgaataactatatggaaaaaatatattagaaaaaaaagatagcatgacccatctaaatcaaaagtccattaattcgcgagaaaattggatttataccattatgaaacttagaattcgcttaaatgctattgtgagaacacgcttcactaaaaaatcattatcaaacgttgtcttagagacaaaatatcatttagagagttatttgaaacttaattatttgattatattggcagtgggcagcagtgacgggacacttttgcccctcgaaccaaaagcgccggcatctcaaacccgacggcgctctcttctctatcctctgtcccctccaccaaaaccgacggcgacgtcgctctcctccaccggtgcttggagctctccctccaccagcggcggtccacggacgctcggcgagctccaccggcgggcgctggtcagatccgcttggcagtcatccacctggcacatcgggtagctcacgcctccgttggcagtcccaccgccgcctggccctcccccagtgcccccggtgatccggaccgcacccgcttgctcggcctaacgaccggctcctgccccgccgcagccgaagctcccagcgtcctcctgcaggccgagctgaaggttcagcgcgccggtggagttcgacgacgaaactccgtcacgtcatacctctccgcctcccgtcttccagacgtctccaatcggggctcccagcgtctcggagaagaggagcagcacggcacggcggctgtggcgaggaaggctcctgtcccatcccaacccagttagcagccgcccaaggaggaggagatccaatcggcgtgcgggcgtccgcggtccatccatcgatccaattccaatctgcaggtgagcagctcggttagattcccaatcaacagctcgaatcgcctgctctcccatcctattgaatgaaactatgatatagaattggtttgcctagttattatctcgaattaatttgtaaagatctccactttggttcgatttgattgtttcttcaactagtggcatattggtctgcttcttacgtgattcaactagtggcatattggttcgatatgaatatggccatttgcagtttttctagcgtttgctaatgaacgcctctaaaggtggctgttgcacttgcagtaggattacatttgtgtgaaatcgaatggttggcgatctgttgttgactggttaagagtgctgccaaagttttagtttagagacctgctgctcggtgttcgccgtatcccattgcgtgttagcgtctgccgactgtgttctgaatttgtgttcgttttgaaactgtgttatgaaaccgtgcaaactgtgtttttaaactgtgccgtaaaatagactttcctgtgaatggcggagcttagcagttttgatctaaagc

SEQ ID NO: 16299 - DNA, 4127 bp, Zea mays
  misc_feature (37)..(70): n is a, c, g, or t
  misc_feature (233)..(256): n is a, c, g, or t
  misc_feature (1520)..(1524): n is a, c, g, or t
gcacgaggtcgtccgtaaccgccgccgtgcagcagcnnnnnnnnnnnnnnnnnnnnnnnnnnnnnnnnnnggtcgtgggctacctcgtcgaggagctccgcgacgaggacacctacgccaccttctgcgccgacctcgccgacgccaacgtcttcatcggctccctcatcttcgtcgaggagctggccctcaaggtcaaggccgcgcgtccggaaggagcgcgaccgcatggnnnnnnnnnnnnnnnnnnnnnnnntgcccgaggtcatgcgcctcaacaagctcggctccttcagcatgtcgcagctggggcagtccaagagccccttcttccagctcttcaagcgcaacaaggccaactccagcaacttcgccgacagcatgctcaagctcgtccgcacgctgcccaaggtgctcaagtacctgccctctgacaaggcgcaggacgcccggctctacatcctcagcctccagttctggctcggtggctcgccggacaacctccagaacttcctcaagatgatcgccggctcctacgtgcctgccctcaagggcgccggcatcaagtacgacgaccccgttctctacctcgactccggcatctggcacccgctggcgcccaccatgtacgaggacgtcaaggagtacctcaactggtacggcacgcgccgggacgccaacgacaggctcaaggaccccaaggcgcccatcatcggcctcgtcctgcagaggagccacattgtcaccggcgacgacgggcactacgtcgccgtcatcatggagctcgaggccaagggcgccaaggtcatacccatcttcgccggcggcctcgacttctccgggcccacacagcgctacctggtcgacccgattaccggcaagacgttcgtgaacgccgtggtgtctctcaccgggttcgcgctcgtcggcgggccggcgaggcaggaccatcccaaggccattgccgcgctgcagaagctcgacgtgccgtacattgtcgcgctcccgctcgtgttccagaccacggaggagtggctcaacagcaccttggggcttcacccaattcaggtggcgctgcaggtcgcgctgccggagctcgacggtgggatggagcccatcgtgttcgccggccgggaccccaggacagggaagtcacatgcattgcacaagagagtggagcagctctgcactagagccatcagatgggcagaactgaagaggaaaactaaggaggagaagagactggcgatctagaacctcgggccccctcccggccagggcaacgtcgggactgcagcatatctgaacgtgttcagctccatttactctgtgctctcagacctcaagaaggacggctacaacgtggagggtcttccggacacacctgaagccctcatcgaggaggggatccatgacaaggaagctcagttcaacagccccaacctgaatgttgtttaccgcatgaatgtgagggagtaccagtcgctgacctcctacgcctccttgctggaggagaactnnnnnaagccacctgggcacctcaactctgatggcgagaacctcctcgtctacgggaagcagtacggcaatgtcttcatcggggtgcagcccacctttgggtacgaaggtgatcccatgcggcttctcttctcaaagtctgccagccctcaccatggatttgcagcatactacacctttgtcgagaagatcttccaggccgatgctgttctgcactttggaacacacgggtccctcgagttcatgcctggcaagcaggttgggatgagtgacgcctgcttccctgacagcctcattggcaacatccccaacatctactactatgctgcaaacaacccatcagaggccacggtggccaagcgccggagctacgcgaacaccatcagctacctgaccccaccggccgagaacgccggcctctacaaggggctcaagcagctgtcagagctcatctcttcctaccagtctctcaaggacaccgggcgtggtcctcagattgtgagctccatcgtcagcactgcaaagcagtgcaacctcgacaaggatgtcccgctgcccgaggaaggggaggagctcccaccaaaggagcgtgaccttgtcgttgggaaggtgtacgccaagatcatggagatagagtcacggctccttccctgcggtctgcatgtcatcggcgagccgccgagtgccatcgaggcggtggccacgctggtgaacatagctgccctcgaccgccccgaggacggcataacctcgctgcccggcatacttgccgccacagtgggcagggacattgaagatgtgtacaggggaagtgacaagggcatactggctgacgtcgagcttctgaggcagatcactgaggcttcgcgcggcgccatcaccgccttcgttgagaagaccacaaacagcaaagggcaagtcgtcaatgttaccaacaacctcagcaagatacttggtttcggtctgtcggaaccatgggtgcagtacctgtccacgaccaagttcgtcagagcggacagagagaagatgagggttctgtttgggttcttgggggagtgcctgaggctcgtcgtgcaagacaacgagctgggaagcttgaagcttgccctcgagggaagctacgtcgagcctggccctggcggcgacccgatccgtaacccgaaggtgctcccgacagggaagaacatccacgctctcgatccgcaggccatcccaaccacggctgccttgaagagcgccaagatcgtcgtggaccgtctcctggagaggcagaaggctgacaatggcggcaagtaccctgagacggtcgcacttgtcctgtggggcaccgacaacatcaagacctatggtgagtcactagcccaggtgctgtggatgattggagttcggccagttgccgacaccttcggccgtgtcaaccgtgtggagcctgtcagccttgaggagcttggacgcccgaggatcgatgtcgtcgtcaattgctcgggtgttttcagagatcttttcatcaaccagatgaacctgctggacagggcagtgaagatggtggccgaactggacgagccagcagagatgaactacgtgcgcaagcacgcccaggagcaggcggaggagctcggcgtgtcgctaagggaggcggcgacaagggtgttctcgaacgcatcaggctcctactcgtccaacgtgaacctggcggtggagaacgcgtcatggaccgacgagaagcagctccaggacatgtacctgagccgcaagtccttcgcgttcgacagcgacgccccaggggcaggcatgaaggagaagcgcaaggcgttcgagctcgccctggcgacggcggacgccacgttccagaacctcgactcgtcggagatctcgctgacggacgtgagccactacttcgactcggacccgaccaagctcgtgcaggggctgcgcaaggacgggcgggcgccgtcctcgtacatagccgacaccaccacggcgaacgcccaggtgaggacgctgtcggagacggtgcgcctcgacgcgaggaccaagctgctgaaccccaagtggtacgaggggatgatgaagagcgggtacgagggggtcagggagatcgagaagcggctcaccaacaccgtcgggtggagcgccacgtctgggcaggtcgacaactgggtctacgaggaggccaactccacgttcatcgaggacgaggcgatgaggaagaggctcatggacaccaaccccaattcgttcaggaagttggtgcagaccttcctggaagccagtggcagaggctactgggagacaacggaggagaacctggacaggctcagggagctctattcggaggttgaagacaagattgaggggattgacaggtaaattgatttgccagatcggtcggccgatcggttccagcattcaacccataacgagcttggaactcttctgcctcattgggactcttgtacaatgtctgggtgtgtgatttatatatatataaaagttgtaacatgtaatactggaggatacaatctttaacaaagagggtggcggttgttccattcacagagactgagtcttaaagaacaagcaaataccccccccattttctgcctttg

SEQ ID NO: 16300 - DNA, 4629 bp, Zea mays
acgccaacgacaggctcaaggaccccaaggcgcccatcatcggcctcgtcctgcagaggagccacattgtcaccggcgacgacgggcactacgtcgccgtcatcatggagctcgaggccaagggcgccaaggtcatacccatcttcgccggcggcctcgacttctccgggcccacacagcgctacctggtcgacccgattaccggcaagacgttcgtgaacgccgtggtgtctctcaccgggttcgcgctcgtcggggggccggcgaggcaggaccatcccaaggccattgccgcgctgcagaagctcgacgtgccgtacattgtcgcgctcccgctcgtgttccagaccacggaggagtggctcaacagcaccttggggcttcacccaattcaggtggcgctgcaggtcgcgctgccggagctcgacggtgggatggagcccatcgtgttcgccggccgggaccccaggacaggcaagccccattccatttctctcgttcctgacataggataggaccctgaatgtctgtatttttcttgttcctaggacacctgtacttaatctcaactgtgagtgtttcttcttgtacttgatgcagggaagtcacatgcattgcacaagagagtggagcagctctgcactagagccatcagatgggcagaactgaagaggaaaactaaggtgtggcagtgcttcccataactgtatacttcttacagagtgcattcaccattctgtctgaaacaaatgacctgtagattacatgttaattggaaacatagtagctctgctacttcactagtcaagctgacggctactagaagaatttactctagatcaatgtcattgtaggctacatgttaattaaccaacggtgggggtttttttattgtcaccggtggggaaaggatcctcacctgaattatattactatttataagtggccaaaatagcctggtttgtatagcaggggatgggggggattacaacaatagcatcacgttactggaacccggggcaattcctatctccaaagcaccccagaagctggacgcatacccgcagcgaaggaagatgtgtgttgcgtcctggacagtccgttttctggccagtttcacgcggcactggaggcgaccactgttaattagccagccaaagaattgcaccaacggtggtagtacgaatgctttcagattgatagtgaagttgttgagctgaaaaccataactgaagttttttttttccatacatacgcaatgccacaagctttctatgatgataatattctcaagacagcccattattagtgaataaacgatagtagatggcaatctataaattccaagttagtcaagcccaaatacatcaaaatgaagaatatatagcacaaggacagatttttttcattacttttggtgtgtaattctagttttcatcgatgtggctattttttcgtaaaaggttaaaagatctgcactttgatgacatgctgttcattaggtagaaaatactgactgatactgggcaatctatcagtccccgtttgcctaagttccgaaacattaaccttttgttttgtttgcctgtttcaggaggagaagagactggcgatcactgttttcagtttcccacctgacaagggcaacgtcgggtctgcagcatatctgaacgtgttcagctccatttactctgtgctctcagacctcaagaaggacggctacaacgtggagggtcttccggacacacctgaagccctcatcgaggaggtgatccatgacaaggaagctcagttcaacagccccaacctgaatgttgcttaccgcatgaatgtgagggagtaccagtcgctgacctcctacgcctccttgctggaggagaactgggggaagccacctgggcacctcaactctgatggcgagaacctcctcgtctacgggaagcagtacggcaatgtcttcatcggggtgcagcccacctttgggtacgaaggtgatcccatgcggcttctcttctcaaagtctgccagccctcaccatggatttgcagcatactacacctttgtcgagaagatcttccaggccgatgctgttctgcactttggaacacacgggtccctcgagttcatgcctggcaagcaggttgggatgagtgacgcctgcttccctgacagcctcattggcaacatccccaacatctactactatgctgcaaacaacccatcagaggccacggtggccaagcgccggagctacgcgaacaccatcagctacctgaccccaccggccgagaacgccggcctctacaaggggctcaagcagctgtcagagctcatctcttcctaccagtctctcaaggacaccgggcgtggtcctcagattgtgagctccatcgtcagcactgcaaagcagtgcaacctcgacaaggatgtcccgctgcccgaggaaggggaggagctcccaccaaaggagcgtgaccttgtcgttgggaaggtgtacgccaagatcatggagatagagtcacggctccttccctgcggtctgcatgtcatcggcgagccgccgagtgccatcgaggcggtggccacgctggtgaacatagctgccctcgaccgccccgaggacggcataacctcgctgcccggcatacttgccgccacagtgggcagggacattgaagatgtgtacaggggaagtgacaagggcatactggctgacgtcgagcttctgaggcagatcactgaggcttcgcgcggcgccatcaccgccttcgttgagaagaccacaaacagcaaagggcaagtcgtcaatgttgccaacaacctcagcaagatacttggtttcggcctgtcggaaccatgggtgcagtacctgtccgcgaccaagttcgtcagagcggacagagagaagatgagggttctgtttgggttcttgggggagtgcctgaggctcgtcgtgcaagacaacgagctgggaagcttgaagcttgccctcgagggaagctacgtcgagcctggacctggcggcgacccgatccgtaacccgaaggtgctcccgacagggaagaacatccacgctctcgatccgcaggccatcccaaccacggctgccttgaagagcgccaagatcgtcgtggaccgtctcctggagaggcagaaggctgacaatggcggcaagtaccctgagacggtcgcacttgtcctgtggggcaccgacaacatcaagacctatggtgagtcactagcccaggtgctgtggatgattggagttcggccagttgccgacaccttcggccgtgtcaaccgtgtggagcctgtcagccttgaggagcttggacgcccgaggatcgatgtcgtcgtcaattgctcgggtgttttcagagatcttttcatcaaccaggtatgaattcaaacaacacattactgcctgtgatttttgtttttgtgcgtaattcgcacagatgcactaaactgaataataatttactaatggaagaacgcattttgatgcctgcagatgaacctgctggacagggcagtgaagatggtggccgaactggacgagccagcagagatgaactacgtgcgcaagcacgcccaggagcaggcggaggagctcggcgtgtcgctaagggaggcggcgacaagggtgttctcgaacgcatcaggctcctactcgtccaacgtgaacctggcggtggagaacgcgtcatggaccgacgagaagcagctccaggacatgtacctgagccgcaagtccttcgcgttcgacagcgacgcccctggggcaggcatgaaggagaagcgcaaggcgttcgagctcgccctggcgacggcggacgccacgttccagaacctcgactcgtcggagatctcgctgacggacgtgagccactacttcgactcggacccgaccaagctcgtgcaggggctgcgcaaggacgggcgggcgccgtcctcgtacatagccgacaccaccacggcgaacgcccaggtgaggacgctgtcggagacggtgcgcctcgacgcgaggaccaagctgctgaaccccaagtggtacgaggggatgatgaagagcgggtacgagggggtcagggagatcgagaagcggctcaccaacaccgtcgggtggagcgccacgtctgggcaggtcgacaactgggtctacgaggaggccaactccacgttcatcgaggacgaggcgatgaggaagaggctcatggacaccaaccccaattcgttcaggaagttggtgcagaccttcctggaagccagtggcagaggctactgggagacaacggaggagaacctggacaggctcagggagctctattcggaggttgaagacaagattgaggggattgacaggtaaattgatttgccagatcggtcggccgatcggttccagcattcaacccataacgagcttggaactcttctgcctcattgggactcttgtacaatgtctgggtgtgtgatttatatatataaaaagttgtaacatgtaatactggaggatacaatctttaacaaagagggtggcggttgttccattcacagagaccgagttacaaagatgcagtatatatgagcctcattttctgcctttgaaacatttcttattctttcagt

SEQ ID NO: 16301 - DNA, 3449 bp, Zea mays
cagggggcgaaggtgagcagccgccggcgaccaggtctgaaggctggaggttgggcaagagaggaggtgtacgctggttttggcggctgggttttggaagaggagaggagaggccagactagatgatactgtaaatggcctgaaaatggcccaataccaacaccctagctaggcgaccaggaaaacactaagcggacgattagtcgccctaatcggcgattagtcggacgactaggacgaccagcccactagtcgagtcgtttgcctaatcgaacccaaacaggcgaccagcccgtcgcgattagtcggacgacttgaaatcactgtgttccatacatttacaatcagaatgctctatgattaccattgtgcatctggagctactgtaaataaatgtcagcagatggtctgttgctaatctactttaaaagatcgatgttcatattattgtggtagtagtagtcttaatggctaacaatagtgtgttttttgacctgtaaactgtgggggaggcccctacagtggtatatatttatttatatatataaaaaaggaagcaaaaaaggggtcaacagccaagaggggtctgtacaggtagagaaacaacaaactaaaaaagagctaccaaagaaagaagaacaatactctgtgttgtttcgtataaccttaactaagtctttgatttattcttaccttatcggttattgtcttagcacaacattctaacaggagtaacagcactactgtagtctctagttgcttattttttatgtagtcccaaaaggctgtcttcctgcttggggggttatctcataaatatccttaaccacttgcaggctccttactgctacggtggcttggcctgctcctgcagtgatttacattggtattattctgtccaccttaggtgcagcactgcagagtttgactggggctccaaggttgcttgcagcaattgctaatgatgacattcttcctgttcttaattacttcaaagtttctgagggatctgagccgcatgcggccactttattcacggccttcatctgtatttgctgtgttgttattggaaacttggatttgattacacccacgatcacaatgtttttccttctgtgctatgctggcgtgaacctgtcatgctttctgcttgatctccttgatgctcctagttggcgccccagatggaaatttcaccattggagcctttcacttgttggggcattgttctgtgttggtatggttcttaatacttttaccattttattttgttttatcacaatcttcagcatgaacagttgatacttgagttaggtccttggtttgagactttgtccacttctattatttttaatctaaccaccttctcttcacctacaatactcaattattatttatcatgttttacaatagcaaatatctaactgaaacagccatgaaagcatttataattataagtgttgacatgaatctttgtatcaatttcagtgattatgtttctgatctcctggtctttcactgttgtctcccttgcccttgcaagcctcatctattactatgtgagcataaaagggaaggctggagactggggagatgggttcaaaagtgcatactttcaattggcactccgaagtctcagatcactcggaggtgcggctgactatctgctttgcaattacttaatcatacttaacaattttgtaactttggtcctttctgcagcaaaccaagtccatcctaagaattggtaccccattcctctgatattctgccgtccatggggcaaactgccggaaaatgttccttgtcatccaaaacttgcagactttgctaattgtatgaagaagaaaggccgtggtatgtccatttttgtctctataattgatggtgattatcatgaactagctgaggatgcaaagactgcctgccgccaattggatgcttacattgactacaagcgctgtgagggtgttgcggagatcattgtagctcctactatgtctgacggcttccgcagcatcgtgcagacaatgggcctaggaaacttgaagccaaacattgttgtgatgcggtaccctgagatctggcggcgtgagaatttgacacagataccgtcaacatttgtcagcataataaatgattgcattattgctaacaaggcagtagtcattgtgaagggactcgatgagtggcctaatgagtaccagcgtcagtacgggactattgacctctactggattgtaagggatggaggattgatgcttcttctgtctcagctcctgctgacaaaggagagttttgagagctgtaagatccaagtcttctgcatatctgaagaggataccgacgcagaggagctgaaagctgatgtcaaaaagttcttgtatgatcttaggatgcaagctgaggtcattgttgtcactatgaaatcatgggagtcacacatggagagcagcagtagcggtgttcagcaggataactcccatgaggcttacacaagtgcacagcaaaggatcgaaacataccttgacgagatgaaggaaactgctcaaagagaaaggcagccactaaaggagaatgggaggcaagttgttgtgaatgaacagaaggttgataaattcctttacacaatgttgaaattgaactccacgatactcaggtactccagaatggcagctgtagttcttgtgagccttccaccaccaccactaaatcatcctgcatatttctacatggagtacatggatttgcttgtagagaatgtcccacgcatgttaatagttaggggatatacgagagatgttgtcacatttttcacatgattatacatataatataaacttcccacctggagactctagtgtcgtctggctgttgtactatcttagcagagactggttacacaagattcaagcgtggattctgccatcgaaatgacaagccctcaccttgaaggcaaccatgatgagatgtcaaatgtcaagggctcttgttcgggcttattgggttcgtgaactactgaactgcagtgtcttcattcttttctggattttaaagatccacatagcgagctttgattcttacagattttgtagtcatcatatgtaaacacttaccatctagtaagcatacttacatgctgccccaatgacagaatgcgatccttaccttctcacaaacatttatatatgtattttctttgcatcacttaagtccatctaaaacttatggacctgtggagatgagcagagagccagagatgcgaattttgaatggctacccccaacaaatgaattttggttgtgctctgtcgcaaattcttggttttcatacattgctcgatgaggggtgctactttacccggttactttctggataattgaaccatatttctctctactaaaacgtgtagggttgagcttgagctaaagattttaacctaaattttt

SEQ ID NO: 16302 - DNA, 2575 bp, Zea mays
tgggaccctccacgccgcccggggtttttccttctgtgctatgctggcgtgaacctgtcatgctttctgcttgacctccttgatgctcctagttggcgccctagatggaaatttcaccattggagcctttcacttgttggggcattactctgtgttgtgattatgtttctgatctcctggtctttcactgttgtctcccttgcccttgcaagcctcatctattactatgtgagcataaaagggaaggctggagactggggagatgggttcaagagtgcatactttcaattggccctccgaagtctcagatcacttggagcaaaccaagtccatcctaagaattggtaccccattcctctggtattctgccgtccatggggtaaacttccggaaaatgttccttgtcatccaaaacttgcagacttcgctaattgtatgaagaagaagggtcgtggtatgtccatttttgtctcgataattgatggtgattatcatgaactagctgaggatgcaaagactgcctgccgccaactagatgcttatattgactacaaacgctgtgagggtgttgcagagatcattgtagctcctaatatgtctgatggtttccgtagcattgtgcagacaatgggcctaggaaacttaaaaccaaatattgttgtgatgcggtaccctgagatctggcgacgtgagaatttgacacagataccgtcaacatttgtcagcataataaatgattgcattattgctaacaaggcagtagtcattgtgaagggactcgatgagtggcctaatgagtaccagcgacaatacggtactattgacctctactggattgtaagagatggaggattgatgcttcttctgtctcagctcctgctgacaaaggagagttttgagagctgtaagatccaagtattctgcatatctgaagaggatacagatgcagaggagttgaaggctgatgtcaagaagttcttgtatgatcttaggatgcaagctgaggtcattgttgtcactatgaaatcatgggaatcacacatggagagcagcagtaacggcgctcagcaggataactcccatgaggcttacacaagcgcacagcaaaggatcaggacataccttgatgagatgaaggaaactgctcaaacagaaaggcagttactaatggagaatgggaggcaagttgtgaacgaacagaaggttgataaattcctttacacaatgtttaagttgaactccacgatactcaggtactccagaatggcagctgtagttcttgtgagccttcctccaccgccattataccatccttcatatttctacatggagtacatggatttgcttgtagagaatgtcccacgcatgttaatagttaggggatatacgagagatgttgtcacatttttcacatgattatacatacgaacttctcacctggagactctagtgccgtcaggctgttgtactatctcagcagagactggatacacaagagcgtggaatctaccactgaaatgacaagccctcaccttgaaggcaactacgatgagatgtcagatgtgcagagctgttgttcgcatattggattcgtgatctattgaactgcagtgtcttcattctttttctggatttaaaagatccacatagcgagctttgattcttacagattttgtagctatcatatgtaaacacttaccatcttgtaattgtaagcatacttacatgctggcccaaagacaaatgcaatccttaccttctcactgaaacatttatataggtattttctttgcatcaaaaaaaaaaaaaaaaaactgatggactggttgagatgagcagagctgcgaattttgaatggctacccccaaatgaattttggttatgctttgtcgcaaatatttggttttaatggtacaagatttctgagatacattactcaatgaggggtgctctgctactttacccagttactttcttgatatatgttttgttgaatgctgttctacatgtgatcttcagctagtaccttgatgttcaggcaatacatctacctgtcgaatgcaatttgtgccgtgtttcccgagctcgtaccactttcaagctcgggcctattcggaacggtactgtttcccaagcttaaagactcgagtttagcctccagcatagggattctgagtattataactgctatttacttcaccatatacaaggtctgtttagatgggctaattactagtggaggttaaaaattagttcggattagataaaattgactagtttttataggtaggattaactagctagtgggctaataactaattgaaagcttggctagtaaattagctaatctgttaatctcttgtttggatggattagggttaatttagctaatttttatctggttaacacataggtggcgtttggttcgtgaaatgtaacgtaaattacaacgataatgattcacactcgattagtagcggtaacaagtttgaataggatgatatcagtttctagtgtggtatctgattacaattatacttaaataaacatagtttaacgttatctgacacagttc

SEQ ID NO: 16303 - DNA, 712 bp, Zea mays
cgacattgggtccctcgaggccggccgggaccgcgcggcctcaatttccccttaacacagcacagaggaagcaggcggcggcgatggcatggcgggcgagcctgtctcggagcctaaaggagatccgcgtcctcttctgtcagtcctccccggccagcgccgctgcccgtgagttcgtgaagaagaactatggtgacatcaaggcccgcaacccctccctccccttccttgtccgcgagtgctccggtgtccagccccagctctgggcgcgctacgatatgggtgtggagagatgcgtgaacttggatggcctgacggaagcacagattgataaaaagctggaggagcttgccaaggccggcgagtctcttaaaaccaaatagttttggaactctatcctgccatgtttaactttcccaaataaatgatgccatatgggtgagcaattgttactctatcgttatctgtagttgtgcctggaattaagtctttaattggctcaactttgtgaaataatcactactcttttacttgccatgcattttctagattacatgctatattgaaaaggaaaaaaaaatcaatgatttgataagaagaatatatacctagtagcttgtgcatgagaaaaaaaaaaaaaaagaccccggcccagttatatacatcattgtatcacagttctatacttcaaaaaaaaaaaaaaaaagcggcc

SEQ ID NO: 16304 - DNA, 1354 bp, Zea mays
tttgtgttgttgctgttgttgttgttgtgctgtttctcaatctctaatttgcctcattttcatacatatatcaaactcaaagtatctctacatgggaaatgcctaaattaaaagctgggcaaggcggtgcagctctacctagagcataggtggttctaggcgtcacctttctaagcaaaatatgtggacatcgatgcggttttaattaactggatatatgttaaggaaataatttgtactttgtaacattatcaataattttatctcttgaatccaatttatactaggatggattatgtttgaggatgaagatttatgttatcaatggttcacaaaggtgaaaccttgtttccatatagtttcagcggctcaactgttgtcaaacctttatgtttgttattacactttacatagcaccaggaatgagggcattctcatgggaaggcccacgttgacctaacttgtcactataaataaataactccggtgtaccctagatacttaggggaaattggtaaattggttgctgactttgttgtcctggcccgtggaatctggtttttatttttccaacgaagagcacgacctccctgtttttcctgtattgagtgaaacacaaacacagaacctaacgaagattaagtgatgaatcttcacttgttatcagacaatgtatggatattgcatattgaatattgcgttctaccttcaactaaagaatatgttctttatatataaagaactagagcatatgttttctgtattgtgtatctacaagattatcattcactaagtgtttggccctaatggtgctccggtgtccagtccccagctctgggcgccgcccgatatgggtgtggagagatgcgtgaacttggatggcctgacggaagcacagattgataaaaagctggaggagcttgccaaggccggcgagtctcttaaaaccaaatagttttggaactctatcctgccatgtttaacgttcccaaataaatgatgccatatgggtgagcaattgttactctatcgttatctgtagttgtgcctggaattaagtctttaattggcttaactttgtgaaataatcactactcttttacttgccatgcattttctagattacatgctatattgaaaagggaaaaaatcaatgatttgataagaagaatatatacctagtagcttgtgcatgagagattgatcgtgcaatatttctgcgcagttatatacataattgtatcacagttctatacttcagttctgcgcatgactgaaattgtgcagacacatgtacaattattatttgtttttttctatactttgatgccatgtataaagttttttttacttg

SEQ ID NO: 16305 - DNA, 851 bp, Zea mays
  misc_feature (830)..(830): n is a, c, g, or t
ccccttaacacagcacagaggaagcaggcggcggcgatggcatggcgggcgagcctgtctcggagcctaaaggacctccgcgcccgccgcggtcagtcctccccggccagcgccgctgcccggtacaaatctcacgcatcttcgatttcactctctaaagtcgctgcttctgatttggtgcgttggtgatctggtcgcccccagtgagttcgtgaagaagaactatggtgacatcaaggcccgcaacccctccctccccttccattgtccgcgagtgctccggtgtccagccccagctctgggcgcgctacgatatgggtgtggagagatgcgtgaacttggatggcctgacggaagcacagattgataaaaagctggaggagcttgccaaggccggcgagtctcttaaaaccaaatagttttggaactctatcctgccatgtttaacgttcccaaataaatgatgccatatgggtgagcaattgttactctatcgttatctgtagttgtgcctggaattaagtctttaattggctcaactttgtgaaataatcactactcttttacttgccatgcattttctagattacatgctatattgaaaagggaaaaaatcaagtgatttgataagaagaatatatacctagtagcttgtgcatgagagattgatcgtgcaatatttctgcgcagttatatacataattgtatcacagttctatacttcagttctgcgcatgactgaaattgtgcagacacatgtacgattaattatttgtttttttctatactttgatgccatggtataaagtttttttttacttgtaaataanaaaaaaaaaaaaaaagcggcc

SEQ ID NO: 16306 - DNA, 959 bp, Zea mays
caaaatataattttggggtgtttgtatttggtccaaaaaagtgctaatattttggaacaggacctaccttacatacccggggtccctcgtcgccggaccgccaatagtagagcgggtgctcactcaccagatcggtgatctgacggcgtggacccgatgctgatcgaatgacccaaagagacggattgcaggcctgttccaccgcgcggcctcgatttccccttaacacaacacagaggaagcaggcggcggcgatcgggcgatggcatggcgggcgagcctgtctcggagcctaaaggagatccgcgtcctcttctgtcagtcctccccggccagcgccgccgcccgtgagttcgtgaagaagaactatggtgacatcaaggctcgcaacccctccctccccttccttgtccgcgagtgctccggtgtccagccccagctctgggcgcgctacgatatgggtgtggagagatgcgtgaacttggatggcctgacggaagcacagattgataaaaagctggaggagcttgccaaggccggcgagtctcttaaaaccaaatagttttggaactctatcctgccatgtttaacgttcccaaataaatgatgccatatgggtgagcaattgttactctatcgttatctgtagttgtgcctggaattaagtctttaattggcttaactttgtgaaataatcactactcttttacttgccatgcattttctagattacatgctatattgaaaagggaaaaaatcaatgatttgataagaagaatatatacctagtagcttgtgcatgagagattgatcgtgcaatatttctgcgcagttatatacataattgtatcacagttctatacttcagttctgcgcatgactgaaattgtgcagacacatgtacgattattatttgtttttttctatactttgatgccatgaataaagttttttttact

SEQ ID NO: 16307 - DNA, 667 bp, Zea mays
aaccttaatacggatcgggttttaaaagccgcaagaatgagggacaaattgctccgtttcgccgcatagccgagaggaagcaggcggcggcgagaatccagtagaacgcgagcagacggcggcgatggcatggcgggcgagcctgtctcggagtgtaaaggagatacgcgtcctcttctgccagtcctcccccgctagcgcccccgcccgggagttcgtgaagaagaactatggtgacatcaaggcccgcaacccctccctccccttccttgtccgcgagtgctccggtgtccagccccagctctgggcgcgctacgatatgggtgtggagagatgcgtgaacttggatggtctgacggaagcacagattgataagaagctggaggaacttgcaatggccggggagtctcttaaaaccaaatagttttggaactcgtatcatgtcttgtttaatgttccaaaataatagatactcctaccatattggtggacaattgctactctgtcattatctgtagttgtgcgtggtacgaagccttcgattagcaaaacttaatgtgtaataattactattgttttatatgctatgcattttctagattacatgaatgattgaaaatgaaaaaaaaaaaaaacacagcggccccttttttaaaaaaaagcggcc

SEQ ID NO: 16308 - DNA, 856 bp, Zea mays
agggcgattgggttcctccaggccggccgggccgggatctcccataacggagagagacgaagagagcagaagcgaagagcagcggcgcaaaggaaagggagccatgctcgcctcgccggcgctcgccggcgcccactccttcgcggcgtccgtgtatggaaacatcctcgtcccctcgcctcccgtccccgcgccggcacgtcgcgcggcgctgtccgtcgtcgccaaggtcaaggtggccacgccccaggacgaccgcatcgcccgccacgtccgcctgcgcaagaaggtaagtggcaccactgagaggccgaggttgagtgttttccgctcaaacaaacatctgtacgctcaagtcatcgacgacacaaagcaatgtactctggcttcagcttcaaccatgcacaaatctctctccaaggaatttgaatactcggctgggccaacgatcgaaatagcacaaaagatcggtgaggtgattgccaagtcttgcttggagaaagggatcaccaaggttgtcttcgaccgaggtggtttcctctaccatggccgcataaaggctctcgctgattctgccagagagcacgggcttgaattctgagtcgtccaggcgtttgttcatatctccaggatcacctgtaatcttcttctttttttgttctctccatatgccgaacagagctgttttgtagtcactcgccttgttctacagggtgcaaagccatggcccatggccactcgttgaccatgtcacgtttttttcgtttggtaagtcttgtgttctgacgcttctcgaattgatataagtatccatctctcccgaattgatattaaaaagcggccaaaaaaggcccct

SEQ ID NO: 16309 - DNA, 879 bp, Zea mays
  misc_feature (24)..(24): n is a, c, g, or t
cattgggacctcgagccggccggngaaaaaaaaatcattgggtacctcgaggccggccgggatctcccataacggagagagacgaagagagcagaagcgaagagcagcggcgcaaaggaaagggagccatgctcgcctcgccggcgctcgccggcgcccactccttcgcggcgtccgtgtatggaaacctcctcgtcccctcgcctcccgtccccgcgccggcacgtcgcgcggcgctgtccgtcgtcgccaaggtcaaggtggccacgccccaggacgaccgcatcgcccgccacgtccgcctgcgcaagaaggtaagtggcaccactgagaggccgaggttgagtgttttccgctcaaacaaacatctgtacgctcaagtcatcgacgacacaaagcaatgtactctggcttcagcttcaaccatgcacaaatctctctccaaggaatttgaatactcggctgggccaacgatcgaaatagcacaaaagatcggtgaggtgattgccaagtcttgcttggaaaaagggatcaccaaggttgtcttcgaccgaggtggtttcctctaccatggccgcataaaggctctcgctgattctgccagagagcacgggcttgaattctgagtcgtccaggcgtttgttcatatctccaggatcacctgtaatcttcttctttttttgttctctccatatgccgaacagagctgttttgtagtcactcgccttgttctgcagggtgcaaagccatggccactcgttggccatgtcactttttttttcgtttggtaagagtcttgtgttctgacgcttctcgaattgatataagtatccatctctccccaattgatattataaaaggggcctggtttggccccta

SEQ ID NO: 16310 - DNA, 856 bp, Zea mays
  misc_feature (840)..(840): n is a, c, g, or t
gccgcgtggggtccctcgaggccggccgggccgggatctcccataacggagacgaagagagcagaagcgaagagcagcggcgcaaaggaaagggagccatgctcgcctcgccggcgctcgccggcgcccactccttcgcggcgtccgtgtatggaaacatcctcgtcccctcgcctcccgtccccgcgccggcacgtcgcgcggcgctgtccgtcgtcgccaaggtcaaggtggccactccccaggacgaccgcatcgcccgccacgtccgcctccgcaagaaggtaagtggcaccactgagaggccgaggttgagtgttttccgctcaaacaaacatctgtacgctcaagtcatcgacgacacaaagcaatgtactctggcttcagcttcaaccatgcacaaatctctctccaaggaatttgaatactcagctgggccaacgatcgaaatagcacaaaagatcggtgaggtgattgccaagtcttgcttggagaaagggatcaacaaggttgtcttcgaccgaggtggtttcctctaccatggccgcataaaggctctcgctgattctgccagggagcacgggcttgaattctgagtcgtccaggcgtttgttcatatctccaggatcacctgtaatcttcttttttttttctctccatatgccgaacagattgtagtcactcgccttgttctgcatggtgcaaagccatggccactcgttgaccatgtcacgttttttttccatttcgtaagagtcttgtgttctgacgtttatgaggacatatcatgtgcaatcactcattttgggacaaagaaaaaaaaacacaaagcccatccgntggtttacttcaatca

SEQ ID NO: 16311 - DNA, 1516 bp, Zea mays
acagcgacacggcaacgcactggggggcccctcgaggcacgcgcacggcgcaccaaccctccgatgtcccatcccctccctagcctccgctccgccgctccccccaactccaccaggctccagtgtctccaccgcttctcgccgctttcccctcctccgcctgggcgcggcgcccgcccgcccctcccgatcccgtggacgtcctcgcaggcggcgtgttgcacgagagcttagggaatgttttaccagtattgttcatggtaaactcagagtttctatcaactgcccgggaaagtgaacttgtttccactccatctttagtgtcaaaaccaatttcttctacaggggcaacggaactacttcgaagtgaattatgggtgggttctgctgctgcctcagtgctgaagaatttgatgaatatgtctatccaaacaaccctatctataggcaatgcgtatccttgaggcatcttttccacagcatttttggcgggtatactgcaacattccagaggcttgagtctaggccaaacaacccagctcaaggggttgctccactgggatccactaatccaagtgtcaacataaatgacaattcactcaatcttgtttctagaccacctccatatgataccgatcctagatatgcccgtgttcaaagagagggattagtctccaggcgtgagaaatccataaatcttgcacaagaagagtcactggcccttagacgaaatgccagcagctctggtattgaacatttagctgctcagaagaaacgcaacagcactgaaaatgagggtgaatataaggtccatcgttctgaatcaactaagagtttgtctgcaaaagcttatagtagcagctatgctgttgtcgcttcagaagatgaggatgtctgccctacttgcctggaagaatacacgccagacaatccaaaaataataaccaagtgctgtcaccattttcatcttggttgtatttatgaatggatggagagaagtgatacatgcccaatttgtggtaaggaaatggagttttgcgagagcccatgatagcctttcggtttacatgatctcacatgaagtctgagctgcaggaaatggggttctgtgagaaccaatgatagcctttcgatttacatgatctcagatgggagcaagggaaacattctacagagtacaacagaatgctggagaattgtaaataatagttccttatgcatgcgatgtccaaatagatctctttctcgagatcagtttcttacatgtactgagatggttatctgtcttactaaattcatgctagaatttgcttggccagtttttgttatatttgcaaatggtagctcatagatggaagcacaactcatggatgaaagaatatattaacctgagcaaaaaaaaaaaaaaaaagttgtgcttccatctatggaacacaactcaggttaatatattctttcatagatggaagcacaactcatggatgaaagcttacagcaaccctttgttggtgctgca

SEQ ID NO: 16312 - DNA, 643 bp, Zea mays
cctcgaggccggccggcacctgtgcccgactcaaccaatctactcgctgctacaacagagtttgcctgttgccttgcttccacctcccggctgcagctgcacctgctgctcgatcggatcggccgcgcgcggcatgtcgaccaccacccccaccaacgccgcctcccagcagggcgacgacgctgcggctggcggcgcggacaagaagccggcgcaagagacggtgacgaagacggtgcagacggtggaggtgcggtcctcggcagggcagcccgacgaggagggcgtgctcaagcccgtgaaggtggtgcacgagatccccgccaaggacagctccggcgtcaagcaggactaggactagctaagctgcctagctcgatcgatcatctagctaggatcgatgctgctgctgctaagctgagtggatttgatgctgctgcggtcagaaatcttatcgtcatttccaccccccaaccagatcctagctagtaattgcaaataaacaaatgttgcgttggatcctaatgtgaattagtgatctgtgcggcctgccgcttcatttgtaaacatgtactaataagacgcctgattttgtgttcgacaaaaaaaaaaaaaaaagcgccccgggcgcccgttctaaagg

SEQ ID NO: 16313 - DNA, 1641 bp, Zea mays
cctcgccgggtttacacaaatcgggtgaggggcgtccattgcgagttgcgactgcgtcgccgattcccctgccggcatgtccagtccgcgccctcccctcggccggatcctccgcctcgccgtcgccgtcgcggcctgcgcctgctttcctagccccgtctccggcatccggaagggcattggctttattcaaccaattgtgtgcagaagcactgttcaggggcggcatctgatctctgatgataatggttatgtatgttctgcactttcaatcaatccatggtctcactgctgcccaacaacaggggaccgcttttcctgccagggctgcgaacttgatttacagtgctgcaattcatatgaatattgtgtttcttgctgtttgaatccttctaagatcaagaaagaagacgtgctgaagctgaaggtagctaagccagttactgctggaacatacacaaatgttttcgatttctgcatgggacgatgccgccatagctctgcaagtgtggttcatgaaaatgcctatgccagtgatttccatcactgtttttcagtgcaacaaaattcatcaggatcaactgagtctagttctgtatcaaagttgttgggcattaacgttgtagtaggaaggcccagggaatcttgcagcttggtgtgcaaagtaagaggacagtcctgtgttccaagcaggctctctgtgttgaacaaatgtgagattttgcagaaatatatgagatgcaagagtggctgctttcccagccttggaccagatcaacctgctgaagttgttgacgaagctccaaccagcttgaatccaggagcatgcttatacatgcagatggatgagcggctcacatgtgatggttcgcaccatcatacccggcggctctgtccatgcgcctgagaaggggaaatgaatgtgacactcataagacagcagaggggaaacaagtggaggcgataagctgataaccgatggttctccatcacacccccatgacgaacaacctctccgcgcatcggttgcgggtttcctcaacaagaacgccctactctcctgtttctgggaaggattatggatgcaaaatgaaatggagtgcctgcaaagatctgctccagttcttgagaagcgtcgtggatgcagaaggagatgcaatgcaatacctttcaaatccttgcatggtatctggtaggattttgcatgctgaatgaaaatgcacgcaggcgattccatgagcctttcatgcatgttttgagacacctgaaccaattatatatattcgtaatatattgcacaagcttccatgcatgttttaagacaataagtaacccaaacagaactagggatacatgatcttttaaatcaattacaccatgccagccagcatctctgcaccacaaactcccatgcccctttttttttggtttccttcgccagcctgaatcaaaaagaataatcagggttgaaatctttcatggacttggggccctccctccctttggtaacaactttggggggtggacttttttttggaggaaaaagttcggtttcctgggccttcttcttgaaaggccggtgggggaagaattttccccagaacttggttccccctaagggctttgtgaaccggaaggggt

SEQ ID NO: 16314 - DNA, 1979 bp, Zea mays
  misc_feature (1578)..(1578): n is a, c, g, or t
ccacgcgtccgcaaatacaaaggtttcagttactggtacattcttggtgaataaagaacatgtggaaagtcacaggtggtcatgtatgtttggggatgttgaagtaccagctgaggttttgaccgatggcaccctacgctgctatgcaccagcacaccaatcaggaagagttccattttatgtgacctgttcaaacagggtggcttgtagtgaagtgcgagaatttgagtatcgtgattctgaagctcattacatggagacttctcgttcccaagccaatggtgtaaatgaaatgcatctacacattcgtcttgagaagctactcactttggggccagatgaccatcaaatgcttgttataagcagtggtaatgagaaatatgagataatgaatgctataaattccttaatgcttgatgggaaatggtcaaatcaagaatcttctgtcaaggaagtagtttccactgctagggtccaaagtttaaagaaactggtgaaagagaagctgcatcaatggctcatctgcaaagtaaacgatgatggaaagggtcccaatgttctgtgcaaggaaggacagggtgtgattcatttagtagcagcactgggttatgattgggctataagaccgataatgattgctggtgtcaatgtgaacttccgggatgctcatggatggactgcactccactgggctgcatctttgggaagagagcggacagttagtgtcctcatagcaaatggagctgcagcaggagcactaactgatccaacttctgagttcccttctggaagaagtccagctgatttagcttcagtaaatggacacaaggggattgctggttttctcgcagaatctgctttgacaagccatctgtcagcacttactattagggaatcaaatgatagcactgtagaagcgtgtgggctaccatttgctgaagatctcactggcattgattctgtccatctcgctggagagggtcctgatgctgaatcacttgaaggttctttaagtgccgtgcggaaatccactcaagctgcagctcgtatatttcaagccttcagggtggagtcattccacagaaagaaagtcgtggaatacggagatgacacctgtggattatctgatgaatgcacactttcacttgtttctcttaaaaatgtcaaaccaggacaacatgatacacatctgcattctgctgctgttcgcatacagaacaagtttcgcggatggaagggaagaaaggaatttatgatcattcgccagagaattgtcaagctacaggctcatgtacgaggacatcaagtgaggaagaactatcggaaggtagtctggtcagtcggtatcgtcgagaaagtcatactgagatggaggagaaagaggcctgggttacgcgggtttcggccccagaaacaactagaaggtccatcgcaaatccaacctgcaaaggctgaagacgaatacgatttcttgcacgacggcagaaggcaggccgaagccaggctacagagagcacttgcccgggtgcactctatgtcacagtacccagaagcgagagagcagtaccacaggcttancaccctgcgttgctgaaaatgaaacagtccagggtgtgctttcgaagcttgctgcaggacgtgttttattttccctcggggtttgatcatgatttgatgctggctactttggaacagatgatgcaggatgagatgctaagccaggcggctggtggtgcggacgatttcatggctggactggaggacttgatctgcatagatgatgccccgccccgatgtctgccattcggtgaagctgagcctttttacatcagataggcagggaggcggtttccttgctccccttttgtcagactagccctgtaaatattcttcagctagttgttcaccccgactgtttactcgctttctgctagtgtacaactataacatagtttcaatgcactgattatcggtagaat

SEQ ID NO: 16315 - DNA, 841 bp, Zea mays
ctcccggggtccggcctggtcgccgtgatacccatctgcattctgctgctgttcgcatacagaacaagtttcgcggatggaagggaagaaaggaatttatgatcattcgccagagaattgtcaagctacaggctcatgtacgagggcatcaagtgaggaagaactatcggaaggtagtctggtcagtcggtatcgtcgagaaagtcatactgagatggaggagaaagaggcctgggttacgcgggtttcggccccagaaacaactagaaggtccatcgcaaatccaacctgcaaaggctgaagacgaatacgatttcttgcacgacggcagaaggcaggccgaagccaggctacagagagcacttgcccgggtgcactctatgtcacagtacccagaagcgagagagcagtaccacaggcttacaacctgcgttgctgaaatgaaacagtccaggatgatgcaggatgagatgctaagccaggcggctggtggtgcggacgatttcatggctggactggaggacttgatctgcatagatgatgccccgccccgatgtctgccattcggtgaagctgagcctttttacatcagataggcagggaggcggtttccttgctccccttttgtcagactagccctgtaaatattcttcagctagttgttcaccccgactgtttactcgctttctgctagtgtacaactataacatagtttcaatgcactgattatcggtagaataatcgcctcttatttgatatatagtttatattaattcaacgtattttatggttttatctgtaattctgcattcgtatcgagccataacggtgtgaatttgcg

SEQ ID NO: 16316 - DNA, 1174 bp, Zea mays
attgggtacctcgaggccggccgggaaatttctgtgtggttactatactacacccacgcctccgaggcgcggccccggccgcccccgacctcagctctccgttacacgcaaacgcaagctcccaagcagctaccaaccagccgggagagggagcgcacgcactgcgacaatggccacggccggcggaggggccgggcatctgaagctgctgggcgcgtggccgagccccttcgtgaaccgcgtacgcatggcgctgcacctcaaggggctggagtacgagaacgtggaggaggacctcaccaacaagagcgacctgctcctcgcctccaaccccgtccacaagctcgttcccgtcctcctccacggcgacaagcccatctccgagtcactcgtcatcgtggagtacctcgacgacgccttccccggcgctggccaggccgtcctccccgccgacccctatgaacgcgccgtcgctcgcttctgggccaaatacgtcgacggcaagttgcacggcatgatggtgaaggcgctcatgggggcaacggaggaggagagggcgacggcgacggtggacgcgctggccgctatggacacgctggagggcgcgttcgccgagtgctccggcgggaaaaagttcttcgccggcgacgcgcccgggtacctggacgtcgcgctgggaggcttcatcggctggctgcgcgcctgggacaaggtggggggcgtcaagctgctggacgccggccgggtcccgcgcctggccacgtgggcggagcgcttcgccgcgctcgacgtagccaaggaggtcatcccggaccccgaccacatcgccgagtttgccaaggtgctgcaggcacgctccgcggcagctgccaccagcaactgagctcgcaagtgaatgctgctgctctgccttcctgataaaatcatatcatggtacccggtttgttcgtttaatctggcgcggaaaaaacatggtttgttgtcgtaccaaactaagagtatgcatgcatgcttgttcttaattatatgtacattcgttcaagaaaaaacagattgttcatgtaacggttaggacttgctgtatatccatatgttgttgtttggttcctgcacaacttaattaagatgcgcagtttagcaaaaaaaaaaacccaagggcggccactctagagga

SEQ ID NO: 16317 - DNA, 3527 bp, Zea mays
tgcagtcacaaaggctctgggcagtgacctctgcggccgcctcctctcctctcccagtccgcccctcccgcctcgttctctccgccatcgtcgccgccgcctccattcctccaccagtccaccatcgccacctacgcccaaccaaacccaactccatctcttccgactataaacgcaacccaccaccgctgccgcgaacctctgcgctccgaataccccagacccccgatcctcccaatggccaccgcattttcgctgcgcgctgcggccccggccaccgctccccgcgccgtctcccgatccacctccggtacgcctctctatccttggcaccatacgtgtcggatttcatagctccctagaagtttatgtttacctgcttctgcttcgtgtgctcgcctgcagcggcgagggtcgtgcccatggcatcggcactggcgggacgcggaaggctggtggcgcgtgcagcagttacagttgcgtgacattgctcttctgatttttgtcagtcctttttttggtcgcaacacacattggctgtcctgaattattttctccttgtgtgttctcttgcgcaggcaaaggcggatgtgccatcgagcacgtccgacgggtaagaacgttttactccctgtctatggcatccatgtgacctgagcccgggacatacgcctgagatgctccacttttcatatctgagattttcatatgtttgctgatttttttcttcaatcactagtgcacacacatgccccaaccgcaaaaggaaaatatgagtggactaagcagcaaagtgtggttttgagcatgaatttctaattcggctacaataataaatgaatactcactggttgtagatatctctaggttatgtaactatatgttgtaagattttattatggtacatgaggccgtcaccattgaattgattgcaagatgaaatttggcaccgaacttgctgttttgaataggttaccaacctgaagtaattacagtagtctggaaaatgagtatttcatccttgtgcctttgcttgcttaaatgaatctacttggcaaataaatctggagatataatattcagttttattgtagttggtacttggcagcactggatggggcaccagttctcatcatttattgtccaagaagtaaactcgttgataaaaataacagatcttaagagatttatattatgacactggggtaaactagacatacaacactgcctcccattcagaaaggttattgggatttgggtgtcaactcacagtgactgctggttgttcattgcatgaaactgattagtaacatgttctctgagaaatatggagttacaaatcgcaggccttgacagcttgcagggttagcaatatgttagaaaaccataacagttctttggctaacctttcctctgttccctgctaatggagcatttctcttttattctgtctattctttttactgaaactctggaagtatgtaggcactggctattcgaataatgtttgcctaaccttgatttctttagtaacgcgatttcttttgtgtatgcctgcaaattcctaaccttaatttcctttcagccatgaggtcttgctgtttgaagctcttcgtgaggccttgatggaagagatggaattagatccaacagtgtgtgtgtttggtgaagatgttggccattacggtggttcttacaaggtgacaaaaggtttggctgatacgtttggagaccttcgagttctggacacccctattgcggagaactcgtttactggcatgggagttggagcgggaatgaaagggctgaggcccgtcgttgaaggcatgaacatgggattcctgctccttgcttacaaccagatctcaaataactgtggcatgcttcattacacttccggcggccagttcaaaatcccacttgtgatccgtggccccggtggtgtgggtcgtcagcttggagcagagcactcgcagcgcctggaatcgtatttccagtccatcccaggcctgcagatggtcgcctgctcgactccttacaacgctaagggcctgatgaaagctgccatcaggagcgagaaccctgtggtgctgtttgagcacgtccttctgtacaacctgaaggagaaaatcccggacgaggagtacgtgctctgcttggaggaggccgagatggtgcggcctggggagcacgtgactatactcacatactcgcgcatgaggtaccacgtgatgcaggcagcgaagacgctggtgaacaaagggtacgatcccgaggtcatcgacatcaggtcgttgaagccgtttgatctgcacactattggcaactccatcaagaagacccaccgcgtgctgatcgtggaggagtgcatgcgcacgggtgggatcggcgccagccttaggtcggccatcgtcgacaatttctgggactaccttgacgcccccatcatgtgcctgtcatctcaggatgtgcctacgccatatgctgcgactctggaggatgcaaccgttgtgcagcctgcccagatcgtggctgcggtggaacaactatgtgcatagattgtggcctgggacgtttgggagactgttgttgccatgaaaaagccttccgtttgttagttttgtgctgtaacaagcattctttggagacttaaggtgtaggcttatagtcgttttgttcttgttttaagaagtataatccagcttcgtagctgcacggactcgatcttcttgttcctaaatctgcgctatgcaatgccgaatttgatggttcgaacaaaaaaaaaaaaaaaaaaataatcattgtactccgatgccatgaacctgtagcctccagctgcactggtcagtgaaacacccatgaacaaagtatttgcactaagtgaatatgggtgtacttcattacaacttagcgtagacatttcattgaaataattagagcccatggatgtctggtgaccatgatgacccttttttgttgaaaaacggtactcatttataggaggccacatgaatgcaagagtgagctctccatatagttgcaagttatacaggtgatcgcaaaacaggacgaaccatcttttggttaaaaggcagtaagagcaggtataatgacgagcgaaacgcatgccacatcatcacagtaactgacgtggaatatagcctagaatttgagtcggcgcttgaatatccgccgagctgttcgtagctaacgaggcctgtgcgccggcttattgcttgctagcgttttgccggctgggtgaagaaaagagaactaaaaaaagtggacccaaataactttattaaatactccctcattttttgagaagccaactatttgtaactttgaccatatttatataagaaaatattaatatttataatacatagttagtataattagatagatctttgaacctattttttagtaaaattgttcgaagatacaagcgttgctaatatattctataaatttaatcaaacttaagaaagtttgaccgacacgaataggacagagggagtaggtgt

SEQ ID NO: 16318 - DNA, 1622 bp, Zea mays
cattgggtacctcgaggccggccgggtcctctcccagtccgcccctcccgcctcgttctctccgccatcgtcgccgccgcctccattcctccaccagtccaccatcgccacctacgcccaaccaaacccaactccatctcttccgactataaacgcaacccaccaccgctgccgcgaacctctgcgctccgaataccccagacccccgatcctcccaatggccaccgcattttcgctgcgcgctgcggccccggccaccgctccccgcgccgtctcccgatccacctccgcggcgagggtcgtgcccgtggcatcggcactggcgggacgcggaaggctggtggcgcgtgcagcagttacagcaaaggcggatgtaccatcgagcacgtccgacggccatgaggtcttgctgtttgaagctcttcgtgaggccttgatggaagagatggaattagatccaacagtgtgtgtgtttggtgaagatgttggccattacggtggttcttacaaggtgacaaaaggtttggctgatacgtttggagaccttcgagttctggacacccctattgcggagaactcgtttactggcatgggagttggagcgggaatgaaagggctgaggcccgtcgttgaaggcatgaacatgggattcctgctccttgcttacaaccagatctcaaataactgtggcatgcttcattacacttccggcggccagttcaaaatcccacttgtgatccgtggccccggtggtgtgggtcgtcagcttggagcagagcactcgcagcgcctggaatcgtatttccagtccatcccaggcctgcagatggtcgcctgctcgactccttacaacgctaagggcctgatgaaagctgccatcaggagcgagaaccctgtggtgctgtttgagcacgtccttctgtacaacctgaaggagaaaatcccggacgaggagtacgtgctctgcttggaggaggccgagatggtgcggcctggggagcacgtgactatactcacatactcgcgcatgaggtaccacgtgatgcaggcagcgaagacgctggtgaacaaagggtacgatcccgaggtcatcgacatcaggtcgttgaagccgtttgatctgcacactattggcaactccatcaagaagacccaccgcgtgctgatcgtggaggagtgcatgcgcacgggtgggatcggcgccacccttaggtcggccatcgtcgacaatttctgggactaccttgacgcccccatcatgtgcctgtcatctcaggatgtgcctacgccatatgctgcgactctggaggatgcaaccgttgccccccctgcccagatcgtggctgcggtggaacaactatgtgcatagattgtggcctgggacgtttgggagactgttgttgccatgaaaaagccttccgtttgttagttttgtgctgtaacaagcattctttggagacttaaggtgtaggcttatagtcgctttgttcttgttttaagaagtataatccagcttcgtagctgccaaagaaaaaaaaaactagagggggggcccggtacccggcggccgccgactagtgagctcgtcgacccgggaattaattccggaccggtacctgcag

SEQ ID NO: 16319 - DNA, 1031 bp, Zea mays
gatgccgggccctattccagtggattattgtttcattcgccccctaaaagcacttgtgacgtgggctggaaccacagatgcctcatcaggcaccaggacagcatcctgcttatgtgtaatgctgttggacatgacgtcagaagagtttctattgagctgctctcattttgacgccaatatccttgggagtttgtctgagatcatcatcagaagtttgcagcaggatatccctgacgatgacagtgagcaattcaagcagaagcagatcattgtatcaggttataagcgatgggctgatcgatttccacatgttaaagatgttgtggagcagcatgtatccgtgtgaatgtgatcatcggctaccccaggagctgttctctatgaatgcaaacggaaatctgacagtgcagctttgacaatgcctcggttctggtggttcattccttttacctggtactttcctgcgacctgtttctgatgcgattttggttagcggaccttggcttatgggaattctgcaatggggaatgttaggttagcgaaattctccagcggcagcccggcagccaacgaggtacaccaacgtggatcagaaagatggcattgtttatccgggaaattctcagctgcgaagcaaatctgacactgtaatgcttatgctgcacgagatttggggactagattctcatctcgctttcaccatttctgaacgcatgtgtaacagaaccaagcccaagtttcaggacaggggttttcatttatattgtttcccatgtatagcgagtttgcattaactgctagagcagtcccatgtattgctgcgttcgctggagacgaacatacgaaaggatatactcctacttaaatatattagagatattgtagcggagtaaaaagcgcacgtctagatttgagatggctcctaaatcttaaaaagtgaatctgaactaatggaatgttgtttgggatagctcctaaaccttaacaaatgaatctgaatctagaatttactcggattcactgtgaagcag

SEQ ID NO: 16320 - DNA, 993 bp, Zea mays
cctggccgcgcgcggccggccgggaaacgtcgaacgccgggaaacaccgaaaggcaagccggcggcaccaaacttttctcctaaaaatcctccaaaaaaacaaaaaaggggaggggaaaatattctcgtcttcttccccgtgcttgccagctcccgaagtcggcgagctctccgaaagcggcggctatgggttccagccaggcagataagccactgcgacgtatcgcggcgtcgttcgaggagctcgccgccgtcgccaagcagcatcccgcggtgcccatggacgctggggccttctcgcgcgcctgctccaacgtctccgtcctcttcggctgtctcggcatcgctttcaagttcgcggagatggactacgtcgcgaaggttgatgatttggtggaggcgtccaagtcaatttcaacattgccttctatggttgagcgagacattcagaccgacactgtcaggaaaccagggagccatacaaggaatctgcttagagtgaagcgcgggattgatatggttaaagtcctgtttgagcaaattcttgtcacagagggcaactcactaagggatgcagcatcggtggcttatgctcaggtctttgctcctcaccatggatgggcaataaggaaagcagtttctgctggaatgtacgcccttccctcaaagtcccagctgttgaagaaattgaatgaagatgaggaatcagcaaaggttcaaatgcagaactttgtcaggtcatcagctccagtaatctgctatgttgatgaccttttcacctcaaggaatttgggcatagattggtgaagaaaaatatggatacgtttgtttgatgtactaatccagtcagatggtgtgctgtgtgagctgggctcagaaaacctttttctggatccgtgtttccaagtcgtaaactaatataactacttagcgatcccaaaaaaaaaaaaaaaaaaacgaccaaaaaaaatcggggcggccgcgcgcagtata

SEQ ID NO: 16321 - DNA, 893 bp, Zea mays
  misc_feature (8)..(8): n is a, c, g, or t
ttgccggntatttgggagggattataaaaaggggagggaaaaaattctcgtcttcttccccgtgcttgccagcacccgaggtcggcgagctctccgaaagcggcggcgatgggttccagccaggccgataagccactgcgtcgtatagcggtgtcgttcgaggagctcgccgccgtcgctaagcagcagcccgcggtgcccatggacgctggggccttctcgcgcgcctgctccaacgtctccgtcctcttcggctgcctcggcatcgctttcaagttcgcggagatggactacgtcgccaaggttgatgatttggtggaggcgtccaagtcaatttcaacattgccttctatggttgagcgagacattcagaccgacactgtcaggaaaccagggagccatacaaggaatctgcttagagtgaagcgcgggattgatatggttaaagtcctgtttgagcaaattcttgtcacagagggcaactcactaagggatgcagcatcggtggcttatgctcaggtctttgctcctcaccatggatgggcaataaggaaagcagtttctgctggaatgtacgcccttccctcaaagtcccagctgttgaagaaattgaatgaagatgaggaatcagcaaaggttcaaatgcagaactttgtcaggtcatcagcttcagtaatctgctatgttgacgaccttttcacctcaaggaatttaggcatagattggtgaagaaaatatggatacgtttgtttgatgtactaatccagtcagctggtgtgctgtgtgagctgggctcaaaaaacctttttttggatccgggtttccaggcctaaacaaatataactacttaacgaaccttgtcttggagcaaaaaaaaaaaaaaaaagcggccc

SEQ ID NO: 16322 - DNA, 1049 bp, Zea mays
ttttttttttttttttgcattactctgaaactacgtttttgtgtcagtgagactgcaattcatatggttcatcgattcgattcagagtcaacacagcgttgacctgtttctgctcaacatcatcttttttttttgtctcactttgagtactgccaacaaccacagtacattgtaggataggattgatttatttcagtacaaatggaggaggaggaggatccaaatgttgttcccgcacacggacatggcagcttccaagaaagaagaaacagacacacaggcacactgcagcagaatacgtcactagagctgggatgttctagtgacgaatctggctggcatttcagggtgcctggggaatcctcacgtacgactgaagaaactgcagccagactggagaagccagcgacatcgtcgtcttgatctcgtccgcgttgtacaggttgccgcggcgcagcccttccagcatctgccggttttgccatggccggtggagcacctcgtatcagcaacgaattatggtagcagagttgggagctagaagcagcttactttgatgacggcggagaggtccggcgggcaggcgccgccgtggagcgtcgtcgccgtcgtcagcgctgcctcctcctcgtggtcatggacaaccacgatctcggccgccttggcttccacctcgcctccggccgccagggcctcgtcggcgaggccagcgtacggcaggccggagtggcacgccgcgcagtcgtgctgcatgaacaccttgtgcccgccccgcgccccgtcctgtgaccacgggtaggccgggcatgcgctggatgccgacgcgacggtcccggcgctgaggaagcccgccgccacgcccacacctgtgctgctgagccggcgggtgctcgtggttccctgtggccgcaggagctcacgcacgaggtccatcgccgccgcggccattgcgccggattcgcagtcgcggcaccaactctagtggtgagtgccgcctgtggttggtggagctcgacgatttgtgataagagggcagagcatgtggtcgt

SEQ ID NO: 16323 - DNA, 875 bp, Zea mays
catcgattcgatgcagagtcaacacagcgttgacctgtttctgctcgaccaccatcttctttttttgtctcactttgagtactgccaacaaccacagtacattgtaggataggattgatttatttcagtacaaatggaggaggaggaggatccaaatgttgttcccacacatggacatggcagcttccaagaaagaagaaacagacacacaggcacactgcagcagaatacgtcactagagctgggatgttccagtgacgaatctggctggcatttcaaggtgcctggggaatcctcacgtacgactgaagaaactgcagccagacaggagaagccagcgacatcgtcgtcttgatctcgtctgcgttgtacaggttgccgcggcgcagcccttccagcattttggtgacggcggagaggtccggcgggcaggcgccgccgtggagcgtcgtcgccgtcgtcagcgctgcctcctcctcgtggtcatggacaaccacgatctcggccgccttggcttccacctcgcctccggccgccagggcctcgtcggcgaggccagcgtacggcaggccggagtggcacgccgcgcagtcgtgctgcatgaacaccttgtgcccgccccgcgccccgtcctgtgaccacgggtaggccgggcatgcgctggatgccgacgcgacggtcccggcgctgaggaagcccgccgccacgcccacacctgtgctgctgagccggcgggtgctcgtggttccctgtggccgcaggagctcacgcacgaggtccatcgccgccgcggccattgcgccggattcgcagtcgcggcaccaactctagtggtgagtgccgcctgtcccggccggcctcgaggccccatcccc

SEQ ID NO: 16324 - DNA, 868 bp, Zea mays
  misc_feature (12)..(12): n is a, c, g, or t
  misc_feature (15)..(15): n is a, c, g, or t
gagtactgccancanccacagtacatggtaggataggattgatttatttcagtacaaatggagagggaggaggatccaaatgttgttcccacacatggacatggcagcttccaagaaagaagaaacagacacccagggcacacttcagcagaatacgtcactagagctgggatgttctagtgacgaatctggctggcatttcagggtgcctggggaatcctcacgtacgactgaagaaactgcagccagactggagaagccagcgacatcgtcgtcttgatctcgtccgcgttgtacaggttgccgcggcgcaacccttccagcattttggtgacggcggagaggtccggcgggcaggcgccgccgtggagcgtcgtcgccgtcgtcagcgctgcctcctcctcgtggtcatggacaaccacgatctcggccgccttggcttccacctcgcctccggccaccagggcctcgtcggcgaggccagcgtacggcaggccggagtggcacgccgcgcagtcgtgctgcatgaacaccttgtgcccgccccgcgccccgtcctgtgaccacgggtaagccgggcatgcgctggatgccgacgcgacggtcccggcgctgaggaagcccgccgccacgcccacgcccacacctgtgctgcagagccggcgggtgctcgtggttccctgtggctgcaggagctcacgcacgaggcccatcgccgccgcggccattgcgccggattcgcagtcgcggcaccaactctagtggtgagtgccgcctgtcctggccggagctcgacgatttggggtagggggccccaccttgtggtcgtgggagactgctgcactgctggcttcgatttggcagagcg

SEQ ID NO: 16325 - DNA, 2298 bp, Zea mays
  misc_feature (1682)..(1682): n is a, c, g, or t
  misc_feature (1969)..(1969): n is a, c, g, or t
  misc_feature (2010)..(2010): n is a, c, g, or t
taaaatcttaaataactctagcattgaaaaataatgcattgaaaagacctcaatcaccaaatgatttatcattgtatgacctgaaaacacacttcatgacacaaaaatccatattcatgtcccaaaatgtacacatgagaccttaagattcttatggcaaaaataagtttgcaacgcagctactgagcaagtgagcatatgtagcactcatatctatagataaagagtatgcacatcatcaaaataagaagcatagacaaattgctgatcatcgtcacttcaattgaacaaaagaaagtcatgatatacttagttatcttctgtggtacaagaagtcaccaaaagaatctatggtagtctacgcaacagagtgtcatcccccaaaacccatgacatgaaaaatctttgaaacagtgtctttgtaagaaccaactaatggaactagaaactaaatgctcagctacgaggtagcaaagagaagcatcagacttttgaattatgatggttacctagtgggtatttcttaacttctgttccactttcacaatttgctgagcaaaatgagcctctcaatatgatgaattaaggaatggaggtagaattctgatacacgccgtcaggagaggccataaaggcactaaatacacagtcatcttgcgctaattgagctgccattgcgaccacgtgaacccttgccattgctactggtacgcagcttctgcttctcagccagctcaggatggtagtactcaaggtaccaccgcacaaacttcttgaggcctgtttgcagatctgtggatggatggtaaccgagctcccgttgtgcaaggcttacattagcatgcgtgtatggcacatctccattccttggcatcttaacaactttcctcacagccttcactttgagcagtttctcaagcaaatccactagctgtgtaacaggcacaggtgaagtgttgcccaaattgtaagtcctgaacggtgccgtacctcgcttcttgcctccactgcctgtgctccgaccagctgtatccaaggccgctacgcagcccttcacaatgtcatcaatgtaggtgaaatcccgggaaatggtagtctggtgtgaacctccaccggcactctcatagacggtaattggccgaccagcaaggatgtccctggtgaagaagaagtacgccatgtccggacgcccccatggcccatagacagtgaagaatctgagggcggtgagtgacagaccagtagatgtggttgcccgcatgagcaatctcctcgccggccttcttggtggctgcatagagagaggctggtcgatccgtcctgtcatgctcggagaaaggcacatgggagttgagcccgtacactgaagacgacgacgcccagacgatggcgggctgagggttggctgagcgcgccgcctcgagcagcgccacgagaccggcaacattggcgcgcacataagacatggggtccacgagtgcgtgccgcacgccggcttgcgcggcgaggtggaggacatgtgtgaagggcacgacgtcgaacagcttggcgaggagctcggcgtcggcgatgtcgccgtcaacgacgtaaacccccgagcgggcgaggagtgcggcgcggccgcgcttgagggccgtgtcgtagtagttgttgaagttgtcgaggcccagcacgccgtcccntcggcgtcgaagcgcggcggccgcgtggcagccgacgaagcccgcggcgcccgtgacaaggacggagtggccccgggagcgcctgacgcgcgccgacgcccgcaccttcttctcccaggcggcgccgccccaggaggcggtggacgagggggacgcgtggagggagcggcgcggggactcgggcgcggcccgcggggcgggcgccgcgggtgagaggaggaggaaggcgaggaggagcgagagggagcagacggaccagaaggcgagcttggagaggagagacgtcngcgaggggtggtggtggcgcgggggcaggcggtggtggtantggtggaactgcggcttgacggccgctgcgccgcccgccgcggccgccgagccgggtgccccggtcagctgcggcgccatcccctcgatccgcggcaatgcggctggtcctggatctcggctcgggcctggggctgggattggggtgatcgggtccgccgcggcgcttgggtttgcgggacctttcgctgatgccgttttttcgagtggggatagccggataggttccgatttgctttcgaggggctgtttcagtgggatttggtttgcgggccgctacatttgggca

SEQ ID NO: 16326 - DNA, 1131 bp, Zea mays
ccttggaccgttggatgcggataataaggaggatcaggagaggatcattgcagatcgcaagacaccacttgtggtgacatctgctccagccgtgcgctacccgaacccaccaaaccctgacaaggtgctttacatcaacaagaaggaggcgccgctgctaaaagttgagagaggtgttccagttaagttctcggtgcaggctgggcatgacatggcactctatatcacttcagatcccattggtggtaatgctacactgaggaataaaacagaggtcatatatgctggcgggcctgatgcccatggtgtactagctaccccaaaagagcttgtttggctgcctgatcggaacacgcctgacctagtctattatcagtcactgtatgaacagaagatgggatggaaggttcaagtggttgatggaggccttagcgacatgtacaataacagtgttgttttggatgatcaacaggttacgttgttttggactctctccgtggattataaatctatatctatagcagctcgaggtgagaagaaaagtggatatcttgctattgggtttgggagtgggatggtgaatagcttcacctatgttgcttgggtgggcaatgatggggttgggcgagtaaaaacttattggattgatggaaagagtgcaacaggcattcacccaacatccgagaacatcacttttgttcggtgtaagtcagaaaatggcattattacatttgaatttactcgccctcttaacccttcttgtaccggaaaagtagaatgcaagaacatcatcgatccaactacaccacttaaggttgtctgggccatgggtgcaagctggtcgggagatgatctgacagacagtaacatgcattcagtcacaagcagtcggcctatacgtgttttgttgttgagaggttcagctgaggcagaacaggatttgcgtcctgtcctggctgttcatgggtttatgatgtttgttgcctggggaatcttgcttcctggtggaataatggctgcccggtatttgaagagcttaaaaggagatgggtggttccaaatacatgtctatctgcagtattcaggaattgctataatgtttcttggcgtccttttcgctgcggctgagct

SEQ ID NO: 16327 - DNA, 1546 bp, Zea mays
gccggccggtccggccgccccgccccgcccagctgcagccagagccacccaccttatcgtcatcctcgctcgctcctcatcgccagcgcctcctcctcctcctccttcttccccaccgctgccgacatggctgcgcaagaagagaagaccgctgttgttgttgctgctgctgccgatgtcgcgacagaggagcctacgccggcggcggagcagcaacctcagccggctggggcggcgcgcagggcaggaccatcggcgcccggcggggctccgcccaaccccttcgacttctccaccatgatgaaccttctcaatgaccctagcatcaaggagatggcagagcagatcgccaaggacccggcgttcacggagatggcggagcagctgcagaagacggtggtgtccccgcggcagcaacagcagcagcaggcgcggcagcagcagcagcagctggacccgcagaagtacgtggcgacgatgcagcagctgatgcagaacccgcagttcgtggccatggcggagcggctaggcagcgcgctgatgcaggaccccgccatgtccgccatgctggggggcctcaccaacccggcgcacaaggagcagctggaggcccgcgtcgcgcgcatgaaggaggaccccacgctcaagcccatcctcgacgagatcgagtccggcggccccgccgccatgatgaagtactggaacgaccctgaggctctgcagaagttcggccgcgcgatgggccgtcggcgtcggcccgtccggcgaggccggcggcgcggagcacgccgaggcggaggacgacgccggggaggaaggcgagtacgaggacgagtccatcgtccaccacaccgccagcgttggcgacgtcgagggcctcaagaaagcgctggaggacggcgcggacaaggacgaggaggactcggaagggcggcgtggcctccacttcgcgtgcggctacggcgagctccagtgcgcgcaggcgctcctggaggccggcgccgcggtggacgccgtcgacaagaacaagaacaccgcgctgcactacgccgccggatacggccgcaaggactgcgtcgcgctcctgctcgagagcggcgccgccgtgacgctgcagaacctggacgggaagacgcccatcgacgtggccaagctcaacaaccaggatgacgtcctcaagctgctggagaagcacgccttcgtatagacgtcccacgccgccggccggcccgtcttgctcgtctgctcttgtcgccgctgcggccacgtcgcttgcctctgctactgctgctgccgtcgccgccattaatgctttgttgatttctctcctggtcgagacaacgcaggttccttcatcacttcactgttgagtatttgcattgggtgtgtatgtatcggattttgctttgcgtgatcacggtaccatatttatttatcggactcctcgttcatcaggtggaggttttcgtaatgaataaggatgaaatttccatttcaccgtccaaaaaaaaaaaaaaaaaactcgagactagttctctcctcgtgc

SEQ ID NO: 16328 - DNA, 1766 bp, Zea mays
agctgcagccagagccacccaccttatcgtcatcctcgctcgctcctcatcgccagcgcctcctcctcctcctccttcttccccaccgctgccgacatggctgcgcaagaagagaagaccgctgttgttgttgctgctgctgccgatgtcgcgacagaggagcctacgccggcggcggagcagcaacctcagccggctggggcggcgcgcagggcaggaccatcggcgcccggcggggctccgcccaaccccttcgacttctccaccatgatgaaccttctcaatgaccctagcatcaaggagatggcagagcagatcgccaaggacccggcgttcacggagatggcggagcagctgcagaagacggtggtgtccccgcggcagcaacagcagcagcaggcgcggcagcagcagcagcagctggacccgcagaagtacgtggcgacgatgcagcagctgatgcagaacccgcagttcgtggccatggcggagcggctaggcagcgcgctgatgcaggaccctgccatgtccgccatgctggggggcctcaccaacccggcgcacaaggagcagctggaggcccgcgtcgcgcgcatgaaagaggaccccacgctcaagcccatcctcgacgagatcgagtccggcggccccgccgccatgatgaagtactggaacgaccctgaggctctgcagaagttcggccgcgcgatgggcgtcggcgtcggcccgtccggcgaggccggcggtgcggagcacgccgaggcggaggacgacgctggggaggaaggcgagtatgaggacgagtccatcgtccaccacaccgccagtgttggcgacgtcgagggcctcaagaaagcgctggaggacggcgcggacaaggacgaggaggactcggaagggcggcgtggcctccacttcgcgtgcggctacggcgagctccagtgcgcgcaggcgctcctggaggccggcgccgcggtggacgccgtcgacaagaacaagaacaccgcgctgcactacgccgccggatacggccgcaaggactgcgtcgcgctccttctcgagagcggcgccgccgtgacgctgcagaacctggacgggaagacgcccatcgacgtggccaagctcaacaaccaggatgacgtcctcaagctgctggagaagcacgccttcgtatagacgtcccatgccgccggccggcccgtcttgctcgtctgctcctgtcgccgccgccgccgccacgtcgcttgcctctgctactgctgctgccgccaccgccattaatgctttgttaatttctctcctggtgtagacaacgcaggttccttcatcacttcactgttgagtatttgcattgggtgtgtatgtatcggattttgctttgcgtgatcacggtatcatatttatttgtcggactcctcgttcatcaggaggttttcgtaatgaataaggaagaaatttccatttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaaaggcttgctttttaaccgggccaatttttgggcccaaaaaaaaccgggtcccgttttatttttttccccaaccaccccccccagggggaaaaggggttttttaaaaaccccaccccccaaggttttttttttattccccacccctttttttcaagctttaaaaataaaccaacagattttttttgggtttt

SEQ ID NO: 16329 - DNA, 1592 bp, Zea mays
ctttccctcctcagcttcagccttcagctcctctcctctcctttcctttcctctgctctcctctccacagctgcagccagagccacccaccttatcgtcatcctcgctcgctcctcatcgccagcgcctcctccttcttccccaccgctgcctacatggctgcgcaagaggagaagaccgctgttgctgctgctgctgatgtcgccgcagaggagcctgcgccggcgccggagcagcagcctcagccggctggggcggcgcgcagggcagggccatcggcacccggcggggctccgcccaaccccttcgacttctccaccatgatgaaccttctcaatgaccctagcatcaaggagatggcggagcagatcgccaaggacccggcgttcacggagatggcggagcagctgcagaagacggtggtgtccccgcggcagcaacagcagcagcaggcgcggcagcagcagcagcagctggacccgcagaagtacgtggcgacgatgcagcagctgatgcagaacccgcagttcgtggccatggcggagcggctaggcagcgcgctgatgcaggaccccgccatgtccgccatgctggggggcctcaccaacccggcgcacaaggagcagctggaggcccgcgtcgcgcgcatgaaggaggaccccacgctcaagcccatcctcgacgagatcgagtccggcggccccgccgccatgatgaagtactggaacgaccctgaggctctgcagaagttcggccgcgcgatgggcgtcggcgtcggcccgtccggcgaggccggcggcgcagagcacgccgaggcggaggacgacgctggggaggaaggcgagtacgaggacgagtccatcgtccaccacaccgccagtgttggcgacgtcgagggcctcaagaaagcgctggagaacggcgcggacaaggacgaggaggactcggaagggcggcgtggcctccacttcgcgtgcggctatggcgagctccagtgcgcgcaggcgctcctggaggccggcgccgccgtggacgccgtcgacaagaacaagaacaccgcgctgcactacgccgccggatacggccgcaaggactgcgtcgcgctccttctcgagagcggcgccgccgtgacgctgcagaacctggacgggaagacgcccatcgacgtggccaagctcaacaaccaggatgacgtcctcaagctgctggagaagcacgccttcgtatagacgtcccacgccgccggccggcccgtcttgctcgtctgctcctgtcgccgccgctgccacgtcgcttgcctctgctactgctgccgccgccgccgccattaatgctttgttgatttctctcctggtctagacaacgcaggttccttcatcacttcactgttgagtatttgcattgggtgtgtatgtatcagattttgctttgcgtgatcacggtatcatatttatttatcggactcctcgttcatcaggaggttttcgtaatgaataaggaagaaatttccatttcaccgtccaaaaaaaaaaaaaaaaggcggcccccccccagtgagctcgtcgacccgggaattaattccggaccggtac

SEQ ID NO: 16330 - DNA, 890 bp, Zea mays
tcggtcgctttccctcctcagcttcagccttcagctcctctcctttcctctcctctcctctcctctcctctccacagctgcagccagagccacccaccttatcgtcatcctcgctcgctcctcatcgccagcgcctcctcctcctccttctttcccaccgctgccgacatggctgcgcaagaggagaagaccgctgttgctgctgctgccgccgatgtcgcgacagaggagcctgcgccggcggcggagcagcaacctcagccggctggggcggcgcgcagggcagggccatcggcacccggcggggctccgcccaaccccttcgacttctccaccatgatgaaccttctcaatgaccctagcatcaaggagatggcggagcagatcgccaaggacccggcgttcacggagatggcggagcagctgcagaagacggtggtgtccccgcggcagcagcagcagcagcagcaggcgcggcagcagcagcagcagctggacccgcagaagtacgtggcgacgatgcagcagctgatgcagaacccgcagttcgtggccatggcggagcggctaggcagcgcgctgatgcaggaccccgccatgtccgccatgctggggggcctcaccaacccggcgcacaaggagcagctggaggcccgcgtcgcgcgcatgaaggaggaccccacgctgaagcccatcctcgacgagatcgagtccggcggccccgccgccatgatgaagtgagtgagctgctggctggatttggattcctttcttccttgtacaggcggtagatgctccagcaagggaaggaagaagtcacatgccatgaacaaatgatgggatgcgtgttcaatttggttcaggtactggaacgaccctgaggctctgca

SEQ ID NO: 16331 - DNA, 1679 bp, Zea mays
ccggccgggttggcttccttgggcagcccccctgcccctgcccaccccacgacagcccaaacccaaccccggcacacagcctgcagcccgctacatacaaaatgagctggtggcttggcctctcctccaccagtggcacagtggcagtggctggccacccaatcgtctcgttcgtcatctacctctccctcctccaacccaagctaagctaaacagcttacagctcgctccgccatcaccgtatcgagagagacagagacaggctagcgagggaatggagaggatgctggccaggctgatgcagcggcggagctccgtccccctgtccggcctcctccaccacggaggagcgcccgccccgctgcaggccgccggcgccactggggcctccccgctgatcttctcgcaccagcagcagcagcagcacacggccgcctccgccgtcctgccggggctcaagatcagggactccgcgtcccagctgatcgggaggactccgatggtgtacctgaacaaggtgaccgaggggtgcggcgcccgggtggctgccaagctcgagttcctgcagccgtccttcagcgtcaaagacagaccggcgatctcgatgctggaagacgccgaaaagagggggctcatcactccaggaaagaccacgttgatcgagcccacgtcggggaacatgggcatcgggctggcgttcatggcggcgctcaaggggtacgagctcgtgctcaccatgccgtcctacaccagcctggagaggagggtgacgatgcgggcgttcggcgccaacctggtgctgaccgacccggccaaagggatgggcgggacggtgaggaaggcgacggagctgtacgagagacatcccagcgcgcacatgctccagcagttccagaaccctgccaacgtcaaggtgcactacgacacgacgggaccggagatctgggaggacacgcttggccaggtcgatatcttcgtcatggggatcgggagcggcggcaccgtcacgggagtcggcaagtacctcaaggagaaaaaccctaacgcaaagatctatggagttgaacctgccgaggcaaatgttctgaatggtggaaagccaggacctcacctcatcactggaaacggagtagggttcaagccagatattctggacatggacgtgatggaaaaggtgctcgaggtgaaaggtgaggacgccgtcaagatggctcgagagctggcagtcaaggagggtcttttggtcgggatatcatcgggagccaacaccgttgctgctctcgagctagccaagaggccggagaacaaggggaagctcatcgtgaccgttcttccgagccttggcgagcggtacctgtcgtccgcgctgttcgatgagctgaggaaggaggcacaagccatggaaccggtcgcggtggattgatctcgccggtcaagctagctagcctgccgggcacgctggagatctggttcctatcgtcacagctgccagccaagccaattgtacttccattcccccctcatccagttttttattttattttaccgtcagtgtgtcacctcatctatgaaccttgcgaaaaggaaaaaaaaagtgcatgaataatgatgggaaaatgttgaaagagaaaaaaaaaaaaaaaaaagccatttgagatggccattctctctcctcgtgc

SEQ ID NO: 16332 - DNA, 959 bp, Zea mays
  misc_feature (867)..(867): n is a, c, g, or t
tttttttttttttttttcgcataatttatgaatacccttagtcattggtaatcgattgttcctttacctgtgtacaacctagaaccgttgaagcaaatggcgtttatttactgctaataattacaaatgaccaaacgaacataatattgcgaggaaaaatctctgtacaaagaacaaatgcatattgctatccataatagaccccaaaaaatattggtaacaggacagttgaagatcacgctagtaaattttagtagtccagttttttgttgctcttaccaaaagttggtctctatgatgtctagttcttattctgattggtggaatctgaagaagtgaaaactcactccttttgtctttggatattttccctccaattgtgtttgtctccatttcgattaccatcaaagtgggaatgagtacaccagttgttgtctgcatcatgatccggacaccttcagcaaagtggttgtgctgatgaagttacaccacattgttccccttgaagaaatctaccttctggtctcacagacagggttgtgtgcaggttcaatgtacgttaggtaaatacctggcatggaaatggattggaggctgactcatggagaccggagacgagagcgttgtcgcttctccagcggaggctgtgcgcgcgggggtcaggggggcatcgtcgcgtcgtgctggcgagcaggcagaaccggaggagatgggggagcgttgtgccttcccaccgctgtgatattaggcggcgacgaccatctccggatggcgaggaagcagcgacgaggagaaagatctctgctgcaccttgttcttgacgggtggatcgacatcagcatgtcgtgactaagaacgactcagtgncgaggcgtccggcacgaaaaagtgggggccccccggatgtgtggccatgcgtttcagttaaccagaaatcattatgaaggtcctggggaagg

SEQ ID NO: 16333 - DNA, 2009 bp, Zea mays
aaatttctccgtgagcggaagatccgatcaccacttcggcgccgcgcgtccgaaccccaacccaaccgcgctgtctatcctcctcctccctttccgcacttggtccggcgatcctgatcgaattggaaccgccttcacccccacccagtgcagtgctcgcgtgctccgctctgcgccggcagcccgcccggaccggaccaggccgtctctgcatttgcgcggatccgccggcgcggtccctgattcgggccgcgctctcgcagatgatggtggcggagaagcccgcgctggggttccaggcgcacggggacggggacgacgagctggagctggagctagcgtcgccggcgccgccgccccggaagatgcactcgctggaattcgagcacatcggctcgctcgccgccgtggccgagtcgctcgcgcccgggagcaggtggcagagggcgctcaccagcgtgcgcgtcgtcatcttccaggccaagatcaacgtgctcctccccttcggcccgctcgccatcatgctccactacctctccggaacgcaccaaggatgggtttttcttttcagcttaatcggcattaccccgttggccgagagattgggatacgcaactgagcaacttgcttgctacactggcccaacagttggggggctactgaatgctacatttggaaatgcaacggaaatgattatatcaatatacgcactgaaaaatgggatgattcgggtcgtccagcagtcactactaggctcaatattgtcaaatatgctgctggttcttgggtgtgctttctttgctggtggtcttgtccattctgacagggaccaggtcttcaacaaggcatcagctgttgtaaactcaggactactgttgatggctgtcttaggccttatgttcccagcagtgcttcatttcacacattcagaagcgcagtatggaaaatctgaagtagctctttcaaggtttagcagctgcatcatgcttgtggcctatgctagctatctattttttcaactaaagagccaccgcagtatgtacagcccaattggtgatgaagaagccgccgctgaggaggaggatgaaaaggagattacacaaggggaagccatctgctggcttttcatattgactatttggatttcagtactctcagggtacctggttgatgccattcagggtgcgtctgattcattaaactggccagtggcctttattagtgttattctgcttcctattgtggggaacgctgctgaacatgcaagcgccatcatgtttgccatgaaaaacaaattggacattacattgggagttgcgatagggtcatcaacacagatctccatgtttgtgattccattctgcgtggtaattggctggatgatgggacaagaaatggacttgaattttcaactgttcgagacagcgactctctttataactgtactagtggtggcattcatgctacaggaaggcacatcaaactattttaaaggtcttatgctcatcttatgctacctcatagttgctgcaagcttttttgtccatgtcgaccctgatgcaacaggtgataactaagtgacaaatctgcttacagcatacctgtgaactgaatggagaggctacgacctaactgcagagttagccaatagcattgccctgcgtagataaggacctgcaagagtcctgaatttggaagcaacttgtgggcagaatctcggaccgagggtttaacttggggctcaagattacaaggagctgatgcagcttttttaggatagcaacagcatcgcccgttgaggaactgtaactttatgtgacggaatcacaaaaatttaccattgtatttgttcaagctacacgtgccacagttttttatgttgtgattggtaggtacggggaagttagacctctagtgctattgggaagaaaattaccattacatttatttaatatattttcctttttttccttgtgaaaaaaaaaaaaaaaaaaaaaaaaaaaaaaaaa

SEQ ID NO: 16334 - DNA, 1439 bp, Zea mays
cattgggggcctcctcgccgccggcgggcaatcaccattacatttgatccgccgcgcgcggcccgatcgacgagcgagcctcattcacactccgatctagctagctagctagtttaggaaagagaaatctgaccacagggatgcggtggcggctgcagccggcgccggcgccggcgctgctcctcgtcctggccaccatcgccgccgtcgtggtggtgcgagcggagccccaggtgccgtgctacttcgtgttcggggactccctcgtggacaacggcaacaacaacgacatcgcgtcgctggcgcgggccaactacccgccctacggcatcgacttcgccgccggccccaccggccgtttcagcaatggcctcaccaccgtcgacgctatatctcggcttctgggcttcgacgattacatccccgcgtatgctggcgcgagcggcgatcagctcctcaccggcgtcaacttcgcttccgccgcagccgggatccgtgacgagaccggacagcaactggggcaacggatcagcttcggcgggcagctccagaactaccaggcggcggtgcagcagctggtgagcatcctgggcgacgaggactccgcggccagccacctgagccagtgcatcttcacggtgggcatgggcagcaacgactacctcaacaactacttcatgccggcggtctactccaccagccagcagtacacgccggagcagtacgccgacgtgctcatcaaccagtactcgcagcagctccggaccctgtacagctacggggccaggaaggtggcgctcatgggcgtggggcaggtcgggtgcagccccaacgagctggcgcagcgcagcaccgacggcaccacctgcgtgccgcagatcaacggcgccatcgacatcttcaaccggaagctcgtcgccctcgtcgaccagttcaacgcgctgccgggggcgcacttcacctacataaacgtgtatgggatcttccaggacatcctcagagccccagggtcgcacggtctgacggtgacgaaccaagggtgctgcggcgtcggacggaataacgggcaggtgacgtgcttgccgttccagacgccgtgcgccaacaggaacgagtacctcttctgggacgccttccaccccaccgaggcggccaacatcctcgtcggtcggagggcgtacagcgcggcgctgccgtccgacgtccaccccatggatctgcgcacgctcgccaggatctagctgtatggatcatgtgaactcgtgaagagaagcaaagcttacagcttcttcctttttttgttctttgtttcccctcgtgattgtattgcttaccactcgcaaaggcacgtatggtctctccatctaaactatatatataaacatgatatatactccctaaaaaaaaaaaaaaaaaaaactcgagggggggcccggtac

SEQ ID NO: 16335 - DNA, 4893 bp, Zea mays
caagttaaactgctactgctgacttcgataatattttcggtcagattggcaactgaaatcacgctggggatccatccattgtccatgcattaggcatgggcggcagcgagagaggcgcttgcacacttactgctgtctgaacgctcgcgcgctagaacctggaagactctcacgcgacgtgctatacgctacacgcctagtagacgcatgcactcgtagttgcagcgagcttcgtgtggtccataacttgtggctccgtgacttgctaacaactgtagccgtctacgtacccgatcaccgttcttttatttgcacgcgtcgggaatccccctacgacacgaagcaatgtacaacccagatgccttgttgcggttcagaaagcactacgttcatacaatttaatatatataataatttcggtatcttattcaatagaaccaattaagagaaccacgttaaagatgttttgtcatcaagatacatacttatttttttttttttgcaattattcgcttacctttaagattcgggtcatattaatatggattctacccaacattaattatttattcacatcgtttgcgctagctaataactggcgtgacggatcagctcgaagccttcgatgcgagccagccagccaaccaacgccggttagttgatcgtgtcctcgtcgtcaccgcattgaatgccacaaacgctatcgccagccgctcttttggatcgcgcgggagctttccatgcccgccgccctgcaggctgcagctggaagcctggacatttactatcaagtgatctctaccaagacggtgcaataaaatctcctagaacaagagagggagtcaaatccgcgtaaaccaatgcaagggtggtgcgcagggccccgcgggcaggcggtggcatgaagtttccgtttgcttgcatgtggagtgtctccggggccggtccggacgccgcgtgctggctggcctgtcttttcccgtgaccccatccgtttccaagccactccaacccagggagggagcacacgtacgcgccccggagggagtggcgacagtacggatggcatccgtgaacaaacaaaatattgccattattcaccaatcacatgctaataataagctcatacagtcattcactggaactggaagtacacacaccgatcgatcgacattctgacctccacatgcatggtaaaaccaaccaaccccagtcgactgtcgtcgcagaccggccggcagctagatctcgtcgctaggaatcaatcagcacaaccccaacctaaccgtgactgctcctccaaccatgcacgcgcacatgcagagggtcgccaatatgaatgctgatctagtgcttctagcaagtaggagtagtagcaaccaagctaccctatctataagtactacggctcgaatgtgtcggccgacggcaatcaccattacatttgatccgccgcgcgcggcccgatcgacgagcgagagcctcattcacaccccgatctagctagctagctagtttacgaaaaaaaaatctggccacagggatgcggtggcggctgcagccggcgccggcgccgacgctgctcctcgtcctgctggtggccaccgtcgccgccgtcgtcgtggtggtgcgggcggagccccaggtgccgtgctacttcgtgttcggggactcgctcgtggacaacggcaacaacaacgacatcgcgtcgctggcgcgggccaactacccgccctacggcatcgacttcgccgccggccccaccggccgtttcagcaatggcctcaccaccgtcgacgctatatgtaagcccatcgtactgcatatatatatcgatcgagctgggtttttttttgtttatttgtcacaactccatcaatatagctccatgcatacgttgtcatttttgctaccatataaagcttctagaatcataaagctggatgagatgggacgaagctgaaaacactagtttttcacgcatcttcaactaggctttgtgatcgctgtgtagaattaagtgtgaaatcacattttttttttctaaaaaaaatacattgcatacagagttatttttgccaaatgcatggttggacgacaacacggtttaggtttttttagcccacctgtttaagggctaaagtttagtaaccaagtctatgcgaacgaggtcgaagcaacatatccgtccattcagatgtcgttgtcaatgccaatgttagttccatgcatgatggcgtacgtacgtgcgcgacatgtcccttgacgcgcgcgcatcatgtattggtgtactcatgtgttgttttttcagctcggcttctgggcttcgacgattacatccccgcgtacgctggcgcgagcggcgatcagctcctcaccggcgtcaacttcgcttccgccgcagccgggatccgtgacgagaccggccagcaactggtactcacaattaagcatgcatgtgtttccatcgtagtagtacgtgatccaaggctcctagctagctcgtgagccgtgaaagatcagtaagcctaccctgacggctgacgcacacggaccacgcgcgccatggcaggggcaacggatcagcttcggcgcgcagctccagaactaccaggcggcggtgcagcagctggctgagcatcctgggcgacgaggactccgcggccagccacctgagccagtgcatcttcacggtgggcatgggcagcaacgactacctcaacaactacttcatgccggcggtctactccaccagccagcagtacacgccggagcagtacgccgacgtgctcatcaaccagtactcgcagcagctccggaccctgtacagctacggggccaggaaggtggcgctcatgggcgtggggcaggtcgggtgcagccccaacgagctggcgcagcgcagcaccgacggcaccacctgcgtgccgcagatcaacggcgccatcgacatcttcaaccggaagctcgtcgccctcgtcgaccagttcaacgcgctgccgggggcgcacttcacctacataaacgtgtatgggatcttccaggacatcctgagagccccagggtcgcacggtatgtatacacacgtcagtcaccaaacccaaatattagctgccttgttcagtatgacagtttatcccatcctgatcgatcgagctatgtatgggtttgtgtttgtgcaggtctgacggtgacgaaccaagggtgctgcggcgtcggacggaataacgggcaggtgacgtgcttgccgttccagacgccgtgcgccaacaggaacgagtacctcttctgggacgctttccaccccacggaggcggccaacatcctcgtcggtcggagggcgtacagcgcggcgctgccgtccgacgtccaccccatggatctgcgcacgctcgccaggatctagctgtatggatcatgtgaactcgtgaagagaagcaaagcttacagcgtcttccttttttttgttctttgtttcccctcgtgattgtattgcttaccactcgcaaaggcacgtatggtccctccatctaaactatatatataaacatgatatatactccctcgctcccgcccaatatatatactgttcgttgtacctttaaaattatgtgtccatattcaaatagatgacaatacatctagacacgtatataaattaaaacacatacatcaaatattgtatgaatttattaacactctaaaacgaatcctattttaggaccgagtgagtgccaacaacatacttctcctatcacgttcttttttgctcggaccaagcatggtcactagtagaaaagagggtgaggtttaatttttacatgcggtatcagtaatcaagcgtcaatgttacttttagtggcgttttttaacaaaatcgtctataaaaaatcataattctgcaaacagtttcccactagaagtccatgttttgacatgcagtttttttaagaaactgtgactaaaaatcgttttatcccttttttgagtttttcaaatggcctcgtttgaaaaaaccatcaacataaaagttatatatctctaaaagttatgaaactttgtagttgacaacttctttatttgaaaccattttgactctcaaaagttgcatctaaatttgttagatttaaaatgcaaattttgtcaacgaacttggatgagaaaaataccaaaataaacttgtaagttgacaaccttttcgtttgatttcgtttacaacctcatatagtcaatttatacttggattgttctaattgtgggcaaaaatactgcaatatagacatggagtaagtgatatagacatggagtaagtgatagacgaagtggtagaggttgaggtttgtgggttcgatttccacggccgcgtagccacgatttttatgcgaaaaatgccgtaacttgcgggcttgggtgaggcctcccctaaaataaataatatttttaaacccattcctaaaaaatattttcactagcggttttattatctcggccgctcatgtaaatcgatttccacttgcggttgcaattacccgcctatacaaataattatttctactggcccctagcaccgcaggtacaaattggttcacaaccacctatatagagcttctctgtaccagtgggtttagcacaatcgccaccgtgcgcagcccgacacgagacaccaggccatgcctcggccacctccccaacccaacatgagacatgactcaactcgaccgattcgctcggcttgcctcaaccgtagaggcccaagcccaacgacctaacaagagggcaggagccaggggatatataatcccccctccacggccatttgccttcctctaaaccctatcttccattttgttatggtcgctcgacttcctgtatgctatgtgtatatcccacgca

SEQ ID NO: 16336 - DNA, 1528 bp, Zea mays
cctcgaggcccgcccggaggagtagtagcaaccaagctaccctatctataagtactacggctcgaatgtgtcggccgacggcaatcaccattacatttgatccgccgcgcgcggcccgatcgacgagcgagagcctcattcacaccccgatctagctagctagctagtttacgaaaaaaaaatctggccacagggatgcggtggcggctgcagccggcgccggcgccgacgctgctcctcgtcctgctggtggccaccgtcgccgccgtcgtcgtggtggtgcgggcggagccccaggtgccgtgctacttcgtgttcggggactcgctcgtggacaacggcaacaacaacgacatcgcgtcgctggcgcgggccaactacccgccctacggcatcgacttcgccgccggccccaccggccgtttcagcaatggcctcaccaccgtcgacgctatatctcggcttctgggcttcgacgattacatccccgcgtacgctggcgcgagcggcgatcagctcctcaccggcgtcaacttcgcttccgccgcagccgggatccgtgacgagaccggccagcaactggggcaacggatcagcttcggcgggcagctccagaactaccaggcggcggtgcagcagctggtgagcatcctgggcgacgaggactccgcggccagccacctgagccagtgcatcttcacggtgggcatgggcagcaacgactacctcaacaactacttcatgccggcggtctactccaccagccagcagtacacgccggagcagtacgccgacgtgctcatcaaccagtactcgcagcagctccggaccctgtacagctacggggccaggaaggtggcgctcatgggcgtggggcaggtcgggtgcagccccaacgagctggcgcagcgcagcaccgacggcaccacctgcgtgccgcagatcaacggcgccatcgacatcttcaaccggaagctcgtcgccctcgtcgaccagttcaacgcgctgccgggggcgcacttcacctacataaacgtgtatgggatcttccaggacatcctgagagccccagggtcgcacggtctgacggtgacgaaccaagggtgctgcggcgtcggacggaataacgggcaggtgacgtgcttgccgttccagacgccgtgcgccaacaggaacgagtacctcttctgggacgctttccaccccacggaggcggccaacatcctcgtcggtcggagggcgtacagcgcggcgctgccgtccgacgtccaccccatggatctgcgcacgctcgccaggatctagctgtatggatcatgtgaactcgtgaagagaagcaaagcttacagcgtcttccttttttttgttctttgtttcccctcgtgattgtattgcttaccactcgcaaagggacgtatggtccctccatctaaactatatatataaacatgatatatactccctcgctcccgcccaaaaaaaaaaaaaaaaaggtggccctttaaaaaaaaaaaaaaaaaaagcggcc

SEQ ID NO: 16337 - DNA, 2582 bp, Zea mays
ctgcaggaatgtttttgaggagcttgcaaatcttctatcaaagagtgcttttcctatcaactgccccttatcttccatgcacattcttgctctagaaggtttgattgctgtgattcaggggatggctgatcgtatcgggaatgcagtctcacgccctgagctcctgcctgtggagcttgatgaatacactcctttctggactgttaagtgtgagaacttttctgatcctcggcattgggtgaagtttgtccgtcaaaggaagtatgtcaaaaggaggctaatgattggtgctgatcatttcaacagggacccaaagaaaggtctggagtttcttcaaggcactcatctgttgcctgagaagcttgatccccagagtgtggcttgttttttccgctatacagctggtttggataagaatcttgttggagatttcctaggcaatcatgatgagttttgtgttcaggtgcttcatgagttcgctcagacctttgatttccaggagatgaacctggatacagctctgcgtctatttttggagactttccggcttcctggtgaatctcagaagatacagagggttcttgaggccttctcagacagatactatgagcagtcccctcagtctttcgcaaacaaggacactgctctactgctgtcatattccattataatgctgaacactgatcagcataacatgcaagtgaagaagaagatgactgaggacgacttcatcaaggccggccggttcccaaatgggggcagtgatctcccacgtgagatgttgtctgagctatatcactcaatctgccgaaatgagattaagacaacacctgagcagggtttgggatattttgaaatgtctcctagtcgttggatagatctaatgcggaagtcaaaatctacgtccccatatatcatcggtgactctcagcctttcctggaccatgatatgtttgctgttatgtctggccctactattgctgccattgcagtggtattcgatcattcggagcatgaagaagttcttttgacttgtatagaaggctttttgggtgttgcaaagatatctgcatttcatcatctcgaggatgttctggacgatcttgttgtttctctatgcaaattcacgactctcttgaatacttctttggttgaggagccagttactgcctttggagatgaccttaaagctaggttggcaactgagacattatttactatagctaacagatatggggattatatacgcaccggctggaggaatgtattggattgcatcctgaggctgcataaacttgggcttctccctgcccgtgttgctagtgatgcagctgatgattccgaacttcctgctgaagcagtccaacgaaaggctgctcctagttcagttcccccatctcatattccagtgatgggcacacctcgcaaatcatccggactcatgggaagatttagtcagctgctctctcttgacagtgaagaaccaagatcacaaccaactgagcagcaacttgccgctcaccagaggactcttcaaacaattcagaaatgccgcatcgatagtatatttacagagagcaaattcttgcagcctgattcactactgcaacttgccaaggctctgatttgggctgcaggccggcctcaaaaggttgccagttcgcctgatgacgaggatacagcagttttctgcttggagctgctgattgccataacccttaataatcgagacaggatcgtgctcctctggcaaggtgtatacgagcatattgccagcatagttcagtccacagttatgccgtgtgctctcgtggagaaagctatttttggactcctgaggatatgccagaggttgctaccatacaaggagaatcttgctgatgaattactgaggtcgttgcagttagttctcaagctcgacgcacgggtagcagatgcgtattgtgagaacatcacacaggaggttgcacggctcgtcaaagcaaatgcggcacatataaagtcacagatgggctggagaacagtaatattgctgctctccattacagcacgccatccagatgcttccgaagtcggttttgaggctatcgtgttcatcatgacagagggggctcacctttcactagcgaactatggcttctgcatcgatgcggcacggcagtttgccgagtctagagttggtttagctgataggtctgtccgtgccctggacttgatgtccgactccgtcagaaaccttgccttgtggtcccaagagataaaagcgacgacatttgaagaaggcgagaaagggccggaggcgataagggagatgtggctcaggctgctgcaagcactgaagaaactgagcctggatcagagggaggaggtgcgaaaccatgcgctggcttctctccagcgatgcctaacatccacgggagaactctgcctccagtccgcgacgtggtcccatgcctttgacctcgtcatattctccttgctcgatgatttgctggagatcagccagaaccactcccagaaggactacagaaacatggaagggtcacttgtgctcgccatgaagctggttgcgaaggtatacc

SEQ ID NO: 16338 - DNA, 1111 bp, Zea mays
gtgcgtctcctctcgcgtccccgtcttcctcttgtcgcctgcctctgcggctctgcctacctctctcgaagcttctcgcgtctcctgggtggccgtgtccagtctcccacgccaccgccccgaccgccggtaggtaataccagttccaagagcactcgacatggcggccgctaatgttggggaatcaacaagcggcggcggcagcagcagcagcagcggcgccgacgccgggggcggattcgagtgcaacatatgcttcgagctgccgcaggagccgatcgtgacgctgtgcgggcacctcttctgctggccgtgcctctacaagtggctgcgcatccactcgcactcgcccgagtgcccggtgtgcaaggccgtggtcgaggaggagaagctcgtgcccctgtacggccgcggcaaggaccgcgtcgacccgaggtccaagaacgtccccggggcggccgacatccccagccgtccggctgggcagaggccggccacggctccgcaggcggaccccaacaacgcccacttccccaacgccgccaacccggcgaacccgtggttcatgggcggcggcggcggaggcatcccgctggccaacgcgcgctgggggaactacaccttctcggcggcgttcggtgggctgttcccgctgctcagcttccaggtgcacgggttcccggacgccacggcctatggccagccagctgggttcccgtacgggtacggccacggccacgcttttcatggcgggcacgctggagcacatgcccacgccgcagctgcagctcctcgggcacgcgcagcaccagcagcagcaggcggatgtgtaccttaaggcgctgctcatcctagtcggcgttctggttatcgcgagcctcgtcacgttctagggcgtcgcctgttggtaggtgttcatcatattgttgctgccttgctggtaataaataagagagagagacagagacaacacgaccgaaactgaattattcagagcggtgcaatgtgttgatagaagggttgttgttgtacatgctgatacatgattgtatactgtggtctttgaacatacattattatcgaataataatctggaggctctgtttgaagt

SEQ ID NO: 16339 - DNA, 2039 bp, Zea mays
ctcacgagaccgtccaggcgtccaccgcgacgcgctctcctgcccgtgcccacctccacgactccacctccgcagcgcccgcagtaacctccccacgccacgccacatcgcgtgcgagccccaaccgtcgccggcctcccaattaagccgcccccgcggcgcgatccggtgtccaccgctgctccgccggaggagggggaaggggaagaaaagggagggggggagcacagggggatgctagaggcgaagccgccgtcgccgggctccggcgcggccggggcggcggcgcacatccacggtcaccggcggtgggcggcgccgctgctggcctcggttctgctctcgtcgctcctcatcaccgcgtcgctcttcttttcctcctcccgcgcgctgctactctccttctcgccgctcccctccgcggcctccgccgagcctctcttcgtcgaggccaagctccgccagcagatgcgggccgaggagcgccccacgcggggcgccgtgcccaggatcgcctacctcatctccggctccgcgggggacggagccgcgctgcgccggacgctcagggcgctctaccacccggtaaacacatacgtcgtgcacctcgacctcgaggcccccgccgccgagcgcgccgaactcgcctctgccatccacgcggaccccgtctacgctaggttccgcaacgtcaaggtcgtcacacgggccaacttggtcacctaccgtggcccgaccatggtggccaacacgctgcacgcggctgccatcctgctgcgcgagggcggtaattgggactggttcatcaacctctccgcctccgactatccgctcgtcacccaggacgatctattgcatgtgctttctgagttgcccaggcagcttaacttcattgagcataccagtgacatcggatggaaggagtaccagagggcgaagccagtgatcatcgaccctgggctatacagcctgcagaagtctgacgttttctggataacagagaaaaggagtgtcccaactgcattcaagctcttcaccggctcagcatggatgatgcttactcatcagttcattgaatattgtatatggggatgggacaatctcccaaggacagtcctgatgtattacgcaaattttctttcttcaccagagggttacttccacactgtcatctgcaatgtccccgagttccgcaacaccacagtcaaccatgatctacatttcatttcttgggacaacccaccaaagcaacaccctcattatctcacactcgctgacttcgatggtatggttaacagcaacgcaccctttgcaaggaagtttggaagagaggatcctgtgctggacaagattgaccaggaactgttggcccgccgacctgatggatttgtgcctggtggatggacagacctactgaacacaactgagaaagggaaacccttcacggttgagcgcgtgcaagatctccgcccaggtcctggtgtggacagattaaagaaactcgtcacaggattgctcacccaagaaggttttgatgacaagcattgcctgtgaaactcccagtaagatgattctggggcagtaggttacacgctcaaatttgaaggcatcgggccatttgctaggaatgcccctactagctgaggcagcagcacattagcgtcatgtacgcgaggatgcaacgataaggaaggtgctcttacagacaactgcttgagttgagttaccgtacagcaggagaccacggatgtagcagtcggagatgattatacagaactagtagctcattagtttatttagatgattataatcagccccccaaccatgaataatgttggaatttttgacatttctgcgcccgagggttgtgcaaggtagcccattctttgtttcgaagccatggcacctggtgcaccagctggtagcgtgagacttcgttgtattgactagtggatgtttctgggtaaactgatacatttgattgcacacatgtattgatttgtttcttttctaaaaaaaaaaaaaaaagaagatgccat

SEQ ID NO: 16340 - DNA, 2095 bp, Zea mays
  misc_feature (2092)..(2092): n is a, c, g, or t
actcacgagaccgtccaccgcgacgcgctctcttgcccgtgcccccgtcctccccttccccctccacctccgcggcgcccgcggtaacctcgccacgccacatcgcgtgcgagcaccaaccgtcgccggccctctaattaagctgcctgcgcggcgcgatccggtgtccaccgctgccccgccggaggaggaggaggaggaggaagggggcggggggtggagcacagggggatgctagaggcgaagccgccgtcgccgggctcctccggcgcggccggggcggcggcacacatccacgctcaccggcggtgggcggcgccgctgctggcctcggtcctgctctcgtcgctcctcatctccgcgtcgctcttcttctcctcctcccgcgcgctgctcctctccttctcgccgctcccctccgcggcctccgccgagcccctcttcgtcgaggccaagctccgccagcagatgcgggccgaggagcgccccgcgcgcggcgccgtgcccaggatcgcctacctcgtctccggctccgcgggggacggagccgcgctgcgccggacgctcagggcgctctaccacccggcaaacacgtacgtcgtgcacctcgacctcgaggctcccgccgccgagcgcgccgagctcgccgctgccgtccgcgccgaccccgtctacgccaggttccgcaacgtcaaggtcgtcacacgggcgaacctggtcacctaccgtggcccgaccatggtggccaatacgctgcacgcggctgccatcctgctgcgcgagggcggtgattgggactggttcatcaacctctccgcctccgactatccactcgtcacccaggacgacctgttgcatgtgctctccgagttgcccaggcagcttaacttcattgagcataccagtgacatcggatggaaggagtaccagagggcgaagccagtgatcatcgaccctgggctatacagcctgcagaagtctgacgttttctggataacagagaaacggagtgtcccaactgcgttcaagctcttcactggctcggcatggatggtgctcacccaccagtttatcgaatactgcatatggggatgggacaatctcccaaggacagtcctgatgtactacgccaatttcctttcctcgccagagggctacttccacacggtcatctgcaacgtgccggagttccgcaacaccacagtcaaccatgacctgcatttcatttcctgggacaacccaccgaagcagcaccctcactacctcacgctcgctgacttcgacggcatggttaacagcaacgcgccctttgcaaggaagttcgggagagaagaccccgtgctggacaagatcgaccaggagctactgggccgccggcctgatgggtttgtgcccggtggatggacgtatctactgaatgcgacgactgaggaagggagacccttcgccgttgagcgcgtgcaggatctccgcccagggcctggtgtggacagattgaagaaactcgtcacgggcttgctcacacaagaaggctttgatgacaagcactgcctgtgagactgccccccagtaagatgattctggctgggggcggtagattacacggtcaaatcttgagggcattgaagccattttctgggaatatgcctactggctgaagaagcagcacatagtatcatgtgatgtacgcgtggatgcgagcaacggtaagataggtgctcttacagacacgccgcctgagttgagctactaccgtacagcaggaggccacggacgtagccggcggagattatacaggaatagtagctcattaggttatgttagatgactatatcagccccttcccaaccgtcaataatgttgggaattttgacatctccgcggcgctgcgggttgtgcaaggcaggcaggcagtccattctttgcttggatgccatggcgcctggtgtaatcaactggtagcgtgtgaggaggcttcgttgtattgactagtgcatatttctgggcaaaacagatgcgtttggttgcacacatgtattcttttatcccttttcctctttgatgatgagtatagcagaaaaaaaaacagttnaat

SEQ ID NO: 16341 - DNA, 3381 bp, Zea mays
  misc_feature (1218)..(1218): n is a, c, g, or t
agaagcaacaacaacaacaggtacaggaacaggaagcaacaccatccatggaacatctacatcttagttcatggcttggcttcatgctggtatagtcctgctatttattagttaccttgctgttgtctgtgtgctatttattagttcatctacatcttttttggttgctggtatgaagcaggaactgaagcctggtatgaaacagaatcacttgttatgtgtcgaccatggtttgagatgtgtgtttctctttcgttagggatttcatttagatattcctgattgaaatcacctggtctttgttctgcgccaatttgctcaccattctgaatttctgactagtgaccatctgctaatatttttaccatctaaactttcattagtagcgcttacatcaaacctcctctgctgaaatctctagactgaattagtgttgtctgccttttgctgttgaacaggtacaccgtacaatacatgtatggactatggactatggtatggagacatggagttgtgcacttgtgttgtacaacatgtagtcctgtgctagtgtgcctgtgcggttgtgtctgttgactgttgtgccttactgccttgtgcgcgtgtgcctgtgcctgatgcctgtggccctgtgtggttgtttattggagaggagagtggtcgagacgtcgagtgctggagtctggagaagtggagaggagagcgaataatgtgtactgtactactgttgttgacttgttgttgtgtacttgtgttagtgtgttctctaattctcttgctctctattatgtgtgattgcgagactaatactattagtgaatctgtgactgtgtgctctatgctatatgactatgtgtgacatctcaactggaatattgtttcactgtttcaatttttaaatattgttgctagacgctacatgctcgaatatatcgggtattttgttattacccgaacccgtacccgaaagtacgggtacccaaaattacgggtacccgacattacgggtacgagttcgggcttaaatgtttaaaacccggaaatataaaaaaacccgaaaaccccgacccgaaataccgagtaaacccgaacgcccagctgtaccacttaccatggtacggtgctagtgtctagggaaaaaatgttgtgtcccctgttcgcgtgccctcagtggcgtagtcaaaagtggggttggaagttacttgttatgatttgtgnctattgtatattacatactaattagttgaccgtacatcgctatggttttatatattatatagttagatgtacttaaataagatatttatttaaatacgattatatttctttattttttaaattattactatataaatatatttataatatctctcatttatataacacaaacaaacataagttgtagtggtagaagacaaacaaacataagttgtagtggtagaagccaagtgctatctactaagtgagtagagtttgaatccttcacaccctattttttggatatttttcacaggaaggaaatttatttccttgttgtgctcgctgaaggagacaacatacgaaaaaatttacacttaaatacagtagagtatatatatatatatatactctatttattaatattataactatatatatatatagttatatatgtgttggccctaaggaaaaatcctgctacgcctctgcagcgtgccctacagtgcacggcaccgcagcacacacatctcacacgcggatagcgccagacgagagcgcggccacatggcccgcatgaacggagaacgacgcgcgccggcgcccgtgcgctccgatcgcctaccgtcgataggccaagcgttccctgagcggatcatggccacacgcggacggcggatcgcccggagccccgcaccaaagcacaccggccacgtcgcgcggcggtcggcgcccgtcggcgtcgctcgttaaaccaaaaaggcgccattagcctgacggcagcgacggacaccgacgagcccgcgccgcgacgcgcgccgaattaactccgccgttgaacgctccgccgcgttgcgcatggaggcatgctttgtttgcttccgaacgccgccgagagcgaggcataggcgcatgtgcatgtgcgtgcctgcctgccgccagaagtagccttgcccgcgcgcgcacggcggctggcccgtataacgtgacgttcgcttgggattttgcaggcaggctgttagcgtcgtgacgtgcaagcgaactgggttcgcacagctgtgcgatctgcgtccgagaggcgacggcgctgtccacgtctcgccaccgtatggtccacggcgtcgcaccgtgcgcgtttgcaggtgctgggtgctggctcaggtgcccgccgctgggccggccccgccccgcccgggacacgctcgcgattcaacaaagacgtacgtacatgcacaaaactagagcgagctgtgtgtgtgtgtgttcgtcatttcctcgatcatggcgaaggcgcaggcgcaggtggcggcgaggttcatgatggaggcgccgccgccgcaggtggtgtcggtcatgcggcggaggaaggcgccgaggagcctgagcaccatcgccgaggacgacagggagatgctggcgccgtgcgggtcaccgtcggaccacggccacgtacatacacataactagagcgagtagagataccgtctcttactgtgtgtgtgtgtgtgtgtttatcaactcctcgatgcatggcgaaggcgcaggcgcaggtggcggcgaggttcacgacggaggtggcgccgccgcaggtggtgtcggtcatgcgacgaaggaaggggccgaggagcctggacaccatcgccgaggacgacagggagcagcagctggcgtgcgggtcgccatcggaccacggcctcgcgacggcgtggtcgtcgctccagaggataccgacgccaccgcagccgccgcgggagcgcgcaggtgggtccgtgacgagggacctcagcaagaacttcttggactcccacggctgccagcaggccagcggctgggagggtggacacatgctaggccaccggcgagccgtgcatgcgctggagcttcacaaggtcggagcttgttgaagagggaagagagaaaatctagcttagctgcagtgagcttgttcgggagaaatatatttgtaccacttccacacgtgcgctcatgcatgatacttcctccgtttttttatttaccacattttagtaaaaaatgaactagcggctgataaatattcaaaaacggagataatattattttggcttagctttatcaagaaaaaaaaaaaaggcacagcggcctgctgtgaagttgtttttcatccagcttcaatttcgcttgaaataactgtaatagttaatc

SEQ ID NO: 16342 - DNA, 870 bp, Zea mays
  misc_feature (834)..(834): n is a, c, g, or t
cctcgaggccggccggggcacacgcttcgcgattcaacaaagacgtacgtacatgcacaaaactagagcgagctgtgtgtgtgtgtgttcgtcatttcctcgatcatggcgaaggcgcaggcgcaggtggcggcgaggttcatgatggaggcgccgccgccgcaggtggtgtcggtcatgcggcggaggaaggcgccgaggagcctgagcaccatcgccgaggacgacagggagatgctggcgccgtgcgggtcaccgtcggaccacggccacgcgcaggcgcaggtggcggcgaggttcacgacggaggtggcgccgccgcaggtggtgtcggtcatgcgacgaaggaaggggccgaggagcctggacaccatcgccgaggacgacagggagcagcagctggcgtgcgggtcgccatcggaccacggcctcgcgacggcgtggtcgtcgctccagaggataccgacgccaccgcagccgccgcgggagcgcgcaggtgggtccgtgacgagggacctcagcaagaacttcttggactcccacggctgccagcaggccagcggctgggagggtggacacatgctaggccaccggcgagccgtgcatgcgctggagcttcacaaggtcggagcttgttgaagagggaagagagaaaatctagcttagctgcagtgagcttgttcgggagaaatatatttgtaccacttccacacgtgcgctcatgcatgatacttccctccgtttttttatttaccacattttagtaaaaaatgaactagcggctgataaatattcaaaaacggagataatattatttttggcttagctttatcnaaaaaaaaaaaaaaaaagcgggcctcgagctccagc

SEQ ID NO: 16343 - DNA, 907 bp, Zea mays
ttttttttcttctctccccaccccctctcacccccaccccactccactccactccacccgcgcacaacagatcgcacgcctcggttccctccactcgacgcttctcccgctcctaacccctagtaccttcgctcgctctgccgcctccgccgacgacgcgccagatccgcgcagcagtggtgtcctccgccgcggatcgagctcccgatccgcgcagtgggagtggcggcgagcgcaggagcgctcggccgggggttccgcgaggctggagacggaggaggaagggagcggtagttccgcggtggtagatccgccggtcctgtcgccggagatggactcatctgtcgagaagcaggggagcgtggcgctggatccggacgagcgcgcgccggcgtccggcgaaaccaaggcctgcaccgagtgccacaccaccaagaccccgctctggcgcggggggccctgcggacccatgtcgctgtgcaacgcgtgcgggatccggtaccggaagaagagacgggaggccatgggcctcgagtccagcagcaaggccgccaccgccggcggcagcgagcaccagcagcagcagcggaagaagaaggccaccgcggcggcggccgccgcctcctccaagcgggagcgggagcgtgagcgggagcggaacaaggaggcggacgaggtcaccgtggagctccgcgcggtggggttcggcaaggaggtggtgctgaagcagcggcggcggatgcggcggaggcgccgcctgggcgaggaggagcgcgcggccatcctgctcatggcgctctcctccggcgtcgtgtacgcctgacttggctagcaaccgcgccggcccccgagacgccgcgcccaaaggcggcgaaaggagaggagggcccgattcgctggacgtgcg

SEQ ID NO: 16344 - DNA, 7969 bp, Zea mays
ctgcagcatagattggcatgctggcatgcataggtgcgttacgcagtcgcccgtgctgtcacgtccggccgatcactgtagcggacccaatacccgaccgaatgatgcttcatgatggtgtcacacgcgtgtgtgacacacaatggccttggtaactcgcgcatttaatgcgcgcggcgctgccatgctacaacgcacctcggtaacatgctgggcggtcacagaggcttgtcacaagcctgccaatgctttgcgcttggtttgggtacgctgcagccgccttgcatctgatgcgggctgaggctttgcttccatgcaaaggtttacaccttgcgcccagcagccacgtggcgtcaccggacccttggctgggtccagagcagagcttgagggcatgttctgccctgaagcaccgagaggccctgatggcgactcggaccccacagggggggggggggtccgagtccctactcaggggtccggtccatacacgtggaggacctaggcctttcagggggggactgcatacatgggggttcgggttccacccatgggggtccaaacccgttggtgaagtcctttggcatagattagagataaccgtgtgggtactgtgtttcccgttggtgaagtcctttggcacagattagagataaccgtgtgggtactgcgttttgatacaatagtaaggggtaccccagttctgtggtaccgacacacacatattaagcataacataccggctgattctaccaacacgctaacaacacgtccatccacttgctcttaaacgaaaacaacaacacatcaacctctttcacgtgttatgtatgttacactaaacaattgtgctgttcctttttcagcaaagaatcttgctcttgctggagtcaaatctgtcaccatacatgatgtcaaaatggtggaaatgtgggacttgtctggcaatttcttcttgtcagagcaagacattcggaaagaacagggctctagcttgtgtctctaagctgcaagagctgaataccgctgttctggtctctgctctgacagaggaattgacgatagagcacctgtctaagttccaggttcgtctctagtactcagtaccatctttcattgctttcgacttgcagtatcctttggtcttgatccagtgaatctgtgatgcttgtcgttgttgctagcagcgttatttatctgttgcctgctaaagcattacatttctgatttcacacctttcttgtctatttgctatgattgcttaacccacagcgtgctcgattgcgcaggctgttgttttcactgatataagtttggagaaggcttatgaatttgacgactattgtcacagccaccagcctccaatctcttttatcaaagctcaagtctgtggccttttcggtagtgtcttctgtgattttggacctgagtttactgtccttgacgttgatggtgaagatccacatactggtataattgcatccatcagcaacgacactcctgcaattgtatcctgtgttgatgatgagaggcttgagtttcaggacggtgatcttgttgttttctctgaggtccaaggcatgacagaactgaatgatggtaaaccaaggaaggtaaaaaatgctaggccgttttcatttagcgtcgaggaggacacaagtagctatggtgtttacacaaaaggtggtatcgttacacaagtcaaagaaccgaaggttctacgtttcaaggcactaagagatgcaatgagagatcctggtgatttccttctgagcgacttttcgaagtttgaacattcacctgtgcttcatctagcctttgaagctctggataagtttaagaaggagcatgtgcgctatcctaccgccggctgtgagcaggatgctcaaagtttcctgaagtttgctgctgatattaatgaagcatctgttggttctaagctggaaaacattgatgaaaagttgctccgtcatttcgcaagtggttctcgagctgttttgaacccaatggccgcaatgtttggtggtattgttggccaggaagttgtgaaggcatgttcagggaaattccatccgctttaccagttcttctacttcgattcagttgaatctcttcctacatatcagttggatccccaggacttgaagccttcaaatagccgctatgatgcccagatctctgtatttggttccaagcttcagaaaaaactgctagatgcaaatgttttcattgtgggttctggcgctcttggatgcgagttcttgaagaatcttgccttaatgggtgtctcctgcagctccaagggaaagctaactataacagatgacgatgtcatcgagaaaagcaatctgagccgccaatttctattccgtgactggaacattgggcaagcaaagtctactgtagctgcagccgctgccattgctatcaatcccagcttacaaattgacgctcttcaaaaccgtgcttctccagataccgaaaatgtgttccatgacacattctgggatggtttggatgttgtcatcaatgcccttgataatgtgaatgctaggatgtatatggacatgaggtgcctgtacttccagaagccactactggagtcagggacattgggcgcaaagtgcaatacacaaatggtcattcctcaccttactgaaaattatggagcttcaagagacccacctgagaagcaggcacccatgtgcacagtccattcttttccacacaacattgaccattgcttgacatgggcccgttcagagtttgagggtttgctagagaaaacaccaaatgaagtaaactcttttctgtctaatcctgctcaatatgctgctgtcatgaggaaggcaggtgatgcccaagcaagggaattacttgaacgcgtctccgaatgtcttgacaaggagcgatgcaatacatttgaggactgtataacttgggctcgattgagatttgaggattatttcttaaaccgcgtgattgtcagctttctttcacttcttctgtatatggtatatgtttctattttcttgacttctctgggattccacatcttcctcttacccagcttatgataaatgaattatcagttttatgacattgtactgctaatttaaccagttgattccatttgtagctgaggactgttaaaatttaagaagtaatattgtattttgatcacgcaaattcagtttgtttttcttggacatgcatctttctttatttagcttttgtgcaagattaactgatttcatctgtttcatgtcagatttgaggattatttctcaaaccgtgtgaagcagcttacattcacttttcctgaagatgctgctactagcacaggcactcctttctggtcggccccaaagcgctttccccgccctctgcaattttcagccactgattcatctcacatcaacttcctcatggctgcttcaatactgagggcggagtcatttgggattgctatacctgagtgggcaaagaacactagctagctggccgatgcggtcaataaggttgcagttcctaaatttgagccaaagaaaggggtgaatattgtgacagatgagaaggctactaacctttctagcgcctcagttgatgatgttgctgttattaatgatcttttggcgaaactggaagaatatgccaagggcctgccaccagggttccaaatgaaacctatccaatttgagaaggtaagtattccaaatgaaactcaatttgagaaggttccccaacgtgcacttttcttttattaggattttgtttgttcgagtcagatggatatgaatttaatagcatgcgctgctttctttccccaggatgatgatactaattttcacatggatttaatagctgggcttgcaaacatgcgcgcaaggaattacagcattcctgaggttgacaagttgaaggctaagttcatcgccggaaggatcatcccggccatcgcaacttcaacagccatggccacaggtctagtgtgcctggagctgtacaaggtcattgctggggagcaccccatggaggactaccgcaacacattcgccaacctagctatacctctgctgtctatggcggagccggttggggccaagctgatgaagcatcaagatatgaggtggaccgtatgggaccggtggactatcaggggcaacctgactgtggcggaactgctgcagtggttcagtgacaagggcctcagcgcctacagcatgtcctgcggcacctgtctgctgtacaacagcatgttcgcgaggcacaaggagaggctgcagaggaaggtggttgatgtcgccagggaggtggccaaggtggaggttcctgaataccggaggcacatagatgtggtggtagcatgcgaggatgacgatgggaatgacattgacattcctctagtctcggtgtacttccgatagtctccctctatctgcacatacaaagtcaagtctattatgtcgtccaagagaacacattcggtcatctggaacgataaacagacgatggactgcattcaatcaaattcccatgccaagggctaatttgggaacctattttttaaggcatttctatttttccaattaaaaatgaattaatttctcttgaaaaatagaaataccttgagaaaatggggtttctaaactacacccaaagagatttactagtcacaagtaggaccggaaaccggaaacgagctgatctcggcttggtaacccagctagttagtcttggctcggtgagttgagagacctagcttgattcgggcttgtttaggctcgtgagtccacttgagagccaccacattaagtcttaatttagagtataaattatatatttttattatataaaataaaaatataagttaaaaatttagtaacatattttaaactatatctagtattgagttcgttgcggcgacggtggataaggaggcaggggcacgtcgtgtagtttacactatgtgtttaataggtagtagagatattttataacatacgtatagctaacaaaaaatgatcaattattgactagtttgttacgatgtgacatggtcgtctttgatttatttattgcatgatctaatacatgatattatatgactaaaactgagatatctcgattaaaacgggaaaaatcgaaaacgttcaaattgtttctgtccagtttttatatttgtctaaaacaaaaaaaaacgatcgaaatatctaaatatgaatttgaataggttaatatagaaattggtgtgaaactaaacggtatatatctctatcattgtcacctctagtcacgccatggagggagtttcaggaggtcaccatgtccatgtggttctccgtcggtcttaaaatggtggtgttttgtcacgtacaaaataagggagttatttgtagttcaatagacaaacgttcatgacttggtccccaatcccattttaattaaagcgtcgtgttacacaagtcaaccaaagtcaatcgccgcgcttaatttgctctcgcccgcccgcccgctacgtctcccatttccttattaaaaagaaccaaatctatccatgcatgaaagcatctcgtctccttggacaccagcggcatcgtcgggtccgtgggcgggcacaggcccgcggcgagcggcgcggtggcctgccctgcatccggcgtttcaggcttcatcacgtccaccggcggcggcggggagcctcctcctagggacgcgaccctgggccggcacctggcgcggcggctggtgcaggtgggcgtgagcgacgtgttcgccgtgccgggggacttcaacctgacgctgctggaccacctgatcgcggagcccggcctccgcgtggtcggctgctgcaacgagctcaacgccgggtacgccgccgacgggtacgcgcgcgcgcggggcgtgggcgcctgcgttgtcaccttcaccgtgggcgggctcagcgtgctcaacgccatcgccggcgcctacagcgagaacctgcccgtggtgtgcgtggtgggcgggcccaactccaacgactacggcaccaaccgcgtcctccaccacaccatcggcctcccggacttctcgcaggagctgcggtgcttccagcccgtcacctgccaccaggccgtcgtcaacaacctggaggacgcgcacgagcagatcgacggggccatctccacggcgctcagggagagcaagcccgtctacatgagcgtcagctgcaacctgccggggctgccgcatccgacgttcgccacggaccctgtgccatacttgctggcgccaaggcctagcaacctgacgggtctcgccgccgccgtcgaggccaccgtgtcgttcctcgacaaggccgtgaagccggtggtggtggccggccccaagatccgcgtggccaaggccgccgccgccttcgtggagctggcggaggcgagcgggtacgcggtggcggccatgccgtcggccaagggcctggtgccggagacgctgccgcggttcctgggcacctactggggcgccgtgagcacggcgttctgcgccgagatcgtggagtccgccgacgcctacctcttggcgggccccatcttcaacgactacagctccgtgggctactccatcctgctcaggaaggacaaggcggtggtggtgcagccggaccgcgtcaccgtcggcaacggccccaccttcggctgcgtcatgatgagggacttcctgtcggcgctggccaagcgcgtgcgccccaacaccaccgcctacgacaactaccggaggatcttcgtccccggcgggcagccgcccgagtgcgaggccggcgagcccctccgcgtcaacgtcctcttcaagcacatccagaggatgctcagcggcggcagcgccgtcatcgcggagacgggagactcgtggttcaactgccagaagctgcggctacccgacggctgcgggtacgagttccagatgcagtacgggtccatcggctggtcggttggcgcgctgctcggctacgcccagggcgcccccgacaagcgcgtcatcgcctgcatcggcgacggcagcttccaggtgacggcgcaggacgtgtcgacgatgctccggtgcgagcagaggagcatcatcttcctcatcaacaacggcggctacaccatcgaggtggagatccacgacgggccctacaacgtcatcaagaactgggactacacgggcctcgtcgacgccatccacaacggccaggggaggtgctggaccgctagggtggccacggaggaggagctcacggcggccatcgccacggccaccggcgacgacagaaaggactgcctctgcttcatcgaggtggtggtgcacaaggatgacaccagcaaggagctcctggaatggggctccagggtctccgccgcaaactccaggccacccaacccgcagtagcttccttgtgtcatcatgaaataaatgaatgaataatagatcaaagtggatggcgaagtactagtatattgttaacagggaaaaccaaatattgctaggagcaaagtaaaaaaaataacatgcgaatgtggctgctgggattcgagcccaggtctctacggccacaacgtagaattctgaccactaaactacagccacttttaagtttgttttatgaaattgtattttattaatgagtttgacctcgtctaggttccgttatttgtaggagctagctattacgtgtgcgagcaaagcaacttcatgttaggaacggaacggtagctaatcaactgtaatagtacattgacactttccacgaaatactacctccattttttctatttgatgtcagataattcatgtttatactaacaaatatcaaataaaaaaaatggagggagtatcatgctaggataatggataatagacatgggaaactcaattgactaacaagattattcactgccacgccatcacataaaaaatatatatgcttctattaattgcaaagctaaat

SEQ ID NO: 16345 - DNA, 2257 bp, Zea mays
ctcttcaaagcggaaaacctcagaaaaccacaatgaatcatcctcgtccaccactgcccccgctctgctgcaactccactcggcccggccgccctttccacccaccttgagcctctgatccgttggtgcttgaccgatccatggacacccatatcggatccgtgaacggggcggcgtcgaaccagacgggtggctgcccggcgtcggcgccggggtgcccgatggcgtccacgccggcgcagcccgcggcgaccctgtcggcgggggaaggcgtcgctggggcgccacctcgcgcgtcgcctcgtgcagggcggcgtcaacgatgtattcgcgggtccgggggacttcaacctcacgctgctcgaccacctgatcgccgagcccggcctgcgcctcgtcggctgctgcaacgagctcaacgccgggtacgccgccgacgggtacgcgcgcgcgcgcggcgtcggggcctgcgccgtcacgttcacagtcggggggctcagcgtgctcaacgccatcgcgggcgcctacagcgagaacctgcccgtcatctgcatcgccggcgggcccaactccaacgactacgggaccaaccgcatcctccaccacaccatcggcctccccgacttctcgcaggagctccgctgcttccagaccgtcacctgccatcaggcggtggtgaacaatctggatgacgcgcacgagcagatcgacacggccattgccacggcactgagggagagcaagcccgtgtacctcagcatcagctgcaacctccctgggctgcctcatcctaccttcagccgcgacccagtgcccttcttcctcacccccaggacgagcaacaagatggggctagaggctgcagtggaggcaactgtcgaattcctgaacaaggcggtgaagccagtccttgtcgccggccccaaactgcgtgtggcaaaggcaggaaaggcatttgtcgatatggtagatgccagtggctatgcctatgccgtgatgccatcggccaagggtcttgtgccagagacgcacccccacttcatcggcacctactggggcgcagtcagcaccgccttctgtgccgagattgttgagtccgcagatgcctacctctttacaggccccattttcaatgactacagctctgttggctactcattcctcctcaagaaggaaaaggccatcatcgtccagcctgagcgtgtgatagtggggaatgggccggcattcggatgtgtgatgatgaaagagttcttgtctgaattggctaagagggttaataagaacaccactgcctatgagaattacaagaggatctttgtacctgagggacagccgctggaaagcgagccaaatgagccactgcgagtgaatgtgctcttcaagcacgtccagaagatgttgactggtgatagtgcggtgattgctgagactggtgactcctggttcaactgccagaagcttaagctgccagaaggctgtgggtatgaattccaaatgcagtatggttcgattggatggtcagtgggtgcattgctcggatatgctcagggtgcgaaccacaagcgtgtgattgccttcattggtgatgggagcttccaggttacagcacaggatgtgtcaactatgctgcgatgtgagcagaacagcataatcttcctgatcaacaacggtgggtacacgattgaggtggaaatccatgacgggccatacaacgtcatcaagaactggaactacactggctttgtggacgccatccacaatggcgagggcaagtgctggacctccaaggtgaagagcgaggaggagctgacggctgccattgagacagcgctaggggagaagaaggactgcctgtgcttcatcgaggtgatcgcgcacaaggacgacaccagcaaagagctgctggaatggggctctagggtttctgccgccaactcccggccaccaaatcctcagtagaagccccgcaggctccaagcctcggagtgccagtagtgatagtaagctgtagcacggtgggggctcaactgaataacgtgaacgcattgccctttctgttacgtgttttattttattgtgtttctgtggtcgtatatctgttttgtgacgtgtcccttgcttctcccatgtgaattccacaagaactatgagaaatttcaggttggtgatcactcatctgtgttgtcactatttgtgctgcgttaccggtgtgattttactgaccaggtaaacatcgccggccagggagtgaatc

SEQ ID NO: 16346 - DNA, 3088 bp, Zea mays
gccggccggtcacaacacgcctccccccgcccgtcagtcagtcagcagccgcaacctcgtacaatcacgaaagcagcacacgagtccacaacagcaccccgcctctttttcttcacgtgcgttgcgtgccctgcccccatggagaccctcctggctggcaaccccgccaacggcgtggcgaagccgacgtgcaacggcgtcggcgccctgcccgtggccaactcccacgccatcatcgccacgccggcggcggctgcggcgacgctggccccggctggcgccacgctcggccggcacctggcgcgccgcctcgtgcagatcggcgcctccgacgtcttcgccgtcccgggggacttcaacctcaccctgctcgactacctcatcgccgagccgggcctgaccctcgtcggctgctgcaacgagctcaacgccgggtacgccgccgacgggtacgcgcggtcgcggggcgtcggcgcctgcgccgtcacgttcaccgtcggtgggctcagcgtgctcaacgccatcgccggcgcgtacagcgagaacctccccgtcgtctgcatcgtgggcgggcccaactccaacgactacggcaccaaccgcatcctgcaccacaccatcggcctccctgacttctcccaggagctccgctgcttccagacgatcacctgctaccaggccatcatcaacaacctggacgacgcgcatgagcagatcgacacggccatcgcgacggcgctgagggagagcaagcccgtgtacatcagcgtcagctgcaacctggccggcctctcccacccgaccttcagccgggatccggtgcccatgttcatctcgccgaggctgagcaacaaggccaacctggagtacgccgtggaggcggcggccgacttcctcaacaaggcggtgaagccggtgatggtgggcgggcccaagatccgggtggccaaggccagggaggcgttcgccgccgtcgcggacgccagcgggtaccctttcgccgtcatgccggccgccaagggcctggtgccggagcaccacccgcgcttcatcggcacctactggggcgccgtcagcaccaccttctgcgccgagatcgtggagtccgccgacgcctacctcttcgccgggcccatcttcaacgactacagctccgtcggctactccctcctgctcaagcgggagaaggccgtcatcgtgcagcccgaccgcatggtggtcggcgacggcccggcgttcggctgcatcctcatgcccgagttcctccgcgcgctcgccaagcgcctcaggcgcaacaccacggcgtacgacaactaccgccgcatcttcgtccccgaccgcgagccgcccaacggcaagcccaacgagccgcttagggtcaacgtcctcttcaagcacatcaagggcatgctgtccggcgactccgcggtcgtcgccgagaccggcgactcgtggttcaactgccagaagctcaggctccccgagggctgcggctacgagttccagatgcagtacggctccatcgggtggtcggtcggcgcgacgctcgggtacgcccaggcggccaaggacaagcgtgtcatcgcgtgcatcggcgacggaagcttccaggtgacggcgcaggacgtgtccacgatgctccggtgcgggcagaagagcatcatcttcctcatcaacaacggcggctacaccatcgaggtggagatccacgacggcccgtacaacgtgatcaagaactgggactacacgggcctggtcaacgccatccataactccgagggcaactgctggaccatgaaggttcggacggaggagcagctcaaggaggcgatcgccatggcgacgggcgacaagaaagactgcctctgcttcatcgaggtaatcgtgcacaaggacgacacgagcaaggagctcctcgagtgggggtccagggtctccgccgccaacagcaggccgcccaacccccagtgatgagcccgtcgatcggtctcgagcgttcctgcaatggcgcctgcgtctgcgtctgtctgccctgaaattttttcgggtcgtttactcgttttcagtcagttactcagtttgtccgtcttcgtcgagcagaactacatccctgctgagggaagctgccaatctttatcctacgatgataatgtctgcaatttcacttgcttccaattgagttctgttacaaatttttgcaacatttttttcccgcatcaataaaattcgttcgcgacgccggtctccttggaggccgccgttactgtgcgccgggtgtgtatccgcatgaccaatacggatttacgtctacaataggtgatttaggactagtttggcaaccttattttttcaatagatttctattttttcaaggtatattagcttattttctcttgataaaatgagaatatctggaaaaatataattgtcaaactagcacttattatatgatatattgtttgaagattgaaattttaaaataaaaaataaaataacagaagagataaaataattgttggagacaaactaagatccgatttcaatactgcactcccgaatctaaacatgagggcttgcgatgtgcagtgtgctgttcgtccatctccaactactggtcgtcatcgttgtaggcttgcgtccaggtccagtgacgttaactttcaacgtactaatacaatacctcgtggtactacatcatacaaattatttaataaaatattagtgcacaataattatatgaaaatgaacacatatattatcactgacctcaatatctcataatttttttccaacaaccaatagttatgacataaacacatcattgaagttaactcgtgagtaaatccatgaagctcatacctaattaggagttgaggtttcttcctcgttatcatcaccggtatcatcctgatcacttgaatcctaaaaaaaggaagctattaatatgaaactaccctgatatgtagacaaaatatttcttcatctttcaactcacatcatctccttcttcatgaaataatccctcaccctcagaatcatcctcgtccttgcttttctttaagcccaagatttgattttgaagctgcag

SEQ ID NO: 16347 - DNA, 3067 bp, Zea mays
gccggccggtcacaacacgccacccatcatcagtcagtcagtcagcagccgcaacctcgtacaatcacgaaagcagcacacgagtccacaacagcaccccgcctctttttcttcacgtgcgttgcgtgccctgcccccatggagaccctcctggctggcaaccccgccaacggcgtggcgaagccgacgtgcaatggcgtcggcgccctgcccgtggccaactcccacgccatcatcgccacgccgccggctgcggcgacgctggccccggctggcgccacgctcggccggcacctggcgcgccgcctcgtgcagatcggcgcctccgacgtcttcgccccgccggaccgtgggtacctcgaggccggccgggcaccgaaccaaaccaacacacgtcaaagcagaaaacctcagaaaaccccaatatatcctcgtccaccactgcccccgctctgctgcaactccactcggcccggccgccctttccacccaccttgatcctctgatccgttggtgcttgaccgatccatggacacccacatcggatccgtgaacggggcggcgtcgaaccagacggttggctgcccggcgtcggcgccggggtgcccgatggcgtccacgccggcgcagcccgcggcgaccctgtcggcgggggaggcgtcgctggggcgccacctcgcgcgtcgcctcgtgcaggtcggcgtcaacgatgtattcgcggttccgggggacttcaacctcacgctgctcgaccacctgatcgccgagcccggcctgcgcctcgtcggctgctgcaacgagctcaacgccgggtacgccgccgacgggtacgcgcgcgcgcgcggcgtcggggcctgcgccgtcacgttcacagtcggggggctcagcgtgctcaacgccatcgcgggcgcctacagcgagaacctgcccgtcatctgcatcgccggcgggcccaactccaacgactacgggaccaaccgcatcctccaccacaccatcggcctccccgacttctcgcaggagctccgctgcttccagaccgtcacctgccatcaggcggtggtgaacaatctggatgacgcgcacgagcagatcgacacggccattgccacggcactgagggagagcaagcccgtgtacctcagcatcagctgcaacctccctgggctgcctcatcctaccttcagccgcgacccagtgcccttcttcctcacccccaggacgagcaacaagatggggctagaggctgcagtggaggcaactgtcgaattcctgaacaaggcggtgaagccagtccttgtcgccggccccaaactgcgtgtggcaaaggcaggaaaggcatttgtcgatatggtagatgccagtggctatgcctatgccgtgatgccatcggccaagggtcttgtgccagagactcacccccacttcatcggcacctactggggcgccgtcagcaccgccttctgtgcggagattgttgagtccgcagatgcctacctctttgcaggccccattttcaatgactacagctctgttggctactcattcctcctcaagaaggaaaaggccatcatcgtccagcctgagcgtgtgatagtggggaatgggccggcattcggatgtgtgatgatgaaagagttcttgtctgaattggctaagagggttaataagaacaccactgcctatgagaattacaagaggatctttgtacctgagggccagccgctggaaagcgagccaaatgagccactgcgagtgaatgtgctcttcaagcacgtccagaagatgttgactggtgatagtgcggtgattgctgagactggtgactcctggttcaactgccagaagcttaagctgccagaaggctgtgggtatgaattccaaatgcagtatggttcgattggatggtcagtgggtgcattgctcggatatgctcagggtgcgaaccacaagcgtgtgattgccttcattggtgatgggagcttccaggttacagcacaggatgtgtcaactatgctgcgatgtgagcagaacagcataatcttcctgatcaacaacggtgggtacacgattgaggtggaaatccatgacgggccatacaacgtcatcaagaactggaactacactggctttgtggacgccatccacaatggcttgggcaagtgctggacctccaaggtgaagagcgaggaggagctgacggctgccattgagacagcgctaggggagaagaaggactgcctgtgcttcatcgaggtgatcgcgcacaaggacgacaccagcaaagagctgctggaatggggctctagggtttctgccgccaactcccggccaccaaatcctcagtagaagtcccgcaggctccaagcctcggagtgccagtagtgatagtaagctgtagcacggtgggggctcaaccgaataacgtgaacgcattgccctttctgttacgtgttttattttattgtgtttctgtggtcgtatatctgttttgtgacgtgttccctgcttctcccatgtgaattccagaagaactatgagaaaattcaggttggttgtcactaaaaaaaaaaaaaaaaaaaaaccaaaaaaaaaaagtgtgattttactgatcaggtaaacatcgccggccagggagtgaatcaaataaaagaatctgcaaaaaaaaaaaaagatgagcccgtcgatcggttttgagggttcctgcaaaggggcctgggtttgggtctgtcaaccctgaaattttttctggtggtttactcgttttcagtcagttactcagtttgtccgtttttgtcgagcttacccttttccctgcgtggggaatttgcccatttttttcctgcgatgtatatgttttcaatttcccttgctgcttctcccatgtgaattccagaagaactatgagaaaattcaggttggttgtcactatttgtgctgcgttaccggtgtgattttacttgccaggtaaacatcgccggccagggagtgaatcatctagagattgggctataagtattgtagcgataattattctagtacggaagcaggagatggagcatgtact

SEQ ID NO: 16348 - DNA, 1870 bp, Zea mays
ctgcatcagaaatcgtcgacgaccaaggcaccgacgccccgcgtatccgggctccgccgagatccgcacgcaaaagcggtgggccctggcacagtcgccgacacttacgcggtttgtagagccaacgcggacgccccaaggcaccagtcgccgatgagcttcgcggcggcagtgcacgcgatcgcgacgcgtctgtgcctctgttgaccgacttcaatttgccgcgacgatccagatcagacagggtctctccgttgccgtttgtggaaggccaggcgacacgtcgccacgcccgtcttgacaaatacagacagggcacgcacgcgccgccataccgacagttccgtctcaaactctctacctgctccgctgcccacacggcacacgagctgtcagctatatacgcccccgcccggccctcccccgggaaacacccatccaagataccgacgagcaggccagagcgaaggaatggactccatggccagcgacgacagcaaccaaggagcagcagccaagccgaagccgaagccaccaccgctaccgctgtccgtgcgcctccagctggccgggctgacagcggccatcgacgccgtggagcgccgcgacgggacggtgaaccgctgcctgtacggcgtgatcgaccggctcctgagcgcgcgcgccagcccgcgcccggacgcctccggggtgcgctcctacgacgtgaccatggacgcgtcccgcggcatctgggcgcgcgtcttcgcgccggccgcggcggaccgcccgctccccgtggtggtgtacttccacggcggcggcttcgcgctcttctccccggccatcgggcccttcaacggcgtgtgccgccgcctctgcgccgcgctcggcgccgtcgtggtgtccgtcaactaccgcctggccccggagcaccgctggcccgccgcctacgacgacggcgtcgacgcgctgcgcttcctcgacgcccgcggcggcgtcccgggcctggacgacggcgtgcccgtcgacctcggcacctgcttcctggccggggagagcgcgggcggaaacatcgtgcaccacgtcgccaaccgctgggcggcggcgtggcagccgtccgcgcgggccctccgcgtcgcgggcgtcttccccgtgcagccctacttcggcggcgtggagcgcacgccgtcggagctggagctagagggcgtggcgcccgtggtcaacctcaggcgctccgacttctcgtggaccgcgttcctgcccgacggcgccacccgcgaccacccggccgcgcacgtcaccgacgacaacgccgacctcgccgacgacttcccgcccgccatggtcattatcggcggcttcgacccgctcatggactggcagcgacgctacgccgacgtgctgcgccggaaggggaaggaggtgctggtggccgagtacccaggcatgttccacggcttctacggcttcccggagctccccgaggctaccaaggtgctgcaggatatgaaggccttcgtcgacagccacatacccacgcccaagctcgccgacgcgtgatgcacgaacaccatcccattccattctagtgtcatgagtcatgactgcttggttcatctatctgctgtcaaaatatatacttcctatatattaaagcagggcgcaaagcttccatctggtgcgcccacgtcatttgtgttaaaaaaaccttcaacgtctttgattcaagcgtgtctccgtgggaagcttccggacgaagctcacacccttttcagctactcgctcgaaacccaagcgtcgctgcatgcttcccacccctcctcgcccatgtagatatacatagtgtagcaataaacaataaaaagtttgttaaaaaaaagaaaat

SEQ ID NO: 16349 - DNA, 2350 bp, Zea mays
ggtaccctcgggtctcgccctgggtaccctcgaggccggccgggatgtccaggtaaaaggaaaaatcgccccatcccctgactatcactggctcactgcccttccacctacaggttccagcggccatggtgaagaagcccaacggtgtcgccaaggccacggcgacctctgctgacgcggcagcccagccatccaaggagaatccgtccacccctgggttggtcaaggcctcgaagtttaagaagagaaaggtcaaggccaaccgtgcgaagcaggcagtcgctgcagcagctattgacgaggtcgcccctgtaggtgcaggcactggtgatggcgatgcatctgcatcagcggctttaccgcaaccatccgatgttgccgaggcattacttgtggtgcaaacgccaaagtcaaccacttttgctgaggcatcacctgtggcacagacgcagaagccagccactgatgctgaaggattggtgcctgcaccaataccaaccactgctgtagcatcagcttcgtcgccaaagccaaaaccagctcaagctaatgctgatgctgcagctgcaatttctgccagcaagggcaatggtgtgggtgctgataatagtaggggtgatggtgagatgaagaacaagaaagagagggccatgagtgacaaggggaaggaggttatggaggaaggaggaagtaagggaaagggtaagggtaaggggaagaaggctgtggtcaagaaggaagaaaggggtgaccgtaaggttgcagggtttatattcatgtgcaatgcaaagactaagaaggagtgctaccagagtcgcttgtttgggatgcctagtgggaagattgaaatggtcaagaagattaggccaggggtcaagctgttcctgtatgattttgacttgaagcttctgtatggcgtgtacaaggcagcatcacatggtgggctgaaccttgtccatgaagcatttaatgggaagttccctgcacaggttaagtttaagattgataaagattgccgtcctctccctgagagtagtctcaagcaagccatcaaggaaaattacaatgcaaagagcaaatttgatccagagctcaccacaaaacaagtccaaaggttacttttgctgtttaagcctgttagtgcacctcaatctgtttcaaataatcaccttggagaaaggcgccactatgaaaaacgaaggaagccacgccattttgaagaaaggcggcctattgaagcagcgcgtcggccacgatttgatgaggaaaggcgccctgcggttagacatgttccttttgaggatccatacagggcaccacgctatgctccagttcctgttgactctcagcatggccattctttggctagtgatcaccacagatattatcaaccagcacttacacctgagcctcggcagcttcctcttgttctagagcctcgatatgttccgccggccctagatcatcatcatgtgccagagcttcgacatgccccacctgcatattatcgcactttggctccatctggtgattcatactatcggtctgttgagaatctggtgcctgagcgatatgcagacagaaccatggctgacttgaccactagagatccaattattagggatcacacagcactaccaggggaggcacttgctcgagcagaccgcttggatgatctctaccgttctgatcgtgtggaggaactctaccgttctgatcgacttgttaaccgtgctgtggaccgccctcatccagcctattttacagctgcttatgagaccaaccctgcttatgctgaaacgagcattaggcctgtctctgcaagggtcaatggacccagtgcggcagtttcgtcactctattccttcagtggtggcccagtatatcggtaatgaatgatcatggctctgttgaaagccttagccagactaagaagacagggtattcgtctctttaactgcaactgttgtttgccttagcttctattcggtattttcttaaatatccttccctggatgaatgacattcgttatcaagacttgatggtctaaactgtcgaaattatgtactgtacttggcgtgctttgaagctcacttcgttctgtgaatggatcgatgcacgtattggtagcatttgcatgttcaaaaaggccgctcgggccggttgctacttgctaaactgagtagggctacctcatgcagtggtcatttcttaggctctgtgtatatcctgatcctaatatacaggacgttagggttgatatctggcgatctgcatatgtggtcataagttttactgattcaagttctcttacttgacagtgcgcgatcagaccacatctgtttagca

SEQ ID NO: 16350 - DNA, 2269 bp, Zea mays
cattgcctatatataaacccggtcgcccctcggcccggccccgccgtctcagttctcatgtccgggtgaagaaaagaaaaatcctcctgttccctgactatcgctacccctccacatccagtggccatggtgaagaagcccaacgacgttgccaaggccgcggcgacctccgccgacgcggcagccaggccatccaaggcgaatccgtccacccctcagtcggtcaagacctcgaagtttaagaagcggaaggtcaaggccaaccgccagaagccagcggtagctgccgcagctgttgacgatgtcgccccggtaggcgcaggcactggggatggcgatgcatctgcatccgcggttttaccgcagccatccaatgttgctgaggcatcgcctgtggtgcaaacgccaaagtcgaccgcttttgttgaggcgtcacctgtggtacagacgcagaagacagccactgatgctgaagtaccggtgcattcaccaatgccagccactgctgaagcatcagctttgtcgccaaagccaaagccaaaaccagctcatgctaatgctgatgctgcagctgcaatttctgtcagcaagggcaagggcgtgggtgctgataatagcgggggtgatggcagaatgaagagcagaaaagagagggctaggagtggcaaggggaaggaggttttgggggatggaggaagtaagggaaaggggaaggggaaggggaagaaggctgtaggcaagaaggaagaaaggggtgaccataaggttgcagggtttatatttatgtgcaatgcaaagactaagaaggagtgctaccagaatcgcttgtttgggatgcctggtgggaagattggaatggtcaagaagataaggccaggggtgaagctgttcctgtatgattttgacctgaagcttttgtatggtgtgtacaaggcagcatcacatggggggctaaaccttgtccaaggagcatttagtgggaagttccctgcacaggttaagtttaagattgataaagattgccgtcctctccctgagagtagtctcaagcaagccatcaaggaaaattacagtgcaaagagcaaatttgacccagaactcaccacaaaacaggtccaaaggttacttttgctgtttaagcctcttagtgcacctcaatctgttccaaataatcactttgaagaaaggcgtcactatgaagaacaaaggaagccatattatcattttgaagaaaggcttcctctgttgcctattgaagaagtgcgtcagccacggtttgatgatgaaaggcgccctgcagttagacatgttcctcttgaggatccatatagggcacaagcaccacgctttgctccagttcctgttgagtctcagcttggccattcgttggctagtgctcagggtgatcacggcagatattatcaaccaccaacacttgcgcctgagcctcgacacattcctcttgttctagagcctcgctatgttccaccggcccatgtgcctactgtgccagagcttcaacatgtcccagctgcatattatcgcacttcggctccatctggcgattcatactatcggcctgttgataatctggtgcctgaggggtatgcagacagaactgtgtcaaacataaccgctagagatccaatcattagtgatcacacagcactgccagtggagacctctgctcgaccagaccgcttggatgatctctaccggattcgtggcgctcatgtggaggagctgtaccgtccacgggaaattgctgatcgtgcggggatcaccactagagcagatcgtatggaggaactctaccgttatgatcgacttgctaaccgtgctgtggacccccctcattcagcctaccttacaactgcttatgagaataaccctgcttatgctgaaacaagcgttaggcctatctcagcaagggttggtggctccggtgcgccggtttcgtcactctattccttttctggtggtccagtatatcggtgatgagtgatcatggctagctctgttgaaaagccttagccagactaagaagacatgatgttcgtctctataactgcaactgccgttttaccttggcttcgactctgtattttcttaaatatccttcactggatgaatggtactcttcgttatcaagaagacctgctggtctatgctgttgaattatgtatttatgctgctgcatctctcttgctatgcttgaagctcgtttcattttgtgaatggaggtttacatattgccatgtttcatgcc

SEQ ID NO: 16351 - DNA, 1387 bp, Zea mays
ccctcgaggcctgccggggtcccccgcgtacgggaaaaatcgccccatcccctgactatcactggctcactgcccttccacctacaggttccaggttaagtttaagattgataaagattgccgtcctctccctgagagtagtctcaagcaagccatcaaggaaaattacaatgcaaagagcaaatttgatccagagctcaccacaaaacaagtccaaaggttacttttgctgtttaagcctgttagtgcacctcaatctgtttcaaataatcaccttggagaaaggcgccactatgaaaaacgaaggaagccacgccattttgaagaaaggcggcctattgaagcagcgcgtcggccacgatttgatgaggaaaggcgccctgcggttagacatgttccttttgaggatccatacagggcaccacgctatgctccagttcctgttgactctcagcatggccattctttggctagtgatcaccacagatattatcaaccagcacttacacctgagcctcggcagcttcctcttgttctagagcctcgatatgttccgccggccctagatcatcatcatgtgccagagcttcgacatgccccacctgcatattatcgcactttggctccatctggtgattcatactatcggtctgttgagaatctggtgcctgagcgatatgcagacagaaccatggctgacttgaccactagagatccaattattagggatcacacagcactaccaggggaggcacttgctcgagcagaccgcttggatgatctctaccgttctgatcgtgtggaggaactctaccgttctgatcgacttgttaaccgtgctgtggaccgccctcatccagcctattttacagctgcttatgagaccaaccctgcttatgctgaaacgagcattaggcctgtctctgcaagggtcaatggacccagtgcggcagtttcgtcactctattccttcagtggtggcccagtatatcggtaatgaatgatcatggctctgttgaaagccttagccagactaagaagacagggtattcgtctctttaactgcaactgttgtttgccttagcttctattcggtattttcttaaatatccttccctggatgaatgacattcgttatcaagacttgatggtctaaactgtcgaaattatgtactgtacttggcgtgctttgaagctcccttcgttctgtgaatggatcgatgcacgtattggtagcatttgcttgttctgccctacaaattggttgccacctgctaaactgagtagggctacctcatgcagtggtcatttcttaggatgtgtgtatatgctgatcctaatatgcaggacgttagggttgatatctgacgatttgcatttgtggtcc

SEQ ID NO: 16352 - DNA, 1994 bp, Zea mays
attggtacctcgagccggcgggttgggccggccgctggcgtttggagcatgggatgcatctttgctgaggtgttaacagggaaacctttgtttcctggtaaaaatgttgtccatcagttagacttaatgactgaccttctaggcacgccatcgatggatacgatttctcgggtccggaatgagaaagcaaggaggtatctaagtagcatgagaaagaaagagacaatttcgttctcacaaaagtttccgaatgcagatcctttagccttggatcttttgcaaaggcttttagcatttgatccgaaagaccgtccaactgcagaacaggcattggctcatccatactttaaagggctagccaaggttgagagagagccatcttgtcaaccaatcacaaagatggagtttgagtttgaaaggagaagagtgacaaaagaagacattagggagctgatattccgtgagatattggaatatcatccacaactgctcaaagactatatcaatggcacggagaggacaacctttctgtacccaagtgctgtcgaccaatttaggaagcaatttgctcatcttgaagaaaatagtggaaacggacctgtgattccaatggaaagaaaacatacttctcttcctaggtctactattgttcactcatctccaattcctgtcaaggaacaaccccgtatcggcccatgtagggaaaggccttcatctgatgagtcctacaggaatcctcgggagacagaacaatattccggcaatctccccagaacgtcacaggctccacaaagagtgccaacagcgagaccaggaagggttgttggtccagtaatgccttaccaaaatggagacaccaaagacccctacgacacacgaaggttggcaatgagctcaggatatcctccccaacaaatcccacaaacgtttggttattatcagacacatggtaaaccagcttgctgcgagccatcacaggctgaaaggtacacgctgcatcagcaggctgcctatgcctgcgcaaaccgtacagccgcgtctgatgttgctctggacatgagagcacccccttttcagcatctatcggcagggcagagaagtgactcttgtgataggctgacagcagagacaaacttgtacacgagatcaaccaacggcatcgctgccactgcagcaggagtggcagcaactactcacagaaaggtcggcgttgttccgtttggcatgtcaaacatgtattagtgactggatcatggccgaatcatggtgaatcctctgtgcggttgatgggtctatgctgccttcaggtggctaaacaccgacaacttgaagcggccaatcaaacctttggctggatgctgcaagtttagagtgcagtagacagtgttttttctgtgtggtcaggaaaagaggaacaccgccggcggcatgaagcctgccaaaaagtttgtatctgcctgtgcctgagaagtgtgcccttggttgcacactgagaaggggtatagtcggcagtccggcggcatgtaatctgggcaatttaggcgccaatttcttttctagagcgaggaggcagaagggaaaggaaggaacattaacgttttaaatgttgtatagagacgtttctcatgcatcaatgtgctacatcagaattacttcagaaagatatgagatacagcaaaaaaaactgtatggcatatgcatggttttagagctatcgtgaactagctccaaaaacatgctgcccaataatcttgaactatattacctgcagggtcgtaatgatcgggaggtaaaagggcgagcattttacgcttgtttatggttgagccgttaatcctaaggcacccaaaaatacttgggccaattggaccacggaaaaagccgtcccctggcaacaaccaagttccagtccttgacattggccttctaaaacaacctaaaagggtctttagtggaccaaccgattggcctttcaagttaatttttaaaggaaa

SEQ ID NO: 16353 - DNA, 1644 bp, Zea mays
  misc_feature (1572)..(1572): n is a, c, g, or t
  misc_feature (1634)..(1634): n is a, c, g, or t
ctgcagtaaaggtgaaccagctacaaattagaacacatttatattcaggtgccgaagttagggtgacaaaatgaatgtgattctcgcctcatctcgccatactaaatgttaagaacagtactgaaagaggagtggcaacaacagtttattctaacaattagtccaaggtgaatatttaatgtttaatatcagtcgttataagcaccccagattgggatatcaggaccgaaataaatagcaacataacatttccccttagaaattaacactatcagcagaacggtttaaaatgttattattcttacactggagttgcggttgattagtaagcattcagactcatttagactaactttgcttgaatttcttccttccttcctaattgttcacattcttattttcttttatcttaaatggtcaacctgccttttgcaggtctactattgttcactcatctccaattcctgtcaaggaacaaccccgtatcggcccatgtagggaaaggccttcatctgatgagtcctacaggaatcctcgggagacagaacaatattccggcaatctccccagaacgtcacaggctccacaaagagtgccaacaggtacctttggttcgtgccatgtaaacatgtggctgatattggtctaactacaaactgtctatctttttgcagcgagaccaggaagggttgttggtccagtaatgccttaccaaaatggagacaccaaagacccctacgacacacgaaggttggcaatgagctcaggatatcctccccaacaaatcccacaaacgtttggttattatcagacacatggtaaaccagcttgctgcgagccatcacaggctgaaaggtacacgctgcatcagcaggctgcctatgcctgcgcaaaccgtacagccgcgtctgatgttgctctggacatgagagcacccccttttcagcatctatcggcagggcagagaagtgactcttgtgataggctgacagcagagacaaacttgtacacgagatcaaccaacggcatcgctgccactgcagcaggagtggcagcaactactcacagaaaggtcggcgttgttccgtttggcatgtcaaacatgtattagtgactggatcatggccgaatcatggtgaatcctctgtgcggttgatgggtctatgctgccttcaggtggctaaacaccgacaacttgaagcggccaatcaaacctttggctggatgctgcaagtttagagtgcagtagacagtgttttttctgtgtggtcaggaaaagaggaacaccgccggcggcatgaagcctgccaaaaagtttgtatctgcctgtgcctgagaagtgtgcccttggttgcacactgagaaggggtatagtcggcagtccggcggcatgtaatctgggcaatttaggcgccaatttcttttctagagcgaggaggcagaagggaaaggaaggaacattaacgttttaaatgttgtatagagacgtttctcatgcctcaatgtgctacatcagaattacttcagaaagatatgagatacagcaaaaaaaaaaaaaaaactgtatggcanaaaaaaaaaaaaaaaaaaaaaaaaaaaaaaaaaaaaaaaaaaaaaaaaaaaaaaggggcggnccgttttaaa

SEQ ID NO: 16354 - DNA, 3665 bp, Zea mays
catatttttatcaaattcgagatatttgattctctaaaaaaacttataatttggaataaaaggagatttaccttccatggaactgattctgaagtaattgatactgtactttaagagtaattcgtgatcaaaatatgctggtaaagtttttttccctgatttctaaatcctaatacgcgttataaaaagaaaaaaaatgctctatgaaattttcattcttcatatatatgatgactaaaaatctactccgtatttttttttgtcgcccatacctctcgtacccattcaattaagaaaatcacatatctctagcagtatataataaacaaaataaaaagagagaaaaaacagcgtaacgtaacagccttcccctaaaccagaggcctctctgcctctagaaaaacagcgttcccacctttgtgccgtgaacgtagcatttgctccgagtccaccattaaagtagtagtcgtcgtctccctcctgcctctcgtgtttcctctcctctgcttcggttacgtcgaacctgcataaagccgccctcccctcgctcgcctatggtgtgactcacgaaacgcatagacacgacacgacacgacacggcacgacacgccggagaagaggagagaggcggaacgatcggaggggaggtagatgaagcccaagaacggcggcctggcctcggacaggaggctgctctcgcgccggatactgatcctctgcttcctcagcttcttcctcggcatactcgtcacggacctgtgagtcaatatagtagatcggtttctcttccgctttctctgttggagccatccatgcccggtgagttctgtctgtgtgccgcgagcgactgcaaggctcacgggttctgcggcggcgatggttctcgtggcaggtttggatcggtgccgagcccggtcgtggtgcagacggggtggcacgagcacgagcacgagcacgacacggagctgcagagcctttccgaggattttgttgccaagccggtacggccgcctaacccctggattttgtgctgtattattcttttgtttgttatccctttttttatatatattttgctctataaatccctaaacctaaccagcttgctacaatgctacttcagagacattgttgaattcgacattgctgcaggcatcgtattcgacattgctttttttttaaaaaaaaaactatctcctgcatttgactgtatttttccataaagcacatggaatggactgcgaaaacgtaaagcaagcttttcaacgtaaagtgattgtgtaacctccctctcttggtttcagaaaccggcagaagacagggacattatgggagaggtgtcgaagactcacgaggccatacagtaagtcagcaacgacatagaaaactggctatagaaactgttcctcgtctacagctagccggtggcctctctgactgccagccagtttgggactaataatctgggtatcattctgtgtccgtccagatacttggagaagtcaattgacacactgcagatggagctggcagcgaagcgcagcatcaacgagcttcacggggaaagtacaggtggtggcgtaagtaagcagaggagaagggtgttcgtggtgatcggggtcaacaccgccttcagcagcaggaagcgtcgggattccgtgagggagacctggatgcctcaaggttcgtgattctttgtctttcccccggactgatgcagaggaaatgatgatgatgcaggattctctctgtttatttatttttatatattttcttgaaagatccaatggcgcaggaaatatccattagggctgactgctatttctcttttgttttactgtgcttgtctgacctgctgtttatcaggtgagaagctcaagaaactggaggagaagggaatcgtcgtccggtttacgatagggcataggtatgctttaactgtatcgcctttcagtctaacgttcgcgaaaacgttacgaacgcatgttttacatatattcaatagtttatgcattcactgaagtaaaaaaaaaaaaactggtttttttttcttctctatgcgttgttgcagcgctacatcgaacaacgtccttgacaaagctatagacgcggaggatgaaattcatggcgactttcttaggctggtacgatgatctccactgaagccacggccacgggtgtactccgttgaagcacagaacacccaaaatctatgctcgatctgcagctgaactgtgcatatatgcttcgcaggaccatgtcgaagggtaccacaagctgtctgcgaagaccaagacattcttctcaactgccgtggccttatgggacgcggatttctatgtcaaggtggacgacgatgttcacctgaacctaggtaaactacgtgctcccttgctccgatccggtaacaaaacgcacctccaagagttcagtgttcgtttagagaagacagaaacctgtccagaaaccttcatggcgtaaaatgtgcagggatgctcgtcgccaccctcggccggcacaagctgaagccacgggtgtacattggctgcatgaagtcgggaccggtcctctccgacaagtataaattcctctgaaaaaaaagcagcgcagcattcgaattgaatcgtcgaaataccagccttcgttttgacatacatgttttctttttcccccacatcaggaatgcgaaataccatgagcctgagttctggaagttcggagaggacgggaacaagtacttccgccacgccacggggcagatatacgccatctccaaggacctcgcgacctacatctccatcaaccagtaagacaaaaccttcttcttcttcttctctctcttgagtggcactggcaggcagctgatccatatgcgttcaccatataccaccgcccaggcccatactgcataaatacgcgaacgaagacgtctcgctcggcgcgtggttcatcggcctagacgtggagcacatcgacgacagggacatgtgctgcggcacgccaccaggtcagtttcttgttcttcgcagcgcctgcagcctcgcgaccgcctctagcttttcttcaccgtaaaaggctgtaaccgatctttgctctccctctctcaaagactgcgagtggaaagcgcaggcggggaacgtctgcatcgcgtcgtttgactggaggtgcagtggggtctgcaatccggtcgagaggatcaagtacgtgcactcgcgatgcggcgaagggcaggatgcgatctggagcgcctccttctgacaagatggtgatggaatcatggaatgattatatatatacagacgcacgcctgcttgtgtgcaggcccaggccatagctgcattagaaggctcgcgttgtgtacacacagtgagttcagagaaggggaggcatgcgtgtctgatacaggaagaaaccactggagcacaatctcttatcttttttgggggggagggttcagaaataggtgatacagccatacagagctcatgtgggtgggtatacatgttttttttcagtcgttagtgcagaaaacacgaatacattcgatttaattcattcgtcccctcttagaagctctgatcaggatcagagaagtttctgcaacactatcttttcgacactcgccatcagtttggttttagtggtgtaaaagacgagaacgctgg

SEQ ID NO: 16355 - DNA, 959 bp, Zea mays
  misc_feature (13)..(13): n is a, c, g, or t
  misc_feature (906)..(906): n is a, c, g, or t
ggccggccggggnttgaaaagccaaacaaaattgcttagccgcgctgcctctgtgtccgcccgttcgtttaattagggtttccggatctgctctgcgtcgccgccgaccaacctccaccgcgcgacgccatggacttcgacgagtacgagtatctggagaagacggtggaagcgttcgcagcgccggccaacggttcgtcgccgcccgggtcggggtacaaggacaaggagcgcagctcacgccgccgctcaacgggcggtgacgaagagcgcgacaacgtagaacgcagatcgaagcgttctcgccccgaggaaggccgcgaccgcgatagagagcggcacaggtaccgcgacggcgaccggcaccgcagcagtcgggagcggcgggaccgtgaccgtgacgtcaaggagaaagagcagggcagggagaacgacaaggacaggaggagccgcgaccgcgaacgggagaaggaggagagggagaaggataggcagcggaggagtcggagccggtccgagcggcgccgtgatgacgaagagcgtgatcgctaccgtgaacgcgatgtcagacgtaggaaagaggaagttgctgaacctgaagttgatccagaaagagatcagaggactgtgtttgcttaccagttatctttgaaggcagatgaaagagatgtatatgagttcttttctagggctggaaaggtccgggatgttcgcctgattatggatcgaaattcacgacgttctaaaggtgtcgggaatatttgtaatatggtgtacctgctgggatactcagcaacttattaagatgggaaacaagatcatattgggtatattgaattctatggatgctatgtctgttccaatggcgatagctctttctggtcagttgcttcttggtcaacaagngatggttaagccttcagaggctgaaaagaatttagttcaatcaaatgcttcaa

SEQ ID NO: 16356 - DNA, 1247 bp, Zea mays
gcacgagaccattacctagaacatcctaatcaccaaacaagtagatctcgcggtgttattcctcccgagtcgcctccccctcaagttccacaaacgcaagccccaatctcgccgtcaccacctcaatccagcaaacgcaaaccccatctcgccgccgccgcgatgtctcgccgctatgacagccgcacgacgatcttctcgccggaggggcgtctctaccaggtggagtacgcgatggaggcgatcggcaacgccgggtcagccctcgggatcctagcggccgacggcgtggtcctcgtcggcgagaagaaggtgacctccaagctcctccagacctcgcgctccgccgagaagatgtacaagatcgactcccacctggcgtgcgccgtggccgggatcatgtccgacgccaacatcctcatcaacaccgcccgcctccacgcccaacgctacgcgctctcctaccaggaacccatccccgtcgagcagctcgtccagtccctctgcgacaccaagcaggggtacacccagttcggaggcctccgccccttcggggtctccttcctattcgctgggtgggacaagcaccacggcttccagctctacatgagcgacccatccgggaactacggcgggtggaaggccgccgctgttggggccaacagccaggccgcgcagtccatgctcaagcaggactacaaggacggcttgacccgcgaggaggccgtcgccctcgcgcttaaggtcctcagcaagaccatggactccaccagcctgactgccgagaagctggagctggccgaggtgtttctgcagccgggctccggggaggtacagtaccaggtgtgctctcctgaagcgctggggaagctgcttgcaaagtccggcctgacacagccaacacccgaggcataatgctctgttttgctgtggcttgtgatgcctactactgctcttagacatggtttaagcatttgtgcttctgttgtgtgaacttgaatattcgacgattatgtggtctaattttatgttgagcatcctagatacgttaatgtttcatctgtaactgtggattgccttgaactggttgcaaattggtgatttctatctgctctgcttgattattgtcgtgattagggagcatgtgggataatggaacaggcaaaattaggtttggttctaacgcatctggatgataccgactgtatttagtgaccatggcaaaattttcaaaaaaaaaaaaaaaa

SEQ ID NO: 16357 - DNA, 1166 bp, Zea mays
ccacgcgtccgcgcagcgagtccgtcccctttcttctctcacaagtagatctcgcggtgttaatcctcccgagtcgcctccccctcaagttccacaaacgcaagccccaatctcgccgtcaccacccccaatccagcaaacgcaaaccccatctcgccgccgccgccgccgcgatgtctcgccgctatgacagccgcacgacgatcttctcgccggaggggcgtctctaccaggtggagtacgcgatggaggcgatcggcaacgccgggtcagccctcgggatcctagcggccgacggcgtggtcctcgtcggcgagaagaaggtgacctccaagctcctccagacctcgcgctccgccgagaagatgtacaagatcgactcccacctggcgtgcgccgtggccgggatcatgtccgacgccaacatcctcatcaacaccgcccgcctccacgcccagcgctacgcgctctcctaccaggagcccatccccgtcgagcagctcgtccagtccctctgcgacaccaagcagggttacacccagttcggtggcctccgcccctttggggtctccttcctattcgccggttgggacaagcaccacggtttccagctctacatgagcgacccatctggcaactacggcgggtggaaggccgccgctgttggggccaacagccaggccgcgcagtccatgctcaagcaggactacaaggacgccttgacccgcgaggaggccgtcggtctcgcgctcaaggtcctcagcaagaccatggactccaccagcttgactgccgagaagctggagctggccgaggtatttctgcagcccgacaccggcgaggtacagtaccaggtgtgctctcctgaggcgctggggaagctgcttgcaaagtccggcctgacacagccaacacccgaggcataatgtactggtttgctgtggcatgtgatgccttctactgctcttagacatggtttaagcagttatgcttctgttgtgtgaacttaaatattcgacaattatgtgttctatttttgtgttgagcatccttgatccgttaatgtttcatctgtaattgtggaagttgcctggagtatggttgcaaattgttgatctcaaaaaaaaaaaaaaaaaactcgagactagttctctctctcctcgtgc

SEQ ID NO: 16358 - DNA, 1176 bp, Zea mays
cattgggtacctcgaggccggccgggaaaaaaataccggccggggagtcgcctccccctcaagttccacaaacgcaagccccaatctcgccgtcaccacccccaatccagcaaacgcaaacccgatatcgccgccgccgccgccgccgccgcgatgtctcgccgctatgacagccgcacgacgatcttctcgccggaggggcgtctctaccaggtggagtacgcgatggaagcgatcggcaacgccgggtcagccctcgggatcctagcggccgacggcgtggtcctcgtcggcgagaagaaggtgacctccaagctcctccagacctcgcgctccgccgagaagatgtacaagatcgactcccacctggcgtgcgccgtggccgggatcatgtccgacgccaacatcctcatcaacaccgcccgcctccacgcccaacgctacgcgctctcctaccaggaacccatccccgtcgagcagctcgtccagtccctctgcgacaccaagcaggggtacacccagttcggaggcctccgccccttcggggtctccttcctattcgccgggtgggacaagcaccacggcttccagctctacatgagcgacccatccgggaactacggcgggtggaaggccgccgctgttggggccaacagccaggccgcgcagtccatgctcaagcaggactacaaggacggcttgacccgcgaggaggccgtcgccctcgcgcttaaggtcctcagcaagaccatggactccaccagcctgactgccgagaagctggagctggccgaggtgtttctgcagcccgacaccggcgaggtacagtaccaggtgtgctctcctgaggcgctggggaagctgcttgcaaagtccggcctgacacagccaacacccgaggcataatgtactggtttgctgtggcatgtgatgccttctactgctcttagacatggtttaagcagttatgcttctgttgtgtgaacttaaatattcgacaattatgtgttctatttttgtgttgagcatccttgatccgttaatgtttcatctgtaatagtgcattgcattgaattggttgcaaattgttgatctctatctgctctgctttattgttgtctaaataacttaattaaaaattataataatataaactaaaattaaaaaatttcaatt

SEQ ID NO: 16359 - DNA, 2817 bp, Zea mays
gttccttgtaggagctttaatagtgtgaccaacaccaccattatcatcaatcttatcaagtgaacttgtggtagatacatcattatcatcacttgacctttaacttgaggtggatcacttattgatgacctccttgttatcaatgttctcatcatcatcttgtacatccatgcacttatcatcaacaaatatgatccttccatttttactataaagatacgacaatatgtcatgggcggtctcctttgtgcatgatctccttgaacaccttatcacttagtcattgatatagattgttagtagtttagtgttcaagatgtaaatagttatttttcgattaggtgagatctttccttttctaatcaaagggtatgagaaaattctacgctcacgacacactagaattttgcatcaacaacaaagaaacaataactcacaaaacctttccactatgcaaagtgtgtgccacaaaaaatgtgtggagcacaagtaacctctagcccttttagctgccagcctacttactctcggatcaattaagaccactaaataagaaatcagagcctgataccatttatagggtcaagatgccagactagaggtagactagacgaggtgaacagtactttcaaaaactaattacgttgactaattaaaataaatatagaattaatacaatttggtctagcgaatactacacacctctgtctatcacaaccatcttacaaaagatcctaatcgaagcaactaaggtgtcgagctagtgagacatcatctacgcaagtctagttagcaagattacacaaacctacgtagctagcaatctaaatattccatgactatatgttctaaatacacgagcgtgccccttacaagagacctgtagagacaggtgtggccacgtgacaagagcgcatctttcaagcgcgctgttggagcacggtcagtgagaacacaacaacttagctctaggcacgtccatgaatataccacttcaggcaagcaaggcatgaagatgatgggtatgaccagctaggacgatggtaaacaccatcgactagataaggggcgagtgtaatcaattagcgtggtcgaccggtgagcagggtggtgcaaggcacaaccgatggctatggctagataagcgtgagaagaaataagagatagaatgacaaaaagtaagaataaaccaatatgctagatttgttaatttgagttgatgcaatttaatcgaagtaaagctgacaattttactatcttcactaaatttgagttgatgtaatttaatcgaacgtctagatttattaatttaataaatttagatttttatgtgtaatctgacaatttttagtgaagtaaagccgttggcgccggcccggccggggaatctggagctggttagcttctgccgagtcgctcccccttccagggtctcaaacgcaaaccccaatctcggcgtcaccgccccaaatctagcaaacggaaatcccatctcgccgccgccgcgatgtctcgccgctatgacagtcgcacgacgatcttctcgccggaggggcgtctctaccaggtggagtacgcgatggaggcgatcggcaacgccgggtcagccctcgggatcctggcggccgacggcgtagtcctggtcggcgagaagaaggtgacctccaagctcctccagacctcccgctccgccgagaagatgtacaagatcgactcccacctggcgtgcgctgtggcagggatcatgtccgacgccaacatcctcatcaacaccgcccgcctccacgcccagcgctacgcgctctcctaccaggagcccatccccgtcgagcagctcgtccagtccctctgcgacaccaagcagggttacacccagttcggtggcctccgcccctttggggtctccttcctattcgccggttgggacaagcaccacggtttccagctctacatgagcgacccatctggcaactacggcgggtggaaggccgccgctgttggggccaacagccaggccgcgcagtccatgctcaagcaggactacaaggacgccttgacccgcgaggaggccgtcggtctcgcgctcaaggtcctcagcaagaccatggactccaccagcttgactgccgagaagctggagctggccgaggtatttctgcagcccgacaccggcgaggtacagtaccaggtgtgctctcctgaggcgctggggaagctgcttgcaaagtccggcctgacacagccaacacccgaggcataatgtactggtttgctgtggcatgtgatgccttctactgctcttagacatggtttaagcagttatgcttctgttgtgtgaacttaaatattcgacaattatgtgttctatttttgtgttgagcatccttgatccgttaatgtttcatctgtaatagtgcattgcattgaattggttgcaaattgttgatctctatctgctctgcattattgttggcaaaaaaacggaccatgtgggccccggacagtggaacaggggaaggtaggttcaggtctactagggcaatttgaggcacctggatgatgcttagtaaacatgggaaattgttgagattaggacttgtgacaggcaagtgcacatgactaagttgagatcgtatatgccactaaacttctggtgattttaatcctatggatgatgctactactatcatcaattgtgcttagttaaccatgcaaatggtaggttcttctgggtataagacattttgacttctcaaagatacattccctaggcatagtgtatatctaaatagtagatacatgataaatgttatgtat

SEQ ID NO: 16360 - DNA, 1964 bp, Zea mays
  misc_feature (9)..(9): n is a, c, g, or t
tacccctgntatcacaaatatatttacaacaagtaaaaaccacttgatccgtgcctatttgctggtgtttgagttcaatggacacagccccaatgaacccatatcgaatggtggcctcccctaatccgtgtcgagcaggttacgccaatggaatcctgacctgtaatcatgtaatactgtttcattttgaggtgacaaacatggacttacgcatacgaacaaatttttagaccgtgtctagtagaatgtgaaaataaagggacataataaaattgtaaatgacattatttaacgagaaaagtttgaaaatagacgataagacatggatgttagagatagagtctgtttagttcgtgactacctgtgtcacactttatctaaaattagtcgttaaaattgaaaaactaacattagccaaaaaaaaattaggtaaattgtaagtcttagcccggctggaaaccacgagagatccaacggccacaaagcaaaagcggagggaccgacggttcggatgggctaaacgcagcgactccgcctccccgccgcccgcacaagtagatctcgcggtgttattcctcccgagtcgcctccccctcaagttccacaaacgcaagccccaatctcgccgtcaccacccccaatccagcaaacgcaaaccccatctcgccgccgccgccgccgcgatgtctcgccgctatgacagccgcacgacgatcttctcgccggaggggcgtctctaccaggtggagtacgcgatggaggcgatcggcaacgccgggtcagccctcgggatcctagcggccgacggcgtggtcctcgtcggcgagaagaaggtgacctccaagctcctccagacctcgcgctccgccgagaagatgtacaagatcgactcccacctggcgtgcgccgtggccgggatcatgtccgacgccaacatcctcatcaacaccgcccgcctccacgcccaacgctacgcgctctcctaccaggaacccatccccgtcgagcagctcgtccagtccctctgcgacaccaagcaggggtacacccagttcggaggcctccgccccttcggggtctccttcctattcgccgggtgggacaagcaccacggcttccagctctacatgagcgacccatccgggaactacggcgggtggaaggccgccgctgttggggccaacagccaggccgcgcagtccatgctcaagcaggactacaaggacggcttgacccgcgaggaggccgtcgccctcgcgcttaaggtcctcagcaagaccatggactccaccagcctgactgccgagaagctggagctggccgaggtgtttctgcagccgggctccggggaggtacagtaccaggtgtgctctcctgaagcgctggggaagctgcttgcaaagtccggcctgacacagccaacacccgaggcataatgctctgttttgctgtggcttgtgatgcctactactgctcttagacatggtttaagcatttgtgcttctgttgtgtgaacttgaatattcgacgattatgtggtctaattttatgttgagcatcctagatacgttaatgtttcatctgtaactgtggattgccttgaactggttgcaaattgttgatttctaacaaaaaaaaaaaaaaaaaaacgtcaaaaaaaagcttgtgggataatggaacaggcaaaattaggtttggatctaacgcatctggatgataccgactgtatttagtgaccatggcaaaattttgaactgcttatgtgttctagtaactattatggttgatgcctatagatgacgctggagctttgattgattgtgttctggaaacaaggcaaaataataaggtattatacgtctttcagattatcttcattcttatgctgtgcttgaattgacgtttgccattaggacttatggtgacactgacagagggtgctgtggtgaaaatgttaagaacca

SEQ ID NO: 16361 - DNA, 626 bp, Zea mays
actacggataggggaacgtgctagagaaaactggtacagtagtgtttttttttggttgtttgcttgcttgattgcttgaagtgaaaggcgtggtctttcacacgttcaaggatccaggcgcaggaaactgttgtcggttcgatggctggggagcccccgaaaagcggcagtcggtggttccacaagatcagtcctggcacaagctgacttcctcctcgggatttccttggtggatgtgaagctgaagcatgtgttactggtttattactgaagctttttggcacccaaggtatgacgacggctgtagctgcctgccttgtagcgaaattggctgcggacggaagcggtaagaagacagacagacagacagcagcggatgctagtttcaccaaaggtcacaggaatacctgctcacgtatcacaaaggctgtaagattttttttccccttctcttttacgacgtgtaatgcaacctactcaggtctaaccaccagttgtcatggactctgatagttttctaccatagattgctactgtagctttatctatgcagctgctgttgtattcattagattgttcggagaagtgtacctcggccccggcctcgctaaaaaaaaaaaaaaaaa

SEQ ID NO: 16362 - DNA, 1330 bp, Zea mays
acgcctgcggtaccgggccggaacccacgcgtccgggtgatcacttgtgcggagttccatccaactcactgtaatacactagcatatagtagccccacgcgtccgattcggcttattgatctgcgacagtcagcactgtgtgacaaccatgctgaactatttgaggagcatgaagcacccggatcaagatccttttttacagagataatagcatcagtttcagatataaaatttgcaagggatggaagacacattcttagtcgtgattatatgacactcaagttgtgggatctaaacatggattcaggcccagttgcaacttttcaggttcatgaatacttacgtcctaagctttgtgatttatacgagaacgattcaatttttgacaaatttgaatgctgtctcagcggcgatggactccatgttgcaactggttcttatagtaatttgtttcgtgtttttggttgttctcctgaaagcgtggaggcatcaacgttggaagccagcagaaatcccatgaggcgacaggttgttgatccagcaaggcctgcacggactctgaccggtgctgtgaggagaggtggagaaaacacaagcgttgacgccagcggaaactcttgcgatctctcaacaaagctgctccatcttgcgtggcacccaactgagaactccatcgcgtgcgctgccgcaaacagcttgtacatgtactacgcataggggaacgtgctagagagaactggcgcaggaaactgttgtcggttcgatggctggggagcccccgaaaagcggcagtcggtggttccacaagatcagtcctggcacaagctgacttcctcctcgggatttccttggtggatgtgaagctgaagcatgtgttgctggtttattaccgaagctgtttggcacccaaaggtatgacgacggctgtagctgcctgccttgtagcgaaattggctgcggacggaagcggtaagaagacagacagacagacagcagcggatgctagtttcaccaaaggtcacaggaatacctgctcacgtatcacaaaggctgtaagattttttttccccttctcttttacgacgtgtaatgcaacctactcagggctaaccaccagttgtcatgtgtactccgatagttttctaccatagattggtactgtagctttatctatgcagctgctgttgtattcattagattgttcggataagtgtaccagtgcacttggttgtgatttgcttgctgtggccgtgatgtggccccgctctctgtaccgttcaaattgaattccgattctatgtgcaaaaaaaaaaaaaaaaaaactcgagag

SEQ ID NO: 16363 - DNA, 1507 bp, Zea mays
gggccgggatacctcatcgtcatccccccgcacccccaacccaacccctcccacctcacctccggcgaccggatcggaggcgcgcgagcgcgatggcgaacatcgacatggcggcggtgctggcggacctggagcgggacgcggcggcggacgcgcggacgccgcggaccaagctggtgtgcacgctcggcccggcctcccgctccgtgcccatgctcgagaagctgctccgcgccgggatgaacgtcgcgcgcttcaacttctcccacggcacccacgagtaccacaaggagaccctcgacgccctccgccaggccatgcacaacaccggcatcctctgcgccgtcatgctcgacaccaagggacctgagattcgtactggatttttgaaggatggtaaaccaatcaaactgacaaagggtcaagaaatcactgtttccaccgactatgatatcaagggcgacacgaacacgatctccatgagttacaagaaacttcctcaggatgtgaagcctgggcatgtcatactatgtgctgatggtaccatctccttggctgttctctcttgcgacccagcagctggaactgtcagatgtaggtgtgagaacactgcaatgcttggagagaggaagaattgtaatctgccaggaattgtcgtggaccttcctaccctgacggagaaggataaggaggacattttgggatggggtgtgcctaatgacattgacatgattgctttgtcgtttgtccgcaaaggatcagatttggtgaccgtcaggcagcttcttggacagcatgcaaagcgcatcaagttaatgtcaaaggttgaaaaccaagagggcattgtaaactttgatgacattctgagggaaaccgatgcctttatggttgctagaggtgatcttggaatggagattccagtcgagaacatattccttgcacagaaaatgatgatctacaagtgcaaccttgctgggaagcctgtggtcacagcgacacagatgctcgagtccatgatcaagtcccccaggccaacccgcgctgaggctactgatgttgcaaatgctgtgctcgatggaactgattgcgtcatgctcagtggcgaaagcgctgctggagcataccctgaggtggctgtgaagatcatggcgcgcatctgcgttgaggcagagtcttccctggataacgacgccgtcttcagggagatgatccaggctgcgcccctcccggtgagcccgctggagtccctcgcgtcctccgccgtgcggaccgccaacaaggccagggctactctgatcgtcgtcctgacccgtggcggcaccacggcgaagctggtcgccaagtaccgccccagggtcccgatcctgtccgtggtcgtccctgtgctgacgaccgactcgttcgactggaccgtcagctctgagggccccgccaggcacagcctgatctacagaggcctgatcccgcttctcgctgagggctccgccaaggccaccgactcggagtc

SEQ ID NO: 16364 - DNA, 1231 bp, Zea mays
  misc_feature (1147)..(1147): n is a, c, g, or t
  misc_feature (1194)..(1194): n is a, c, g, or t
  misc_feature (1217)..(1217): n is a, c, g, or t
cattgggtacctcgaggccggccgggcttttctataaaattccctccggtacctcgtcgccggccgccatcccgctgcttttccaccgaccccgacgccgacgccaccgccgctccctccccagtccccagtccccttcccgggccgcggagcagagatccggagcgccgcgcgatggccaacatcgacatggcgaagatcctggcggacctggaccgcggcgccagcggcggcgacgcgcgggtgcccaagaccaagctcgtatgcacgctcggcccggcctcccgcaccgtgcccatgctcgagaagctgctccgcgccggcatgaacgtcgcgcgcttcaacttctcccacggcacccacgagtaccaccaggagacgctcgacaacctccgccaggccatgcacaacaccggcatcctctgcgccgtcatgctcgacaccaagggtcctgagatccgtacagggtttttgaaggatggtaaaccgattaagctaaccaagggtcaagaaatcactgtcaccactgattatgatatcaagggtgacgaaaatatgattgctatgagttacaagaaactgcctgttgacgtgaagcctggaaatgtcatactctgcgcagatggtactatctctctggccgttctatcttgtgatcctgatgctggaactgtgaggtgtagatgcgagaacactgcaatgcttggtgaaagaaagaactgcaatctgccaggaattgttgtggatcttcctacattgactgagaaagataaagaagacattttggggctggggtgttccaaatgatattgacatgattgctctatcctttgttccgtaaaggatcagatttgggtactgtgagacaggttcttgggcagcatgccaagcgcattaagttgatgtcaaaggttgaaaaccaagagggtgttgtaaactttgatgagatcttgagggagactgatgcttttatggttgctagaggtgatcttggaatggagattcctgttgagaagattttccttgcgcagaagatgatgatctacaagtgcaacattgctggcaaacctgttgttaccgctacccagatgctcgagtcgatgatcaaatcccctaggcccacccgcgcagagccactgacgttgcnaatgctgttctgatggaactgactgtgtatgccagtgcgaagtactnctggacctacccgaggtggtgtnaaatcatggccgac

SEQ ID NO: 16365 - DNA, 5351 bp, Zea mays
  misc_feature (249)..(249): n is a, c, g, or t
  misc_feature (307)..(307): n is a, c, g, or t
  misc_feature (1020)..(1020): n is a, c, g, or t
  misc_feature (2126)..(2126): n is a, c, g, or t
cgctctcgctcccactccaaggtactatcccaaattcagtgggcaccacgtgtccagcgactgacccctgcctggtgcatgcgccttccatctccggccggtctccgctcgtcgtcctcgcccagcccagagacgcccacggaatcgcaattccccactcccaccccccttctcctttctataaagggaaacttcgccaccaaatctcgaatcccatctcgctgctctccgccgctcgacgccgacgcngacgccgacacctctccctcccccattccccgtgccccggaccgcggagcagacagangcgagatccggagcgccgcgcgatggcgaacatcgacatggcgaagatcctggcggacctggaccgcggcgccggcgacgcgcggctgcccaagaccaagctcgtctgcacgcttggcccggcctcccgctccgtgcccatgctcgagaagctgctccgcgccggcatgaacgtcgcgcgcttcaacttctcccacggcacccaccagtaccaccaggagacgctcgacagcctccgccaggccatgcacaacaccggcatcctctgcgccgtcatgctcgacaccaaggtctcttccccaccttccctgctgcgtgctgccttctgtctgtgtcatggatttgctgccgttgcatgctttagctgcatgtgtgagttggctacccgcttaccaattggttggatcgggcctggcgcctgccggggtttctttttctctttgccgccggagggatctagtgatctgttcagtcggactcggacgagctagaattttttttttaatctcatctcaatatgattcccactcatggaacttggtattttgatctcaatgggttttcggtagcacaaggtttagatctcaacttaattagtgcatgctacatgtataacgacatacattataccattaataacgcgtgtaatagtacgaaacaaacttctcccacggcaagtagctttccgtaggcaacatgcgctgacttttggcngttgccaagggtgtgtgtcttgaatgatccgcatgccatatacgtcttgttggttgaagttactttcagattctgactgcttattgttcaagttactgcaactctggaatgtttttggacttaaataaatggtttgactgcttggtgtagagttcatctgcatcgagcttccaaggtcttgatttcttgacagttgctgctactttatttaagatgctgttggttatttgtgtttgtaaaaaaggaaacagcactacatgttggttaaagttagtttcagattttgtcagtatgttcaatccttttaccttgtacaatagcactttcggttgtatgtctaactttatctacccagacccagagtgtactgaacagttggtggatgttgagcactcctactttacctgatgtgggagtttgggtttaagaagtcaattccttcactagacttgaagattggcaaattgtaagccaaaatatttttcatggacatcggcgttttgagctcaatggtttctgaagaagtatttagacattcatcttgatcaaaatgaatgctacatatatgttcagcacctgtgattacattagttgctttcttacgaagtgggatattgatttgtgacagttcgacagaatagtgtttgccttgttgccattcatgtgaaaaaatctccgtgtgaatggttgaagttagttccaagtttgttatgttttgttcaggttactttctctacttctggttatggttctaagtttaatggtatgggtcagagattattgtattgtatctaatgggtcggtcaattttcaattggtgtttcattttcttgacacaaaaaaactgatatacaatggaacttctaagggtatttattccttaattttttttcagttgccactaagttgcttcctcttcatttttcttatgtttcagttatgggtcccatggtcatatttgttgatttggcttcatcactaaaatcgagtacatatatactatacctgctctttgctgcttatgttgttatgtgccctccatgatattatgtagcaaaaaattctgactgtgttcttctttgtaggacatttaaggttgttgcatnaagtgttcttagtcagtcttttgtttctgcagggtcctgagattcgtacagggtttttgaaggatggtaaaccaattaagctaaccaagggtcaagagatcactgttaccactgattatgatatcaagggtgacgaaaatatgatcgctatgagttacaagaaactgcctgttgacgtgaagcctggaaatgtcatactctgcgcagatggtactatctctctggccgttctgtcttgcgatcctggtgctggaactgtgcggtgtaggtgtgagaacactgcaatgcttggtgagagaaagaactgcaatttgccaggaattgttgtggatcttcctacattgactgagaaagataaagaagatattttgggctggggtgttccaaatgacattgacatgattgctctatcctttgtccgtaaaggatcagatttggtgactgtcagacaggttcttgggcagcatgccaagcgcattaagttgatgtcaaagggtcgtatatactatcactgtcgacctttaaagggttatatcagctatatttctgtccataatttggcacgactccattttttgtttgcatctctcgaatgaaaccttcccatcttaatttttgctgtgaacacatgataaccacatgctatgttatttatcatgtaacatatgaaagtagtatgttgagtacccttttaccaactaggatatactgcttgcccaggctgcaacttcacaagaattttttactttacagttggttagcgaaatgcaattctgttaacttgacgctacatttccacctggtaggctgttttactcctaaccgaattctgttaacttcacatggatctgatttccttaatgatatggttctgctatgcaggttgagaaccaagagggtgttgtaaactttgatgagatcttgagggagactgatgcttttatggttgctagaggtgatctgggaatggagattccagtcgagaagattttccttgcgcagaagatgatgatctacaagtgcaacattgctggcaaacctgttgttactgctacccagatgctcgagtcgatgatcaaatctcctcggccgacacgtgctgaggccactgacgttgcaaatgccgttcttgatggaactgactgtgtcatgctcagcggagagagtgccgctggagcctaccccgaggtggctgtgaagatcatggctcgtatttgcatcgaggcagaatcttccctggaccacgaggcagttttcaaggccatgatcaggtccgcgcctcttccaatgagccctctggagtcccttgcatcatctgctgtgaggactgccaacaaggccaaggctgcactgattgtcgtcctgactcgcggtggcaccacggccaaactggtcgccaagtaccgccccagggtccccatcctctccgttgtcgtacccgtgcttacgaccgactctttcgactggaccatcagctccgagggcccagctaggcacagcctgatctacagaggcctcattcccctcctcgccgagggctccgcgaaggctacggattcagagtcgacggaggtgatccttgaggccgcgttgaagtcggccgtgcagaagcagctctgcaagcctggtgatgccatcgtggctcttcatcgtattggcgtcgcctccgtcatcaagatctgcatcgtgaagtgatcaccacgacctggttctcactgctgggattccatgaaacagcttttctgcctcctttttactgcatttttttccggagacagatatttatgttgtaagcctgcgtctgttgtttgcagttgcggaatgttttttgttcacgtagttatttagctggtaaatggggagggagaggactccattgatgttagtggtaataagatttgtgtctatggagttgagttgaaagggttttttcatgctaagccccgagacactaggagatggagatcgaggttgagatgagataagcaataagtgaaaaaaatgttgatttgctttctttgtatgcacacgcttttgaggggtaagattagtctccattggagttgagttgaattgtttgttggttgcaactggagctagcatcttaacattttaataccaaaccaatggattgagttagaaacaaagacattcagatcacatctatgacagcaaccggtactgcatcaactgagtgatcgagacagtttggggaaggaagcaccaataataggggaaaaaacaaagaaaatactagtactagaggctagagcagcaagttctagaaatatatagggatgaaagatacatgagactatgacaggctagaggaggaaggagagagatgccacgccacgggaggaaagatgagttctggtgttttctgaatatactgttctttccttttcgtacttgttatccagataagcttagcaataaagtgcctatgttttaaattataagttatttttatttttttatagatatattgttaatggtttgaattgatataggctctatctaaatatataataaaagctttacgacgatgacttatgattcgaaattgaggaattgctttattttatatgtactttattttatatccattggctacactcttttagagcatctgtttatttacttactatacaaagtaagattcggcatgagtagcgaaaaactattcatgtgaaatatggttgattcagtcagtgaaacttgttaactagatggcaattttacccacggtttttgcacctgatggatttgaataaagggtacaaaaaaagtcacccgtggttacgtgagggccggagattcgtagagacgtggattgggcgcgagtatcaaatttaatcacaggtaccgtaatttgataatatataatttatatatcacgtggaccataattatagcatatggaactacgaagatagtgttttttatggataactagcgtgccgtgggaaagtttgccgcaactgcaaccgctgatcacgtcttcacggacgaaaacaggccaggttccggatgccctgtgaagaacgttcaacgcgttaacaacctagccggtggtcaggtcaaatcaggcatgcttaggtgcaggtgcagggatgattaggcatctgttcccgtgtgactcctctatataccgacagggatgacgacgacgatggcgttcatcggtgcatggctgaaccgtacatatgctccgatcctgca

SEQ ID NO: 16366 - DNA, 2151 bp, Zea mays
gccatccagtcctggagcctgcgcggctgcgccttgcatcgcatctccgtcgtcgtcctcgcccacggaatccgtccaattccccacgccgcccgtcgtccttttctataaaattcactccgccaccaaatctcgaatccccatcgcgctgcttttccaccgaccccgacgccgacgccgacgccaccgccgctccctccccagtccccactccccttcccgggccgcggagcagagatccggggcgccgcgcgatggcgaacatcgacatggcgaagatcctggcggacctggaccgcggcgccagcggcggcgacgcgcgggtgcccaagaccaagctcgtatgcacgctcggcccggcctcccgcaccgtgcccatgctcgagaagctgctccgcgccggcatgaacgtcgcgcgcttcaacttctcccacggcacccacgagtaccaccaggagacgctcgacaacctccgccaggccatgcacaacaccggcatcctctgcgccgtcatgctcgacaccaagggtcctgagatccgtacagggtttttgaaggatggtaaaccgattaagctaaccaagggtcaagaaatcactgtcaccactgattatgatatcaagggtgacgaaaatacgattgctatgagttacaagaaactgcctgttgacgtgaagcctggaaatgtcatactctgcgcagatggtactatctctctggccgttctatcttgtgatcctgatgctggaactgtgaggtgtagatgcgagaacactgcaatgcttggtgagagaaagaactgcaatctgccaggaattgttgtggatcttcctacattgactgagaaagataaagaagacattttgggctggggtgttccaaatgatattgacatgattgctctatcctttgtccgtaaaggatcagatttggtgactgtgagacaggttcttgggcagcatgccaagcgcattaagttgatgtcaaaggttgaaaaccaagagggtgttgtaaactttgatgagatcttgagggagactgatgcttttatggttgctagaggtgatcttggaatggagattcctgttgagaagattttccttgcgcagaagatgatgatctacaagtgcaacattgctggcaaacctgttgttaccgctacccagatgctcgagtcgatgatcaaatcccctaggcccacccgcgcagaggccactgacgttgcaaatgctgttcttgatggaactgactgtgtcatgctcagtggtgagagtgctgctggagcctaccccgaggtggctgtgaagatcatggctcgtatctgcatcgaggcagagtcttccctggaccacgaggcagttttcaaggccatgatcaggtccgcgcctcttccaatgagccctctggagtctcttgcgtcatctgctgtgcgaactgccaacaaggccaaggccgcactgatcgtcgtcttgactcgcggtggcaccacggccaaactggtcgccaagtaccgccccagggttcccatcctctctgttgtggtacccgtgctaacgacggattctttcgactggaccatcagctccgagggcccagctaggcacagcctgatctatagaggcctcattcccctcctcgctgagggctccgcgaaggctacggattcagagtcaaccgaggtgatcctggaggctgcgctcaagtcggccgtgcagaagcaactttgcaagcctggtgatgccattgtggctctccatcgtatcggcgtcgcctccgtcatcaagatctgcatcgtgaagtgatcaccgtgacttgactcctaagtcccaggggggtggttctcaccgctgggacctatgaaacaacttttctgcctcctttttaactgcatttttcggagacagataattactgtatgttgtaagcccgcttctgttgtttgcagctgcaagatgtctttttttttgtttacatagtttttgagctggtaaatgaggagggagaggactccattgatgttagtggtaataagatttgtatctacggagttcagttaaaaggcttttctacatgaaaaaaaaaaaaaaaactgtaaaaaggttcatgcccttgtttagtgtaaagatcatgtagatagatgccgggtttttt

SEQ ID NO: 16367 - DNA, 2151 bp, Zea mays
ccggccgggccgggatcccagagacgcccaccgaatcgcaattccccactcccaccccccttctcctttctataaagggaaacttcgccaccaatgcccggatcccatctcgctgctctccgctgctcgccgccgctcgacgccgacgccgacaccaccgccacctctccctcccccattccccgtgccccggaccgcggagcagacagaggcgagatccggagcgccgcgcgatggcgaacatcgacatggcgaagatcctggcggacctggaccgcggcgccggcgacgcgcggctgcccaagaccaagctcgtctgcacgctcggcccggcctcccgctccgtgcccatgctcgagaagctgctccgcgccggcatgaacgtcgcgcgcttcaacttctcccacggcacccaccagtaccaccaggagacgctcgacagcctccgccaggccatgcacaacaccggcatcctctgcgccgtcatgctcgacaccaagggtcctgagattcgtacagggtttttgaaggatggtaaaccaattaagctaaccaagggtcaagagatcactgttaccactgattatgatatcaagggtgacgaaaatatgatcgctatgagttacaagaaactgcctgttgacgtgaagcctggaaatgtcatactctgcgcagatggtactatctctctggccgttctgtcttgcgatcctgatgctggaactgtgcggtgtaggtgtgagaacactgcaatgcttggtgagagaaagaactgcaatttgccaggaattgttgtggatcttcctacattgactgagaaagataaagaagatattttgggctggggtgttccaaatgacattgacatgattgctctatcctttgtccgtaaaggatcagatttggtgactgtcagacaggttcttgggcagcatgccaagcgcattaagttgatgtcaaaggttgagaaccaagagggtgttgtaaactttgatgagatcttgagggagactgatgcttttatggttgctagaggtgatctgggaatggagattccagtcgagaagattttccttgcgcagaagatgatgatctacaagtgcaacattgctggcaaacctgttgttactgctacccagatgctcgagtcgatgatcaaatctcctcggccgacacgtgctgaggccactgacgttgcaaatgccgttcttgatggaactgactgtgtcatgctcagcggagagagtgccgctggagcctaccccgaggtggctgtgaagatcatggctcgtatttgcatcgaggcagaatcttccctggaccacgaggcagttttcaaggccatgatcaggtccgcgcctcttccaatgagccctctggagtcccttgcatcatctgctgtgaggactgccaacaaggccaaggccgcactgattgtcgtcctgactcgcggtggcaccacggccaaactggtcgccaagtaccgccccagggtccccatcctctccgttgtcgtacccgtgcttacgaccgactctttcgactggaccatcagctccgagggcccagctaggcacagcctgatctacagaggcctcattcccctcctcgccgagggctccgcgaaggctacggattcagagtcgacggaggtgatcctggaggccgcgttgaagtcggccgtgcagaagcagctctgcaagcctggtgatgccatcgtggctcttcatcgtattggcgtcgcctccgtcatcaagatctgcatcgtgaagtgatcaccacgacctggttctcactgctgggattccatgaaacaacttttctgcctcctttttactgcattttttttccggagacagatatttatgttgtaagcctgcgtctgttgtttgcagttgcggaatgttttttttttgttcacgtagttatttagctggtaaatggggagggagaggactccattgatgttagtggtaataagatttgtgtctatggagttgagttgaaagggttttttcatgctaagccccgagacactaggagatggagatcgaggttgagatgagataagcaataagtgaaaaaaatgttgatttgctttctttgtatgcacacgcttttgaggggtaagattagtctccattggagttg

SEQ ID NO: 16368 - DNA, 1255 bp, Zea mays
gcacgacgttcagacaggttcttgggcagctttccaagcgcattaacttgatgtcaaaggttgaaaaccaagagggtgttgtaaactttgatgagatcttgagggagactgatgcttttatggttgctagaggtgatctgggaatggagattccagttgagaagattttccttgcgcagaagatgatgatctacaagtgcaacattgctggcaaacctgttgttactgctacccagatgctcgagtcgatgatcaaatctcctcggccgacacgtgctgaggccactgatgttgcaaatgccgttcttgatggaaccgactgtgtcatgctcagcggcgagagtgccgctggagcctaccccgaggtggctgtgaagatcatggctcgtatctgcatcgaggcggaatcttccctggaccacgaggcagttttcaaggccatgatcaggtccgcgcctcttccaatgagccctctggagtcccttgcatcatctgccgtgaggaccgcgaacaaggccaaggctgcactgattgtcgtcctgactcgcggtggcaccacggccaaactggtcgccaagtaccgccccagggtccccatcctctccgttgtcgtacccgtgcttacgaccgactctttcgactggaccatcagctccgagggcccagctaggcacagcctgatctacagaggcctgattcccctcctcgccgagggctccgcgaaggctacggattcagagtcgacggaggtgatccttgaggccgcgttgaagtcggccgtgcagaagcagctctgcaagcctggtgatgccatcgtggctcttcatcgtatcggcgtcgcctccgtcatcaagatctgcatcgtgaagtgatcaccacgacctgactcctaagccctggggcgtggttctcactgctgggattccatgaaacagcttttctgcctcctttttactgcaatttttttcccggagacagatatttatgttgtaagcctgcgtctgttgtttgcagttgcggaatgttttttttttgttcacgtagttatttagctggtaaatggggagggagaggactccattgatgttagtggtaataagatttgtgtctatggagttgagttgaaagggttttttcatgctaagccccgagacactaggagatggggaccgaggttgagatgagataagcaataagtgaaaaaaattgttgatttgctgaaaaaaaaaaaaaaaaaggcccctagggccgcccg

SEQ ID NO: 16369 - DNA, 959 bp, Zea mays
  misc_feature (941)..(941): n is a, c, g, or t
gccggccggtttccggagtgcccgccgcgtcgccagcgactgacccctgcctggtgcatgcgccttccatctccggccggtctccgctcgtcgtcctcgcccagcccagagacgcccacggaatcgcaattccccactcccaccccccttctcctttctataaagggaaacttcgccaccaaatctcgaatcccatctcgctgctctccgccgctcgacgccgacgccgacgccgacacctctccctcccccattccccgtgccccggaccgcggagcagacagaggcgagatccggagcgccgcgcgatggcgaacatcgacatggcgaagatcctggcggacctggaccgcggcgccggcgacgcgcggctgcccaagaccaagctcgtctgcacgctcggcccggcctcccgctccgtgcccatgctcgagaagctgctccgcgccggcatgaacgtcgcgcgcttcaacttctcccacggcacccaccagtaccaccaggagacgctcgacagcctccgccaggccatgcacaacaccggcatcctctgcgccgtcatgctcgacaccaagggtcctgagattcgtacagggtttttgaaggatggtaaaccaattaagctaaccaagggtcaagagatcactgttaccactgattatgatatcaagggtgacgaaaatatgatcgctatgagttacaagaaactgcctgttgacgtgaagcctggaaatgtcatactctgcgcagatggtactatctctctggccgttctgtcttgcgatcctgatgctggaactgtgcggtgtaggtgtgagaacactgcaatgcttggtgagagaaagaactgcaatttgccaggaaattgttgtggatcttcctacattgactgagaaagataaagaagatattttggggctggggtgttccaaatgacattngacatgattgctctatcc

SEQ ID NO: 16370 - DNA, 2271 bp, Zea mays
cggcatccccaccagcccagcaccaggaaggaaatagcggcgagcaagagctggcggaaagaagaggaaagccaggcacgccgctcacccaccgcgccaccaaccgcagatcctaaatccgatctctctctccctccctccctccctcccgctcgaggttttcggtttcgatccggcaagcgggcgagatcttcatggcgacgtcgttcgaccgctgggagaaggaccccttcttcctcgccgccgaggaggtccaggaatccgccgatcggatggaatcggtttatcgggtatgggtgcaggagaggagcgggggcgattccgaggcggcaagcgtcactggaggccctacagctgcgcagcttcgccgcgagctgcacacggcgcttggtaccgccaagtggcagcttgatgaactggcgcgggcagtcagatcgaacgatctggttatgtcagcaggaaaagacacaagggctaggcatgatgattttgttacagcaatcggctatcgcatattagaggtcgagaactacttgaaagaatccaatcttgcggacgggagggggccattgagctgggttcacttggatgaggatgaaagggacgaccttgcagcttttctatctgccagtccttttcaacagaaagacaaagtggtcacaattccttcagcaggtgacattgaagtgggcagcaatgcagcaaggatgaaaaatgatatatcaactgacagctccaaggattcagctggttccacggatttgatttcaggcacagcaaaggaagatttgcatcgtgggcacagaagagcagctagtgccagtgctgatataggctcatggagcatgtcaatccctaatgaatgtgaaggaactacagaacagttatctgatggctcagacaaattgcctttgcgtaagatagtgaaaacatgtgctttgacaagtaccttgcaatctaagactagaacgaagtggaaaaatggagctgttaggtgggcaggcagtaaccaacaggatgttgaagaggctatccctctgaatacttctcagttgagtcagggcttagaggaatgctttgaaaggaacaagagttgcttaagtacatgtgatgagcatacatacaataagaaacttcatggttggctcggagcccttcgtagacaacttcaaaggtctcagtaccaaattcaatatgggcatcatattcaattgattgttttggcacttgctgcccttgtaatcattgtatgcatagtgaggacaatctggtgactatatttatttgctcatgattggatttctagcctcacaagatcagcagcttgtatggtaaattcactggcagttaagttactcttggtcaacttgatcctgaagcatgcatatgaggcaactatggtagaccattttggtagtcaaggttcaaaatcacgtataatgatctggttggggccacttatcttgccacatgttcagggcagtctgcctcgtccttggaagaacatctacaggacaatccttgcagcacggttgtttcaccacacttggatatgctcccgaatggtgccttgaacaattgatgcacctcgagaactcaatcctccgtggtgagttggtgactggttggcacctatgcaatggcccagtataaattagtggtgcagtgggctggcgatcatgctgctagcaaccgaaattgcaagacttgtatcatacataaacgctattgcttttaccgcctgacacggaagggtggtgatcatgcatcaatgctattgcttttacaacctgacacagaagggtgtcatttttttttgtaggagttgccatctgaactgtagagctccataggggataggttctgatcggaatgtgaatggcactagaaaattacttttactgtatctgcttgtgttgtcaagaaccgaatgaggtgcctggcagccttgtctgtaccctgtacactaaaattggagaatgttgaagccctcggcagtaatcggctggacttgtaaggtgccagtgtgtgttgagcctgcatattacggctaaattcggtgaagattatagcactttactgtgcatcctaatgtcaaagcccccaaccaatgtttggtattccaaaccccgaagtcccaaggaaacccctcttggtcgagtcctcttacagattcgtgtttatgagaaatcatgattcggcttctgtagcataaataactggcagcttctgcatggcctcgaacaaaaggaagctcactcgtcaggggta

SEQ ID NO: 16371 - DNA, 1802 bp, Zea mays
gttgctttcgcttcggttttctcccagaactccaccgagagaggggaaggactccacaaggagaggggccgaggggggagtaaactcgggtccgtgtgacggcagagagtttccgacgaggagagagaagcagctgggaagggcactcacggagcttacagagaaaaaaggggtcgaggttcatgcccgtttggttcctcggttgctgcgtgaggcggccggaggagtcgtgaaccgggaatgacgggggtggtggtggtttccagcgcggggtgcaagggtggcggcggggcgaagagggccgccggcggcagaggtggcggggaggaggagcggcggcggcgggcggcggttctggagctgctgctcgcggccgtgcggcgctccgtggtggcgtgccgggtggagcgcggggccgccggagcccgggtggccggcgagagaggaggacgcggcggtggcgctcgaggagatggagatcggttggcccaccgacgtccgccacgtcgcccacgtcaccttcgaccgcttccacggcttcctcggcctccccgtcgagttcgaggatgagatgccctgccgcgtgcccagcgccagcgccagcgtttttggtgtctcggctgaattgatgcaatgcacatacgatggcaagggaaattcagtccccacgatattgctgctcttgcaggagaggctgtatgcccacggggggctgaagtctgaggggatctttcgcattaatccagagaatgaccaagaggagcacgtgagggaccagctgaacaaaggaattgtacctgatgacattgatgttcactgcttggctagcctgattaaggcatggttcagggaacttccagaaggtgtcctggatggcctgtcccctcagcaagtgcttcaatgcaattctgaaggggagttccttgagcttgtgacactgttgcgccccactcaggcggcactcctcaattgggctgtcgagctgatgtctgatgttgtcgaagaggaggagctcaacaagatgaatgctaggaacgtagccatggtgtttgcccccaacatgacacagatgtcagatccactgacagcactcatgcatgccgtccaagtcatgaactttctcaagacactgatcttgaggacgcttcgggagcgcgatgatgcagccaccaccggagagtacacaccatactcatctccagcatcatccagtaagcatgatgacgccgaatgctgctatggcagtgagcaggacatggacaggagctgtgagatgagtgacatgcatagccagatcagcaagtctgggcgacatgcagactatctcgtacgctacaatacctgttttgacagcgaacaagaggtcgacgatcatctgagtgaggttgaagaaggtttcttgcgtcggttggagcgtgatcttggagcagacagaccagaggtttcttgcagaaaaatctcagagatcatggccctggaggatgctgagccgaaagctgaaactagagcagtggagaagggcatacagaatgagaatgaagaggttgctgaacagctataatgatggaagttctgtgtttttaggcagtaaagcttattattgtaagtactgaacactgaccaatggtctttatccaacacctcggttgaatgtattgctccagtgtatgatgtaaacttggctgatccttttaatgcttggtgcccctttgttaccaaaaaaaataaaaatggaaatggtcaggctcactgggaacatgagcccttgatcataaaaatttcctgtgatcgagttgatatat

SEQ ID NO: 16372 - DNA, 5256 bp, Zea mays
gctcggtacccctgcagcctaagtggaaggttaaatgaattctggatgttcttcatgttataactaatgtctcatttggtttcgatgctcacatctggttcagtgttggaatctgggaccttccccgatcctcattgcccctgaaatctgattagcatgacttattttttgctacaatttctttggatctttttctttacatcctactagaacttgatgcacctttaattgaggtgtcagcaaatcctggggatcatttgcttgcagtgccaagttagcggtatttgtataggtaaaccctctgtgaatgaatgcagaattcaggttataggctggatgcgatttgagctttaaaagagattgctttttaacaaactgaacacctgcactcacaggtgctacataaataatatgatttcatttagtcgagtcctgtatgttctaaaatatccttaagccctgtgctagcatcttgtgtttgttctatttcaaagatggtttttactgttctttgctgtattgcttctatgcatattctttagagccgtgtgttaacttgtgctattgtgcattgcagaagctagaaaaggcgaaaaccgaagattgaaaaagaccagcaagcagttttagagagcagatgaaaggcgggcatttttgttgatgtcttatctttcgtgtcaattgtgtttttgcttgtcccgtagacctttcaggatatctggagtgtatcttcaagtatgtgatatatatatacgattcaagaacctgtctgggatgattattcatctttcgggacacgtcctgtttggatcattatataacaacatcgcaaatgtcttgtgtatgtaacattttttactctggaactgctaatgctcagttaagaagtggggacacgtgtgtgtttttcctcctttgcagccaactttcatgacatctcaaatactactgaagtagtattcgtatacaaggtgaaacatctgagaaagcatgtgatagtattaagcatcaaacattctagagaagaagaccagttgtaataagtgaaaattttcagttcctgaagatgatttattttagaccacttgtctgaagattaatcgaggagatgtcatatataacacaagtgactgcaaagattcactcgaagtatgattccacaagccacaaagctctataatctggataggatccttcacgatacactagatctgatgaacaattatatacattaattcccattgcttcatacaacatcatcttaatttcctgtcagcatctacatagggtaatctcgagttgtcgatatatgaataacatcaaataaagtaaaacaaccatgcatactgtgaatctccctgtcaagtgtttacaatcagcagatttttaaacggacggcacggttctgctgctctggctctgctcggccgccggctcagcgcatggttgctgctgctgcggcagcccctgctcctcatggtctcccagcatcaaggtggcggcggggaccacctgcacctgcacgtcgctgctctgctcggccggttcaacgcatggctgctgctgcagcggcaacccctgctcctcatagtctctcagtatctctaggaaacctttccgatagacattgttgagccagtcgtcgaagtagtcgagctccgccactgctgactcaatgcgtcgactctgttcctcctcgcctccggccatcaggggatccccgccttgttcatgaccatgaacatagcagggcatcaaggtggcggcgggatccacctgcacctgcacgtcgctgctctgctcggccggttcaatgcatggttgctgctgcagcggcaacccctgctcctcattgtctcccagtatctctaggaaacctttccaatcgacattgttgagccagtcgtcgaagtagtcgagctccgcctctggtgactcaacgcgtcgactctgttcctcctcgcctccggccatcaggggatccccgccttgttcatgaccatgaacatagctgggcatcaaggtggcggcggggtccacctgcacctgcacgtcgctgctcggctcagcgcatggctgttgctgctgctgctgctccccatcgacattgttgatgttgagcaagtagtcgacgttggacttgcccaactcgcctccgaccatcaggggatcatccatcgtcgggtaagcagtagcaccggtgaagatggcgccggcggggtcctgcatctgctgcacctgcacgtcgtggatcaccttggttggcggcgcctcggggtgatcgcctgtcgccgtcctcttggtattgtatttcttcttggccagagacgaggacgaacggtgcaccttgcacagcacgtggtcgccgccgccgccctgggtgtcgtcgtactcggtcatctgccatcccttcctgtcgaagcgatggcgatgccgacccgacgtcccctcgtcctccttctccttgcggccgtaggataagctgcaggccggcgcgccgggcaagccctccacgggcttcgggccagtctccgagtgccagcacgtcccggcggtctccaccgcgcgcagcctgtgcccgctggcccttcccacgccgttcttgtatcgtttcggacagtataggtaccactgcctgttgtacccgtcctccgtcacgtcggtgcccggcaccggctccaggccggcgaccagctcctcaggagcagcggtgtacacgtccacgttgtggatgaaggctttgtcgacggttccggcgcggaggccgcgcaggagggcgacggacgcctcgttggtggcccggaagacgtgatcgtcggcggccatatgccaccgatctccgatctccaggtggtgatggtggatcggctagcgcctagcgcgtacgttctgtcgccgcgggtgggggacgatgatggctagcttcttgtgtctacgtaagttctgcactgcacgcggacaggcaggtagctaggtaggtgtttatatacacctttacgagataagtctgacagcagaattttgaactgtgaaacagatcgatctactagatatataggagataaatctcgaaatggtatggatttctgtttgtgataggctgcgtgcagtgtatttctgtttgttttcttttacaaacgatggatgatttctgtttgttttcttttacagacgatggatgatttctgtttgttttcttttacaaactttgtaaatttgttttagacgtcaaaacaaaccatgcatgtacgtttttgttcttgctgtttcttttacaaactttgtatttctgtttctttatttcttctacaaatttacaaactttctaaatttgttttacacgtcaaaactcaaaataatctttataattaagatgtcaatgcggaaatgtattccctcagtttgttcaatcccttgcttctaaaacctgatttgtatgtataggttgaattgttttcaaaattcaatgaggccataaataaaggcatcgtattcaagattaaaattcatcataaaattattattattattattattattattaatttacagtaatcattacattctctactttattacaaataataacacgattgatcatgtattcatgtatgtttggttgttgtgaaattctaatttgaaatttaaataaaaatatatttgtttgtccgttgtttatttgaattagaggacaagcaatcacacacacatcactagcacaagtcaaagcacatagcacttataaccgcacacatattcacacactagagacttgggagctcgatgtgatacccaattttctgaaaagaagttaaatgtatttttcccttttctttcgtgatctgtgtagttggggttggagttttttaggaagcattcaccaataaaacagtagaatacttgttggatttgtgcgttggggtcgggagcagacgtgagagcgagtttgggtcgtggatctcgatccggcggtgaggagcccattagttaacaccataaccggattcaaacagcgatatcttttaaaatataattccaaatcaagcacataagtacttattggaaagataagacaaagccctacatgattatcatactggttaacactaattacccacgaaaaattcacagaaactgctaatactactgctgctcacccacctgaaaaatctgtttttttggacagcaacataaccggattcaaacaacgatatctcctaaattataactccaaatcgagcgcataagttctcgttggaaaggtatgacaaagctctacatgattctcccactgatccctactaattgcccacgaaaaattcccagaaatcactagaactactgctgttcgtccacccactaaatttctggacagcacctctaccaaatcgcataggtaaacatgtaaccaattggattgcagcacaaatacaacaaaatgatcacgaaaatcaccttgggttcctcctttcctccttcttttcttccttcttcctccctccaaactcccatggaagactcgcacccacacgacggacaccaagcggggaggctccaccttggagaggaagaggtgggggggctagggttgaggggtggcgctgcaatcacttggggaagaaggagagggattggggcggctgcaagagtggaagagaggaaaagagaggggggcggccaaaggggtgggggagtgagagggagggggcggctagggttaagggggggaaactaatgggctccccaccgccggatcgagatccacgacccaaactcgctctcacgtctgctcccgaccccagcgcacaagtccaacaagtattctactgttttactggtgaatgcttcctaaaaaactccaaccccaactacacagatcacgaaagaaaagggaaaaataaatttaacttcttttcagaaaattgggtatcacactctaccccccttaaaaagaattcgacctcgaattccgacacttctatcgaaacaacaaaagaaagattaatgaatcaacaaaactcacacataaataaaagttcgagtagttctgccgcatcagctcctcaagctcctaggattctaagatacgcagcagacgacactctagagtctggtcttgctacacaggaatcggctctagctcgatttgatggtctggattccgcaaatacttcctcaacataaagacatggaatacatggtgtactctaatcatagattccgacaattacatgtgctaagcccagggggaccgag

SEQ ID NO: 16373 - DNA, 609 bp, Zea mays
cattgggaccctcgcgcccgggcccggccggccggccgggagaaatccccattccaagcgcgagggttttgctgctgctccagccggacccaggacaagaagcggcgcgatggcggtgggcgacctggcgttcaaggcgctgacggctgggctgggcgtcgccacgctctacctcgccgccaccttctccgtcaacgtctaccgcggcctctcgtggcactccgagcagtccaagctagaaaaggcgaaaaccgaagattgaaaaagaccagcaagcagttttagagagcagatgaaaggcgggcatttttgttgatgtcttatctttcgtgtcaattgtgtttttgcttgtcccgtagacctttcaggatatctggagtgtatcttcaagtatgtgatatatatatacgattcaagaacctgtctgggatgattattcatctttcgggacacgtcctgtttggatcattatataacaacatcgcaaatgtcttgtgtatgtaacattttttactctggaactgctaatgctcagttaagaagtggggacacgtgtgtgtttttcctcctttgcagccaaaaaaaaaaaaaaaaaagccccccggccgc

SEQ ID NO: 16374 - DNA, 810 bp, Zea mays
gacgaacagccccgagtgggctatattcgttctcccggcgtgctccgtctctcctctctcagcgcgacgattacggctcagatcttcgtcgtcatcttctccggcaacgagcacccaaagatggtggtccttcaaccagatcggttcctgagcgagctgacgagcatgtacgagcggagcacggagaagggctccgtctgggtcaccatgaagcgatcaactctcaagggcaaggcacagttgcggaagatggagaataaggggcaggaggtagagcacaggtgcctcgtccgcgcctccaatggcaagaagaacatctccacctcggtttctctaaaggagtacacaaagttccaagcttcatacgcaacagttcttaaggcccatatgcatgctctgaagaaaagggagaggaaagacaagaagaaggctgcagatgctgagaaggcaattgagaccgcacccaagaagcagaagaaagcatcttcaaagaaatcttcggggtccaaatcataaggcgctcgcagaaatcaagtcttctcccttctgttgttaccgcaccgccagactaattagggtgtcgtgaaattttttcttatctggtttttatccgaatttgtgtctgggagatgaaagcctgtgaatacacttttatagagccgtgtcatcgatgctagcattttttgaagcagagttttgaggtgaatgtgaggcactgtgctgccctgattggcattaacgaaaatgcacaagtttgaacttttattgcataaaggtaatggagtttgttaggcaaaaaaaaaaaaaaaa

SEQ ID NO: 16375 - DNA, 888 bp, Zea mays
  misc_feature (867)..(867): n is a, c, g, or t
gatcgcccgcctcgccgacagccccgactgggctatattcgttctcccggcgtgctccgtctctcctctctcagcgcgacgattacggtaacgccgtcgccgccctacggctcagatcttcgtcgtcatcttctccggcaacgagcacccaaagatggtggtccttcaaccagatcggttcctgagcgagctgacgagcatgtacgagcggagcacggagaagggctccgtctgggtcaccatgaagcgatcaactctcaagggcaaggcacagttgcggaagatggagaataaggggcaggaggtagagcacaggtgcctcgtccgcgcctccaatggcaagaagaacatctccacctcggtttctctaaaggagtacacaaagtttcaagcttcatacgcaacagttcttaaggcccatatgcatgctctgaagaaaagggagaggaaagacaagaagaagactgcagatgctgagaaggcaattgagaccgcacccaagaagcagaagaaagcatcttcaaagaaatcttcagggtccaagtcataaggcgctcacagaactcagtgtgtcttctcctttatgttgtttaccgccagactaattagagtgtcgtgaagttttacttatctggtttttattcgaattcgtgtctggaagatgaaagcctgtgaatacacctttatagagccgtgtcatcgatgctaacattttttgaagcagagttttgaggtgaatgtgaggcgctgtgctgccctgattggcattaacgaaaatgcacaagtttgaacttttattgcataaaggtaatggagtttgttagggaaaaaaaaaaaaaaaagactccgagctcgtgcgattaatanaaaaaaaaaaaaaaagcccct

SEQ ID NO: 16376 - DNA, 2459 bp, Zea mays
cccacgcggccgactggaccttcaagcgcaccgcgcgtcattgttctcgttggcctttcttcatcagcaaatgtcggatcacttgccaaggatcttttggcatttgcagaaggagatgatcggaaactgaaattatctaccattgcttctcctacttataagcttcgaaccacagtactgcaagcaccatatggtgatcttaccacatgcatggaactggcgaaggttgctgatttgttagcgttcgtactgccagccaattcattctacagtggtgatttgaatagcccaattgatgagtttggatctcaatgcctgtctgtatttagggccatgggcttacctagtacagctgtttttattcgtgatcttccagcggataataaaagtaggcaggaattgaagaaagcagcaacttctttcctttctgcagagctgcctgaggactgcaagttttacttggcagacacaaaggatgatttgcataagttcatgtggcttttcaaggagcagcatctttcctcgccacattggagaaaccagagatcttatgttatgtctgagcaggtctgcataaatcctgatgaaaatacgggattgtgcacattgctcgtgtctggatatttgcgggcccacaatctttcagtgaatcagcttgtccatgtttcaggtgctggtgattttcagttaggccaaattgatgtcctcaaggatccctcgcctccttgtccgcggacatcctctgcggtaatggaaacagaagataatggaattcagattgttaacacttttgttccagacccttcaagtcaggaacccttacttgttgaaaatgtgccagatcctcttgccggggagcagacttggccaacggaagaagacatggaggaggtcgacataaacaacaaacagagaaaattggaaaagaggaagcttccccaaggcacttcagagtaccaggctgcttggattgttgaggacacagatgatgaagataacgactctgatgatgacaaccagactgaatctggaatggtcattgatgagcaaggtcactcagaccaaggaagtgatggttcagatatagatgcagtgtctcactttacggagaagtttgatggagaaactattggggatactgagatggcagatgaagaaaatttgacgaaagaccagatagaggcagagattaagaaaatcaaagaagctaatgctgatgatgaagaatttcctgatgaggtggagacaccattagatgtcccagcaaagaagcggtttgcaaaatacagaggactaaagtcatttaggacatcatcctgggatcctaaggaatcgttgccactggactatgcaagaatatttgcatttgataactttacaagaactcaaaagcatgtctttgctaaaattgctgagttagatggaggcatgaagaattgtgctcaagtgggatcatatgtaaggctttatgtgaaaaatgttcccactgatatagcctccaaactctgtcatccatcaagaagaatacctgtggttgtttctggtcttcttcaacatgagtccaaaatgtcagttcttcacttcagcataaagaaacacgactcttacgaagctcctatcaaatctaaggagcctttgattttcaatgttggattccgacaatttacggcaaggccactgttttcatccgacaacatcaactgcaataaacacaagatggagagatttctgcaccatggccgattttcggttgcatctgtatatgctccaatttccttccctccacttcctctaatagttttgaagaacagagatggcgagcaacctgccattgctgctgtaggttcgctaaaaagtgtggatccagaccggatcattctgaagaaaattgttctgaccgggtatccacagagagtctcgaaactgaaatcgatcgtgcggtatatgttccacaatcccgacgacgtaaaatggttcaagcctgttgagttgtggacaaaacatggtcgtcgtggccgcatcaaggagactgttggtactcatggtgccatgaaatgcttattcaatagcagcattcagcagcatgatactgtgtgcatgagcttgtacaagcgcgcgtatccaaaatggcctgaacagctctaccacgtataagattgcttgacgtttggctggatatgtaccagcaggcagaagcagaacgacgggaatgaaacagccttggagcttgcgtgccgtttagcttaaactaaatattttaggattaggaaaatgttttgttggtcgcctgagctaggaggccgaattttgtattggtccttcatatacttttgaacattctccttggacgtcctttattttagtatcaaatttaaattcaaaaaaaaaaaaaaaataaaaaactcgaggaagggcgccggtaccaaaaaaaaaaaaaaaaaaaaaaaaaaaaaaaaaaa

SEQ ID NO: 16377 - DNA, 1857 bp, Zea mays
ctgctccaccgtaagcgcctgtttcaccgccaccgccgacttcggttggtcctcacccgcgcgtggatggcgcacgcgcctctctcctccaagtgcgccgtcgacaccaagctcccctgcctcaccgcgcgatctccagccccgccgcgctcgcaagtcttgagatcgagcagatccaccatcctgcgccctcgccccatcacgcactcaccttggccccgcatccctgcgccgccataccctcggcctcgccctcgcctcatcctcccctgcccccgcaccgcatccaacgcgtagatccagcgtcgtcgccgcgatacctgcccatgccaccgcgtgcgcaccccccgtgccgtcggcaaaccctagcgtgatccccaccctgcccccgtcctcctcacatcatcggctcccccgtcatccatatcccagtggacatctctggcgacgagaggatgacgtcgtccggggtggtggccgcccggacaacccgttgctcgccaggccgagtctcctgagacccttgagcttgctcagtgacggagggatgcttccatggaaggaattgaaatacagatcaagaaactctaggctctagcactactccagctcttctggcatctgaccggagaatttgttctcggatagcgctagctgagcaaggctggtgaggctggagacgtcaggttggctacagtgtcggggatgaacccactcagcgcgttactactcagatcaagctccactagctgggcgaggtcgccgatggaggatgggattggccccgtcaaccggttcccctgcaacgccaacttcgtgaggttcttcatgttcccaatccctgttgggatggtgccgttgaggaggttggattcgaggcccaacgtcgtgagcccgatgaggtcgtcgctggccggtggaatagacccggagatgctgttttcccctatgttcagtgcttgaatctccctcgggaggcgggcaatggagcctggcaactagccaccgagcttgttgttgtcaagggcgaggacctgcaggctgccgcagttggtaagatggtccaggaactcccagccttactcgtcgctcgccgtcagctggttgcccgacatgtacaacgactgtgggcagagcatgccgatgactcactgctcctttgtatccttatgctattgttttcatccgacaacatcaactgcaataaacataagatggagagatttctgcaccatggcaggttttatgttgcctctgtatatgctccaatttccttcccttcacttcctctaatagttttgaagaacagagatggcgagcaatctgccattgcagctgtaggttcgctaaaaagtatggatccaaatcggatcattctgaagaaaattgttctgaccatgtaagcttgggtgcatccatcttcacaaggcaattttatttacttagaatcctgcacccttttatgttccgtcggaggtgtttggttttctatctgtacacaatcactgtaatgttttgtggagttttacaggatatggcgacatgttggttcgcctctaagggctcccgtttagacctcagctaacatagtggctcatcgttcatgctatattatgtgcaggtatccacagagtctcgaatctgaaatcgatcgtgttgtatatgttccacgatcccaacgacgtaaaatggttcaaggcaagtatttatgcgtgccattgacatatccaatttatccattttcgacgcaacgacaatgttatttttgcagcctattgagcggtggacaaaacatggtcgtcgtggccgcatcatggagaccgttggtactcatggtgcgtcggttcaccaatcaaa

SEQ ID NO: 16378 - DNA, 1133 bp, Zea mays
ccggccggggccccactgacagccgtcgaggacgccatcctcgctcttgcgtccgtgattcgcgcccccacccgctgacagccatcagcgatcccatccacgcgtcgcgccccatctgtgcccctcgcatcggcccccctcgaaaaacctgtttcgtccctcacctctgcccccaaatccgagccaccactgcctgccgctcttcgtcgtcctccggacgcccatgctgtcgccctctccccaacaccgtcgtcctaccccgctggagatcccagccgtggtccatggaggacgtgcggcgcgacgaggaggtcctgcagcgggccaatgttgtcgtgcgcggggacgaggtgacggcggcgttctacgcgcattggtgatggcttctccaccgtgttccgcacgcacttctactgcgccgtccgcggggagctccgcaccgatgccaaggtggccggcttcgacgggatcgtaatctccaggagctatgctgcctccacgccaccgtcaagcgcatcctcggcatctgcttcggccaccagcataagaaacacgactcttacgaagctcctatcaaatctaaggagcctttgattttcaatgttggattccggcaatttacggccattgttttcatccgacaacatcaactgcaataaacataagatggagagatttctgcaccatggctggttttccgttgcctctgtatatgcttcaatttccttccttccacttcctctaatagttttgaagaacagagatggcgagcaatctaccattgcagctgtaggttcgctaaaaagtgtggatccaaatcggatcattctaaagaaaattgttctgactaggtaagcttgggtgcatctatcttcacaaggaaattttagttatgcagaattgtgttgttcgttaagatgaaaaccaactcgagttggtttcatcaagatatttttgttatttgtgagcttcaatgtattcatttattgatttaggaaacaaccaaaaaaaaaaaaaaaaaagcttatcgataacgtccaacctcgaggggggggccgggtacccaattcgcccaatagggaatcgaattacccggcgttcattggccgtcgttttaaaacgtcgggactgga

SEQ ID NO: 16379 - DNA, 1378 bp, Zea mays
aacaccgtcataccgacagcgaagacctttgccgtttttattcttcctccgtctctgcctgtacagcggcggcttggccacctctgagcctcaagccctcaacctccctcttcggcgcgtaacgtcagtcctcaggtattggcagcataaagtgttagatttgtccttgattgaggtaccccttcaaaggtcaagatgttgtggcgcgcagtacgcagtatggatgtaataatgcattcttcgagtttccttcttccgaaactgtatcaacctgtcaacaaaccagtcaagaactatgctttagttgttctaaaccagcatcttccacgattcatgcctcgactctgggatcatgcaaacttgaggatctgcgctgatggaggagctaatcatatttttgatgagatgtatcagataaccaatgatgaagacaaaaaaagcaccagaaataagtatgttccagaaataattgaaggggacatggattctataagacctgaagtaaaactgttctactctagtcagggatccaaaatttctgataagtcacataaccaggagacaacagatctacacaaatgtatttctcgaatccatcattgtacgcctgatgatgaaaaaccaaatctctgtgtacttgttactggagcactaggtggaaggtttgatcacgaggcggcaaatatcaatgttctgtatctgttttcggacatgaggattgtcctcctatcagacgattgcttgatccgacttcttccaagaacacatcgccatgagctttatattgagtcgtctgttgaaggaccccattgtgggcttttccctgttggagcaccatcaacaagcacaacaactactggcctgaaatggaatctaagtgaatcaaagatgagatttgggagcatgataagcacatccaacattgtgcagtcggagaaagtaactgtagaatctgatgcagatctcttgtggacaatttctctgcgaaatctgacataagcagttcctagtttgttatcttttttcttctctttcctgtcaagtggcaaccaagctcttgtacagccacttttgtgtttatgagttgtgtgtctggtaaataaataccatctgatgacaaatcgatgaggtctcatcattagacaggatgtctaccacgatcttgaactgctgatgaattatgtgaataacacgagcaggcatgatggttgtatcctctctagttgtataactgtattgttgtacttgcaacggggtttcttgtataaaattgttctcaacagttcacactgtatggttggattttgtaatgagtctggcaattgggtacagtgatatatgctaatccatctgttctaatgtaagacattttagattt

SEQ ID NO: 16380 - DNA, 1022 bp, Zea mays
ctattgttgctgagacctctttgatgtcattattgcgatggagttacaagacaggcatggaaaaatccacaagctcctcaaatggacaagttactttggtaaatggatctgaatttgcgattatctctcttatggcctcagagaatgacttgaggattccagaatctctgccatgccttcatgacaaagtacttgcagcagctgcggaagcagctatgagtttctcaactgatcagagaagaaagcagaatccagcagcagggattattggtggcttcattaaaggaatgaaaggcaaggctgaagaaaatgcaaaaatgagagaaagtttgacattgcgagctccaagcgaacagttggagtcaattttctcgaaagaaccatttgctgaaccttcaatacccgaccttgatgatccgatggaagaactgtcaatcgatgacatagagattgacgatgaagtagcagtagccctggcacaagcagcatcgtccacatcccaagggaataagagaacagcagtggaggaggagagagcgaagctgtttgaagggtcaaacagtgcggataaaccgagaatgagaacgcagcaggagattctaaccaaatataggtttggcggggacgccgccgccgcagctgctcatgcgaaggataagctgatgcagaggcaggagaaactggagagaattagccaacaaaccgcggagcttcagaatggagcggagaattttgcttccctggcgcaggagctcgcgaaaacaatggagaacaagaagtggtggaagctataaactgggtttgtttgtacgtatgtgtgttgttggatgacacccgtcgttgcgaattggggcacataccagcattaccattttttgtgtccgtattaaacactttggatattctttttgtgttttggtgatgtacgtgtaaagataaaaaagagagaatgaatgggaaccctcttctcctggctaaaaaaaaaaaaaaaaaaaaaaaaaaaaaaaaaaaagggcggccgc

SEQ ID NO: 16381 - DNA, 4749 bp, Zea mays
  misc_feature (3066)..(3066): n is a, c, g, or t
  misc_feature (3299)..(3299): n is a, c, g, or t
cgagggtaacggggttttcaaatttgaagttacaaagcgctcgggatttaccaaattcaacgaatttcgagcgatttttcgttttcgcagacgaccaccggaaaaatgcgttcaaaacctgcacgtactaattcatcaaagaagattactacgtacgtgcatcgcttttgagaaacgagcagagcaacctgcattgtatgaaactggaaaccgttggccatggctactcagaagatcaaaacggtggcaagcttggccagtagctccttgagaacagcagggcagctggcgttgagcacctcgaagccatccgtcgtctgagtgaaggagccaaggttgccgctagaagagaggaaacggaagcacgcctccttgagcgcagggcaatggtgtcggtcagctaaaaccagcatcgtggccaccgagtccgcgcgtatgtgcttgcacagcttctcctggcaaaccagcttcatcctgtcgacgccgtacctgtccgcggcggcaagcagaagctgatactgcaccatggcttcatcgtcgtcgtcgtcgtcgtcgtcgccgctgccagtctccggcggcaacgagtcggtgtagatgaaggccagcagggcgctgaacacctgggcttccatgtcctcaaccggtatgacgacgccggtgcccttgctgctctccatcatctcgccgaacagctgcgctctgaacacgggcgaccgcgccgcgagcacgcaccggtgcgcggagaacgtctcgccgcccgcgtcgaccagctggaacgtgacgtccgcgccgtccttgcgcgccagcaggtcgccgaggtgccggtggaggtcgtcggacgggggcgccgcgacgaaggcgtcgccgtcgccggccgtggccgcggcgaagggcttgatggcgatgtcacagcggacgtggaagcagcggccgccgtcgttgtcgaggtagtactcctgccgctccaggtcgtccctggtgaggaagcccggacactcccactgccacatctgctggatcaggcagttctggaacaaggtggctcgggtcctggacggcaccggcaggcctcctcggtccagcaggctgagcttgaacgaggcgttgaggggctcgcgggtgctgctgtagggaagagagacggtgaaggacgccgtaccagcggcgggatcagcggagcagacgcatcgccagtggtagccctgtatgcagggagaccatgaagagtagtcctcgtccaagaaggcagaactacgctcgagccgggcggccgcgatctcgaacaggtggtgctcactctccatagtggtaccgtctcgtctcgaactcgacggcggaggctcagggggtgctcgtcggttgtggtggtggatgaggcgcccggcaacaagttatatatactaggtgttgatggcgtagggtcacaagtacggatggacggctgccgatgagatgaggtgtggggctgctgagctgctgagaccctgagcaccagaccagaaacagtttgcaaagttgcacgatgtgcatgcagcgggttggaagagggaaagctcaatggtggtagccaccatgtgactctgagaataaaggaacgccgaaagtgctttcatctgataccctagctgacgctgcaatggtgctttattagtcagtacgtactagtaattcagtaaattttaaagtttcttttatttagaaggaaaggagacatatgcacatctttatattttcgtccaaagattcctcctccctctttaacttttttccccggatgcccctatagaaatagggaacccatcaggtatatatatataggcttttggtgcacatattaaatcacaagcatccattttagatctaacgtcattctgcacctcttgttactgtcatgtatattttccaagaacatccctccatcatccttctctgttttctccaaagagccccctcccttaaatctaagatggatgacaacgattcaatatcatcgtgattggttgccggcctcgcttctgcccggcttgtgctagcctgagccgatagaaaagctccagcctctcgtttccacgcatgctagactactaagaaaatacctttgttgtacccgcacgtacagattaggcgcatgctatacaagtaaataatcagaggcacaagcacggtcaacacacgtgcttggcctatgcaccgttggcctggtaaccaatcacacagtattgacctgtttgtttgttttacgccagcgtgcatatgcacccgtggaattttaaagcaagtcgtgtttggttgactgcactttatgtactggttcaacagatgtaattcaagggctgcaatcaggctgagggcatacgcggctagcggacgtatgcccgcgtgtaggcgctgccaatgcagcggcacacaaaccgatgtagagtttatgtgtgtttagatttaaccactacaccgattttatattcaagttcctcatattcttgcgaacaaaactataccacacatattgtataatatgtggagatttattcataaatttttctctagtacatgttctgatataaacagccaaacaaagtctgtgtctggtctgcacgtgtctgtatgagcaaccaaacaaaagcgcttacatgaactcattctggttgtatcaatactggctaagatcatacgagccaggctcaacttctaagagaaccaaacacaccctatgtgttctatgtgcatcttaaatggtcataagagaccatttgggacggctcccactctggctactagacagagcgctcccaaacacgtcagctaaaacagctcattggagggagcaggagtcggtttagcccatgaggccttgtttggcaacgggtgtaaaagcgagtattgaggcccaatacatgtcccacgtgtaatcaggtccacgacgggagcatgttccctgtgtggcccatatttatctttggcaaatcaggtgttcaagtgtattagggtcctatacacgccaatacgccggggatagaaaaatccccaccgaggcgtggaagacagcctgtcgttctcgcgtggcgncgtcactaaccctagatcaagacgagtgcatccacggctctccacgccgccgccgatctcgtcgagaggcatccacgactctccacgccgccgccgatctcgttcgtccagcgtgtgagttttacttcatcatgtactgcatttcttcctgttcttgagcgtcggcactggctgggcgccggcacctgtgcgggatgaacgaacaagagaagagaatagacgacacggagagnggggaggagccgcgaggtgcgagaaaaaggaggccaaaagcagccgctgctgccttgttggttgagtggcacggataggccaaaagcagtcgctgctgccttattgggtgagcagcacggatcttgatttcacgcatctggcagggtgagcggcactagaaaagcagctccagctagcagctactaatcctatagccaaatattggccagaagcgtagtcaatggtagaatggctgaaaaagttatttcctcatgcgtttgtttttccgactgcaattattttctaatcctgtgttttcctttttttctctgtttatgaaatagttatttcctcatacatgttagcaataataattaagttttgcatatacaatgactcttaacctttgatttgttatattctgaaatttattagcccatttttttgttttgtatgctatgatatcagattgcattgtaccaaggataagaaaaatggatcaactaattaggaatagaagagaagaggaggacgaggagttaatgctctttcttttccctgctctttatttaattagtaatagagggagagagaaaagagcaaggcatgcttctattctatctcgcaaggagagacttaatgagattctcgaaggacatgagaagaattgtcttgtcgcattccgtatggagcctagtatattcaaagatatagcatcatttcttagagaagaacacatcctacgtgatacaaggggtgttactttggaagaaaaattgggaatgttccttttcatgttgtcccataatgctagttatgaggatttacaacatgaatttaaacatagtggtgaaactatccatcgacacatccaatcagttttccatataatcccatctctcatgtatagatttgtgaagcctgccactggaatttcagttcattggaagattagcatggatgaatggttctttccttacttccataattgcattggagctattgatggaacacatgttccaattaccatttcagcagaaaagcaagctccctataggaatagaaaaggcacactaagtcaaaatgtaatgttggtttgtgattttgacttgaactttacttttatatcatctggttgggagggatccgctacagatgctagggttctaaggtctgcgctacttggaggattccatgttcctgagggaaagtattatcttgtcgatgggggatattctaacacaccatcattcattgcaccgtaccgtggtgttcgataccatttgaaagaatttggccatggtcaccaacgaccaagaaactataaggaattatttaatcactagcatgttttattgtggaaccacatagagagagcaataggagttttgaagaagcgtttccccattctaaaagttggaacacaccactcaattaggaaccaagtgaaaataccagctgcagcagttt

SEQ ID NO: 16382 - DNA, 1168 bp, Zea mays
cagcaaactccggggcccccctcgcccgccggcagattgcctcgctccccaaaaccttcacaaaaaaagccacccaaaaaaatccgtttcataactgaaaaaatcaaatagaaaaatcaagtgaagccggtaaagaaaaaaatggcagtggttggcctatccagtgctttcgctcctctcagaggttcttggatagccgtaaggatcaggcagggtggccaacgtgcagggatcagcttgtgtccatctccaaggagcaggaggagctgcgcggcagtggttcgggcggaggtgagcttcgtggacgccgacgaggcgaagaggctcgtgggcgaggagggctacacggtgctggacatcagggacagggcgcagcgcgagagggcacacatcaagtcctccacacacgtgcctctcttcattgagaaccaagacaacgacattgggaccatcgtgaagcgccagctgcacaacaacttcgcggggctcttcttcgggctgcccttcaccaagctcaacccggacttcgccctgacagtcaaggacaagttctcgccggaaagcaagctgctggttgtctgccaggaaggtctcaggtcagcagctgctgcagatgcactggagaaagaaggcttccaaaatattgcatgcatcacatcaggtcttcaaacagtgaagccaggaacgtttgaatctgtggggaaaagtgagctgcagaacgcggggaaagctggccttgtgaccatccaagggaagatttctgtagtccttgggactgtattgattagtgcctacctgtttataacattcttcccagaccaggctgagaagctttttgacttggctggcatcagcttgtgatcagagctgatgttcttcggtactccacttcataatcaggatggttgatcaagtcagattcactcagatgtttccagactgaaaaggaatttttgctctgtgtactattagggaattcttgagagattagcacttaaattctttgaaacatcccttttctcgatgtacctcctatatatatcgtatgcttgattcatctacatgtttgtgttgcttttcgaaaaaaaaaaaaaatcaggctcagggcacatgcgatggtgaagtcagaattcttgagttagcctttgtgaggcgtgttggttcttcg

SEQ ID NO: 16383 - DNA, 725 bp, Zea mays
tctatgttgtttgatggacctcaggttggcaataatgtcaagtatccccagctgatcagaactaccaaggtgtgtgggcattatgccgcaagcttagcggtttttggagctacatttgtaggtgtcgagcaggctcttgcaaggtacaggatgaagaaggacatcattaatggtgctgttgcaggttttgctgctggtgcttctctgggtttcagtgctggaagcttccgggcagcattcttttcaggctctgcagtcgctttgacatctgtagtgctggatgtcaccggaacgaaaactactgatgaagaagaaaaaggccagcactagccaccctgagatatggaagagtactatctgtttcagaggagtttcatctctaaagaaatgctagcagagtagtagtattggcggcagtgaggatttcttaaccatcgatactagcacacaaacgtactactccctccgttttttatttatttatcgtgttttagtttaaagtgggcgacaaatattcgagaatggaggtagtatgttcataatagaggtagtaggttgtatacttcgcccgcgtcatggtctgaggtagttggttgtttcttcctgacgtatgctctatgcttaagaatgtatatcccttctgtgcagagggttcatgctcttctatggtttatatatatatatgtgtgtgttttcattcatgctgaaaaaaaaaacacaaaccc

SEQ ID NO: 16384 - DNA, 1639 bp, Zea mays
gtctttccctttaaaaagaaagtataggataagtctggttatggcttttccctctcaaattgaattgaagcaccgggcgttgtcgcgacggcaagcagtcggctctcccagttagtccccaaacccaaacgccgcgactacagcaaccatggccaggcctcctccgctgaaactcccgtgcgaccgcccgctgccgtatctgcacgacagcctcatcgatgagatcctcctccgcgtcccgccgcacgaccctgggcgcctcgttcgctgctcggccgtctgcaagctctggcgccgccacctcactgaccccaacttccttggccgctaccgcgcgttccacagggtgcctcccatgctaggcttcctcttcaacctagccgatggttgcttcgttgtgcggttcgtccgcaccacctccttccgccctcgtaccctcgaccacgccggctgctacgtgcgcgacgcccgccacggtcgcatcctcttctgcaacatcatcagcgagaagagagaatttcacctcttcgtatggagccccgtcacggatgagcggtgggggctgtacataccgttcccgttctaccatttcgtggcggctgtggcggtgctctgcgctaaggccgcgcgcgaagggggctgtgactgcgaccacctcaactgccacagcgggcccttcctcgtcgcatttgttgccaccgacgaagatggggtgacgtgtggctgcgtctactcctcggagaccggcgcctatagcatcatgacctgtgctcaacaccccaatggtaccgaggacatggacacattggatcccgtcgtgcttgtgggaaataggatctacttccccgctggacagagcaagaccatcgtggagtacgacttgggtcgccagaaactcgcatttctcgagccgccgccgttaccgcaccaaggtcacggtatcctcatgccggcaatgggaggtggtctggggttcgccagcgtgcgggagtcctgcctctacatgtggtcgagagagaccggttctgatagaactgcggcgatatggacgcagagcagggtattggaactcaacacactgcccgattgcgaaactgcgcttggcttcagggagagcttgatgggggaagatgtagctgtggttggctttgcggagggcctcgacgtcatcttcttgaggacagatgttggcgtcttcacgattaaccgggagtcaggccaagtcaagaagatgaccagcataaggcccgacctcgtctttccttacatgagcttctatactccagatcatgctacgggctgaccaccagtgccatgatgagaacactgggatccattcattccatgacgatgaaccttcagtcggtgcattgccttatggcagacacatgatgctttaagtgcttcgtttttagttgagtatataagcaagcgaagagtcagtgatcgtggcaattagttgtctccactcctgttgaatccttaggacctggactgaaatctgtgtcaggttaacattcagattttataaattctttgcatatgcttggctagggaacttgtggaactgatacataaatccaccctttttcctgcagtgaatatctgctgtgtgctatacagaaaaaaaaaaaaaaaa

SEQ ID NO: 16385 - DNA, 672 bp, Zea mays
ctgctggttgtctgccaggaaggtctcaggtcagcagctgctgcagatgcactggagaaagaaggcttccaaaatattgcatgcatcacatcaggtcttcaaacagtgaagccaggaacgtttgaatctgtggggaaaagtgagctgcagaacgcggggaaagctggccttgtgaccatccaagggaagatttctgtagtccttgggactgtattgattagtgcctacctgtttataacattcttcccagaccaggctgagaagctttttgacttggctggcatcagcttgtgatcagagctgatgttcttcggtactccacttcataatcaggatggttgatcaagtcagattcactcagatgtttccagactgaaaaggaatttttgctctgtgtactattagggaattcttgagagattagcacttaaattctttgaaacatcccttttctcgatgtacctcctatatatatcgtatgcttgattcatctacatgtttgtgttgctttttgaagtatctagacctgcagttatgattcaggatttcaaatagaagctttttatccatctaataaaaataaacaacatgagaacattgaccctgaaagattatgtagaccttgataccaattgcagttgcagatgaaatgattgtcttgtgtaatggtgt

SEQ ID NO: 16386 - DNA, 4250 bp, Zea mays
caatgcgatgggtgccatgtatgcagcggtgctgttcataggaattaccaacgccacttctgttcagcctgtgatctccatcgaaagatttgtatcttatagagagcgagctgctgggatgtattcagcgttgccttttgcattttctctggtaactcctgtcaaagtgttacccccctgctagaaataatctttagtgctcataacattgtgttagcaatgggatccctctaataattactattttttttggcaggtcactgtggagttcccttacatccttgtgcagtcactcatatacggttcaatcttctacagtttgggatcatttgagtggacagcagccaagtttctgtggtacctgttcttcatgtacttcacgttgctgtacttcactttctatggcatgatgacgacggcgatcactccaaaccataccattgcgcctattattgcggctccattctacacgctgtggaatctcttctgtggattcatgatcccaagaaaggtatgggataaactagcgcccccataattcacacctaacgtactgtagctgatttctaaaccatagcctaccaataattgtgaattttcatgtgacatctcgtccaaaaagttgaaagttatgacaaaagaagtcctagatttaggacacatatttttttttgttgcttgcgtttcagagttgaaacgcaccgttttaattttcgtttgggcgagtggaggaatgctttgcagaccgactgccctagatgggcccatatttatttgtcagcttggggctctagctgcagaatgcatgagtcctatctcttatgggcccattagtagtccggtaaaggctattgttcacaacaactcggcaccgcacttgccaatgattttgtagagaggtcctctctctctctcttctctctaaaacaaagttaaaaacagaattaatattcttggttcaagtttgtttttcttttacttattagagggtttgaactgtttatcgtaaaattttccatctaaaaaaagccttgaatgggtagctcatgtagacactgcatgcgttttaatttctgggaaaagctagcacagttttcacagtccacactcacattggtttctctttgggaaatatttgtctgacaacccctttgctcggcagcagggccaagagtgttgacactactagatgttatgctaatgttatttgcacttgagcttcagctagagggtgctcttgcagcactgttgactgaccgtctgttttctctggtgaacgcattgcatgtgcagcgcatcccagtttggtggaggtggtactactgggccaacccggtgtcgtggacgctctacgggctcctgacctctcagttcggcgacctggaccagcccctgcttatggccgacggcgtcacctccaccaccgtggtggctttcctggaggagcacttcgggtttcgccacgacttcctcggcgccgttgcggccatggtggccggcttctgcgtcctcttcgccgtcgtcttcgccctggccatcaagtacctcaacttccagcggcgatgagagagcaagtggttcagctagctagctagtatagtagccaccgccgacacagacccaccaaacggatcgcagcctactgtacatgcatacaccgatcagtgcaggagggcagcagcacaatgaattatgaatgcgatgtacctaccagcgcgtcgtattggcacagttaatttgcccattacccccagaacatttcgccggggtaaataatcttccggtcggtcacgggagcgagagtgagaaaaagtaaagggtactgtatagccagctattccatgtacttgctgccttggcctcccctccatcgttatacggtggcgtcgcttcatgcagggtttttttttttgacccggcctttttctccggcgcccacgagcggccgccgctgcgcctatggggggtcgacacctgcggggcttttcgaccgctttggcatgcagccttcgtcctgcgtgatacttttggatgcgtaggcggcagccgcaccgcagtgcttccaagcgctgcaaaagccagcagagtcttgggagtgtcctctcctctcctctcctgccatctatcagtctcagtcgagatcgaggtgagtgatcgacccgcctatgcaaaaagacgagcatctatgtctctgcaggtacgtggaacaggtcgagtccaagctttacgtgcgtgtacctcttgttcctgcctgcattcgcagctcgaccgagaagatggcagttagtacaagctagcgaaaaagcgagaggctgcgtgcgtgaggccgtgagtgcatcgtgcatgcatgctccgtccgtccggcctcggtagcttgtctgcatccgccgcacgttaatgtgttacctacggggctaccggctacgctacggggtgtcaggcatgcagtctggttgcagcggcaaagccaacgaacaataagccaaagaggcagccgtttgtcgctttgcatgtgcggcatcatgatgcgtgtctgtcatttctcgacgacgacgggcggacggcgtgcccggcccggacgtcggccatgacccatggctcgcgtgggtggccgcgccgccgtgtgcttcttattcctaccgaccgagttgcatgcatgcatgtacacgatccaaccgcccacgccctccagctagataaagatcgctggcgaagggccgggccgttgatgtgatcgccgccagcctgctgctgctgcctgcgcgtacgtccgtgccgagcacgcaattgctgattccactgaatggatggatggatctccatctcctcctctgctagcgagccagtcagtggtctagcctggacagctgagctagctcgattggtcggtccatgcatgcatcaggtcgggtccagcgtacttcctacgcgcggctaggcgtagctacctatataccttcccttcccttcgtccctctctccgatcagtgtgctcaggcaggcgcgaccatgcatgcctgcctgccggcggtgccggcgcccggcaggatatttcgccgtttgggttgggggtaggctggtaagttgatggatggggatcaccggcggcatggaccggattattcctgcaacaacgcgtagctagcctgataaaacccatgcatccacgtccaccatcagatggatccatctccactagctagcagagtagcagtacagtgtacgtatcactaccaccgcagcggcaagtgcaagtgacggttcggttgttggttgcattgcaattgcatgcaccgctgggctactatagctacctgctgcgagagagaagagagaacgtgctgctctgctgctccatgcttccaccagccagccagccagccagctttacacgcacgacgacacgagagcagcgggcccgagcctaatgctagggctaatcatgagccatccaactgggttaggtcgaccgagtaggtggctagctagctagcttctagctagattttttgacgctttgcggacggccgggatgcaggcagcgctggccgctgggtccgttccgtggtgcttgcaggcggcgcgaaagactgctgtgctagctgatctcacaccacccccagtccccacactggtaaaataggatcggatccgggatgccgccaaaacggccaccatcggaaacaacgtatagtatatacgtacttactaggcgacggcgcatgctccaagacaaatcacgacgcccatgcacgatcgacgacgcaaacgccgtcgtgcggatcctctgcgctgccgatctgatagcaccgcgcgcaattaaactaattgaacagccagtgattattaggctatatatagccccaatcgaaacgcaggattattagacaacaaaaaaaaccccgaaggaataaaaaagaagttttggaagtactagtatggtaaggagtatatgcacatgcgatcgaaacggacaagtgaaaatcacatggtactgtattctgtataacgagcgaaccgaccgtcattattaagaagaaaaggctgtgaagctatatattttcttcttcttcttttttgaacaactagtacatgctcactacagtaaactaacaaacatccgacggcctccggttatgtccgacggctacaactggcgctcgtacataggccttatctccgacggcctcgtacagagccgtcggacataaggttatctccgacggcctcgtaccgagccgtcggagata

SEQ ID NO: 16387 - DNA, 1442 bp, Zea mays
tcaatcagtggcctagcacttctgccgaaagccagcatctccctcgcgtccggcaagcctcctctccaagcttcgaatcgtagagaaaagcaagcccgcggggccgacccggtcggcatccgaacccaacgcctctgagagccttaaaccccgacccgagcctgtcagactgacatcgctcgaccatttccccatttccattcccatcccaattcccagccgtttcatttccacctcctccttttccaatttcgactcgattcgaaacaggataccaaatgcatgatcgatcccacaagccgcagccggcggaggccggcaacggcgggccggctggcgagggcggcggcgggaacgtggatcgggtgctcttcaagaacctcgtcgagatggtgccgctcgtcgagtcgctcatggaccggagggtcaacccggcatactcgcgtcgcgcttcgctggtctacacgccggcgccgcccaagaaggcaagcgatttgaaaagtgtcaaattgccacagagcgtatcagccaaaaagcggagagaccctggtgatatagccaagaagagcaccccagattctaacggcgacaacggttcagttgtgccattatctctgtcaggtgctgaaaatatgcccaaggatgaggttgccgtgctaagcgagcagatcaatgacctacaaaagaagctgcttgagaaggaggaggcactgaggtctgcggagagctctgtgactgagatgaatgcagcatatgcaactatcgatgaactcagacgcctggtggctgacaaagaagctttgatcagatctaccaattctcagttgcatgatgcaaagattatgcttgcagacaagcaagcgtctttagagaaacttgaatgggaggtgaagatgtcaaataaaaaggtcgaagatcttcaaggagatatgtcgaatatgggattcgagataagctcattgatggtatttttcgaaaaaatttcagagaatgtttcaggtgactcttatgatgatataataccatcatcatatgaattagagacacttcaatcaatgagtgaaattgacaagattgaggtcgacaagctagacaaggaaagggttacatatgctgaagctctggcggcagcgagagagaaccctgacgaggagcacttgaatatagctgcggaggcgaggtcaaggctgcaggtccttgtactttagtgtccccttctgattatagcgtttgtatgataatgttgaactgctgatgtaattgtatgtgttggcttgagttgaggtgctcgtggaatccttccggtgattgattcagcactgtaaactgacagctgtttcatgttgtaaccatatttaaggcgtgtttgatttctttaaaaaaaaaaaaaaaaaattaggaactaaatttagtccctaaaatttcctaaaaaaaaaaaaaaa

SEQ ID NO: 16388 - DNA, 1319 bp, Zea mays
ctggccggggtccgaacccaatgcctcgaaaagccttaaaccccgacccagcccctccgggtcacccgaccgttttccatcttcactcccaaccgtttcattcccacctaacttactttttccgatttcgactcgattcgtcattccaaacaggacaccgaatgcacgatcgatcccacaagccgcagccgccggaggctggcgagggcgccggcggcgggaacgtggatcgagtgctcttcaagaacctcgtcgagatggtgccgctcgtcgagtcgctcatggaccggagggtcaactcggcctactcgcgacgcacttcgctagtctacacgccggcgccgcccaagaaggcgagcgaattggaaagtgtcaaattgccacagagcgtatcggccaaaaagcggagagaccctggcgatgtatccaagaagagcacccctgattctaacggcgacaacggcttggttgtgccattgtctctatcgggtgctgaaaataagcccaaggatgatgttgctgggctgcgcgagcaggtcgattacctgcaaaagaaactgctcgagaaggaggaggcgctgaggtccgcggagagcctcgtgactgagatgaacgcggcatatgcaaccatcgatgaactccgacgcctggtgtctgacaaagaagctttgatcagatctaccaattctcagttgcatgatgcaaagattatgcttgcagacaagcaagcatctgtagagaaactggaatgggaggtaaagatgtcaaataaaaaggtcgaagatcttcaaggagatgtgtcaaatatgggattcgagataagctcgttgatggcatttttcgataaaatttcagagaatctttcaggtgactcttatgatgacacagtaccatcatcatatgaattagaggcaattcaatcaacgagtgaaattgacaagatcgaggtcgacaaaatagagcaggagaggattacctatggtgaagctctcgcggcagcgagagagaaccctgacgaggagcacttgaatatagctgccgaggcaaggtcaaggctgcaggtccttgtactatagtggtggcccccttctaattctagtgtatgtatgataatgttgaactgctgatgtaattttaccttgttggcttgagttgaggcgcttgtgaaatcgttccaggggtaatggaacgagcactgcaaaaaaaaaaaaaaactgaggtctgcattttttatcatgaagcttgagctatagttagattttttgtgacggttatcatctcaagatttaaacctatggttggaactgcttatgtaaatt

SEQ ID NO: 16389 - DNA, 1450 bp, Zea mays
ccaggaaaaaaaatccacaaaggcacaaagatggaaaaggtgtattggactctttttaaagctaaaaaaacagttcaaaagattgctgcttttcgcttcagtgctgctccgattctgtttcagaagattaacaatttgaaattgtgacgatcctaattgccatcttctcgataataatgaggaaaaaaagattgacgcgcttttcgtgtcctcagaaactgcgggtttgctgaaattctcctccactttcccaagcaaagaacaaagaaccgcccttgttctctgcgactctgcccggccggtctccgaggcgggcggagggaaccagagagcaaggcgaggagcgcggaagggctgagggaaggggcggcggggcatggctcgccggccggcgtcgtgggagcagggcggcgacgagtacgactatctcttcaaggtcgtgctcatcggcgactctggcgtggggaagtccaacctgctctcccgcttcaccaagaacaccttcgccctcgactccaagtccaccatcggcgttgagttcgccacgcgcacactccaggtggagaacaagattataaaagctcaaatctgggacactgctgggcaggagaggtaccgagcaattacaagtgcttactatcgaggagctgtcggggcgttgctagtctacgatgtcactaaagtaatgacatttgagaatgtgaagaggtggttgaaggagctccgggaccatgctgactcgaacatagtcgtaatgctcattggcaacaagactgaccttaggcacctgcgctctgtcgccgttgaggatgctgcaagctttgcagagagcgaaggtttgttcttcatcgagacctctgcgctcgatgcgacaaacgtcgagaaggccttccacaccgttctagccgagatctaccggataatcagcaagaagcccctgtcttcggaggagtctggtttggggtccggtaacctcagagagggacagtccatccaagtgtcagccacaaattctggcgcccttacgtcgcggtgctgctcttcttagagccacgcccaccaggatcatctgaagaacaacagttcgtcaagaaggtcctctcttccgaagtcgaaatatttactcccctttgtgtgaacaataagcgtagatttaaagaatgtcagactcagacgctgactatatatacttgacctgcatagtcatgttccgtcgagaggtgctgtgggagaaaagttgtattgctctcgagcatagaagaaggctgtgtgtatcagaccccagcaaagctgcttgctattaaccgtggcagggtagtctctgtgattttgcagctataattttgttgggggttagttactatgactgcggagggtgtcgtggcttgtggcaacttgattcccgacgtattatagaatcctctttgctatccgtttgccccccaccccc

SEQ ID NO: 16390 - DNA, 858 bp, Zea mays
  misc_feature (43)..(43): n is a, c, g, or t
aatcttgaataaatccgtgtgatggtgattgctctacttactnggaagtactagtaaagggccttagactttcctgcccgcttgaagtgtcttttgggtcaattacatagctcacctgcagaatcttgagactcttcttcaaatcgagagtgatagtaggcatggggcatgtcgaacctgaagatggcttttcacttcgtcgtttatcaggccgttcaccttcatcagctccctaattttctttggcgtggcaacatgggggccaccgagctgattcatggtggctacgaactggctatatagatctgtaaccatatcaatatgaaaatatctcaatatgaaaatatcccaatccaacaaagtttataaatatcactaaaacccaagtacacgaccaccctcactaaaagcatattctgaactgtggagaaggccttccacactgttgtagccgagatctactggataatcagcaagaagcccctgtcttcggaggagtctggtttggggtccagtaacctcagagagggacaatccattcaagtgtcagccacaaattctagctcccttacgtcgcggtgctgctcttcttagagccacgcccaccaggatcattggattggggccttgggggcagtgcatccgttcgtggtctgcacgtgcaacctagcagagaggagaggaggaagatgagtcacgccgtcacagaatttgggggcacgccagctgagcagtggcgactggcggtggcggctatgcttgctgtgcggctgtgcctgggcgaggggcgagggcgatggaagactgcaagtggaagagcagtggtccacgggggggggggggggggggggactagtg

SEQ ID NO: 16391 - DNA, 5415 bp, Zea mays
  misc_feature (539)..(539): n is a, c, g, or t
  misc_feature (710)..(710): n is a, c, g, or t
  misc_feature (3559)..(3559): n is a, c, g, or t
  misc_feature (3873)..(3873): n is a, c, g, or t
  misc_feature (5140)..(5140): n is a, c, g, or t
ctctctctctctctttctcttttcatgagatggagaaaagctacaaggtcaggtaaaaagattcatggcacagtactacgtactaacactccaagtcaatagtgcgttcttgctcatgctgccgttctgttctgttactgaacgctcgcatggtcctggactcctggtccttgttcatgatctcacactcttcggtccagattccgtagcgtgcaataactgggagtgaggtagggccggccagccagccagccagccagcaatgaacagtagacaggatctggcactggcactggacagggatctccatgaccatggcggcaggacgagatgcgacggccaaggcctgtctcttcatggcggtgggggcaggcagcgtttaaaacgaaccccccacttcaatggatgcggcggggtgtggtacttaacttggctgcacgcggtgcgcttgtgcagatcctcaagcaagcaaggatattatgttatgatgatggtgatgacgaccacgatgttaatagtgatgatggtggaagcgaacncgttggtctttccagaaacagaaacaataatggtctgtatacaagtgtatttactggatataatcaaatgtgctcaaagtgaacactgtctgcactgaaaggaagacaccaaactgaagagagactgtagggcagaataatgtaactggaacaacaccattatcatctccncctccgatttcctcagccattaaactcacggcttacgcctgcagccgtcggcaacgggctgtgactgtgacaaacacacaccttgaacctgcatcacagagtacacgggccatgcagaatgcaactcagttcattgttcataataccatgggtcgatcagagtagcagagaaaatcagtcacaggtttgtcctcctggaccctggtgcggcgcaaatgacagcaggacatttcaatatcaagatgcttacagggaggaacatgggttcgatcgaacagtggggaaccatagcttaggacacagcttataagaagctttaaattgccatggaccacactgagccatgccaccagaagcaagcgtaaactcaaccatccacagcaagaaaccaaataatccttgctattataagaccgtgtgatttaccactgaaaaaaatgactactaaccaagactgtaaactatttttttcctttcatcacaaattaaattgtaacaatcattataatgaccatttttccatataattcctaaacgtatttttatgttctgttcataatcaaccatgacatcaacacgaacagaaagggaataaaaagacggaggaaatcaagaactatccaaagttatacacgtatagatagaaactttgttttgccctgctatcatcttgcgagcggcccacgagtcgtccacatctccgcgctccaacccacaacccaggcccaaaccaaaccctttaccggccccacatgtcatcctacagcctcaaccctacaccgccattccggtcgctccctctctgaccccacatgtcatccacccatcaacgacctcagatataaaataccccggccctcgaggccggccggacgcgcgcccaaaggcccccaaccccaaccttgcaggaaaagagagagagagagacgaccccccaaatcggaatccgcacacccccatccatggccgccgccctgctccgccgctcgccggcggtgcgcgcgctcctctcgccggcactctcgtcccgcctcgtcgcgtccaagccccactcctcgtcccccgcgccgccgccacctgccaaggccgcctccagcacgaagaccttctcgatctaccggtgggacccggactcgccgtcgacgaagccgcacctcaaggactaccaggtggacctgtccgactgcgggccgatggtgctggacgcgctgctcaagatcaagaacgagcaggacccgtcgctcaccttccgccgcagctgccgcgagggcatctgcgggagctgcgccatgaacatcgacggcgacaacggcctcgcctgcctcaccaagatctccggcgcctcctccgcgtccacggtctcgccgctgccccacatgttcgtcgtcaaggacctggtggtggacatgaccaacttctacagccagtacaagagcgtcgagccatggctcaagcgcaaggaccagcccccgcagcagggcaaggagatcccgcagaccaaggccgaccgggccaagctcgacggcatgtacgagtgcatcctctgcgcctgctgctccacctcctgcccgtcctactggtggaacccggaggagtacctcggcccggccgcgctgctccacgccaacaggtggatacaggacagccgtgaccagttcaccaaggagcgcctggacgccatcaacgacgagttcaagctggatctgtttgttggtgctgaatgatgtgtgattgatcgattgcatgtcatcctttgaatgtcttgatgaattgtttggtccttagatgtgatgttcctatgttgtatatcttgctagcagtaacactcatgactgagtggctgctgtgactctgatttgatgatcttagtatcacaaatgaaggaaatgtgttgaatagattacttagacatatttaaatgcatcatggttttgattgttcttctggtatctagcttatgagtaacaaatacatcacactgtggtgtgttgaactactagcctgtccttccagtatagagagtgctagtttctttctttatcattgttaacttgcaaatgaccatcaactgaatttacgatgctaaagccggttcttgtggatttgtgtgccacacgcttaccttgaatgatatagttgtctaatatgctaaattttctccgcctcaagtttctaggatgttgctaagtccatgacacattcaccctttttaggcttccgctgtgggggacgcttatcaaaccgaaacccaacatgttcatgcaccttcaagctcgaggatatcacggggtgtcagagaagagaaacctgcgggaccacaaacgtagactgcttgcagaaaaatatgagctaagaggaaagatgtataaggccgtctgtagggaccctgatcttccattggatatgcgggagaagttccgctataaactgtccaagttgccaagaaatagctccatgacacgtcttagaaaccgctgcattttcacaggacggtctcgcgctgtctacaagaaatttcgcatgtcccgtatcgtgttccgcaccttggcaaacaagggtgaactgatgggcgtaaagaaggcatcgtggtagatgctaaagagccagtagaaaaaggcgctagctctgcattagtccaggaaaataaggttgtgtgcgtggaacctttcgatgtctgatccctgaaacaatctttaaagtttctgacccgcagccaattttatttaaatattttagctgaatcaatgtactgtactgttttttttggatattatgcacttgtgaagttaaaggatcggaacatgtttgtgaatgcagaaatgtttttttctgttatctttcacattggntcatgaatatgttgcgattgttactctgtacttcatttccgcaaagtagttaccacctcactacgaagtttacatcatgtgctcagaaaggttgtgaatattgtacgtttagagtaatcctgacttcataagttctttgtttcagtctttgtttggctctacttctattctaccttctggacttcccacttctcagaagtttgttcagcattgcaaatccgtgatccttgctgatatgttgagctatttattgttctagtgttttatttgattgtatgatccatacatcagccgtttggttcaccttgcctctntttaacttatttgatgtgcacatggagggtttgtgttggatcataggaactaagatatgacagctagctttcatcaaataatatgataacgaacttcatattccgttagtgtaattaatgaacattagtgttttgtgtgcactatttttatattcctagaaatcaaaactaatagaggcagttttgtttgccttgactttcagcttttaggcaataatgttgagtattttttgttcctaactgttacaagaaactctccttctcctggacagacagcatatccgtaaatgctacatgctgcagatctgtgtagataccgaatactggtatatttaaattgtagagcctagtagtttacagttttgtgaccgcgttattgaatttttatctccaatggagtggttgaagaagtacccccggtgttccagtttgaactttgcttgggatgcgcgtgtaggaggtccccggcatgccgccttaatgggccacgcaacaggtggatacaggacagccgtgaccagttcaccaaggagcgcctggacgccatcaacgacgagttcaagctgtaccgctgccacaccatcaagaactgcacgcacgcctgccccaaaggcctgaacccggcaaagcagatcgacacgatcaagaagctccagttgggtgccccaagtgcctgaaaccgagcgtgtcttcccttgaaaacggtcgtggaacagacctgtggaaaaaattgggatgaacttgccacttatttcgttgttgttgttgttctttggtcttcgcgcggtggtttctacctgccaaagacgaataattcccggctggggcccctccagtccactccacccatgcttttgtgtcaggcggagcggaggtagagcatagggagtgaataaccgctaccttatttcatttctatgatgtatctatctaatttggtcctcccctgataatgcacgacccgtagtgttaacaggcgtatttggaccttcaagaagtatttggacatggcaaatgtattttggaatgctcttatctaccgtgagatgagaaaggaactatagcgtaatggttatggttttccactagcatcttctggtcctgcgtttgatccccacatggtgaatttcgatttggttaaaaaaaaatctccttgtcatgtaccaccagctcttggggatcgacatcctgcgcgctactctttagggcttgttcggttagctctcaatccatatggattgagtgagattggatgggtttgaatccnaaacaagtcaaacttcttaattttttccaatctcatccaatccatgtgtattgggaataaccgaacacgcccttagctggattattgcagagtggaaagttgatcagtctgttagtgatgggagccaggatttgagagttttctcggccaggaccttatttcggtctcttcttagtatataataccaggagacagtctttttaaacttttacctgctttcaactgaatcaagtgccaaataaaatatcatacgggatatcacgttaagccggccc

SEQ ID NO: 16392 - DNA, 1347 bp, Zea mays
cttcagttcacaaggccaccacgcgcgcccaaaggcccccaaggccccaaccccaaccttgcaggaaaaaaaaagagacgaccccccaaatcggaatccgcacacccatcatccatggccgccgccctgctccgccgctcgccggcggcgcgcgcgctcctctcgccggcactctcgtcccgcctcgtcgcgtccaagccccactcctcgtcccccgcgccgccgccacctgcgaaggccgactccagcacgaagaccttctcgatctaccggtgggacccggactcgccgtcgacgaagccgcacctcaaggactaccaggtggacctgtccgactgcgggccgatggtgctggacgcgctgctcaagatcaagaacgagcaggacccgtcgctcaccttccgccgcagctgccgggagggcatctgcgggagctgcgccatgaacatcgacggcgacaacggcctcgcctgcctcaccaagatctccggcgcctcctccgcgtccacggtctcgccgcttccccacatgttcgtcgtcaaggacctggtggtggacatgaccaacttctacagccagtacaagagcgtcgagccatggctcaagcgcaaggaccagcccccgcagcagggcaaggagatcccgcagaccaaggccgaccgggccaagctcgacggcatgtacgagtgcatcctctgcgcctgctgctccacctcctgcccgtcctactggtggaacccggaggagtacctcggcccggccgcgctgctccacgccaacaggtggatacaggacagccgtgaccagttcaccaaggagcgcctggacgccatcaacgacgagttcaagctgtaccgctgccacaccatcaagaactgcacgcacgcctgccccaaaggcctgaacccggcaaagcagatcgacacgatcaagaagctccagttgggtgccccaagtgcctgaaaccgagcgtgtcttcccttgaaaacggtcgtggaacagacctgtggaaaaaattgggatgaacttgccacttatttcgttgttgttgttcttctttggtcttcgcgcggtggtttctacctgccaaagacgaataattcccggctggggcccctccagtccactccacccatgcttttgtgtcaggcggagcggaggtagagcatagggagtgaataaccgctaccttatttcatttctatgatgtatctatctaatttggtcctcccctgataatgcacgacccgtagtgttaacaggcgtatttggaccttcaagaagtatttggacatggcaaatgtattttggaatgctcttaccaaaaaaaaaaaaaaaaaagcggcc

SEQ ID NO: 16393 - DNA, 1413 bp, Zea mays
ccggccgggatgggtacccccccgcgagcccggccgggacgcgcccccccaaggccccaaccttccaggaaaaaaaacccggaatccgcacccatccatggccgccgccgccctgctgcgccgctcgccggcggcgcgcgcgctcctctctccggcgctctcgtcccgcctcgtcgcgtccaagccccactcctcctcccccacgcagccgccccccgaggcaaagggcgcctccagcacgaagaccttctcgatctaccggtgggacccggactcgccgtcgaccaagccgcacctcagggactaccaggtggacctgtccgactgcgggccgatggtgctggacgcgctgctcaagatcaagaacgagcaggacccgtcgctcaccttccgccgcagctgccgcgagggcatctgcgggagctgcgccatgaacatcgacggggacaacggcctcgcctgcctcaccaagatctcctccgcctcctcggcgtccaccgtctcgccgctgccccacatgttcgtcatcaaggacctggtggtcgacatgaccaacttctacaaccagtacaagagcgtcgagccgtggctcaagcgcaaggacccgccgccgcagctcggcaaggaggtcccgcagaccaaggccgaccgcgccaagctcgacggcatgtacgagtgcatcctctgcgcctgctgctccacctcctgcccatcctactggtggaaccccgaggagtacctcggcccagccgcgctgctccacgccaataggcttccgctgtgggggacgcttatcaaaccaaaacccaacatgttcatgcaccttcaagctcgaggatatcacggggtgtcagagaagagaaacctgcgggaccacaaacgtagattgcttgcagaaaagtttgagctgagaggaaagctgtataaggctgtctgtagggaccctgatcttccattggatatgcgggagaagttccgctataaattgtccaagttgccaagaaatagctccatgacacgccttagaaaccgctgcattttcacgggacggtctcgtgctgtctacaagaaattccgcatgtctcgtattgtgttccggacattggcaaacaagggtgaactgatgggcgtaaagaaagcatcgtggtagatgttaacgagccagtagaaaaaaagcgctagctctgcactagtccaggaaaaataaggttgtttacatgcaatctttcagtgtgtgatccctgaaacaatctttgaagtttctgaccggcagaccaattttatttaagtattttagttgaatcagtgtactggtgttttttggatattctgcactcatgaagttaaaggatcagaacttgtttctgaatgcagaaatgttttctctgtttcttaaaaaaaaaagaaaaaaaa

SEQ ID NO: 16394 - DNA, 1242 bp, Zea mays
tcctgtccggggcgttgggagcctcgaggccggcccggcccccccccccccaaggccccaaccttccaggaaaaaaaacccggaatccgcacccatccatggccgccgccgccctgctgcgccgctcgccggcggcgcgcgcgctcctctctccggcgctctcgtcccgcctcgtcgcgtccaagccccactcctcctcccccacgcagccgccccccgaggcaaagggcgcctccagcacgaagaccttctcgatctaccggtgggacccggactcgccgtcgaccaagccgcacctcagggactaccaggtggacctgtccgactgcgggccgatggtgctggacgcgctgctcaagatcaagaacgagcaggacccgtcgctcaccttccgccgcagctgccgcgagggcatctgcgggagctgcgccatgaacatcgacggggacaacggcctcgcctgcctcaccaagatctcctccgcctcctcggcgtccaccgtctcgccgctgccccacatgttcgtcatcaaggacctggtggtcgacatgaccaacttctacaaccagtacaagagcgtcgagccgtggctcaagcgcaaggacccgccgccgcagctaggcaaggaggtcccgcagaccaaggccgaccgcgccaagctcgacggcatgtacgagtgcatcctctgcgcctgctgctccacctcctgcccatcctactggtggaaccccgaggagtacctcggcccagccgcgctgctccacgccaataggtggatacaggacagccgtgaccagttcaccaaggagcgcctggacgccatcaacgacgagttcaagctgtaccgctgccacaccatcaagaactgcacgcatgcctgccccaagggcctgaacccggcgaagcagatcgacacgatcaagaagctccagttggacgcctgaaagcggtcatgccttcccttcaagacgaacatggaacaaaacctgtgaaaaattgcccttcttttgcgccgtggttttctacctgacaaataattcccgatttgggggcctcctggaggtagtgtagggagtgaataactgctacagcatttcatttttatgccgtatctaatttggtcatctgcaatgcattgtatggatcaccatcacttgtggatgattgccgttgcactttaaatttgcttcacataaacgaaaaaaaaaaagccaacgcggccccgctagttctagatcgcga

SEQ ID NO: 16395 - DNA, 2031 bp, Zea mays
gccggcccggcccgggacggcacgcaccacgtcagaagccccccaacccaccggtctcccactcagaccgtccgacgaacgactcgactgtcgactcctgcacaggcaacacctcacctcgatgatgcatccgctccgccgcatcctcgtgctcttcctcgtcggcctcctccccgcggccgcgtggtccttggcaccaccccgcttcccgaggccccaaccccgctcgcggccgggagctaatggggtgggagactacgagtacgagacgcgatacttccggcagcggctggaccacttcagttttccaggggtcggggacgaggacgaggcggcggcgttcttccagcagcggtacctggtgggccgcggcggtgggtgggctggacccggcggccccatcttcttctactgcggcaacgagggcgacatcgcctggttcgccgccaactccggcctcgtctgggaggccgccccacgcttcgccgccctcgtcgtcttcgccgagcatcgctactacggagagtccatgcctttcggtagcaaagccaaggcgtacagcgactccaagtccctggcgtatctcacggccgagcaggcgcttgctgacttcgctgtgctgctcactgacctcaagaggaacctatcggcagagggcagccccgttgtgctctttgggggctcatacggtggaatgctagctgcttggatgagactcaaatatccccatattgctattggggctctcgcatcatcagctccgatcctgcagtttgaggacattgttccttctactatattctatgatctcgtatctgatgattttaggagggaaagtttaagctgttttcttacaataaaagactcctggaaagaattagatgaccaagcaaacgagcaagatggtctactgaaactaagtaaaacgttccacctttgccagaccctgaaaacaagtggagacctttcagattggttgagctcagcgtacagttatctggccatggtggattacccacttccatcagaatttctcatgcctttgccagccaatcctattaaagaagtatgcagaaatatcgacagtcaacctaagggtactggtactttggaacgtatatatgcaggagtaaatgtatactacaattatactggcactgttgactgctttgatctaaatgatgatccccatggaatgggtggatgggactggcaggcttgtaccgagatggtaatgccaatgtcttacagtgaacagaggagcatgtatccaccatataaatttgactacacttcctatgctgaggattgcatcaaaagctatggtgtcaggccaaggcctcagtggattacaacagaatttggtgggcataatatcactaaggtcctggaaaattttggtagtaacatcatattcttcaacggacttcttgacccatggagtggcggaggtgtcctgaagaatatatctgagagtgtcgttgctattgtggctccattaggagcacatcacatcgatctgcgcccggcaactccagatgacccggattggctggtggccctgagagaatcagagctggagatcatatctggctggctatgggattactacggggctggaggagcacccttccagcctgtaggtgtcaagggctcctcttcatactgaggaaccgcaccctggctaataattcaaatgcttggtctcagaaataagagggccctgctgcaagtgccaaccaccgttaatgctgctgcggtgctgcgtcatggagaaggaagatcttcatgttgatgatcgggcaccgaattcgctcctgcatcatgtgccatatcagtagcatttggtctgtgtatcaaatgggacatgtacttggctgatgaggtgaggaaaacactggataacgtaacgactctttcgcagtggtggtggcggtcaggtgctctagaggcttggatatcacgtgcatgtgccgctgtaaataacataatgctctatgtacgtgtacatctgcaaaaaaaaaaaaaaaa

SEQ ID NO: 16396 - DNA, 2206 bp, Zea mays
  misc_feature (18)..(18): n is a, c, g, or t
gtggagcacttccctgtnacatgtgttgagaaatatcaaatatgaaccaatcaatgacaagtcggacccactggattgacagcctctgacaccgaaaaagccacagatcggatcgcggcgagcagaggccacctccggattcgggcgctcggcgtagccgcgcagtggtgtgtctgcctccctccttgtatcctcctcgaattcgagcggcggcgacggcgggaagggagatggaggcggttagaggcgatgggaggtggtgcgtggtgactggcggccgcgggttcgccgcgaggcatctggtgacgatgctgctccgctccggcgagtggcgggtgcgcgtggccgacctgggccctgccatcacgctcgaccgcgacgaagaagagggtttcctgggtgctgctctccgcgaaggccaggccgtctacgtgtccgccgacctccgtgacaaggcccaggtcgccagagcttttgaaggggcagaagtagttttccatatggctgctccagattcatccatcaacaacttccaccttcattatggagtcaatgtcgatggaacaaagaatgttattgacacttgtatccgttgcaaggtgaagagactcatctatactagttcacctagtgtcgtgtttgatggagttcatggaatttttaatgcagatgaatcaatgccttacccagataagtttaatgattcatattcagaaacgaaagcggatgcagaaaagcttgtgatgagagctaatggtagggaagggcttcttacatgctgtatacgcccaagtagcatttttggccctggtgataagctaatggttccatctttggttgctgctgcaagggcagggaagtccaaatacattattggtgatgggaacaactactatgatttcacctacgtggaaaatgtggcatatggccatgtttgtgcagagaaaactctatcatctgaagatggtgcaaagatagccgctggaaaaacctatttcataacaaatatggagcctataaaattctgggagttcatgtcattgattttagaaggtcttggatatgaaaggccttcagtaaaaataccagtctctgttatgatgccagtggctcatgttgtagaatggacttaccagaaatttgccaagtatggaatgaaagttcctcagctgaccccttcaaggatcaggctgctttcatgtaacaggacattcagttgctcaagagcaaaggagcagcttggttatgaacctctcgtgtcccttaaggatggagtgaagagaacagtagagtcgtactcccatctacaagctcagaatcataggagtatatcaaaggcttcaattttcctcgggaatggaaatcttgcaaaaacagtactttgggaagatgcgaagcaaactgtgacagtgcttctactgttggctgttatctactaccacttatttacatgtggttacaccttcatcacagcgatggcaaagcttttgtcactaactgctctgttcttattcattcatggcatgctgccatcaaatctgttcggtcacaaggttgagaaactcgaggcctctaattttcacatcacccaggcacaggctcatcatattgctcattccattagttcgaattggaactctttagtcagtgcgctaagatctctttgtagaggaaatgattggctattgtttctcaaggtttcactatctctgctggttgtcagcatccttagttccatgtcttctcaggctgcatttaaaataggtactgctctggttttcacaggcttcaaagcgtatgagaaatgggaggacagcattgatagtatggtgggcgacgcctgtaccattcttctgcactttggttctgccaaggaatcatctagctagaaacaaacgtaggtgtagcttgcagactgccagttgctttgtttactgatattatcttcagctccagctgtttctgggtttcgttgacctaaattttcttctgtattcatctgatggtgttgtagaattgcctagcggcacatatgcaagttttggactcttttcctcttgatagttgatgtacaatatgaaattgtacatttttcccctttcccctgggaggcggcctcttcccatgtagagtgacaataggctctagtaaagattgaatcggattaggattggactctattacaaccttgataaaaaagcttgtc

SEQ ID NO: 16397 - DNA, 1187 bp, Zea mays
aatgaattggctcattcctcaaaccaaacgcctcgttaatccgcgcgttcctcttctttcccgttgcaatcgaacaaaacctccttttgtttatcggcatccttaaatatgtcttaacagcatccgggaatattatcttctctaggtgctacaaacaatacattcaaggaaaaagagaaaatatgagttttatccctgatgaggacaggagacttgtggataccacttccactgaaaagaaaaatggcagaaacaaaacaaaattcgctgctccatgtaaactgagctgtaccatagaacaaattctggctgtgatgctctactaagccaaacggagtactctaccagtttggcacctttatatgtacattttattgctcacgatctgtagaactgcaaccgtgctccatcagacagccggcaagaacttctcgccttcagcagcgggcttcgattgctcacccactttccggaaaactagcttctgttgcggaagctggccgttagagggcaccgtgacctgggtgtccacaaagatgctgtcctcgtccttgaaatcacctctgaggatgcccttcgcgagttcgttctccacgtgctgttgaatcactctcttcaccggcctcgcgccatagttcgggtcataccccaggcttcccaagaattcaatagcaccgggtgagacttccagcttgattttgcggtctgcgatcctcttctgtactcttgcgagctgtaatttgacaatgctgttgatctgttctctctcgagaggcttgaagacaatatactcatctacacgattcatgaactctggacggaacacagatcttgcagcatccatcaccctcctctttatgttctcataggctgaatcagatgatccaacttcttcgtccatgtttagtatatactgcgacccaacgttggacgtcatgataattatggtgttggtgaagctcactttccgtccttgagagtcggtaaccctaccgtcgtccagtatttgaaggaagacattgaacacatccgaatgagctttctcgatctcctcacccaaggcgacggaatatggcctacgacgaacagcttctgttagttgaccaccctcttcatacccaacataacctggtggagcaccaatcaatcttgagactgaatcttctccatgcccggccggcctcgag

SEQ ID NO: 16398 - DNA, 1234 bp, Zea mays
gcccgccgggtccccaggagcccacggcacggcgacgccatcgacctcactccctccctccctccctccatccctcactcctcctcttcgccgcctcgcaagcaatggcggtggcgcggctacgcgcggtcgccgccgccgtgctgcagccggcgctcgccgcgggcggccgcggcgagaggcggccgctcgggacggcggcggaggtggccgccggcgcgggcccgggggctgcgaggtgggagctcatgggcgcgcgggactactacgactaccgccgcgccatgtacggcgacatcacgcacaaggccatcctcgtcgacgccgccggcacgctgctcgcccccaccgagcccatggcgcaggtgtacaggacgataggccagaagtacggagtgaattactcagaggatgagattctgatgcggtaccggctagcttatgcgcagccatggggtcgatcgcgtctgaggtatgtcgatgacggaaggcccttttggcaacatatagtgagctcatctaccggctgctcagatctacagtacttcgaggaactgtaccagtactacacaactgagaaggcctggcgtctctgcgacccagacgctggacgtgttttcgaggcgttgaggagggctggcgtcaaaacagccatcgtgtccaacttcgacactcgtcttcggccgcttttacaggcgctgaaatgcgacggctggttcgacgcagttgctgtgtctgctgaggttgcagcagaaaagccgaaccccacaatattcttgaaggcctgcgagctgctaggagtgaaacctgaagaagcggtgcacattggtgatgaccgtaggaacgacttatggggagcgagggatgcaggctgcgatgcctggctttggggcagtgacgtttactccttcaaggagatcgcggagaggatcggagttgaggtgtagcaagttgtttctcctcggtcggcgccacttaccccgggcgtcttgtacatattcccaagagaaataacaagagcatcagtttctcctgtgtgcgactgtgccaggccttttgtagcaaataccgatgtgcatttccacgcttccctgtagcaaatactgatgtgcaggagctctgtccgggttgaattcacagagaagagggtaccaaaaaggacagctaaaatgcaatgcagagaaacaagaacagcaaactcacacaaataatggcgaaagcttctcttttgccc

SEQ ID NO: 16399 - DNA, 4176 bp, Zea mays
gggttttatacctgctatttgcagtttgcctactatttggagaaagagcatcaggggatttttcgtaaaatgaataggaccagtatggggagcatgggagggcttctctgtaaaaaggctttgacaccgttggatactagatgaatggactggatgcattttgagcatggagcatcgaccttctttgtcgcttagggctagattgggaactcaaatcccctttggatttcgctgctgcggttactgcatctgagatctacatacttggttggttaattggtttgattcagatttgagattgggagtggggaccctgtttcaagtttattaaagtggcacccgataactatagcaattccgaaagtatccgatctctctctctctctcaagccaaccgaagaatcacttctctgatagtttaaaaatcaatcctaaaagatacaaaatggccgcctgtttcagcagcaccgcagctgcaagcagtcactgaagctacagtgtctactgtcttccaccatcagccgccgcgcctgcagccgctttgctgatgggttcacgaaatgtaacgaaaatagtgtcagtggtttgcactcgattactatagtaacaagtttaaataggccggtatcaatttttaatgtggtatctgattgactaaaacaaatatgatttaaggtaattattatattacaaatatgtgaatcaaatgacacataagttctggtgtcaatgtgtactttcagcacacaacacataatctaattagtcggctacctgacatgaataaatctgcactagttgtagttggtagtggttctttttccttgctgcgtttactgccatcctgcttgaactgtagtactagtattatgttagccgtaaccgagtaaggccctgtttggtttccatggattggagctctggaatggttcctagccaaattatttctctaatttataaaaattttgatgagttggaacgaatcctgattcattcctagacaaacaacgggccctaactgatttcagtacagttgggtgaatcaggtagattgtaacgtgaacatgcctgtcaaaattgatccaaggaattacgtcttacagtcacccaaaaatgtacaagccaatagtgctccatacaaatctgattgcaggacagtcaaaaaaagacgtttgacagattcttcttccttacaaaagccacaaatggtactatctttccatttccttttaagcagattatccttggtcaaaatagcattatgccaggtttagccacacgcatatttttatgttaagaggcgtttgttttcgtaatcatcacagtttctgaacagatgcttatagaccgagctaacagagagcaaaccagactttccccatttccaaatcacccaatcaggctggttattgggtttaaatctgaaaagcatgatatacaaaagtctccgagttgattctatgaatcttgagatatccatctcctgaagttcaatctccgattcctattacttatagtggacactgaacgttcatgttctggcgtaaaccatccatgtgcagcaatctccagatggaatacgtggacctgtacatggtgcactggcccgtgaccatgaaggccgggaggttcacggcccccttcacgcccgaggacttcgagccgttcgacatgcgggccgtgtgggaggccatggaggagtgccaccgcctgggcctggccaaggccatcggcgtgtgcaacttctcctgcaagaagctcgagaccctgctctccttcgccaccatccctcccgtggtcaatcaggtccgcctcgtcctccgaatacttgtagtagccagctctagccatggcactgatgatatgtagatagaaaacctttccttttttttgtgtgtgtgaaattaaacatggatagagaccattggcaagtttatctttgggggtaataatgtgtgtatgtataatgcaggttgagatcaacccggtgtggcagcagcggaagctgagggagttctgcagggcgaagggcatccagctatgcgcctactcgcccctgggcgccaagggcacgcactggggcagcgactcggtgatggactccggcgtcctgcacgagatcgccaagtccaagggcaagaccgtggcacaggcacgcacccgcatcctcctctcgccaacccattgacaacacacactctgactgatcgatgcaacaggtgtgcctgaggtgggtgtacgagcagggcgactgcctgatcgtgaagagcttcgacgaggggcggatgaaggagaacctggacatcgtggactgggagctgagcgaggaggagaggcagcgcatcagcaagatcccccagcggaagatcaaccagggccgtcgctacgtctccgagcacgggccctacaagtccttcgaggagctatgggacggcgagatatgatatgagtaaacgttacgtcggcgccccgctaggcggctgccttgcgtgacggagcaacgagctccccgtcgtgacagtgagcggctgctttgtgtggttttatgtcgtgccatctgtgcaacaaaaagtgatgcttagtgtcacagtatgtgtgaaataaattaaaaaggattttctggttacgccggtcaatgcgtgccactgccctgccaccagcccaccaccgcagggttggcagcgggaccatgacgccaccgggagatccgctcgccgcacgcacatcggcctgcgcttggcggtggccggagcccatccgcctcgcatctacacctatatacccagaaaaaaaataaaagtatttgccgcaaaagcgcgcgctggtacttttgcgacgtgcgccggtatcgcgtagccgtcggccactgggccgccccattgacggcccgcctacccgttcacggcgtctccacggcccgcctacccgctcctcccgatcctcacagcttatcatgattcatgagtagcgacctcacggccgggaagccgccgtgtgtgtaaagccggccggcccaggccccagggcacggggggctacccttgcctcgcaaggcgctgcttggcttgttgcaggaccagatgtctgtgctgcaggcttgcgcggacttgcggtgcttgctcacgttggtgcaaccaaagcagcagcagcactgcagcagcaacaacaacaaaatccgaggaaaaacgcaagcaattttgcaaggccgcaagggtaccagtgcgccatcacagcttttatggaattgctactgtatcgccgagcatgtcttagaggtttgccatcacagcttttacgttgtctagtctagggaatacttgctttgtagcttttggtcaaacagaacagcattctcaatcttatcagggcaacgacatttttcttttctggattatggtcagggagaaaaaaaaatcaaatgcattgtactccggttttctttttcttttcccattttaatctgaaaaaaatgtttgcgaatttgggtagtaaccacatggtagtgtagcttaagcgcaggtcctcaggcgagagacagagcatattctctgcagtaaccatgcgtaggagtataaccatgggtcagtctgtgcttttttttacagagcattcagcgccggatgaaatggatggccctggcgcactgctggtgctggcgtgcgtggtaaaaagctgttacaccacgtgaagaaacgcaggcaacgggtaaaggcattttttggttccttttgctaaagggaggcgagaggggggtggagatggagctggggagaggcagaggccatcctctgatgcaaatgcaatgcccacttttgcagggaggcactgaccatgacgatgccaagccgacgagtagcaagcagtgcaacctgctacaccggtccagtaccgtatcggaggcctagctgtccagtctgaggtactttttccctcccgcacacggtacttctgaagttctgtattctcataaattttagatatactattctctgatgagctttgccataaagcaatgcatgtcgtctcatctaaaaataaaactactacaaaaagtttagaatgttgttctgtgaaacgattcgtttgtggtctcttctttctcgagaacaaatcctagaatattggaccattatacttacaaatagctggtttcttctttataaaaagattatcccg

SEQ ID NO: 16400 - DNA, 1288 bp, Zea mays
ctcgccccgcggccgacagccaacacaagtcaagtcggagcccgcaggtgtcgacaccgcgcgccgggagccggaagaagggtggggggtgagctgtggaccatgagcgcgaccgggcgagccccgtgcggcctgccgcgcatcggcctgggcacggcggtgcagggcccgcggccggaccccgtccgcgccgcggtgctgcgcgccatccagctcggctaccgccacttcgacacggccgcgcactacgccaccgaggcgcccatcggggaggccgccgccgaggccgtgcgcacggggctcgtcgcctcccgcgaggacctcttcgtcacgtccaaggtctggtgcgccgacgcgcaccgggacagggtgctcccggccctccgccggacgctcagcaatctccagatggaatacgtggacctgtacatggtgcactggcccgtgaccatgaaggccgggaggttcacggcccccttcacgcccgaggacttcgagccgttcgacatgcgggccgtgtgggaggccatggaggagtgccaccgcctgggcctggccaaggccatcggcgtgtgcaacttctcctgcaagaagctcgagaccctgctctccttcgccaccatccctcccgtggtcaatcaggttgagatcaacccggtgtggcagcagcggaagctgagggagttctgcagggcgaagggcatccagctatgcgcctactcgcccctgggcgccaagggcacgcactggggcagcgactcggtgatggactccggcgtcctgcacgagatcgccaagtccaagggcaagaccgtggcacaggtgtgcctgaggtgggtgtacgagcagggcgactgcctgatcgtgaagagcttcgacgaggggcggatgaaggagaacctggacatcgtggactgggagctgagcgaggaggagaggcagcgcatcagcaagatcccccagcggaagatcaaccagggccgtcgctacgtctccgagcacgggccctacaagtccttcgaggagctatgggacggcgagatatgatatgagtaaacgttacgtcggcgccccgctaggcggctgccttgcgtgacggagcaacgagctccccgtcgtgacagtgagcggctgctttgtgtggttttatgtcgtgccatctgtgcaacaaaaagtgatgcttagtgtcacagtatgtgtgaaataaattaaaaaggattttctggttaaaaaaaaaaaaaaaaaacccgagagggggggcgccccccccccatttcccccttagagg

SEQ ID NO: 16401 - DNA, 2699 bp, Zea mays
cattgggtccctcgaggccggccgggagggagtgacacgtcccgagcacgagctcgtcaacacccgaccccgtccgcactctagagtcgctacccgtgaatccgtgatttccattctaaaaattatccttcctcccgtgcctacagtcctacacctcgacgatgccaaaaccctagcgcagcagcgcgaactacacctctccccgtcctgttcctcgtggcgcggtagccatggcggagccggccatcctcgacccctcccccttcgatctccgccactatccggcgcacctcttcgacccggacatccccctcgccgccgccgacttcccactcggtgaattcgccggagacgacggctgtgatggcctagacttcgacgtgcccgtagatttctctatcgacgacttcctcctccggtctcctgaccgcgggcacgacggcgacgactccggcgagggctctgctgccggatccggccccaccgcatcttccttggcctccccggccacctccggcactaactccgccgtggccaacgtcggcaaccgcaaggtgaagcacgaggactcggacgagggaaggagcggcgccaccccgaattggagcctcaagcggaagcaggtgagtcccggagaagcaacctccgatggggccaagtgccgccgatccggcgatggggatgtttcgccatctgcatcggcgtcgcgtgcagccacggaggactccgatgagaggggcgtgggcggcgaggaagaggacaagcgccggactgcgcgcctgatgcggaaccgtgagagcgcgcagctctctcggcagaggaagaagcggtacgtggaggagctggaagagaaggtgaaatcgatgcactcggtgataaatgacctcagttgtaagatctccttcatcgctgcggagaacgccacactgaggcagcaactcggtggtgtgggggtgagtggaccaccacctggggtgtatccaccgccaccgccaggcattcatttcccttgggtttctgggtatgcaatgcggcctcatggctcccatgttccacttgttccaatcccgcgattgaagccgcagcatgcagcagctgcagtgaaggtatccaagaaaccagatgtcaagaagtctgtggagagcaagagtaagaccaagaccaagaccaagaccaagaaggtggcaagtattagccttcttggtttgctgtttgttgcatttgtctttggcgcttttgttccggggttcaatcatagtctcggactgagaggaaggagcgacaatgtgatgtttggaaattttggccagtctgatgctagggtgtttagtgtcactaaccatggtaaaggacctaaaggcagtttcaacagtagtgacatgatcagtactgatcatgacatgatgactgggcatgatgatggagcggggcagaaacaccgagctgcaaataactctagtgagatcttgcctgctttgttgtatgtgccgaggaatggaaaacatgttatgatcaatggcaatttgattattcattctgtgatggctagtgagaaagcagtggcacataagggctcaaatagtcagtcagttaaagatcacaaggagaccagtgttgctatagctcgctatctgtcaccacctggaaaggatatgaattcaaaagagatgttcccgccagatgcaccactgccacaatggttccgtgaaggaatggaaggacctgttttgaactcgggaatgtgcagtgaggtatttcagtttgatatttctccagcttcggccaaatctggtggcattatacctgcttcggccaaatctgcctcaagtgtcaatgctacccagaaaattctgaaaccttctcctgcttataggggcaagctgaaaaacaggaggatcatgtataacgaggcaattccacttactggaaaaacagcgaacaacacaaagcctcaggcttttaacagtactgctgaaagcagcaaggtacctgatactgatagcaagcctgcatcatcagttatcgtctctgtgctagctgatcccagggaggctggcaatggggatggtgatccaagagtatcaccaaaacccctctccaggatatttgtcgtcgttctgctcgatggtgtcagatacgtgacttactcgtgcacacttcctttcaagagtgccagcccacaccttgtgaactaaccttggggccggtgcagctttctggtccatgagcggctaaatagttggggttttctgatgcattggaggtagatgaatgaatacagtaatgtggtgttgcttgctaacaatgaaaacagacttcaagactcgcactcggcctgaggtaatttgagtttgtcgaaggtttgtagtgtggactggcgaaatgttgtgcaagttcaaccttaacccatgaggtttgtgcttctatgtagtcgagttattatactcacctctttctctggtactctttattgcggagctggaaaatataacagctgatgagagaagacaatatttggaaaataactttgtactagtatatattatatatatagtgtactatatatagggatgtaatatggttcggaaaatatccgtccggatccggattctaagatggtgaacactggttcggatggaattttcggaaaaaaaaaagaaaaaaaaaaaaaaaaaagcggccccccatattttgttcgg

SEQ ID NO: 16402 - DNA, 2418 bp, Zea mays
agctgcgttacaaaaaacattttatttaaacaaaaaatacaatgcttccattgtgaagctcttagccagcactagcaaatgaatcggtcctacagatatcagcaactcagacagagtgcaaaaggtgttacagttccaacacttgtaagaggacataggtttgaaaatatgcctaaaccattcaatagcacagaattcaacagactaatagactgaattttgacttcacgcagaaattgatcgggtgataggcgcattttttggtcacggtccaatgataataagcaatgagcacatgtcattctccgcaaacatggatctgtcaaatatcaattaaacataaccactaacaccattgactaccctatcagtgtcatatcaacagttgcaatgttaatacgcagacaaccacgcaccaatgcaccgtcaatacactgaattaggcgaatggcaggactgagggtcgtagcattattgtctccgtgccgtacgtaccttcttcatcgtcgcgcttctcctctaggccgagcgcgctgtcgaagttcttctcgatgttcttcacgctctcgctgatcttgttgacggctccggcgatgtcctgcaggccgccgagcgacaccttcccggaccaccacgccatccctgtccccggcctccgaccgccaccggctcacggcctccgcctccgcacctggcgctggcgccttagatctcgggcatagatctaatgacccgcgcagccgatccaccgcccacaccccacaccacgcgcgggcgggagcggaatctggccccccggcaacctcgcgctcgctgaccagatcagctgagcccgcgagcctacgatagcgcgatgacgggggccgagccggcgccgccgcgggcctggggggagaggggggaagctcttcagcgagctcccgccgcgcggtggcgactggcgaagcgggaggggagatgtagctgcggggggggaggggggaggagtgcgtagggttgggttgggccgtggagcacgacggaggggtgggagagagtgcgttcggccgttggcgcgtgtggacgccgcgtcggcgtcggtgatcggccgcccgcctgcctgccacgctctctcggttcggtgcagtgagcagtcagcagtggatctcgctcggcctgaacgaacacgacggaggacggacggatcgatctgcccgcggggaggtgcgggtgcggctcgtcccgtcgctccagctgcgtcccgccgtacagtatagagtatagacacagtgggccgtgtggaccttgtcgacaagtcgcgcatgggctgttttaggcccgttcggcctacaagacggacaagcccaagcacaaacaaaaactgcagaagcagaacactagaacagatcctcgcttagcctacctggctccatgtcggtattgccaagtcagctcgcatcagaatcaggagatcaggataagcctatccagagcaggccacacggcatcctccctatgggtcacggccatcttcgcgcctgagagtgcgaggcgtccacccacacaaatcccaaatcctcagcacgatacgatccgccgaattaagttcgtgcacgtacgcacgcaccggccccccagcaacccccaacagcgccactgtccagtgcgcgcgtcaagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacaggtgccatgatgtttccaacccattcaattccctgcggtaactagacttgctagggtgatctgatctctctgctgcatgcgttcttcacgtcaccagagcaagttcttcgagacgttcgcggctccgttcaccaagagaggtctgctgctcaagttcctgctgctgggcggcggctcacttctggcctacgtcagcgcgtcggcgtcaccggacctcctgccgatcaagaagggacctcaggagccgccgcagccgggcccgcgcggcaagatctaagctcagcttctccatttgcatggtctagtagcttgctttgtactgctagcgccggtcgatccgtcgcaatcgtcatggatcatctctctatcttgttgttacgctgttcataatttggtatatttgccattccgctattgtgtactctttggcatacatacaataattaaaatggcgttgcgtggctctcaaaaaaaaaaaaaaaaaagcgtatcccta

SEQ ID NO: 16403 - DNA, 3305 bp, Zea mays
cgacctgcagttatggactttgacattaaatcttcaggttgctccattacattatcctcctgtacaacaacagatacttcccctgcctccatcttattgctttcttcctcactttttttggtatcaatattgccatcatgtaatttgacttcaagacgagtaactttgtctactgtatcgcaattctccagttggctactaagttcttttgggacatcgtattcttgagcaatcttgtcctcaacttcagttatattatctgaactagctagcatggattctgctggttgtgactgagaggcattcccatcagatgtgtcttcctttcctgtatcaatagattcacctgtttcggtgtcacctgatttatctattttgataggcgaagaaaatgcactaccatcaggtaagtctccagcagactctctaagctgatttggctctgcttcatcactaggacaagaatgtttactatattgatggtcctggttttcttcaactgttgaaggatgtcctggagattgtgatgtttctgatgcttcatcatcacccaccttagatgcaggtgcctcagtgcagccatcaagcttttcttctgctactgaaggatgtgctggagtttgtggtggcatggactgctcagaaacatctgccttagaaacaggtgactcattggagatactatgagcttcttctgattttgaaggctgttctggaaatgttgttcctgatacttctgaatgatctacctcggatgtctgtttcttagttggggtgctatgattttcttcctctgctgacagatcctttggaaattgtggcttttctgatacttcagtgccatcttcttcaccattgtgtcccatgaaagccatgacaggattgaagaatcctattccatcagagttggatgtccgcgatcctgatgctgcgttacaaaaaaaacattttatttgagcacgcagctgcgttacaaaaaaacattttatttaaacaaaaaatacaatgcttccattgtgaagctcttagccagcagtagcaaatgaatcggtcctacagatatcagcaactcagacagagtgcaaaaggtgttacagttccaacacttgtaagaggacataggtttgaaaatatgcctaaaccattcaatagcacagaattcaacagactaatagactgaattttgacttcacgtagaaattgatcgggtgataggtgtgttttttggtcacgatccaatgataataagcaatgagcacatgtcattctccgcaaacatggatttgtcaaatatcaattaaacataaccagtaacaccattgactaccctatcagtgtcatatcaacagttacaatgttaatacgcagacaaccacgcaccaatgcaacgtcaatacactgaattaggcgaatggcaggactgaggatcgtagcattagtgtctccgtgccgtacgtaccttcttcatcgtcgcgcttctcctctaggccgagcgcgctgtcgaagttcttctcgatgttcttcacgctctcgctgatcttgttgacggctccggcgatgtcctgcaggccgctgagcgacaccttcccggaccaccacgccatccctgtccccggcctccgaccgccaccggctcacggcctccgcctccgcacctggcgccttagatctcgggcatagatctaatgactcgcgcagccgatccaccgcccacaccccagaccacgcgcgggcggaagcgggatctggctccccggcaacctcgcctcgctgaccagatcagctgagcccgccagcctacaatagcgcgatgacgggggccgagccggcgccgccgcgggcctgggggaagctcttcagcgagctcccgccgcgcggtggcgactggcgaagcgggaggggagatgtagctgcgggggggaggggggaggggagtgcgtagggctgggttgggccgtagagcacgacgaagggtgggagagagtgcgttcggccgttggcgcgtggggacgccgcgtcggcgtcggcgtcggtgatcgcccgcccgcctgcctgccacgctctctcggttcggtgcagtgagcagtcagcagtggatctcgctcggcctgaacgaacacgacggaggacggacggatcgatctgtccgcggggaggtgcgggtgcggctcgtcccgtcgctccagctgcgtcccgccgtacagtatagagtatagacacagtgggccgtgtggaccttgtcgacaagtcgcgcatgggctgttttaggcccgttcggcctacaagacggacaagcccaagcacaaacaaaaactgcagaagcagaacactagaacagatcctcgcttagcctacctggctccatgtcggtattgccaagtcagctcgcatcagaatcaggagatcaggataagcctatccagagccggccggggcacggcatcctccctatgggtcacggccatcttcgcgcctgggagtgcgaggcgtccacccacacaaatcccaaatcctcagcacgatacgatccgccgaattaagttcgtgcacgtacgcacgcaccgggacaccagcaacccccaacagcgccactgtccagtgcgcgcgtcaagcttgcttagctagccgccatggcctccctcgccgccgtctccgtgaagcccgtggccatcaagggtctcgccggcagctccatctccggaaggaagctcgccgtcgccaggccgtcggcccgctccatccgcaggccccgcgcagccgccgtggtggccaagtacggcgacaagagcgtctactttgacctcgacgacatcggcaacaccaccggacagtgggacctctacggctctgacgcgccctcgccctacaacccgctacagagcaagttcttcgagacgttcgcggctccgttcaccaagagaggtctgctgctcaagttcctgctgctgggcggcggctcacttctggcctacgtcagcgcgtcggcgtcaccggacctcctgccgatcaagaagggacctcaggagccgccgcagccgggcccgcgcggcaagatctaagctcagcttctccatttgcatggtctagtagcttgctttgtactgctagcgccggtcgatccgtcgcaatcgtcatggatcatctctctatcttgttgttacgctgttcataatttggtatatttgccattccgctattgtgtactctttggcatacatacaataattaaaatggcgttgcgtggctctcaaaaaaaaaaaaaaaaaaaaaaccaaaaaacccaaaaaaaaaaagcggccgcggcc

SEQ ID NO: 16404 - DNA, 1249 bp, Zea mays
gcacgagcttccttccttctccgctcgtcgtcgttctaccggcatggccggcattaccaagcgccgcacctccccggcctccacctcctcttcgtccggcgacgtcttgccgcagcgggtcacccggaagcgtcggtccgcccgccgcgggccccggagcaccgcccgtaggccgtcggcgcctccacctatgaatgaactggacttgaatacagctgctcttgatccggatcattatgctacaggattgagagttcttcttcagaaggagctccgaaatagcgatgtaagccagcttgggagaattgttctcccaaagaaggaggcggagtcttacctccctattctgatggcaaaggagggaaagagtttatgcatgcatgacttgctaaattcacaactgtggaccttcaagtatagatattggttcaacaacaaaagcaggatgtatgtgcttgaaaataccggagattatgtaaaagctcatgaccttcagcaaggagacttcatcgtgatctacaaggacgacgagaacaaccgctttgtcataggagcaaagaaggcaggagatgagcagaccgccactgtacctcaagtccatgaacacatgcacatctctgccgcactgccagctccacaagcgttccatgactatgcaggccccgtcgcagcagaagctggtatgctcgcgatcgtgccacagggtgacgagatattcgacggcatactgaactccctgccggagataccagtggcgaacgtgaggtactccgacttcttcgacccgttcggtgactccatggacatggcaaatccgctgagctcctccaataacccctcggtcaacctggctacgcacttccatgacgagaggatcgggagctgctcgtttccctacccaaaatccgggcctcagatgtgagatcctggcagaaaaactgccgcggtcaaaaccatcatcccctgcgtggaactcagagatcccctggttgacgccattgctgtacatccaaataaatggcgtcctcattttgtatgttcagtagtatatgattgggtacgcgtgttgtttatgtgtaaaagggtaactctgcaaaactgaactgagcgttacatcagatgcaacgctgtgacgactgacgaggaggcaggctctggtgtttcctgtcctgcaccctgtgaatgtgtgtgcaggtacataaacgaaagacatcctgtgcattagcattaaaaaaaaaaaaaaaaaaaa

SEQ ID NO: 16405 - DNA, 1622 bp, Zea mays
gcacgagctcgtgccgctcgtgccgaaaggaactaaggaaggcgagggccaccatccccaaaacccgtaaaaaaacccgaattgacaaattgagtcgacggggaaggaaataaagaaggggaagagcacgcgccgccgccagcaccgcgtccgccatggccgcctcctcccgccgcgcgtctcaattgctggggtccgcggcctcccgcttcctcctcgggcggggcttcgccgcggcggccgccgccgcgccctcgccggcggtcttcgtcgacaagagcacccgcgtgatctgccagggcatcacggggaagaacggcaccttccacaccgagcaggccatcgagtacggcaccaacatggttggtggagtgactcccaagaaaggtggaactgaacatttagggctcccagtgtttaactctgtagcagaagctaaggctgaaacaaaagccaatgcaactgttatatatgttccaccaccatttgccgccgctgctataatggaggcaatggaggctgagctcgaccttgttgtctgcattacggaaggaattccccagcatgacatggtgaaagtgaaggctgcactaaatagacaatctaaaactcgattgattgggccaaattgccctggtatcattaagcctggtgagtgtaaaattggaatcatgccaggttacatccacaagcctgggcgtattgggattgtatctcgttctggtaccttgacatatgaagcggtgtttcaaacaacagctgtaggcttggggcagtcaacttgtgtaggcattggtggtgacccattcaatggcacaaattttgttgattgccttgatgaaatggtcgtcggccgaccctcagacagaaggtattgttctcattggtgaaattggaggtacggctgaggaggatgctgcgacattcatccaggaaagcaaaacacaaaagcctgttgttgcattcattgctggacttacggcacccccgggccgtcgcatgggtcatgctggagctatcgtggcaggaggaaagggtactgcccaggacaaaatcaaggcactcagagaggcaggtgttaccgttgtcgagtcaccagcgaagattggctctaccatgtttgaaatcttcaagcagcgtggaatggtagaatagacgatggagacattgagaaaccgcattttgatgctcatgggcaattgcgagcaattccttccatggcctcaaacaaaactaatgaggctaccttttcttacgtgccttctgtttggaagatggcctcttcacctggatcaccttccaatgagctcatttccaataagacgtttcagagccatggacatgcttggagtcaatgtgaatgcctaatttcgaatttttattgtttacacatgtcaatctaggtttaccaatctgtttccttgtattatattgtgcggtaaattgccccacagctgaggacgattgctttgctcggtgtcatgtttgagaaaatttcttatttggccctgattgaaacttgtctatcttggcccttgtcctgaaataaaatttcttacctattcgacctcagaaaaaaaaaaaaaaaaaaaaaaaaaaaactcgagactagttcctcgtgc

SEQ ID NO: 16406 - DNA, 1509 bp, Zea mays
  misc_feature (16)..(16): n is a, c, g, or t
gcacgagaccattacntagaacatcctaatcgagacaactttccctgcaagaatggatcgcgagaccaagaacagtagaccaaagacaaaggaaggcgagggccaccatccccaaaacccgtaaaaaaacccgaattgacaaattgagtcgacggggaaggaaataaagaaggggaagagcacgcgccgccgccagcaccgcgtccgccatggccgcctcctcccgccgcgcgtctcaattgctggggtccgcggcctcccgcctcctcctcgggcggggcttcgccgcggcagccgccgcggcgccctcgccggcggtcttcgtcgacaagagcacccgtgtgatctgccagggcatcacggggaagaacggcaccttccacaccgagcaggccatcgagtacggcaccaacatggttggtggagtgactcccaagaaaggtggaactgaacatttagggctcccagtgtttaactctgtagcagaagctaaggctgaaacaaaagccaatgcatctgttatatatgttccaccaccatttgctgccgccgctataatggaggcaatggaggctgagctcgaccttgttgtctgcattacggaaggaattccccagcatgacatggtgaaagtgaaggctgcactaaatagacaatctaaaactcgattgattgggccaaattgccctggtatcattaagcctggtgagtgtaaaattggaatcatgccaggttacatccacaagcctgggcgtattgggattgtatctcgttctggtaccttgacatatgaagcggtgtttcaaacaacagctgtaggcttggggcagtcaacttgtgtaggcattggtggtgacccattcaatggcacaaattttgttgattgccttgaaaaatttgtcgatgaccctcagacagaaggcattgttctcatcggtgaaattggaggtacggctgaggaggatgctgcaacgttcatccaggaaagcaaaacacaaaagcctgttgttgcattcattgctggacttacggcacccccaggccgtcgcatgggtcatgctggagctatcgtggcaggaggaaagggtactgcccaggacaaaatcaaggcactcagagaggctggtgttaccgttgtcgagtcaccagcgaagattggttctaccatgtttgaaatcttcaaacagcgtggaatggtagaatagacacagtggtacagtagagagacattgagaaaccgctttttgatgcttgcgggcaatcgcgagcaattcctcggtagatccttctccctggccacaaacaaaactactgaggttttcttttcgtacttgtcttatctttggaagatgtcctggccttcttcacttggataacctttcgctgagctcatttcaataagacgtttcggagccatggaaatgctatgtcgcttggagtcaatgtggatgcctaatttcaaatttttattcttcatacatttcaaaaaaaaaaaaaaaaacccaaacc

SEQ ID NO: 16407 - DNA, 1674 bp, Zea mays
caggccgaactttccctgcaagaatggatcgcgagacccaagtagagtagacgaccaaagacaaaggaaagcgagggccaccatcccccaaacccgtgagaaatcgaatcgagaagggaagagcacgcgccgtcgccagcaccgcgtccgccatggccgcctcctccccccgcgcgttgcaatcgctggggtccgccgcctcccgcttcctccacgcgcggggcttcgccgcggcggccgccgccgcgccctcgccggcggtcttcgtcgacaagagcacccgcgtgatctgtcagggcatcacggggaagaacggcaccttccacaccgagcaggccatcgagtacggcaccaacatggttggtggagtgactcctaagaaaggtggaactgaacatttagggctcccagtgtttaactctgtagcagaagctaaggctgaaacaaaagccaatgcaactgttatatatgttccaccaccatttgccgccgccgctataatggaggcaatggaggctgagctcgaccttgccgtctgcattacagaaggaatacctcagcatgacatggtgaaagtgaaggctgcactaaacagccagtctaaaactcgattgattgggccaaattgccctggtatcattaagcctggtgagtgtaaaattggaatcatgccaggttacatccacaagcctgggcgtattgggatcgtatctcgttctggtactttgacatatgaagcggtgtttcaaacaacagctgtaggattgggtcagtcaacttgtgtaggcattggtggtgacccgttcaacggcacaaattttgttgattgccttgaaaagttcgttaacgaccctcagacagaaggtattgttctcattggtgaaattggaggtacggctgaggaggatgctgcgacattcatccaggaaagcaaaacacaaaagcctgttgttgcattcattgctggacttacggcacccccgggccgtcgcatgggtcatgctggagctatcgtggcaggaggaaagggtactgcccaggacaaaatcaaggcactcagagaggcaggtgttaccgttgtcgagtcaccagcgaagattggctctaccatgtttgaaatcttcaagcagcgtggaatggtagaatagacgatggtacagtagagacattgagaaaccgcattttgatgctcatgggcaattgcgagcaattccttccatggcctcaaacaaaactaatgaggctaccttttcttacgtgccttctgtttggaagatggcctgacttcacctggatcaccttccaatgagctcatttccaataagacgtttcagagccatggacatgtttggagtcaatgtgaatgcctaatttcgaatttttattgtttacacatgtcaatctaggtttacctatctgtttccttgtattatattgtgcggtaaattgccccacaactgaggacgattgctttgctcggtgtcatgtttgagaaaatttcttatttggccctgattgaaacctgtctttctttcttggcccttgtcctgaaataaaatttcttacctattcgccctcaaacaactagatagcgccggcgcccagcctctccgcacagcgccagctgtggtggacacagggcgcgcgatcctacggcaatgcgaggagtcccaa

SEQ ID NO: 16408 - DNA, 2971 bp, Zea mays
  misc_feature (2822)..(2822): n is a, c, g, or t
tgtattttttacttggagtaccgtgcagcagtatctgggttgtacatgccctaacgcatactccgtccgacccatcccatactacacatttttttaaattatatatagggttgaattgaaaaagaaaaaaaaagctagttagaggagaagctatattggccgtaacgtgagacatacaggactgggagtctggaagtaggagtggacagtgacgggtgacgactgtgcctctgaatggatcctatcctacacaagtcatgggggccgccgccagctcacacacactgccgacgctgccgtgccactgccatcctcgagcacaagggaccgaccagacccgatccacagctcatcacacacacacacagtggcgagctcgtcaattgcaggtcccaagacagcaagcgcatttacacagcacgctgaaagccgggacgcagagcagcttttgcgccttgtcccctcctgctcgtcgcttccctcactctcacagccacgccacgccacgagagaagaatgccgccgacgctgggcctgctcctcgcggcggcggcggcggtcctgctgctgctgctgccgccgccaccatcggcgggggcgcaggagacgtgctggtcggggccggcgccgcggcgcggggcgtggatgtccgtggccagcttcggggcgcgcggggacgggcagacgctcaacacgggcgcgttcgcgcgcgccgtggcgcgcatcgcgcgtcgccggggcgcgcggggcggcacgctgctgtacgtgccgcccggggtgtggctcacgggccccttcaacctcacctcccacatgacgctcttcctcgcccgcggcgccatcgtccgcgccacccaggtaccggctaccgtacgggcaattgcccatcgcccttcgtggttcttggtcgccgccactgccagccatgccttgctaccatcgaactaataagtgagcaggacacgtcgagctggccgctcatcgacccgctgccgtcgtacgggagagggcgcgagctgcctggcgggagatacatgagcttgatccacggccacggtctgcaggacgtcttcatcacaggttctttcttacactgccagccagacagccacccactgagccactcctccatcgatctgctcaaagctccgcattctgttctggtctgcggcgtcaggtgagaacggcaccatcgacggccaaggcggcgtgtggtgggacatgtggaagaagcgcacgctgcccttcacgaggccgcacctgctggagctcatgtactccaccgacgtcgtcgtctccaacctcgtcttccaggactcgccgttctggaacatccacccggtttactgcagcaacgtagtgatagcaaacctgactgtgttggcgccgcacgactcccccaacaccgacgggatcgatctaggtaaggtaaggtaaataaatacaataccacctgagctgagcattccttcctgctctgctgtgctgacaaacaacatctccgccctgcagattcaagcagcaacgtgtgcgtcgaggactgctacatctccgccggcgacgacctgatctccatcaagagcgggtgggacgagtacggcgtggccttcggccgcccaagctccggcatcacggtccggaggataaccgggtcgggcccgttcgccggcttcgcggtcgggagcgagacctcgggcggcgtggaggacgtcgtggccgagcacctgagcttctccggcgtgggcgtcggggtccacgtgaagaccaactcgggcaggggcggcttcatccggaacgtcaccgtctcccaggtgaccctggacggcgcccgctacggcctgaggatcgccggcgacgttgggggccaccccggcgcgtcctacaacgcgagcctgctccccgtcatcgacggcgtggcggtcaggaacgtctggggccggaacgtccggcaggccgggctcatacggggcatcagggactcggtcttcagtaacatttgcctctccaacgtgaagctctatggcattggcagcgactccatcgggccgtggagatgccgagccgtcagtggcagcgcactcgacgtgcaaccgtcgccatgtgcggagctggctagtacgtccgggacaggtttctgtacctgaatcagtttttccgcctcctatagcagcaataaagacgtcagcatttctccattttgttcatcacctacagggccctttgtttctttggcaaactcttctgcgattcagctgtcactgttgaattctgctgttggcagaggataatctatttttaccagcagccattgcaagagaattatttttacgtccgtgaaatggtgagaccgatcagcattgcacatcctggtgttggtgtaaccagatcccccactgccgtgtgggcgcgggacactgccggccccacacgcagtgaccggcactcacgggtaccatggacttgtttggaagcaaagagaataaaaaagatgagttgtatagtgtttaatgttccagaagaagagaaagagaagcttcttgtaacacccaaagtcttattttggaagactagtaaaattctcccaatatttttaagttaaaatatatttttcatcataattatcttacctttaaaactattcattctaaaacaatgttttctaattaaaaagaaaggttaataaaggaaggatttcagtaataatttgttcctttgacaaatcatatatttctagagttttctcttaggccccgtttgtttcgttggaattgaatttcattttaataattataatttagacaaaactaattaagtttatatanttatatgtgtaatatatttgtatattatcctaaatcatatgaagagatagttatatactacatttatgttatagtgaagcaagtagaagagtatgctataagttgtatatcagaaaaataatatgtaaatctatagaatcaattttcat

SEQ ID NO: 16409 - DNA, 1596 bp, Zea mays
ctcgaggccggccgggagcagcttttgcgccttgtcccctcctgctcgtcgcttccctcactctcacagccacgccacgccacgagagaagaatgccgccgacgctgggcctgctcctcgcggcggcggcggcggtcctgctgctgctgctgccgccgccaccatcgacgggggcgcaggagacgtgctggtcggggccggcgccgcggcgcggggcgtggatgtccgtggccagcttcggggcgcgcggggacgggcagacgctcaacacgggcgcgttcgcgcgcgccgtggcgcgcatcgcgcgtcgccggggcgcgcggggcggcacgctgctgtacgtgccgcccggggtgtggctcacgggccccttcaacctcacctcccacatgacgctcttcctcgcccgcggcgccatcgtccgcgccacccaggacacgtcgagctggccgctcatcgacccgctgccgtcgtacgggagagggcgcgagctgcctggcgggagatacatgagcttgatccacggccacggtctgcaggacgtcttcatcacaggtgagaacggcaccatcgacggccaaggcggcgtgtggtgggacatgtggaagaagcgcacgctgcccttcacgaggccgcacctgctggagctcatgtactccaccgacgtcgtcgtctccaacctcgtcttccaggactcgccgttctggaacatccacccggtttactgcagcaacgtagtgatagcaaacctgactgtgttggcgccgcacgactcccccaacaccgacgggatcgatctagattcaagcagcaacgtgtgcgtcgaggactgctacatctccgccggcgacgacctgatttccatcaagagcgggtgggacgagtacggcgtggccttcggccgcccaagctccggcatcacggtccggaggataaccgggtcgggcccgttcgccggcttcgcggtcgggagcgagacctcgggcggcgtggaggacgtcgtggccgagcacctgagcttctccggcgtgggcgtcggggtccacgtgaagaccaactcgggcaggggcggcttcatccggaacgtcaccgtctcccaggtgaccctggacggcgcccgctacggcctgaggatcgccggcgacgtcgggggccaccccggcgcgtcctacaacgcgagcctgctccccgtcgtcgacggcgtggcggtcaggaacgtctggggccggaacgtccggcaggccgggctcatacggggcatcagggactcggtcttcagtaacatttgcctctccaacgtgaagctctatggcattggcagcgactccatcgggccgtggagatgccgagccgtcagtggcagcgcactcgacgtgcaaccgtcgccatgtgcggagctggctagtacgtccgggacaggtttctgtacctgaatcagtttttccgcctcctatagcagcaataaagacgtcagcatttctcaaaaaacagcatcacctacaggctacagggccctttgtttctttggcaaactcttctgcgattcagctgtcactgttgaattctgctgttggcagaggataatctacttttacc

SEQ ID NO: 16410 - DNA, 5717 bp, Zea mays
  misc_feature (5692)..(5693): n is a, c, g, or t
  misc_feature (5701)..(5702): n is a, c, g, or t
gaatcgcctttgactaactcagaaggaaaagcaggctcttcaaagaacattgacagatttggcgtctgtcgttcctataggaatactcatgcttttgccagtgagtctttctatttctacttcttgaacaagtagaggcttattaggcccactttatcatttgatttaatctgtgtggagtaatccttttaaccttttgccttatccgcgtgtactgtgggctactaagagtcatttggtgtgttttttaacaaacacaggagagctgtgtgtcatttcattaaggagaaaaaataggtagggggacaagatttgtcaacccctattacaaggctaaaaggccaaatatccacaactagatagtccgcgccacacacgctataagaacgaccatattcccattggaacgaccacgctaagcccccaccgggagccggcgcaaaaagagcaggtcctgcagggctgaagcaccagccaagcaccacatgttatcctcctctaccactgctaacaagacacgttggatacaaggtgtagcgccctcaaacacacaagaattgcggttcttccagattacccaagccaccaaaataatcagggagtcaagtcctttcctcaaactcttctctacgtttttgatactttggcaccaccaagctgaaaaccgagtgcagccagactgtgtggcaatggcgagcaaacccagcttgttaaggatcaaactccaaacttgcctggcgaaaacacaagagacgaggatatgctggatggtctcctcagcctggtcacaaagagggcatgcagtaggatggggtagacatcttttggctaatctatcagctgtccaaaccctgtttttgatagccagccatacaaagaatttgcatcttaagggagcccacgacttccaaactcgccaccaagggccaaaaattgtggatccagtaaagaaagcttcatacgccgacttgcttgaataaacaccgtggctggagagacgccaggtatgctgatcggcggtatctggctgaagtttcacctcctgaaccatattccagagctgcaggactccaccaacacctgcacagacagggctcctttgatatctgaaacccacatgcgagctgtgagaccttgtactactgttctctgctttaaagcccttgtagagatcaatttgattaaagatggacaacattcagccacagttttaccctgtagccaacggtcggtccagaatttaacgttttccccattgcctaccactgacgcaacagccacgttgaagaaggccttcgcgttgcggggaacctggaccggaagacccgaccacggtcttgaagaatccgtttttgcagtcatagccaacggatacgtaatgcccagctcatcaacttgagattgagaatgcccgaaccgccatactgcaaaggatgatgtacagtatcccacgataccaagcaatttccctccattagcattaccgtgccctttccaaaggaacccccttcttctcttatcaatcgccttgatgacccattttggcagatcaagcgcaagcattagataaatagggacagaagatagtaccgacttaaccaacaccagacgcctagcgatctggcaaatgttgcaccaggtacgaccaaaacccaaatgttgcagtatatcaataaaaaaggaccaggaaaccgaatcaaaggctttggatatgtctaacttcaaaaggatgtgaggttctttcttgctgtgtagcgatctgtcaatttgctgaaccatcagaaaattgtcctggatactcctccctttgacaaaggcactctggttgatggaaaccatgcttggaaagagcggagctagccgggttgctagtattttggacactaatttagcaaaactgtgaataaggcttatcggcctataatccttaactagcagggcatccaccttctttggcaggagagtgatgaaagctgtgtttaggagcttgaatttggagacatgccctctctgtataacaaggagtgcagccatcatgtcctccttgatgatgtccagcctatgcaaccatcaggcccgggggccttatccataggttaatcttttacaaccgaccacacttcatccataaaaaaagatgcttcaagattgttaagatcatgctgctggatgcccaggttatgaaaatccaaagtgaagtccctctgcactgctgtaccgatcagattatcatagaaatccagagctgcttgctgcttatcatcttgtgatgtggcaatttggtcaccgacctgaaatttagcaataatttttttttcttgcggtagggagcttgctggtgaaagaaggaagtgtttgcaccccccccccctctcacagatatagaatgcgggagcgtagccttgcaacagtgcgctccaagagatgcaagacctagggaatgctgtttcagcttttgcctaagccattcctctcccggagagagccctctgacatatctagcaatctcaagacggtgaaggatttccttggccatatcaagttgcaatctgatgttacccaccttgcgttggctccatctctgcaaccccttgctcagtctttgcagctttaggaagacacactcaacaggggaggaagtagatacatgagcattccaattgtcagtgacagcatccaagaaaccaggtcgtttgggccaaaaactttcgaagtgaaaccgcctcttcttctgaatttgggctgagtctgaggataagaggacaatggtcagaaaaccccgaggaggcactctgcaagagtgaatcagaatagatgtcctcccactcagagcagcacaaaactctgtcaagccgcacaagagtaggggatgacctctcattggaccatgtatacttacgaccatgtagaggaacttctgtaatattggtatcatcacgaaaacttcgaaatctgcccagcaacgctctgttcatgttggaattattcttgtcggctgcttggtaaatcatgttaaagtccccagccaacacccacggtccactgcatagcgctctgatatctttgagttcctgcaggcatgcgattttattctaatcttcctgtggtccatagacaccagtgaagcaccaattcacaccatccagcccaacgaactgaactgaggctgagaaaatatcaatgcgagaagagatggcctgacacacagctcccttccacgcaatcaagatgccaccacaggtaccatttgcagggagggtcaagcacttgtcaaattctgtcccgcaagctgagagcaacagataggcggagaacgcctccactttagtttcttgaagacaaacaatgtcggctttggaagaaagaattgtatctcttacataatcacacctggccttattattaaggccacggacattccaaatcaggatgcttgacaaattcattgtaaacaaaataaacacgaccaggtatcaaggaattagagaccgaccaggatctccggtcctctgaactcctcgctgcaatccacctgccagcagaagatgactgcgagagcagcgagatgagcatcagcaagtggtccatcgaacagcttgctgtaggcgtcttgtgctttttggtcgatggcttcattgtcggtggcgactcccagacacctgattacccttctttgtgcttcagaggtgattggtccctgccatggaaaagtattttgttgtgtccaagattatacacatatatatatatgtgtccagcaattaattaggacgactaggagacgacctgatcggtcctctgggacgactaggtggttgcctgacttgaaatcagtggtccaagagtgatgtcaatcacgtactctgacctgtgaatctatctactgtaaagtgtatttactgttggagcattgtgacaattgcctttctgtcccagcttaccgccgttggtcatgctgctattttggctttcatccagagatatgtgccatcgatggtatgcattttacattcacacgctactcaccccctgttgccattataattcctatttgtctatttgcaatcgtgtagatcccgtccacatatgcccccggtaggttggatctccttaggcagattgagaaggttaaggaaatggaagttgctgaaggcagcagtgaagatatattggaggaactgaacaaatgaaataagctgggcatgtacagatggacatgattatactgcttagcttacggtctttcctgtaaagtgtaagtaacaaattcacccctggtcttctaattttgttttcttctaattgtttggttactctcttcacaatcatgtttgttgtttttttttttttggtagtgttttggaacaagacatttgagggggtttgttttatctaaagattctttgaatggcatacccgctggaaacagaagtgcaaggccctaggaataagtaaccaatcattgtgtcgacaaatgttccacgtctgcaggctgctgtatacataaaacatactccacattatacattacatgggcggctcacggtgcccttcaacatagtagaggatgaatgtccaagttcctcctggacagtgttctgtgtagggtagtggttttgatagaggattgtatatctagttggtatgttggtgatcacctttgttttgttttttaggaaccaagcctactacatgcattattgtctgtacccaaatgccaagttcagtgatctcctacgggattgagtggtgcgggcattttctaataataagccaagcccgtgagcaagatgtaggcgtgaacggcccccgtcaggtctgaattcgcttctggtttggccgtcgaatgcttccacacgcaccctgtaaactacatgcacgtagcctaatggctatgcaacgctggatatatttgtgtgcaccgctggatgaggattcgacgagtaagatcgtctctaggtccaccggcactgcctcatcaatttatttatttatatttatttattgctgccgcgtccaccgtccgtccccaaaccctaccgcagtcgccgccaccgtctcccctcctgatccaatccaatggcgcgcctccacctcgtggccgtggcaatgggcttgctcttggccttgacgacggcgcaggcaccgggcgcgtccacgatgcccgcgcccatggcgcagcctccggcgacctcggcgcctcctcgtcccgcgccatccccgacccagaagaccgctccagctccggcgcccaatgccacggtacccgcccccgcctcgccgccggcgccgagctctatcgggcagacgccgaccgaggcgccgtcctcccctccgccgcccagcgccgcgtccagcgttgcctccgccttgtacgtggccgccgctatggcggctgtcgtgtttttcttctgaggtcggtactcggcgccgatggatccgccgcctatggtatggtacggtgcggtgtggatttgacacgatggctcccgctaccgctggtcgagtttgcttattaggatactagtagttaattaatagttgggttgatcagatcagatctagcgtttttgttgagtggggatattatttcttctacggatctgcacactagggttatgtcactaaaaaaaaaaaaaaaattagggaaggtgcaaacttctaatttgaatcacatgatgttgatccaaannaaaaaaannaaaaaaaaataaaaa

SEQ ID NO: 16411 - DNA, 2445 bp, Zea mays
gatacgccgtctgctattttcaagtttatgataataattgcctctaaaattgatgctatcttcagccgttgttgaagtgttgacatcggttttaatcattgcagtcgcttgaaaatgttgaagaagctctggttaagttagaaaatcattgggtacctcgaggccggccgggttgcctccagaattacatgtttccagttcgcactctggtaaggaggatctgaaggctgcatgctctgatcttgaaatgataagaagactgaagaaagaagctgagcttcttgaggcatcctttctagcaaaagcagaatatctggaggtgagccgttgcaagtagcggatcactatctcctgcagaggaaggacctgtaaagacaagtagcaggacgaacgatacatcagcaccacaaaaaacaggaagcagggtggataataaacgtcgcccattttgggacttctttggtcggtctttgaaagttgatccagctcttgcagatcaggatctgatcactgtcgccaatgtggagaaggaaggcatggagtcaaatgacatcctccgcttcgaacagttaagacgtgagctgattgagttagaaaagagagtgcagaagagtgcggatgaagctcaaaaggaggaggagatggttgtcgcagaaaaaacaactgcaccatcgcctggctcatcagtttcttctcgtcagactaccaagaaagaaaatgtcataactaaatcagtggagaaggtcaaagagactacaacgactgtgttgcaggggacacaactattagcaattgatacaggagctgctatgggtttgctaaaaagagctcttattggggatgaactaactcagaaggaaaagcaggctcttcaaagaacattgacagatttggcgtctgtcgttcctataggaatactcatgcttttgccacttaccgccgttggtcatgctgctattttaattcctatttgtctatttgcaatcgtgtagatcccgtccacatatgcccccggtaggttggatctccttaggcagattgagaaggttaaggaaatggaagttgctgaaggcagcagtgaagatatattggaggaactgaacaaatgaaataagctgggcatgtacagatggacatgattatactgcttagcttacggtctttcctgtaaagttgttttggaacaagacatttgagggggtttgttttatctaaagattctttgaatggcatacccgctggaaacagaagtgcaaggccctaggaataagtaaccaatcattgtgtcgacaaatgttccacgtctgcaggctgctgtatacataacatactccacattatacattacatgggcggctcacggtgcccttcaacatagtagaggatgaatgtccaagttcctcctggacagtgttctgtgtagggtagtggttttgatagaggattgtatatctagttggtatgttggtgatcacctttgttttgttttttaggaaccaagcctactacatgcattattgtctgtacccaaatgccaagttcagtgatctcctacgggattgagtggtgcgggcattttctaataataagccaagcccgtgagcaagaaaaaaaaaaaaacagtgttcgtcacgcctgaaggcgcttctggtttggccgtcgaatgcttccacacgcaccctgtaaactacatgcacgtagcctaatggctatgcaccgctggatgaggattcgacgagtaagatcgtctctcggtccaccggcactgcctcatcaatttatttatttatatttatttattgctgccgcgtccaccgtccgtccccaaaccctaccgcagtcgccgccaccgtctcccctcctgatccaatccaatggcgcgcctccacctcgtagccgtggcaatgggcttgctcttggccttgacgacggcgcaggcaccgggcgcgtccacgatgcccgcgcccatggcgcagcctccggcgacctcggcgcctcctcgtcccgcgccatccccgacccagaagaccgctccagctccggcgcccaatgccacggtacccgcccccgcctcgccgccggcgccgagctctatcgggcagacgccgaccgaggcgccgtcctcccctccgccgcccagcgccgcgtccagcgttgcctccgccttgtacgtggccgccgctatggcggctgtcgtgtttttcttctgaggtcggtactcggcgccgatggatccgccgcctatggtatggtacggtgcggtgtggatttgacacgatggctcccgctaccgctggtcgagtttgcttattaggatactagtagttaattaatagttgggttgatcagatcagatctagcgtttttgttgagtggggatattatttcttctacggatctgcacactagggttatgtcactatggttgccattgttattagggaa

SEQ ID NO: 16412 - DNA, 2217 bp, Zea mays
agtcttaaaggtgttgatcatcacgtgggaaatcatttggagttaactttctttgtaaaaaaaggttttcgatattctcctaaccaagggttgtgtctttggatttgaattctggattagtcccttgtgttctgtatcaattattaaagtggctatcgtagccctttaaataaaatttccgaaatgtctaatatcatcgaagtcagagtttggatgaagaagttatgaacatttttagttgagccggtgtgtcttgctcagtaataagcatatgctaaaagcaagagaagagtacatcgcaaagaaattctatgcagagccgctatcagattcaccagcaccagcttttttcttggcaaagtactcttctgctcgggcttggttctttagataattttgtggaagccatttctttcgtttaggtaacagagttagggaacaaccagctgcctcaagcttctctttagctgaagctgaaaacgctccagccttgatattcaacttaactgatacatccccatctcctaagatctacaaacaggtgaacaacaagtgatcatgaaggtaagacaaaatatgattgcaaaaactaacaggtggcacatgccacttcatgtttatgttagcagatatggaagtttgtagttactctagaatatattgtaaatccaatgaacaacctatgggaacattgccaaattgtacaaacaaagctattcaacacttcaagtggtgctcatctaacagaaacaaccaaaaaaactcgatcccgtattgcatgttctaatagatgactctaactcaagtggataaacttggtacctaacattatcacaggctaattcagaatcgatacaacaacctataagaagtaaaaaagtaagaatactggccactcaatctaacgacaaatcactaaacacttcgattcttgcttcaaatctggggtacaataaggttgccttaaagagaacatgtcctcactggccaagacctaagccaaacccttgaatatgaagtcattcatattttcgaacgtgtcaagttctatgtcacaaataccagtccacaaaacaagttttattgaaacaaaccaaaaggttaatcatcaaaagatttaccttcagcggcagcttcctttccctgcctgatggattgatcagaccccgtgatttcaggctttccagtgatatttcgtcaccatctttgaatccgccgcgcactatgtcttttaaattgaatggcacatacttcggcaggccaatgtgcatccctgaaaagccatggtggaactcacatcaggcaacttctcaatcacttgcatttctgcattccttgtaaccttgatgggctctcacgagtaacaacacaatgcatagttcaattagttatgcgccagcctggtgtgaatttaatcacggatgggcaatgccgaagtgggggtgtgagacaagcatctgtctgaactagagcttagcgagttgcttcgattgagtgcattaggggaagcttcggtttaactgaagcaactcaccgccggcaatgccccgtagcttggggagacggcggtagagcggcatctgccctccctcgaacccgcgccggacgccgggccccgagcgcgatttctgcccgcgcataccgaacccgcagctcgcgccctggcctgcagcaataccgcgtcccttacgcttgggccgccggcgggaccccttctggggccccaaattgtcgagccggaacttctccactggcgctgcggcgtccgaggcctcggctgccgccgcggcgctgctgcagacgacggtgacgcgacggggcgggagcgcgcggagcgggagggcgcggggcgcggcccagcggccggctaggattccgggaccaacgacggaggaggaggtgaaagccgggatgtggaggaagatggcggtgggagcgagggagaggagggtgatggaagccatgactgccgttggaagggcttgcgaattgcgattgtggatagaagcggataattggggtttgggaacgagataagatggagacgatgggcctcttccactctttatttgggcctgtttttcaaacagccgtggcccattcatgtcaataataataatatactcgaaagttgtatataaagaagaaaaaatcggtatttttctgaatagaagatagaactatatcaaaactttgatacattatattctctaacgc

SEQ ID NO: 16413 - DNA, 1095 bp, Zea mays
ccataatttttttattttattttttttttttttttttttttttttattaaagtggctatcgtagccctttaaataaaatttccgaaatgtctaatatcatcgaagtcagagtttggatgaagaagttatgaacatttttagttgagccggtgtgtcttgctcagtaataagcatatgctaaaagcaagagaagagtacatcgcaaagaaattctatgcagagccgctatcagattcaccagcaccagcttttttcttggcaaagtactcttctgctcgggcttggttctttagataattttgtggaagccatttctttcgtttaggtaacagagttagggaacaaccagctgcctcaagcttctctttagctgaagctgaaaacgctccagccttgatattcaacttaactgatacatccccatctcctaagatcttcagcggcagcttcctttccctgcctgatggattgatcagaccccgtgatttcaggctttccagtgatatttcgtcaccatctttgaatccgccgcgcactatgtcttttaaattgaatggcacatacttcggcaggccaatgtgcatcccgccggcaatgccccgtagcttggggagacggcggtagagcggcatctgccctccctcgaacccgcgccggacgccgggccccgagcgcgatttctgcccgcgcataccgaacccgcagctcgcgccctggcctgcagcaataccgcgtcccttacgcttgggccgccggcgggaccccttctggggccccaaattgtcgagccggaacttctccactggcgctgcggcgtccgaggcctcggctgccgccgcggcgctgctgcagacgacggtgacgcgacggggcgggagcgcgcggagcgggagggcgcggggcgcggcccagcggccggctaggattccgggaccaacgacggaggaggaggtgaaagccgggatgtggaggaagatggcggtgggagcgagggagaggagggtgatggaagccatgactgccgttggaagggcttgcgaattgcgattgtggatcgcagcggcgcccgggggcccgggaacgagatcccggcgg

SEQ ID NO: 16414 - DNA, 2802 bp, Zea mays
ggccgccccccctttttttttttttttttcaatgatcaaataccaacggtattctatatattattgtacttatactatatgcgttggctatatccatagtaataaaggataataataatatccatccgtatacatatatatgcatacgatgatgatgcctgcatctgcatgacggcgacgtcatcaggcggccggcttctggcggtggaaccacagcctcgtctcccggatgaacctctccgccttctcgttgatgtcgtcttccgcccctcgtgaagcacggccgccgtagatggcgggcctgttgatcaggctgtggaactcgatcttgctcaccttctgcaccggcacctccccgacacctgcagcaccggcgccggcgccgctgcgggcggccggggcagggttcttgctcttgccccagcgattcatctctgattgtccggctcttgagctagatgggcggcgacgatgatgcgattattatactggcaacggggatagatagatagatcccggccgccgccggcccgtttatataggctaggcatatgaaaaggcagacacagctagcgatactctattattgagttgggcgatgctatagccatagcctgctgcacagttcttggacgacgacgcacatgttaattctcacttctcagttctcaccaggtctcggtcgtctctgcggacgattgtgtgtcttcggataagccaggcatagccatcagtggcaagcaaagcatacataggtggcagctttgtttttgtggagtcgtcgccgtctctcagatgatggcatggcatgcaagggattgggattccatacatgcatgcgatgcgaatgcgatcgagcagcaaggctacgctaccaaaccacgacaaccctggcgctgccacttgctaggcaggcagcagagcgcccaggcgtgttgcgcgttgcgcactagcgaggaggataaatatctccgttgcaccacactgtttatgactttatgagctaaagattcaaataggaaggtaacgactgttatgcaagcagtccttctgtgcaagcatgtaagcaaaccatttgatacattagatcgtgatccaaccgtatgtcacatttaacacttaaatccttccaccaccagctcaataatctttataaaaaaaacccctaagaaaccatgaatgtatttgtggttggatcacgatctaatggatcagatgatttgcttgcacgtttacacagaaggactatttgcataacagttgttgccgttgtttttagggattaatttttagtcactctattttattctatttcaatcctctaaattgttaaatatggagaccataactctattttaattttcgtatttaacaatttaaaaaactaaaataaaataaaatagatcaaacaacaccttactatggcagcatgagaaagagataaaaaagatgacgaaaaacgtctgcacagaaaaagagatggggcaaggtcaaggaagcaaatatgcagggatcattgtcactgccacatgcacctccgtggcaagtgtcctttggctttggcatcaatcaaatagacaagaggccacctctaccaccgccatccgcagtccatacagtgacccccacgaggtcaagaacctgtacgaggagaggaaagaacctggaagagaggagcttgaggagatggcgagcgccgagggcgagaggtgggtgggactggcgacggacttctcgcaggggagccgagaggcgctgcagtgggcggcgaccaacctgctccgcgccggcgaccacctgctgctgctgcacgtcatcaaggagcccgactacgagcagagcgaggccatcctctgggaatccaccggctccccgttgattcccctctcggagttctctgaccctattatcgcgaagaaatatggagcaaaacccgacatggaaaccttggacctcctgaacactacagctacccagaaggaaattatggtggttgtgaaagtcctgtggggagatccgcgtgagaagctctgtcaagttatccatgacaccccgttgagctgcttggttataggaagcaggggccttggcaaactcaagagggtgctcttaggaagtgtcagcgattacgtcgtgaacaacgcaacctgccctgtcaccgttgtcaagtcatcaagcaccgaaggttgatctcatcaccgaaatgcctgaatattgctgttgttataataaaagatggttggcctcatgaagaacatgcactagtttctagctacctgaaacatgttgaaccgggcaatcctattgtaataatagacaaagtgccttatgaagggcatggttatgtaataggtctgttctccagagtagatgtgccatgcttttgtgtcatcaccgaaagtgccttatgagtgatccttggcctattattcttctgctgcgctacagtgatgtctatgcttgtacttgaaagaatttccgtttgatctattttgactatgaaaatcgaaggaccgcatatttcatataggagatacatgaacatgctcagaggaagagttgatattatgacagatgcaaattcatccacaaaccagatgaacacgccatgcttgaggatcctgtccacgtggccaaccatgacctcacccttcaccggcttctgtgtgatgcaggtaaacgagactgggaacatgacatctccagttagttcacgcacttttccttcagatatcgccttcagctgattaacggcaacatagtagccatgctctttggaagccctcctgttcgtgacatcct

SEQ ID NO: 16415 - DNA, 1921 bp, Zea mays
cgacctgcagatcgatccatatatggtggaactgcatgctctgatctctctgcgtggatatatatagagaaatctggtatctaattttacactttgaactcgtaaatctctatcaaacggaccctaattaatttaggtagctctagctataaccaccttcgtgtccatataaaaatacgcgaaaaataagctttgcatcctaacaactagctagctagctaggcatgtcgtgtcctgctccttcgtttgtttgtttcctgatgaatagtggcttgtaatttaacagccgttgagtccagatctgccgcggacactggtttatgtaggcattcaattgcaatacattactatctggttcatgtgtccatggttgtcatgtcataataatctttgcttcaataagcacgtacgacaatcacacagtcaaacctcatcgactgactttctctgtgatgaaatgcaatgcagttagagattacctgccgagggcagcgcctccaaccgacgatgaccctgcagatgagcattgacaaaatttgagcagctagcggccgtcgttttcaaacgaagcgtgatgctcttgccctctgtgtctatatataatctatcttgttataatatagtattccacccgttcataaatatatgatatcgttaattttttaaaatattttcaccactcgtcttattaaaaataatttattatttattttcttgtgatttgttttataacttaagatagtttgtgtttaatttaaaatattatatatttttaataaatattttgaataagataataggttaaaattttcgaaaaaaggtattatatatttataaaatgaggtagtactagttgagatgacaacatgaaaaagaggtcaaatgacaagctggtaacgaaaaacgtctggttttgtcagaagaagaggagccgcccgagcctcccccaagcgccgaaaccgtcgtggtacaatctgtgacaagtgtcctttggcttggcatccataggccaccgccatcagcagtccaatacagtgacctgacctccacgcgaagccaccaccacaactccacaagatctagaacctaagaacctgcagaggagaggaagaggagcttggggaggagatggccggcgccgagggcgagaggtgggtggggctagcaacggacttctcggaggggagccgggcggcgctgcggtgggcggcggccaacctgctgcgagccggcgaccacctgctgctgctgcacgtcatcaaggagcccgactacgagcagagcgaggccatcctctgggaatccaccggctccccgttgattcccctctcggaattctctgaccctatcattgcgaagaaatatggagcaaagccggacatagaaaccttggacatcctgaacactacagctacccagaaggatatcgtggtggttgtgaaagtcctgtggggtgatccgcgtgagaagctctgtcaagttatccatgataccccgctgagctgcttggttataggaagcaggggccttggcaagctcaagagggtgctcttgggaagtgtcagcgactatgttgtgaacaatgcaacctgccctgtcaccgtcgtcaagtcaacaagcaccgaaggttgatcttatcgccgagatgcctggatgtgatgttgtaataaagatggttggcctgatgaagaacatgcactagtttctagctatttgaaacatgttgaacgaggcaattctaatgtaataataatagacaaagtgccttatgaaggacatggttgacatgcctttgttgctgtatgagtgatgtttatagttttgagggtttgaagatgtggatcatttgcctattaaaaaaaaaaaaaacagtatgagcgatgtttatcacacgcaatgccaataaagaacactacagata

SEQ ID NO: 16416 - DNA, 2893 bp, Zea mays
ttgggacctcgaggcgccgcgaggccggccgctgttcccgtcgaccggattcggttcggaccgcagctccccacactcgtccgtccgcccgtcgaatggcggctcccaaaccctaagccacagatcccttcccctgcctcagcttcgaacgccctcgcctcgccgccggtctttgtgtactgccgctgtgtccgtcggcgcggatcaagggtccgctccgctgcaccccgcggggagaaaggggcgggcctcggcgtcctccgctcgtcgcccgagtgtctgagtactatcaggtgcaagtccagccgaactgattgcatgacatatgaaatagcgagcgtcgaatgaccttctctatggatatggatttgaacgcatcaccggtgcctgacgatgatgagcagcagccttacaatgaaccagtggaggctgagtatgctcaggaggaacatgttgaatctgctgtcgcaacattgcgccgggaacgtgaagaaagacgcaagagactaaagagagagcagcaggatgatgggtcaaggctacattcccagcagattagggttgattatgctcctcaacccaaaaggcatagtcgcatcaaagaggcacctcagggctggttggactgtcctgcatttggggagccaatagataaaatcataccatctaaagttcctctcgatgaaacattcaatgagtcagtgcctcctgggaagcgatactcctcaaagcaactagttaacaaacaaagaaaagctggtcgtgaaataggtctggtgattgatttgacaaataccaccaggtattattcaccagctgaatggacgaagcaaggtactaagtatgcgaagattgcatgcaaggggagagatgcggtacctgacaatgaatctgttaataagtttgtctatgaggcaatgatattccttgatcgacaaaaacattcaaagaatcctaaatatattctggttcactgtacccatggtcataatcgtaccggtttcatgattattcattaccttatgcgcacacacgtatcttgtgttgctgaggcgataaatatgtttgctcaaaggcggccacctggcatatacaagagggactatattgaagcactatattcattttaccatgaggtccctgagaatatgatgatagcatgccctccaacaccagaatggaagagaccagatgatctcgatttaaatggcgaagctaagcaggatgatgacgacgacaatggtgatccagaaccaccgcgtaatgaatcagaggataaaatcatcaccaacgacgatgtgttaggggacgaagtgccatatgaccagcaagaagctttgcgtgtgctatgttataagttgcttgaaatgccccttataaggggacattcacaatttcctggatcacatccagtttctcttaacagtgaaaatctgcaactacttagacagcgatactactatgctacatggaaagctgacggaacacgatatatgatgcttataatgagagatggttgtttcttgattgatcgaaatttttgctttagaagggttcagatgcgctttccccataagagccttgaaggtctgcatgatatgaccttgattgatggagagatgattatagacacggtaccagattcaggcttgaagagaaggtacttggcatatgatcttatggcacttggtgcagtgtccaaaactaagttgccgttttctgaaaggtggaaaatgctggaagatgaaataatacgaccacgttattatgagaaaaataaatttgagagtggttctaagagcaatccgttgtacaaatatgacatggaattattttcggttagaagaaaagatttttggctgctctcaacagtaaaaaaggttcttaaggtgttcattccatccctttgccatgatgctgatggccttatatttcagggctgggacgatccatatgtaactcgtactcatgaaggtctcctgaagtggaaataccctgagatgaattctgtggactttctgttcgagcttacgaatgataatcgtcaactggttttcctttatgagagaggaaaaaagaaactcatggatggtgcccggatagcatttactgacgatgtagatccatcctctatcgccgggaggattgttgaatgctcctggaataaggaagaacagtgttggtcctgtatgcgtattagatctgataaatctactccaaacgacatcaacacataccggaaggtgatgaggagtatcacagataacattaccgaggaaaagcttctcgaagagattgatgagataagtcttctcccgatgtatgctgataggatgcagcaggctcatacaaagatggcacaacaacagcggcggagattgccaccacagtgctagccagtgctggggcgctctcctaccgccctagccagctgctggcttccgtagctgtgtaattagtagaggtttcagtagccccatatgatgatggctggctgggtctggcctgccaactaattctttgcacctcatttgtgtcttctccctgccctcccacccacctgtataggcgtcgccgcagagtagtttccctgtaaattgtgtactctatgttctcccatattctcccctatggttttatttttcatgggtgtagaatagcgtttaacaagagggtggtcttctaggtacattagtgtacgcgttactatctctcggtgttgcggttgccttgtgctagaataaatatggttaccatctgttgctgatgggtcatgtggttcccccggcggatatcatgtggttgcgtggtatgggttattttcgtcttctgttttgttcgcacctgatccgatccgatcttttgttcaatgaagaagaaaaaaattattggt

SEQ ID NO: 16417 - DNA, 1912 bp, Zea mays
gccggccgggtctcggcccgactggagactgctgttcccctcgaccctcgtccgtccgtccgtccgtcacctgacggctcccaaaccctaccccgcagatccctccccttcctctacccccgcctcgccgccggtcttcgtcacccgtcgccgtgcccgtcggcgcggtgttaagggtccgctacgctgcacctcgcggggagaaaggggtgggcctcggggacctccgccctccgcgcaaggtcattgaatgaccttctatacgaatatggatttgaatgcatcaccggtgcctgacgatgatgagcaacagccttatgatgattcagttgaggttgggtatgctcagacggaacatgttgaatctgctgttgcaacattgcgccgggagcgtgaagagagacgcaagagactaaagagagagcagcaggatgatgggtcaaggctacattcccagcagattaggaatgattatgctcctcaacccaaaagacatagtcgcattaaagaggcacctcagggctggctggactgccctgcatttggggaaccaatagataaaatcataccatctaaagttcctcttgacgaaacattcaatgagtcagtgcctcctgggaagcggtactcctcaaagcaactagttaacaaacaaagaaaagctggccgcgaaataggtctggtgattgatttgacaaataccacccgatattattcaccagcagaatggacgaagcaaggtactaagtatgcgaagattgcatgcaaggggagagatgctgtacctgacaatgaatctgttaataagtttgtctatgaggcaatgatgttccttgatcgacaaaaacaatcaaagaatcctaaatatattctggttcactgtacccatggtcataatcgtacaggtttcatgattattcattaccttatgcgcacacacgtctcttgtgttgctgaggcgattagtatatttgctcaaaggcggccacctggcatatacaagagggactatattgaagcattgtattcattttaccatgaggttcctgacaatatgatgatagcatgccctccaacaccagaatggaagagaccagatgatctcgatttaaatggcgaagctaagcaggatgacgatgatgacaatggtgatcctggaccactgcataatgaatcagaggataaagtcatcaccaatgacgatgtgttaggggatgaagtgccatatgaccagcaagaagctttgcgtgtcctatgttatcggttgcttgaaatgcctcttggaagggggcatgcacactttcctggatcacatccagtttctcttaacagtgaaaatctgcaactacttagacagcgatactactatgctacatggaaagctgacggaacacgttatatgatgcttataatgagacatggttgtttcttgattgatcggaattttagctttagaagggttcagatgcgctttccccataggagcctccaaggtctgcaagatatgaccttgattgatggagagatgattatagacacagtaccagattcaggcttgaagagacggtacttggcatatgatcttatggcgcttggctcagtgtccaaaactaggttgccattttctgaaaggtggaaaatgctggaagatgaaataatacagccgcgtaataatgagaaaggccttgagcgtggtgctaagagcaatccgttgtacaaatatgacatggaactattttcggttaggagaaaggctttttgggtgctattaacagtaaaaaaggttcttaaggtgtttattccatcgctttgccatgatgctgatggccttatatttcagggctgggatgatccatatgtaactcgtactcatgaaagtcttctaaagtggaaataccctgagatgaattct

SEQ ID NO: 16418 - DNA, 2643 bp, Zea mays
ctagaacatcctgatcgaaaaacagtcaaaagctccccattcctcttccccttctcacccggcactcgaactctgcggccctgcaaaccctagctttcgctccatggccgacggcgatccggagccggcgccagcgccggcaccggcactggctaacgagaagctccatgtccgggcggcggcctacgtggatgagacgcgcccgccgccaccgctggagccctccgggggtccggacgaggagaagcgcccgcccgaagaggtagaagcggaggtggagatgcacccgccgcgggaaccaaccggggagccgcccgttgatcgcccgggggtggaggtggtggcggacatgaaggcgaacgaagtggagaaggaaaggggggatcgggcaaaggagaagcgggagaaggataaagggaaggggaaggaggagaaagagaaggtggacgaagaggcgaaggggaaagtgactgcggtgatgaaggtggatgggacggagaaggaggtcaagccgacccggcggccagctggggccagcgcggagacgcccatcctagcggtgccggtggtggccgtgccttgcttcatcgcgcctccagggtttgcgggccagtttgcaatgactcatcaagcagctttggcaagtgttacagcacaggcacaaatgcacttgcagtcaccaactccatctgcatgttcggaagtgccatcaagtccattttatatgacaccaagatctctagtgccattgcagcattcaccatcagtaactgaaggaaatatttgtacaccaattgctgacaagtcattttcatctgattcaaaatcacaccatgttgtaaatatggtagctgatggcttcaactggaggaaatatggtcagaagcaggtgaagagtagtgataattccaggagctactatagatgcacaaactctggttgtctcgctaaaaagaaggttgagcatttccctgatggccgcgttgtggaaatcatttacagaggagcccataatcatgaaccaccacagaagaccagatttgcaaaggaaagagtgactcctattagtgttccctctggaggcgaaaccttgaggcttgtgaacacagaaattgtagaatctagcacgcctacctgtgaattggaacggagtgccatctcagaaacttctgagcagcatctcttttgctcaagtgactgcgaaggggatgctggtaacaaatctgaagatgaacatcctagcgcggaagccctgccaaagcgaagaacacttgaggctacagcaccaaatttaacgccggttcgcagaactgttagagagcaaaagattattgtgcaggctggaaagatgagtgatggatacagatggcgtaagtatggacagaaaattgtgaagggaaatccaaaccccaggagttattaccgctgcacgcacggtggatgccctgtccgtaagcatgtggagaaggcgccagatgatgttaacaatattgttgtaacgtatgaaggcaaacacaaccacgacgaacctttcagaagcagcagcataccagtttctgtaatcagtccatcagcgacagccactgagcaacccaacacatcaagtacgtcagatgagagacctccaaccattacccagaaggacgccaacagtgagtctgataaggagacaaccttgaaatttggaggcgagaaggcactcgaatctgcgcaaacgctgctcagcatcaaaactaactccgatgacatgaagaactctgtcctgaaggaaacttctgctgcagttccagtccaaaacaattgagcatgctgagatagggtgattctattgacatctcttaggctgtcatatttattggttgagtgatatgctattatgttaacttgtatgacgtgaggcttggtgttcggtattccgtgtggagcatttgaggaagcattaggtttcaggaagccacgactggttgtttctgcctgtatagattcccattccctagtgtgtacaggtactgtattttatctgaggccagataacatgtgtggggtggttcttgagaacctgtgtgtgctgtattgttctagctcgatctattgcaatagctgatacgagattgtcatttatttatcggtataacacatcgtgcgtgccgtttgcagtttgtgatagcctgcaccattacattctctggtactgtgtacaaacaaagcgatggaatgatgctgggagctgctacttctgtgccaatgcgaagctgggagcgggctccaggtccttcaccgcattcttcacggcgttgatgtcgatgtcgatcagcttccccgtcatcgacgagatgacggtgcagctgctcttgtcctccacgtacggcaggaacagccgtgccttctctgccgacgagaacaaggccacactggcaaaagaaggaataaacgttgcagaacccaaggcatggcatatatatatagcacgagcacgggttcacttaccatggcttgtcgcgggcgttggcgagctgcacggcagcggtgtttgtcgcgacgacgccggcagagtcgttgatgaggcaggtgagcttgggagtcggtcagaaaatggcatggtaagccatctttcagattcagaggtaccatttccattctgca

SEQ ID NO: 16419 - DNA, 2026 bp, Zea mays
taccattggccgctgcgccgccatggccgtgtcgccggaccagcagcagccacctgcaggggtagggtctcccttgccgtctcctcgcctccgcgtccgcgtccgcgacaccaccctcgtgccgccgtctccgtcaccaccggagacctcgctcccgctcaccttcttggacatcttctggctgcactccccgcccgtcgagcgcctcttcatctaccgcctcgcccccgacgctgacgtcgacgccatcatctccagactccgggactccttgcaccaggccgtccgcgccttctaccctctcgccggccgcctccgcctcacccccggcacgtccgaccgctacgagctgcactaccgcccgggtgacgccgtcaccttcaccgtcgccgagtgcgacgacgatgacgcggacgcgcacttcgacgccctcgccaccgacgagccccgcgaggttgccaagatcgccacgctcgtgccgccgctgccggagcgcggcgggctgttcgccgtccaggccacgctccttcccgcgcgccgcggcctctccatcggcgtcaccgtgcaccacgccgcctgcgacggctcgggctccacgcatttcctgcacaccttgggcggtcgcctgcagagccggcgcagaagcgccgccgccgccgccccctgtcatcgaccggtcactcatcgccgacccaaggcgcatgtacgacgtcttcatccaaggagcgccgagcactgaagagtacgagttcgtcaagatgtccgccgaccagctcttcgctacgttcgcgctgtccaaggacgaactgaagcgcatcaaggacgctgtggccgagagaggctgcgagggcgcggcgtcccgcccccccggtgctcctctctagttgccaccttcggcttcgtctggtcgtgctaccagcaagccaaggaggccagcagcggcgccggagagttccctatgaccggcatggcctttcccgtcgaccaccgctcgcggatggagcctccccctgccggacaagtacctcggcaactgcgtgggcccagcgttcgcgctggcaccaacaggcgagctggcccaggccggcgcaggcgggttctttagcgcgtgcgccgccgtcgcctcctccatcgacgaagctgtacgcgacatcgagacatcaaacgtggaggtgtggtttgaccgcatcagggatttaatcccgatgggttttctgaccgtggccggttcgccgaggttccgcgtctacgatatggacttcggattcggccggccggcgaaggtggatgtcgtgtccgtggcgaggaccggcgcagtggcggtggcggagagtcgggatggtaacggcgggatagaggttggggtctctctacagccggctgccatgaagaggtacaggaagtgcttcgcggatgctatcgcgtggctccaccagaggacatgagagcgacaactcgatctaatcaaatatggagagacgggtcttttacggagtctatcatgtgatgaaaaatcaacttgcactttcttccttttaaattatactaccatattctagcttttcaactagataaaccttttctattcgtttagatatgcacactatctagatatgttataaaacacgattatgcatttaaaattatttaaaaagcttacactttaatatagtgagaggaataaggggttttgtttgttgcctcacatgtcacaattagtcacgtctaaagttacgtaagtttgactaagttaagcatatatttgatttcgagccacagctgtggtaagatttttctcctcttacacatgtcttacttgtgtggaaaaattcctttagacgtggcaaactgtggcgcagaatttgaccgtctaaccttagacaccttatgcaagtacggtataaaaatatgtgataatttttggtaacatgtatagaaccaaacatgccttaaaatttccattgaaaaatattttgggctatagattctctactatataaagcaattgtttcaacagcgtaccacg

SEQ ID NO: 16420 - DNA, 3128 bp, Zea mays
  misc_feature (3059)..(3060): n is a, c, g, or t
  misc_feature (3077)..(3077): n is a, c, g, or t
  misc_feature (3083)..(3084): n is a, c, g, or t
acatggattggatgagattggaaaaaattgataagaagtttgacttgtttaggattcaaactcatccaatctcactcaatccatatggattgagagctaaccgaacaaagccttatggattggtttagggtcaataatgttattgggtggattggatttaatttcctcatgtttttggttggatgtgggatggatgtcaaaattactaaatttggtgtgggttggatgtgggttgagtttttttgccattagaaggcttaggtgcaggctaatagaaacgttagtagtgacaggccacgtagctagagaattaaaggtaaaagaagaagagtgctttttgccaaactctcgctctgagactctccgaggtccagaactccagatctgccagtaggcctacgcatttggcttggccacaatgcgttgtttcgaacggagttttcaccttgtcaattgtaaaagcaagcatattacttgcgcaagctactccctgcgcagtcacgtactgctcagctaggtcgacattgacggtacttgaaagaaggttccatgcatatctggcagatggcccacatctatcgattttcctcattatcggagtttctatattagtatattcccatatctggcaaatatcatacgtattttgttcccttctttctgtgtcaagcagcacaggtggaggaggtatcgtcatgtggtgacgaaaacgaaaagggagggagacttttcctctcgccgtggaaggcagaggcaggctagcctagataaacgtaaagaattaccggaggtaataaacgagatgtgatctgctacgcgagctgatatttatttctacgaactcccagccatgtaactgattttttttttctcgcgtcgtaagcaagatgatcggatacgtatcgttattcgttattatatataaaaaagattgttccagagagcatgtgtagcacgactgcacgagtgtgtagcgtgtgcacaccttctacaaacggtctcaaacgaagctatcagattccttttttcgccgatcggcttcatcgagatgagacatgtgcgcgtgccttcgcagttcgctccaaaggtgacacgaattaaactttagtcaggaaacccaacaacctataatctcttctgaaaaaaatgaatatcaataaacactccttagaagtggtgcagcaaataaattataaaatagttggaacagaaagatgtgtgttcgtttctagttttctctcttttttctttattcgaaaaaagaaagtgaattcggtgacgttttgtggtcatggatgacgcaacgtaccgtccagaagatcagtgcgacgggtaggcgagcagacgaaactcacaggaaggctgctggtgctggggaggcggcaattttttccagcagcaacagcaaacactgacgaactgagccctatctatatcaacctcacatggcctcccataccatctggccccggtccaactattcagtccaattgccacacactgcctgacgcaagctcgctcgtccaagtccgacgttgataccattggccgctgcgccgccatggccgtgtcgccggaccagcagcagccacctgcaggggtagggtctcccttgccgtctcctcgcctccgcgtccgcgtccgcgacaccaccctcgtgccgccgtctccgtcaccaccggagacctcgctcccgctcaccttcttggacatcttctggctgcactccccgcccgtcgagcgcctcttcatctaccgcctcgcccccgacgctgacgtcgacgccatcatctccagactccgggactccttgcaccaggccgtccgcgccttctaccctctcgccggccgcctccgcctcacccccggcacgtccgaccgctacgagctgcactaccgcccgggtgacgccgtcaccttcaccgtcgccgagtgcgacgacgatgacgcggacgcgcacttcgacgccctcgccaccgacgagccccgcgaggttgccaagatcgccacgctcgtgccgccgctgccggagcgcggcgggctgttcgccgtccaggccacgctccttcccgcgcgccgcggcctctccatcggcgtcaccgtgcaccacgccgcctgcgacggctcgggctccacgcatttcctgcacacctgggcggtcgcctgcagagccggcgcagaagcgccgccgccgccgccgcctgtcatcgaccggtcactcatcgccgacccaaggccccgcgtccgccccgcctccccaggagcgccgagcactgaagagtacgagttcgtcaagatgtccgccgaccagctcttcgctacgttcgcgctgtccaaggacgaactgaagcgcatcaaggacgctgtggccgaggaggctgcgaggcgcggcgtcgcgccgccccggtgctcctctctagttgccaccttcggcttcgtctggtcgtgctaccagcaagccaaggaggccagcagcggcgccggagagttccctatgacctgcatggcctttcccgtcgaccaccgctcgcggatggagcctcccctgccggacaagtacctcggcaactgcgtcggcccagcgttcgcgctggcaccaacaggcgagctggcacaggtcggcgcaggcggtttctttagcgcgtgcgccgccgtcgcctcgtccatcgacgaagctgtacgcgacatcgagacatcaaacgtggaggtgtggtttgaccgcatcagggatttaatcccgatgggttttctgaccgtggccggttcgccgaggttccgcgtctacgatatggacttcggatttggccggccggcgaaggtggatgtcgtgtccgtggcgaggaccggcgcagtggcggtggcggagagtcgggatggtgacggcgggatagaggttggggtctctctacagccggctgccatgaagaggtacaggaagtgcttcgcggatgctatcgcgtggctccaccgggcgccgtgagagcggccacgcgagcgactcctcgatctaatcaaatatggagaaacgggtcttttacggagtctatcatgtgatgaannaatcacttgcactttcntccttnnttaatatactacccatatctagctttttcactagataaaccttt

SEQ ID NO: 16421 - DNA, 797 bp, Zea mays
  misc_feature (782)..(783): n is a, c, g, or t
  misc_feature (785)..(785): n is a, c, g, or t
gatatttttgaccgtgcgccaacggccaacctagcgccaacctccggctccaatggcatccctccggctcgtggcaacgctagcgccctccggtcctccgccgccacctcgacgtaagcagcggagaccgtcctccgcagtccgtctgacaggtgggatgggcctggcggcagctgctgccgtggcggcggccgcggccgcctcaccaccggcgctcgccgcgctgtccgagccggcgaacgcgctctcgctgcccacctgggccgtccacgtctccagcgtcgccgagtgggtgacggcgatgtggctggtttgggactacggcgagaagacggggctcaagggttggaaaggcctctcgtgggggatggttccacttctaggtggagcaatgtgtgcttgcacgtggcatttcttctacaattcagagtctcttgaagttcttgtagcccttcaaggtgctctgacagtggttggtaacataacaatgtgcatagctgcataccgcatattcaaagcatcccaggaaggctcaaaaacttcgtaggctgcaagattggatcttacagccggtttggcaaggtgatgagatatggagcttgcgtttctctgacatggatgagaatggagaactatttgattgttgtttttttttttggcccattagataaaagtttattggaaaggacaacctttcacagcaatatgcatcctctgctgtagtattatttctcaggggccaagataaaagacaatgtctggaactcaaaaaaaagaaaaannanaaaaaaaaaaaa

SEQ ID NO: 16422 - DNA, 803 bp, Zea mays
  misc_feature (767)..(767): n is a, c, g, or t
agcgccaacggccaacctcacgcagtcccgccgcatcgaatggcatccctccggcttgtggcaacgctagcgccctccggtcctccgccgccacctcgacgtaagcagcggagaccgtcctccgcagtccgtctgacaggtgggatgggcctggcggcagctgctgccgtggcggcggccgcggccgcctcaccaccggcgctcgccgcgctgtccgagccggcgaacgcgctctcgctgcccacctgggccgtccacgtctccagcgtcgccgagtgggtgacggcgatgtggctggtttgggactacggcgagaagacggggctcaagggttggaaaggcctctcgtgggggatggttccacttctaggtggagcaatgtgtgcttgcacgtggcatttcttctacaattcagagtctcttgaagttcttgtagcccttcaaggtgctctgacagtggttggtaacataacaatgtgcatagctgcataccgcatattcaaagcatcccaggaaggctcaaaaacttcgtaggctgcaagattggatcttacagccggtttggcaagggatgctcagccgcatttgaagattgacgttgctgagagcctgagacgatgataggagaagatacagatagccggtcggttggctttaccttgtgaaacagtatgattgtgatggagttgaagaagaacaaagttgcgtctctcctgtaaatacctgtgaaagtaaaccctgaatccggttacagtcttagaaaaaanaaaaactatctccagcagccttttattttactcttt

SEQ ID NO: 16423 - DNA, 1402 bp, Zea mays
ttctgcccacgcgtccgcggacgcgaccattcagaaatgcggcccatgacgaacccgcccctgctctcaccgtccccgttccctcttctcctccgcctcctccacctctcgcgcgcccctcgccgccggaaccctaccaccgggcgggcacctacttgtacttcccgcaaccgcctcccgctcctcctctccgctgccatgtcctccgcttccaacaccgccccccactccgtcgtcgccgaccccactactcttgcccgcaaagtcgcagacatccgtgccgccggacccaccaaactccaggttatcgccgacttcgatggcacgctcacgcggtactggtacgacggcgcccgcgggcagagtagccatggactgctcaggcaagggaacgaggagtacgacgccaagagagaagcgttgtaccagcactaccaccccatcgagatctgccccgacatcccactctcggagaaggccaagctcatggaagaatggtgggagaagactcatggtcttcttattgaaggcggtcttacatacgaagctatcacaaaatctgtctctgatgccgcaattgctttcagagagggtgtggtggagctctttgagtacttggaggagagagagattccagtgctggtattttctgcaggacttgcagacataattgaagaggtcttccggcagaaactacacaaaacattcaagaacatcaaggttgtctccaacaggatggtgtttaatgaagaaggccgtctcatagcatttaaagggaaaacaattcacgttctaaacaaaaatgagcatgccttggacatggctgctccagtgcatggcaatccgggggatccgaacggatttatggatgactattcattggtgaagaaaaggaccaatgtgctgctacttggcgatcacattggggacttggggatgtctgatggtttaaactatgacaacaggatcgctgttggattcctgaacgccaacatcgagaaatctttgaaggattactctagcgcgtttgacattgtatatctgaacgatgctccgatgcacggagttgtgcaacttgtgtctgaattatgtccataatccagtgatcttcgaatcgcccctcagaaaaaaagtatatcttcccatcaactttgcagctaccgaagttcgctcacctggaaatgtaaggattccactcttgctaactagggcttgcttcatgagcagctgttctataggctcatttcagggctaaagagcccttggaacaatgttttttagcactagtgcattcaaacacccactgtagatattttctcctcctcttccaattcgaaagatccgtgaatgtttttttcaaaaaaaaaaaaaaaataaaaaaaaaaaaaaaaaacggcacgag

SEQ ID NO: 16424 - DNA, 2649 bp, Zea mays
aacccaacccccacctattcgagcgacgaaactaccaaagcggaagggggaaaaagcacgcgacgacgcgacggtgaaggggaagtgtgaagggaagcagaagcgagacaaatccccacccggctccaaaccctagccacctcccccgtcccccccttttcgtcccccagatctcgctggcgtctgctccgcctcgcttcgatgtgaccccaccctagggtttgagacggtgttgcggtgtgtgcgtgtgtcgcggcgattcgcgacgcgagtaggattcgaggtgtcggcggcggtgcgagcgcaaatgaaggacccggcgcaccgcacgaaggtggtgctccggcggctgccgccggcgatcgcgcagcaggccgtcgtggaccaggtcgatgcgcgcttcgctgggcggtacgactgggcctgcttccgtcccggcaatgccagccaaaagaatcataggtattctcgactttacctaaatttcaagcacccagaggatgttgttgagtttgctgaggtcttcaatggacacatatttgtgaatgaaaagggtgctcaatttaaagctttcgtggaatatgcaccatcacaacaggttcccaagtcaaatgtcaagaaggatggccgtgaagggactgttacgaaagatcctgagtacttggagtttcttgagtttatttcaaagcctactgagcatctgcctagtgctgaaattcagcttgaaaggaaagaagccgaaagggcagctgctggaaaggaggcacctgttgtgacacctcttatgatgtatgtccgccagcaaagggcagctaagagtatggctcagagacctggaagtaggcttagcagaaaagttgcaggtgttgtaactagcagttccagtcctaaaaggtcttttgagaagcgccgatcctccacgtatgttgtacgagacagtattaaggagaaaccgacctatatcatggtgccaaagagagaggagcatacacaaaggggaaaaattgtttctggaaattcagatgccacaagtgggggggcatctggatctggtcagtcttctgacaaaattgtcattttgaaaggaagaggaagggttgattcgaacacacctgatggagcagctcaacagtcatcaacccctgtgaagaatataccaccatcgagttctagactagacaagcgatctgaagctaatggaagaattattaaaactgttctttcaaacaaggaagttcgcagttcaaatccatctcaacatgagcaggaaggtcacatgtttaatactgagaaggataagcgtccaccacgggctctcaaccctcggactattgtgaaagatcaggtagttgaaaatgctgagagaagccattttgatgagaagaataattatgtccacagctctgctccaattggtgagaaggttgaaaggcatgccagaaacagagatagacctgatcgcagtgtatgggcacctcgccgctatgacaaatctccgcctgggggtgtttcacatgccttgtcgtcagatttttctcaaatgcagtcacattctggagataatgtctcacaactaacagatggtcatggagacagaaagacagacacaaggggtcatggaggtagccgtggtgttcctgttgaaaatggacataggcatgccaaccgtcgtggtaccccatgtgatccaaaggaaaccaaaatatctgctagcgtgcctgatggaaagaattcaaagaggggctctgctagctatggtgctcatgagagacaagtatgggttcagaagtcaagttcaggctcgtgagtttgtccattgatgatactcccataaaaaacaggtattgaagtcgtggagaagtcttggattctgcagcgcattcttctttgttagctgttgatcctgtgaagtatggtaacgaaatgtccaatggtcaaatgctaccatgaagtgcaatctcagatctgtcagtcgaagtctcagctgaaaagagagctcggctgatttgattcacagaaatagtgaagtaacataacccggcatgtaggtagctctccgacaactttgggcaagatttgatttgtgcccaatgttgatctttctggagcattggatggagattaggttggcatcactacctcattacctcgtgatagtggtcacatatttccaagacccctggaggttacacgcaccctcggcaattcgtcagagatggatgtaaatatctctagagaaagaagaggtctggttccgattgctgtttacaggttagaggtgcaacgtatttacaaagagagataagagttatcacttatcagactacctggtttgttaaataaaggtgaatttagttactagattatgagaccccgtgttttgacttctgcaatcgtggttcacgacagcagaaaggttacctaggagtgtaaaagtgacatctcattttggtgctatggttctgactcaatgggatgtgacttgtgatgtggttttgtcgtctggtgtgtgttttgctgccatgttcctccaaatgacccgggggttctgtcgtgttagggatgatatgcttggtgtacagcatcaaaatgttttaaatcttaaaagtgatgttgcctggctttaatggtggatcctgtccgttctcc

SEQ ID NO: 16425 - DNA, 895 bp, Zea mays
ctgctgtcatctcccacggttggtccacctcctcctgctcctctggcctctgcggtgcctcctcccggtcccgagtcccggccatgtcgtcgccgctggaggatgtcagcgtgggcatggaggaggaggatcagcggcccctgaaccgggccctgctccaccggagcgccaccaccaacgcctcccaggtggccatggtcggctccaatccctgccctatcgagagcctcgactacgagatgatagagaacgagctgttcgaccagaactggaggacgaggcgcaaggcggaccaggtgcggtacgtggtgctcaagtggaccttctgcttcgccatcggcatcctcaccgggatcgtcggcttcttcatcaacctcgccgtcgagaacgtcgcgggcttcaagcaccaggccgtttccgccctcatggactccgccagctactggacggcgttctgggtgttcgccggctgcaacctggcgctcctgctgctggcgtcgtccatcacggcgttcttgtcgccggcggccggcgggtcgggaatcccggaggtcaaggcctacctcaacggcgtcgacgcgcccaacatcttctcgctgcggaccctcgctgtcaaggtgcgccgtgtgtgttccgttcccatcctcctgccctcgccgtcgctttcgcttgctgcagtgcacatgctcccctcaccatttcctggtgccagctgcgcaaatggattaccatccacactaatataatgtaacaagggcattcattcctccatccaactgcatgatctacgagaaaggaaagcaaccagcaagtaaataaacaatcataattagacttttctggccacagtttactactcctactgcagttccccggattataaatctgggtgagc

SEQ ID NO: 16426 - DNA, 3946 bp, Zea mays
  misc_feature (1798)..(1798): n is a, c, g, or t
ttgggtgcctcccgcccggccgccggcatcctaaatccaaaccaaccccacacccccaccaaactaccgaagcggaagggggggaaaatccacgcgacgacgacgcggcgaaacgaagggaagggaagcaggagcgagacaaatccccacccggctccaaaccctagccacctcccccgtcctgtccccagatctcgctgccgtctgacccgcctcgcttcgatgtgacccggccctagggtttgagacgtgttgcggtaggggtgttctcaaggattcacgacacgagagagattcggggaggcgtcgacggtgcgagcacacatgaaggacccggcgcaccgcacgaaggtggtgctccggcggctgccgccggcgatcgcgcagcaggccgttgtggaccaggtcgacttgcgcttcgctgggcggtacgactgggcgtgcttccgccccgggaatgccagccaaaagaaccatagacattctcgactttaccttaatttcaagcgccccgaggatgttgttgagttcgctgaggtcttcaatgggcacgtatttgtgaatgaaaagggtgctcagtttaaagctttcgtggaatatgcaccatcacaacaggttcccaagtcaactatcaagaaggatggccgtgaaggaactattatgaaagatccggagtacttggagtttcttgagtttatttcaaagcctactgagcatctgcctagtgctgaaattcagctcgaaaggaaagaagctgaaagggcagctgctggaaaggaggcacctgttgtgacacctcttatgatgtatgtccgccagcaaagggcagctaagagtatggttcatagacctggaagtagacttagcagaaaacttgcaagtgtcgtaagcagttccagtcctaaaaggtcgtctgagaagcgcagatcctccacgtatgttgtacgagacaacactaaggagaaaccaacctatatcatggtgccaaagagagaggagcatacacaaagggaaaaagttgttgctggaaattcaggcgatgccacaagtgggggaacatctggatctggtcaggttgctgagtttaaaagggataaaattgtcatattgaaaggaagaggaaggattgattctaatacacctaatggagcaactcagcactcatcaacccctatcaagaatgtgccaccatcgcgttctagacaagaccagcgacttgaagccagtggaaaaattattaagactatactatcaaacaaggaagcccgcagttcaaatccttctgaacatgagcaggaaggtcacatgtttaatactgagaaggataagcggccaccacgggctttcaaccctcgtaccattgtgaaagatcaggtagttgaaaatgctgagaggagccattttgatgagaaggctaatcatctccatggctccgttcccatcgcgcggccggttgaaaggcatgctagaaacagagatagacccgatcgtggtgtatgggcagctcgccgctatgacaaatctacatctgcaggtagttcacatccttcgtcgtcagagttccctcaaatgcagtcacattctggagataatattttgcaactagcagatggtcatggagacagaaagacagacacgggggggcaaggtggtagccgtggtgttcctgttgaaaatggacataggcacgccaaccgtcgtggccttccacgtggaccaaaggaaactgaaatatctgcaagcgtcccccctccctccgattcaaagaggggctctgctagctatggtgctcatgagnagacaagtatgggttcagaagtcaagttcaggctcgcgaggttgttcattgatgatactcccatcgaaacaggtattgccagtcgtggtgaagtcttggattctgcagtgcattcttctttgttagctgttgatcctgtgaagtatgttaacaaaatgtccaacggtcaaatgctgctatgaagtgcaacctcagatttgtcaatcgaggtcttgctgctatagctgaaaagagagcttgctgatttgattcacagaaatagtgaagtaacataacccggcatgtaggtagctctcgaccacttttgggcaagatttgattcggtcccaaggttgatatttctggagcaatgggtggagattagtttggcaccagtacctcactacctcgtgacagtggtcacatatttccaagacccctggaggctacacgcaccctcgtcagagatggatgtaaatatctctagagaaagaagaggtctggttctgattgctgtttacaggttagaggtgcagcgtatttacaaagagatataagagttatcacttatcatcagactgcttggtttgctaaataaaggtgaatttagttactagattatgagaccccgtgttttgactgccgcaatcgtggttcgcggcagcagaaaggttacctagagtctaaaagtggcatctcattttggtattatggttctgaccaaatgggatatgatgtgacttgtgcggttgttttggacgcctggtgtgttttgctaccatgttccaccagacgacccgggggttctgtagtgtcagggatggatgatgtgtttggtgtacagcatcactggtgcttactgttttaaatcttaaaagtgatgttgccttgccttaaaaaaaaaaaaaaaaagtgctcttgtccattccgtcatgaaagttaaaaaaacatgcttgaaaacggaactctccagtattttggagtggttggccccctctaagctgattctcttgtttataaccggtgctcctcttttcttctacccccagcctcatcttacaagtcctaaccttcgaagtcctaacctttgcgtgttctctttagattaaagctgtttggactgctgctagagactgattaaagtcaagcggagcgaaacgtttctgccttgcctgcatggtctccggcagtgctatcaatgcagcctcctgaatcaccataggtgagggcgcatggacccgtggcattaggggtgtgtacaggggcgggcctaggatttggacaataggtattcaaaattttactagagcaaaaaaatgttttgatagcctaaatctatgctagtagccttagtcatatataattgatggcctaaagcctattagagtagcctttagatatatataattgattagcatgcacagacgagtagctctttcccttgagcctcggcgagcggcacagcaggcgtcaaggtcaggccatcggttgctcactcgcttcacgctcccgcccccgacacattagtccggcttcgtggctcctccactcctgcaaacccgcgctggcgcgtcgccaccagaatttgagcccttgaagccttgaaagaagcgacgaaccgaagggcagtcaccaagccatgaaagacatggtgctggttggctcattcaatgagcctaatgctttaatggactgtgcgttagggaaaaacgagacctggaatgcgagtttgagaatagaactatatattttatgtttttgtaatattttagtgtatatatctaacatatatatgtatatctatttttaccaaaaaaataatgggtattaaactgaatacccttgctactatgtgggcccgcccatgcagagcccccacatcaatcaattcccaactagagagtctccgcactcgaacgagaaaatgagcagctgagagcgagatgcatcaactcccaatctattattagagcagcatctaatataatctaatctatagggaaaactcagcgcgctgcttgctctcgtgatgcaaacaacgcagcaagtacacactcctctccggagatgcgcgatctgtgtgccatgatgtcccatcaaaatctggcgcatgcacgagctgctgcattggttgtagtagtagtatgcctgaacctgaatcttctgcag

SEQ ID NO: 16427 - DNA, 2966 bp, Zea mays
cctcgaggccggccggggaccgatcctcggcaacggatatctcggctctcgtatcgatgaagaacgtagcaaaatgcgatacctggtgtgaattgcagaatcccgcgaaccatcgagtttttgaacgcaagttgcgcccgaagcctcattggggaccgcgagcccgccggccgggaagccgaagacgcgaccgacccaggcaggcaccactccgctcaacgcaccgggcggcacccaaatcccaaaccctagcacacgcaccatggcggcgcagcagaagatccggtggggggagctggaggaggacgatggcggggacctcgatttcctcctcccgccccgcgtcgtggtcggacccgacgagaacggcctcaagaaggtcatcgagtaccgcttcgacgacgacggcaacaaggtccgggtcacgaccaccacccgcgtccgcaaactcgctcgggcgcgcctctcccgcagcgccatcgagcgccgccagtggcctaagtttggggacgccctcaaggaggacgcgggctccaggctcaccatggtctccaccgaggagatcctcctcgagcgcccccgcgccccagggagcaaagctgaggagtcagctgcatctggtgatccgctggctatggcgagcaagggaggtgctgttctcatggtttgcagaacctgtgggaagaagggcgatcactggacctcaaagtgtccgtacaaggacctggcaccaccgactgaaactttcacggacaggcctccaacgtcagatggccctcctgcaccaggtggtcctgctaagggagcatatgttcctccaaccatgagaggaggtgctgataggactggagactcgatgcgccgcaggaacgacgagaattccgtccgtgtgaccaacctctcggaggacacccgcgagcctgacctccttgagctcttccgtgcctttggccctgtcagccgtgtctacgtcgcggtggatcagaagactgggtcgagcagggggtttgggtttgtcaactttgttcacagagaggacgccgagaaggccatcaacaagctcaacgggtatggttatgacaaccttatcctccgagtcgagtgggcgacaccaaggcccaattagttttgccgctacctgctagaatcgcatatttctgttgaattatatcagtatgtttgtttgaattactggtacctgagtcatgaatttatcttgttggaaaaacctgttatgtgtggtttggttggacgagaataactatactcgcttcttttatattgagttcgcatgccgtttgttgtcagcaaaaaaaaaaaaaaaaagcaccacgaacgggtgatgattgtatggctgaacaaagcaaatttcatggtcgcaaggctggcaccttgcatagccttgaatgcttgatcctttgggtcagagactctaaaggttcagtggtttactagcatctcattcgatcaaaagataacaaaaaacgaacgactaaaccttatcagaaaacttgaaacaatgaccaaggagaattccttgttggcgtgagtgttctttgttcgagtcatctatatctataatgatctattaagaaactaatgtgggcatctgatgatactactgtttcaccattcgcgctgacgctctgggtccacccgccacatcgcacaaaaaataatgcagagcgagcattcgaatccataccccttcaccaccaaatcacacattttttagtgtttagaaataaataatagttatatttgagtatataacaaccatagtaaagcacagacttctggctagttttagatagatttcaccaggggttcagggatttgcctaaagtgtatgcaggaacttgttctcaaagacaggaagcgtcgacactcgatgagaatgaggcctgtgtgatcacaagtgcctacaaaagcaaaccgaatctggattaagaaaaaaaacagattattttttttgaaattcgcaggagagctacgtgtcattttattaaaaagaaagaagttatcagagatattaaaacctcaccccgtttggagctctgtccgcattcagcgggttctccagccatcctgataccgacgcgtggccgcatcctcggacccgagattttaattcgctctgtttgagtcgtgcattgtgtccgttgttcacatccatgcttctttgaatccttccccgctccctcgtcctcaccggcagccgccgctggcgtcgcccccatcccgccatcttccttctcgggctgccccgcgagtttctcctcgcacctgcgtctcctcgcaccccacagacgtcacaactgccacctagcctgccccctcctccgcgccaccctacaaccactcatgtcgtcgtgtcgctggcgtaggcgttgccgcccactcctaagccaacgccgccggtcgtcacttcaccgacgcttaggcacacccgtcctctttcgcaaccccctccaccgggatccatacctcttcttcccaacaacaaactcgccgccgccaaccccacctaccgagacctagccctcctctggtgacggcaacctctcgatgttcccgtccaacatctccgccctcatcgcggcgaccccatatgcttccggctcccgccacttcttcataagaaataaacctgctcgcatactctcttttctcttcccctgtctgtcgtgccgtctctcttcctccttccacaggtgtcgcctcagtccgtatcgacccctttccgatccccgaggcgaagctacgactctgccatagcgtttgagaagatcaaggtctccaacccaatcgtcgaaacagacggtgagatcccatcgcttatctttcaatttcttgatttggacatcaagtactacgatttaagggataatgcaccgtgaagcaattgatgacaagatcaccatgaaatttgagagtccacttcatcatatgtggctgagggcatg

SEQ ID NO: 16428 - DNA, 6803 bp, Zea mays
  misc_feature (568)..(568): n is a, c, g, or t
tggtctattctttagaaattttataagatttataggaactcaacttttttgttccaaaggatcacatagaaaaatttactacagcattttaatatttcaaaatcccttcacctttcctttgttctaaaggaggccctagtcaagtaatgtatagttacaccgatttgaagaaaaaaagtaatgtaaaactgcgcttcgaaacatgagtaaaaaaaaaggcaaaaagcatctacccccaagaacgattattgcgggagtgacaaagccaaggtcacatcacatgatccatacacactcagtgatatgtacgtgctggcagcaacaaatgctcttgtcgatcagccattgcgaaacactgtgtacagcgcacggtgtaccgtaccacacagtagcacttggcgtggatcgtagactgcacactgacggcgacctagcatgcatggggtattaattaatcggccactacaaagggaataagctgccactgcatgccatgtgaaggattccgatgcttttccttccaaactggccggtgggtcgcgtcgtttaacgagcatttaacgacgtnccgaatctcgcacggttgcgacgttggtggttgcgtccccatcaaccacaatttgatgtcgcgcagcgcactgcacccccacagccgagaacgccacggcatcagtgaatcaaatctggttcgaaattccgcaaattttgtcaaacttttacatttttcaattcggcgcgggaaatataaaccagagaaaaaatatgataaaaaaatcagaactttttccgggtcttctgaatcgatctaaacgcatttgataggtaaatttctttgaaaaaacagcaccgcagcgagaaacttcagttttggagcgaagtccgtgcattgatgtatacatgttaatgcatatatacttgtatatatgttatggaaatgacatatagcgatgtagcatatactatatgttaacaaatgttagggctagttgttatatatgttatcaggtattaggtttacttgttagtacttagtatatgctatcaaggatagttaacggcaatagagggttagatatctacattaggatagtggtattatttgcgtgctatatgtagaattattatttgcatgtattatttgcagaattaggtattatttgcaggtattatttggtataacactaccaggtattatttgcagaattatttgcgtgctatagttttagtattattttactcacctagtagtgttagtattattcctattgcttaatactatttacatgttatattattatttgagtgctatagttttattattatttatgtgctatatgtagaattcggcatactattggtgatactcggcaaagcagtatattccggtattgtggtcatcatgtgcaaaggaggctattccagttgttcatgtcctatgtatcaaattatcttcaacctttgaattgtgtgaacctttatattatattacgcaaaaccttttatatgaacttgtatgtcaccgttgtggagttatattattaaggagcagtacaaactaaagactaatgcatatattttgtacttgcatatatatggtttttattctgatgaacgaattatatgtgaaattattgttacttattatgcaacgtgaatatatacattactatatgattctatcattttttttattttttccaacacaatcagcattttccggtctaaattatacgaaacccgccgagaaatttaaggattctgctttaaaattcgacaaatttcattccattttctgttttcggtagcgtatgaaacatttaaatccgacgaaaatgtataccctgatgatctgcattctcgccctttagcgccatgggggcccccgggccggccgggatctcttcgacactctcacatgcatcgaagattccgctgacactaaaaagatcgaaatggcgccgggatcgtcgtcgtctcgtaaggccaaggccctcaaggcatcgtaccggctcgtcgccgacaacttcctcgccgtcctcgccatggtttctgtcgtcgccgtgctcttcgctgcatggccgatcagcatcgaggaccttgcctgccggctgcacgcggtgcggccactccacgtcctcacggcggcgatcctgacggcggccctcgcgaagctgaggcgcatgagccggccgagcgacgtgtatctcgtggagtacggctgcttctggcccaagccgtgcttccgggcgccgttcgcgacgtgcctggagcacgtgcggctcttgccgtacctggtcaacgaggacgacatcagctggggctggcggctcctccagcggtccgggatcggcgaggagacctgcgtgccgtacgcctaccactacctgcccccggaccgcagctttagggcctccctggacgagaccgagctggtcatcttctccgccgtcgacgatgtgttcgcccggacgacggccgtgacgcccgcggacatcggcgtggtgatcgtgaactgcagcatcttcacgcccacgccggtgttcacggacatgatcgtgaacaggtacaagctgcgcgccgacgtgcggagcgtgaacctgtccgggatggggtgcagcgcggcgctcatctcgatcggtctcgccaggaacatgctgcaggtggcgccgccgggcacgcacgcgctgatcgtgtccacggagatcctctcgtcgcagtactacgtcggcatggaccgctccatgctcctgcccaactgcctcttccgcatgggcgccgccgccatgatcatgtccaacaccgcggcccgaggcgcgcggttccggctcgcccgcgtcgtgcgcacggtggcctccgcgcgggacgccgcctaccggtgcgtgttccaggtggaggacgaggagagcaacacggggatccggctctccaaggacctcgtgcccactgccgcccagaccctgaaaagcaacatcgtcgccttcgggcccctggtcctgcctgcctcggagaagctcctcgtcgctctgtccatcctgaggcggaggctagtacagagcagccgggggagggtgtaccgcccggacttccgcaccgcgttcgagcacttctgcatccacgccggcgggcgcggggtcatcgacgaggtgcagcgcggcctcggcctctccgacgaggacgtggaggcgtcgcggatgacgctgcaccggttcgggaacacgtccagcagttcggtggtgtacgagctggcgtacatcgaggccaagggcagcatgaggaagggagaccgcgtgtggatgatctccttcggcgccggcttcgactgcagcagcgtggcgtgggagtgcatcgagcccgccgccgacgctgctgggccgtgggccgactgtatccaccgctacccagtgcagctccctaaattgatggaggcccttgattgaatccgtacatgtagacgtgaagtggcataatcaatcaatgttgtactgtatctttaatgtccaaatctgtcatcaacggacgggacatgtgattttttaacggactagttccaaataaactgttactgatctttcaattaaaaaaaaaaaaaaaaagaacgcggccaaatcagtgcagatctcatcatcattgtgtgcacatcaaatatatggacaggtcaaggggggcaaacagttgagtaaactgaattacatgaagtatacgttacttactgttagttctgagttcaatctttgcttatgttgcaaccgaagtcctatcacctcgtagtgaatgttggaagtgtattttcttcgttggaccatataagtcctggtcatacactagtgaactcggccttttttttggcatggtccatatgattttgctgagaattgattttgctaagaagttaaggacttgtttggaagcaaagtattttaaatccatggttttagaatactataggttttaaatgtcatggcaaatcatggtattttttacatcagctcaagaaatactagtttgaaaacaaagtatattaaaccatggtatttagtgtatatgcaagaagctagtcctagtgggttcgagtggagttttaaatactccaaaaatatcatggtaactattaaacaatgatattcacaactgagtttttacaatatagtcaaacacctcctgacgaagaataacatgatatgctctaatatcatacttttatctgaaaacccaaaaaaatactttgcttccaaacaactcctaagctccttgacaaggaagtgatttttcttttgcttagtttactactcattgatgaggaagactcaaaatgcttctgcgtttttaggttcatcgtcaatgttatcatggttcgtctagaatttgttgccgacaatgtaattttgggcgtagagcgagctattagattttgcagctggattacaaagttccggctgaacgtaggcaatcgcaccgcaacaggatataatgttgctatggctgatggctcgccttggacgtgttcccctttaatcacatgttgttaattcaaccaaactttgttaacctcgtatctttaatactgcaaaatctagccggcaaaaaaaaacactgtccttctcaatagataaactaatgaccaaacgatcacaatgccggcaaatattttagcatcccacttactgcatgaagaacgggattacaaaattccccatcttctccttcctctcgagctcatccttctcagccatctgtttcagcgttgtccaacccttccttgcccgcttccttgagctgccagaaacctgagaagaatctcttgctgcatatttcacattatttctagagccattcgaggcagacttgctggagcctgagagggcgtcaatggctgagccagaaatcatgccacttcctgtcttgagtagtcctgctgaatcttttgcaacagtcaccaccggtggtttcattttctgaggcgtgacaaatgatgaaccaggtgcaagttctgcttgcaaagtagcttcacatatcctaaccttctcaggaaaaatatggctagtttcacgcatctgttcatcaagattacaatttaacctttcgccatgctcgtcactttcagtagtcgactgcctcaacagagatgacgattccacttgcaaaattgctgcttgagaaagctcaagcacttctttcttatcatgtgctcttgtgttgctaccgtttcctctcacaattatatgggatgagttcatggtagcatgccctcttgacagtaacaggctctgaacaacacccttcccactacccaatattaggttctgatctccacagaaatggcatgcataggaaacactgttctgacaacagtttgatttcttccgacgttttgctttatttctcttgttccttatgcggacagtgcagttgaagcctggctttaagattgtctcacacctgcaatattggaaacaccttgttacagatctgtgtactgagatatttctgtaggctgaaataagggctgtgagtagacagaagttacaaaatactagtagaaaccagacagaatagcatgactacgatgtgaaacaagcacaacatattctaccagaatgtacagatgattttcactactctttggaattcccagatcactttggcctggacactaatattgtattgcatcccatctgggatactttattattttaatttcaagcttccttctagctcatggaaggattcttagttatttgatacaactaaattatacgtatatatctgaattccaagagtaatggttgaataagatagaaattttatcaggaggccatactaaatggaaaaggaacacccttattgtcatcacaacattttaattttactttactgatagtaaattaatgagtatgtgcagacatgcacacatggtattgtaatacatcattttcattttactttgcttatcataaactaaatgaggtacatgcagacacatgtttgtctcacagctgactagttacaggacacaagccattgttttcaagtcggacgacttattggtcgttctggctgaccgacttgggcgattaatcgcgattggtccaaaccgacttggacgattaatcgtgattaatcggacgacttgaaaacagtgacaagaacaaccaatcaggatgcaaagaaaccttttgcttctacgtagggatggaaacaggatgtatatttcccaatatccatctgtcccaaaagggtttaaatactaaatggttagtctatatatgactctagacattaatatttgtaaggtatccaaatcaaatactcagtcggatttctgatacgtataagggatagatatcaatatccaacacatccgacactatctctatccaacttagaatcccaaaaagaaacaactatccgttcagatccaatcgagttttatccctacgtctatggtattatgaatattgaccgagaaccatcctgcatgcaatgtgtgttagtaagcagcaggattataactataaccatcgatcatacaattgggccacccaaacaatgtttatcaggatatgtcaaatggctatcatgaaattttattgatataatagatttttatcacataacataaagcactgagatatattaattgttcatccatgtatcttgacagatattgttatctgtgattgattggagattagcacaaaatctagttaaccatgagagtcgagaaaaattaatttgcacagtcaaaggctgagaaagatagttcaaggtcttacaacagataccaaaatcctttacaaccccag

SEQ ID NO: 16429 - DNA, 4632 bp, Zea mays
ggctgcacccgaaagttgaaactcctctgtggaatagatggcacagacccagaaccaaacaccggtgcctgcctgacatggtacacccgattgaggtcccgtgtgaggtccgaatccagctgaacgccactgcatcataggattatggttaattccatgagacaaatgtcgattgattctaggattgaacccccacaattcaaggcactgacctgcgagtgctcctgattgagtccagatgcgcggtctcccaggccctttccacggccacccacagacgtgtgtcaccatctccaccttgcatcatcctcacgacttcggcgtaacatgattggttgcccggtcatccggcgcctggctcgctggagcctggcttgccgcaaacgtcatttatgtcgtttccacgcgtgcaactgaaggtgtttgatttggcctatcccgcatctctgtacattcagatccgttcatctacaaacaagcattcaatcaggtgctgctggtcagtcaacgcacgcacacagcctggctgccgagcagcaggcatccaatcacgtagaaagtgaatgcgggcgagtctgcactgtgtggcggcgttgaagggtacagaggacagacaggagacagaacacccttcagcctcgctgcaacaggtgtgccggtggtatttgcctcgtttttgggctgggccaagacaccccttcgactcatcagttttcccagggcctttattggaccgaaagactttatggtacttgggtgccaccgtgaatgacgccagaaatttctcctttttttgaaatttgaaggccacggttctgaccagagcgcaggttacgcctagacgaagaacacgtcgacgatgagcaagccttctccgcgtgctgtttctccactctacgatcggccagcactagataatctgccagtgtcatgtgtcgcactaagaacgtcatcaaggaggaaaaatgagtttgaattacctggacatagccgatgtcggatctctcccacagctgcatccttcaatcttggaacacgagcccacatacctcagtggatccgagcactagcttaccgtataccttgaccacttcagaagtcatggatggaaaagaaagaaaatccccccgtcaggaaaaagcttctggagtttttaccacgaaacctgggtgagatgaatctgaagaacgggagtcacatgcgcccttggagagtacagtggcacttattacgttgttcttgccggccagtcatcgtgaaagaatgaatgcctgacaggctgtgtactacgtacgcccgcaatctttagcagcgaatcgttcaatcatcaaacgtagtggctggcccaccatacggttttccgtatatgctgctagcttgagcggcggtttaaggcactgccaaaaagaaaagaaaaagaagaagaagaagagctacaaaagagaacccccgtcagaaaaagcttctggagcttttatcacgaattttcgagagatgaatatgaagaacggttgcaggtacggaccacggacaccgaaactggagtcacatgcgcccttggagagtacagtgccactttttatgttcttgccggccaatcatcgtgaaggaatgaagggtgtgcagtacgtccgcaatctttagcagcgaagcattcagccatcaaacaaagtggcccatatggtttccgtttatgcttcaagcggcggtttaaggcgataccaaaaagggtgcaaaaaaaaaggggtaacgtgtcggctgcccagaggctgcgtatttgcaaattgcaactgatgtgttgctactccgtggtacgtagttgaatttgacccaggcccgaaccgttcagccctccaactccaaccatgcatcgtgctatgccctcgagtattgggccgcccgacacgtcaccgtcattattagttattattactcgtggcaactgatgcgtctatataccatgggttggtgtcggtcgcttaatcgtattgtgctcgtgccagtccatcgtaccaggtggcggtccaaacaagacactagactcgtgtcatatcgacattgacactataaatcgtgcccatgccgtaccaaagcactgcaaagggtcgtgttgtgcttagtgtctacccatttaacaccgttcacttgccatctataccctcgagactcgagttatgcccttgaaatctaacacacgcttccatatgcactctcactatctcacacatacctatagatgtccactaagatcgaagcccgacccgcttaaaacggacacaggccggtccagcacaaataagcgagctaggcctggacagagaattaagcacgatatgctagcctagtatgatccgtttagtgcttgactcgtttggtctgttttttattacaccacgcttttcggctcgtttttccattcttacgggccgacccaacccgtttaagtccataacatgtccaaccattcatagaaataagcccgcggacttatctggcccgattaccatgtctggcggtacaggcccaaacagggtcggcccatttgaacatcactacacataccgaaccagacttcgttcgccgtagacgcgcgccaggcaagcaacaatggccaagcttctcaagccttggtacgcggccttcgtgaacagattcctcgccgtggtcgcggtggcatctatcgtagccgccgcgctccggcgggcgtggccagcattcagcatggacgatgtcgtcggcagccttggcgccgcgcggccggtccacgtgctcatggcggtcatcctggctgccggcgtggcgaagctgaggcgcctgcgccggccgcgggacgtgtacctggtggagtacggctgcttccgaccgcggccgtgcttccgggcgccgttcgccacgtgcctggagcacgtgcacctcctgccgtacctggtggacgacgagagcgtcagcttcgccatccgcctgctcgagcgctcggggctcggcgacgagacgtgcctgccctactcctaccactacatgcctccggaccgcagcctcgaggcggcccgggaggaggccgagctggtcatcttctccgcagtggacgaggtgttcgccagggcgagcgtgaggcccgaggagatcgacgtgctcatcgtcaactgcagcatcttcacgcccacgccggtcttcgccgacatggtcgtcaacaggtacgggctccgcgccgacgtgcagtgcctgaacctgtccgggatgggctgcggcgcggggctcgtctccatcggcctggccaagaacctcctccaggtggcgccgccaggcacgcgcgtcctgacggtgtccacggagatcctctcgtcgcagtactacgtcgggagcgagcgcgcgatgctgctgcccaactgcctcttccgcatgggggccgccgccacgatcctctccaacagccccgagcgcgcgcggttccggctcggccgcctcgtccgcaccatgaccgccgcgcgggacgccgactaccgctgcatattccaggaggaagacggcgagggcatcctgggcgttcgcctctccaaggacctcaccacaacggccggccatgcgctcaagcggaacatcgcggcgttcggccccctcgtgctgccggtctcggagcagctcctggtggcgatgtcgctgctcaagcgcaagttcatgagcggccggcgcgccagggtgaggctgtaccgcccggacttccgcaaggcgtttgagcacttctgcatccacgccggcggccgcgcggtgatcgacgaggtgcagcgcgggctcggcctgtccgacgaggacgtggaggcgtcgcggatgacgctgcaccggttcgggaacacgtccagcagcctggtgctgtacgagctggcctacatcgaggccaaggcccggatgagggcgggcgatcgggtgtggatgatctccttcggcgccggattcgagtgcagctgtgtggcattggagtgcgtcaagccgccggccgacgccggcgggccctgggccgactgcatcgaccgctacccggtgcatctccccgaagtcgccaaggacaacatctgatcaaccccttcttctggatctggggcatgctgcatcatgctggacatgaacatgcccaaggcttccgtcgtcgtcgatgtcgtcgtccttagtgccgggctgtcggccgccgcccaacatgtcgtgctctgtctatgatcgatctcttggaaataatgtagccctacccctacggtgtccaaaacgcaagtatggcgcgtttgtgtttgttaccactgcacttgtttaccacgctgcactgcgtttgtgtttgttaccactgcacaaagttaattaagcgccagttacgatcaaaaaaaaaaaaaaaaaagccggccgcccgggatatttacaatttgttatacatctaagtttttcttagctttgatcagattaaaaaaccgagcaggaccaagagatatggctagaacatctccaacaagaaatcctacatttaacttctaaaaattaaaatatgacctaatttaaaatatttaggaccgtaaaaacatttacaacttaaacaattgactcttatatcatgttattagaaaatagatcatgtcatttaagaaataaata

SEQ ID NO: 16430 - DNA, 5478 bp, Zea mays
  misc_feature (1651)..(1651): n is a, c, g, or t
  misc_feature (4550)..(4550): n is a, c, g, or t
attatgttttaggtagaggggttaaatataaaataatagttataattagatctagatcggatgcaccagatcgcttgattgcatgcttgcaccaggataagtgattgcataggatattttcccgctaactataactggatggttgagtttttttttacttttgtcacaaccatccagcaaaaaacagcacaagtgtttggccttggactgactacagatcatctcttcacaagaaattaatgatctaaaaatgttacataaataatttctagtaactctgaccagaaaagaaaaagaaaaaaaaacttacaaaaccttagcggattatcagtcaccaaccatggcggcgctccactgactacctcaaaccggtctcgaagcccacaatctaacgggcaagccgtagttgtgaaaagatcggatcacgccatcgcggctggcggtcacgatgaccgtgctccacgcggcggatatcatggagagacagtcgcccagctgcgggctgcttccaggctttgctgtagaaggcaacttctcttcaggccatgtcgccaatcccttgctgccgtccacgaacgaccacggctcagcggactggcactccccgtggtggcgcaaaatgggcatgctgcaggatttctcagtcaggtaggaaggcttcgtgtgcccatcttggtacactcccggccatggtactgcggtagttacagctttggagaagaacagctcgcacgaatgaaccgatcttgcatctctagagttcgccaagttccaaatgtagacgttggaatctttgcccgcagatataaggtatctgccgtctgatgttaatgacggcgatgacagagccttcgacttccaaggccctgtatcagagattcagagataacaagtagagaagaagggagcacatcctatcagtaactgaagttcaagacgtgtaacgtggttgaaccacgatgagtttctgctttctttgtgaatttctaccttcaaacttttggatggtatcaccattgacgactcggattttggaatctcctgatgtaactacaaccctattggaatcacttgtacataactgcaaggcggtgttcagaggttagagatttgatatggtttataattgcaggaatactagtgcttccaccaatcagcggcaccgagcccatacagtatgaacaatggagaaaaatgaacctttagattgttgatccgactggcggctgacttcttcttcccttgcacaaacaattctttctctagctggatgttttcacctaaaacgggaaattgaaccgctcactcttagtactgaattatcggtaaatatatttcgttcgctattacaagttggagcactcaacataagtagaattacattaagaaataagacctccacgtaccagattgatcatagaaacgacatgcgcctgcaatagtgccaacaacaaaaccctggtatgcatatgcatgaattagggtccacttgctgaaaaagaatagtctgcaatggcagttgtttctgattcacacctttccatctgactggtaactcaaagcagttatgatagttcgcgtataagtccagccagttactcgtttgtccaacacatcccaaatgcgcactttaccatctaatgaaccgctnatgaagtatttctcgtcgatagggttgaactgaacacatgttactgttgtcaatcacaaaggaacagaaaagagagtcaggttcttatccagggaaaaatattgaagttattattatgctccaatgtactgagaacatcacaaaggctttctcatcatcacaataatagtttaccaatattctgcttaccatagtctttgtgtttgaaaactgcgagacaaccgtcgcagcccggtttccataagcgcactgtcttatctttagatgaagttaacagacactgatgtcaaaccaaggcaaaagaaaaggtgtaagcaatttaacagggaagcaacaatatctgatactccctgcattttaaatatatgacgtttagggacaacctaatcagtttagggctagtttgggagcaagggtattggaagggattgatagggttagaataccttactacttaattttgagtagtaagggattctaatcccctcaatttcctccattacctttactcccaaacaaaccattattgtttctagataattagcttgtcataagcgccatatatttaaaactggaaggagtatctgtttatgatgcatggaaacaggttagtggatatagcttaagtggtctgagtgatacgtgaggtatacaaaatacaaaggaagacttacatctgatttggaccatgccatatcaaggatatcacttgcatggccacgaaattcatgtaatggagtctctgatatacgaaaaaccttcttgggtataactgcaagtgcagggttgtgcttctttcctatatttgtcttaaagacctgaactttttccaccttttcatgcggatcctctcccctgtataacttaggagatgcttctacttctatgatttgccatatccgtacagcacaatcctcaccgccacttgctaaataccagccagatgggctgaacttcatgaccctaattgaacccttgtgagctctgatttcttgatccatgtacacagcagagaattcaagaaattttttcttccggtgctgaactcttgttctggttggtatactgtttgtgcaatttttcacatggacatcgtacttgcaaatgccaccaaagcttctctttgtaacgaatttccttgacgagcttttgccgtccttttccttagcactttttgtttcttttgcaggactgttaccacatcccctccgcaataacttttgaacagacctagagaggccaagcaaactctcaaactccagaagagtcatcaccttatctgatccaacctccttgggcatgccagttatactgctgtgtgcaccattgtggacaatatatctctttccagtatccgtatcccttatgcaacaggcaccgtcaaaatctgactcattgtcacaaacagatgaatccccggaagaaaggccactgacagttctctcctccatgtcagtggaagactcgacggctgtgatttcaccatggcattgaaaagaacctatcctcgtagacacgaaatcatcgagtctcattcccttcaggaacctttggcgcctttcttgaacactaattggttcgtttgcccaaatctcatactctaatttcattggccctgaaacttcatcacttgtgctgcaatcctctgaaaacgaaggttcccctgcagatagaacatcttcaaatgcatcgaagaaaacatcatcactgtctgattcggaccttggcatcttctatgaactcgattcagcaccagacagtgaattgacaaggaggggctctagcactcagtgaaggcagtggggtatcagactgtcatctgcaatcaacagtgcaaatatgaggctgtgttaaaggaggaaaaagggtggtaacgtgagaagaagacggagaagaaccgccgaaaatgactcccagcgaaattatgggcaagtgccaactgccaagtggacatcttttcaagtgaacttttccaaaggtaggtgatcttattccctcgcaccaaaagatacatacgactaggagcactaagcgaagcatggtgtagcaagttcaattactcaaaaaaaaaaagagtatacacaaagcaaagaatgaaggtctgcatacaatggaactgtgcaaaaccagagagacctaaaaggtttagttcggcagcagttcactgtttgcacctgcgaatgacaagaggaagaaattcgccgatatgggaccaaaaaagcagcatgtatagcaaaatactcagaaggaactgaaaatcctcactcgtggagcaatgcaaaccactaccattccaagcaaagcaagcaaatgctagtaatacagcagtgctcaccagagtccacaacactgaactgtcacaggttgtcaataataaagcaaaccaaagaaaacacaggcccaggctaaccaccaccaaactaatctggcggcgtaggttaacctatagagtaatcgccgcctccgtccggcactcctgacaatgctcaccaacaaggcaacaaactcgacacccgtacacttcaggccgccacacctagggaatcccaccggacggacgaagcaagaagaacctaacaacacacactgcatgccacacgggcggggagggcgggcggcacagcgaaaaacagcgcggaaaggatagcaggacacgaaagtaggggagcagtgcccgtagataggaaagcgggaaggggaggagcaggggggggcctgccggcgggcgccgcctcctattttgtctcctgcatctgcgcaccgcaggcgtaggggcgtaactcctctctctctctctgcgcctaccacggccattaaagttgccacctctcagttgagaggaacaacccgggcgcgggaaacgaaacgaacctactgttcctctgtttcggtcagagcnttggattactacgggagaaaaaatttgtgtgttttgtttgtgcttattacatgtataaattggagagtcgaagggcaacggggagacagtttcctttcttccctttttttccatacatttagaaaccgttcatgaaccgaaagagtttttactggtattgtgaattctgtaccggctacttctacttatacggtgttttatcactgtgccattgccccgtgagatcgaccgcctggacggaacagagaacagcgagaatccagagcgcgccactcacctactgcgagagccctcgacggccactccccaagccacccccgccgccgccgcagccgacgacgacgacgccgatcttctctcgccgccacgcgccatcccggttgcggtagggtcagaggaggaggaggatggcccgcccgactcggaggcgcggagtgtgtttggagggggcaggacgggggggaatgggaggcggggcttggggttggggaggcgcggattgtgcgcttcctgcgctctcgagtccggccggcggccgcctcgtttgctccggtcccaggtcttggtttccacggcatgcgctttttatgctgggctaacgccgacgcggtcttccgtttccagcaccagatgaacaaaagctgaaccgctgtctggccctggcttatgagctgtgataagagaattaggtggcagcgcaccagatgctgatgcgcgtgtgatccattccatttccatgctggcatgctgccatgcgctagtatatgtatgtataggtctaatctgccaagcgcctttgtaagaaacaaattaaaactggaggcgctggacgcgagtgggagttgcaagtggcgcatgtgagcgcaccatctctcgccgttctaaaaataaccataaccgtatcagggagagctgcccgcgtgatagg

SEQ ID NO: 16431 - DNA, 1655 bp, Zea mays
ggttcccctttaatcacatgttgttaattcaaccaaactttgttaacctcgaggacatattctgtgcaatcactcattttggtgcaagcgtgcaatcaaactatccagagcatccagtctagatccaacagtttcatatggaagtggttaaatgtaaaatagacactaggtttcaggtggaaggggttaaatgtaaaataatagttaccattagatctagatcggatgcactagatcgcttgattgcatgcttgcaccaggataagtgattgcataggatattttcccgttaacctcgtatctttaatactgcaaaatctagccggcaaaaaaaaacactgtccttctcaatagataaactaatgaccaaacgatcacaatgccggcaaatattttagcatcccacttactgcatgaagaacgggattacaaaattccccatcttctccttcctctcgagctcatccttctcagccatctgtttcagcgttgtccaacccttccttgcccgcttccttgagctgccagaaacctgagaagaatctcttgctgcatatttcacattatttctagagccattcgaggcagacttgctggagcctgagagggcgtcaatggctgagccagaaatcatgccacttcctgtcttgagtagtcctgctgaatcttttgcaacagtcaccaccggtggtttcattttctgaggcgtgacaaatgatgaaccaggtgcaagttctgcttgcaaagtagcttcacatatcctaaccttctcaggaaaaatatggctagtttcacgcatctgttcatcaagattacaatttaacctttcgccatgctcgtcactttcagtagtcgactgcctcaacagagatgacgattccacttgcaaaattgctgcttgagaaagctcaagcacttctttcttatcatgtgctcttgtgttgctaccgtttcctctcacaattatatgggatgagttcatggtagcatgccctcttgacagtaacaggctctgaacaacacccttcccactacccaatattaggttctgatctccacagaaatggcatgcataggaaacactgttctgacaacagtttgatttcttccgacgttttgctttatttctcttgttccttatgcggacagtgcagttgaagcctggctttaagattgtctcacacctctggcaaaggaaagtggcggcgttgaggggtactccggcggcctcggcgctcgcggcgaggcggcgccccagcagcgcgccgatcgggcgcaccccggcctccgggcccgcccacgccgctagcctctgcaaatgcttgaccctcagcagggaggcatcgtctacgcgcgtcctcccggaggtctcctcgcggagcgacacggcctgattcatggacctggccggcgtcgaggtgccatcggtgctgcgaatcttctttcccatgccgccgctggtgcaggacctgtgggtactctgtcagcaagaacggttgctagccctagcttgcgcgtctccggcggcggggatttttttacaagacggcaggatgggctttgctcatggcaagggtgatcaaagttgacccactggtccgcgcggctgaacgtcgtggcgtgttccgaccaccgatacagcctcgtgccgaatt

SEQ ID NO: 16432 - DNA, 781 bp, Zea mays
gctcgcccccgcgccggggaagatcgacgagcgcacggcagcctgccgtaaggcagcggatctggttccgtctggctggctcggcccgtcaagccggctgccggtaggagcggaggagacggcgtctcgccgctcgcttcgtttccgccttccccctcccgcaaagtcgccgccggctcgcattcgtggttccgcgtgggggtccggggaaacgcgacgagagaggcggaagcgatggcgaagtcgtgcaaggggttggccatggagctcgtcaagtgtctcagcgagacccactgcgtcaaggtgcagaaaaggccgtacaaggagtgcgctggggagaaggtgcccaacattaccagcgagtgcgttggcctgcgggagacctacttcaactgcaagaggggccaggttgacatgcgggcccgaatacgcgggaacaagggatactagtgatgtgcctgcaatatccacaatcagttttggtttctagccatgcttctgtgacattgaggtgtaatgataacatggtttagtttgcccgtgttctgtttttgataggtgaggggaactcacaacacacgtggcttcaattgatgaggggagtgcattcctgtctacattctattacatttgatattccctctgttttaaattgtttgacgttttgttactatgatctatgcgtgtagcaaaagttaatctatggtccgtttggtttagctgtagattcctgaaaatctaattctagccgtgaaagttgcagcgaaaaaaaaaaaaaaaa

SEQ ID NO: 16433 - DNA, 1577 bp, Zea mays
gccggccgggccgggaccaccggcgcctcgtctcttcccgtctccccagtccccactctcgtccccgctccctccaaaggcctcccccgacccccccccggccccaccaccactacatggcggcggcgctcgcctcctcccgctactgctggagccgcccgtcgctgccgccccaaccgacccgcggccgccgctccgtcactagctgcgcgctctccggacgagagaaaagaaactcctttagctggagagagtgtgcaatttctgttgcattgtcagttggactaatcactggtgcaccaacgtttggaccaccggcctatgcttcttctcttgaacctgttcttccagatgtgtctgttcttatctctggacctcccattaaagatccaggtgctttattgagatatgctttaccaatagataataaagctattcgtgaagttcaaaagccgctggaggatatcactgacagcctcaaggttgctggtgttagagccttggattcagttgaaagaaatgtcagacaagcatcgaaagcactgaacaatgggagaagcttaattcttgctggccttgctgaaccaaaaagagcaaatggagaagagttgttgaataagttggctgttggatttgaggagcttcaaagaattgtggaagacagaaatagggatgcagtagctccaaagcagaaagagcttctccagtatgttggaactgtagaagaagacatggtcgatggctttccctttgaaataccagaagagtacagcaacatgcctcttctcaaaggaagagctactgtggatatgaaggttaagattaaggacaatcccaacatggaagactgtgtatttaggatagttctggatggatataatgctcctgtgactgctgggaacttcgtagatcttgtcaaacggaaattctatgatggcatggaaatccaaagagctgatggctttgttgttcaaactggagatccagaggggccagctgagggctttatcgatcccagcaccggcaaaatccgtacggtacctcttgaaattatggttgatggtgataaggcgcctgtatatggtgaaacacttgaagaacttggtcgctacaaggctcaaacaaaactccctttcaacgcttttggaacaatggctatggcaagagaagaatttgatgacaattctgcttctagccaagtattttggctcttgaaagagagtgagctaacaccaagcaatgccaatatattggacgggcggtacgcagtatttggatatgtaactgagaatgaggactacttggcggacgtcaaagttggagatgtcatcgaatcaatccaagtcgtctcaggcttggacaaccttgtcaacccaagctacaagattgtaggataacgtgttttgtatcagagtttcttgtctgtgggtctctgtcctcaagtcgatgtaaagtgctatatagtatcttactcccatatccttctcgctcgttaacgagggtttgtgtcacgcggaattcgatagtaattgaaagtacagagtcattgattggtagtccaaaaaaaaagggcggcc

SEQ ID NO: 16434 - DNA, 2045 bp, Zea mays
gctccacgtcacgacgccgcatctaaccctccggcgactcatcgccggcgagccggtccgccacgccatagcctcgtccggacccccacgccggccggcgtctcgttcctctctcgcccccggtaccctccataggcatgggaatggggtctgcgagagggggcgcagggggatggctccccggcgagcggtggcggcgggtcatcttcctcgctctggcggccgtctcgttcctcatctcactcatactcctcttcctatccgcgccgcgtctccgcctcccaagtgtcgtcctgccttacaccaccgcttccgcttctgccgtccgccgcgggcccggcgagccgccctgcctggtgtacctgctgaccggcgcgcgcggcgacgggcgccgcctcctcaggctcctcctcgcggtttaccacccgcgcaaccggtacgtgctccacctctccgccgacgcgccagacgacgagcgcctgagcctcgccaccggggtcgtcgccgcggcgcccgccgtgggagcattcgagaacgtggttattattggcaatcccaccgccgggacgcccgtggggtcctccggactcgccggcacgctccgcgctgcggccgtgctgctccggctccacgctgactgggactggttcctcaccctcaatgccgccgactaccccctcgtcacacaggatgacctgattcatgtcctttcttctgtcccaagggatcttaacttcattgaccacaccggtgacgttggatcaaaagaacctgagaaagttcaacaaattatagtcgatgctggaatttacttgtcagggaggaccaacttctttcgaggaacacagaaacgagcagctcctgaggcttttaagttctttacaggttctccatgggtcatattaaaccggcaatttatagagtactgcattcttgcttgggagaatctccctaggattcttctcatgtacttcaacaatgtaatacaacctcaggaagggtatttccagacagtcatctgcaactcactggacttccgtaatttcactgtgaacaatgacttgaggttcatggtgcaagatgattccgctcagaaaaagtcccttttcacgagcagggaacattatggtcacatggtggatagtggggcacccttcgcaaggccgtttcaggagaatgatcctctgctggaccagatcgacggcaatatactcaagcgttggagccatggaccagttcctggtgcttggtgcacaggaaggaagaggtggttcagtgatccatgttcccagtggggcgatgtgaatgttttgagaccaggtcctcaagcagtgatgttgcaccaatatgtaaatcggaccttagaagaagcaaagtctagcagcaattcatgcaggcggtagcagcattggcgtctagaacctcatgtcccatggttgaaagctttgagctttttccgcttatccactaagggttctccactctgctgaataaatagctgccacatgtctaagctgaaacaagcactcgtcgcacctggaacaaagccatggagggatgttcttttctgatattttcatgatgactatcatagtcacggatcaggagtttcactttggtctgtgattaatctgtgcaatccccatatttggctcatataacacttccaggcgctgataataggctgaagcttatataactactgttgtttatatgttgcggttatttgttggacagcttatattcatgctagtagatcaagttacgaatcccttatgctcccctgttgtgaggactgtagactgtagaacaagggattttgttacttgttagtcttactgaattcatgttgtgctttggacttacataatatgcctagtcctgtattgtacctaaaatgagactccagtcatctcagtttacctttgaggggtgtttggaagcatattattatttgcagtttcaaagcaatactatggtcttttagatttaaaaaaaagggggggggggggggggggggggggggggggggggggggggggggg

SEQ ID NO: 16435 - DNA, 2810 bp, Zea mays
aattcggcacgaggcgcccacgcgcacaaaccaagacaaagttgcgatgctccatgctccacgtcacgacgccgcatctaaccctccggcgactcatcgccggcgagccggtccgccacgccatagcctcgtcctgaagcgcacttaatcctacgtctcgttcctctctcgcccccggtaccctccataggcatgggaatggggtctgcgagagggggcgcagggggatggctccccggcgagcggtggcggcgggtcatcttcctcgctctggcggccgtctcgttcctcatctcactcatactcctcttcctatccgcgccgcgtctccgcctcccaagtgtcgtcctgccttacaccaccgcttccgcttctgccgtccgccgcgggcccggcgagccgccctgcctggtgtacctgctgaccggcgcgcgcggcgacgggcgccgcctcctcaggctcctcctcgcggtttaccacccgcgcaaccggtacgtgctccacctctccgccgacgcgccagacgacgagcgcctgagcctcgccaccggggtcgtcgccgcggcgcccgccgtgggagcattcgagaacgtggttattattggcaatcccaccgccgggacgcccgtggggtcctccggactcgccggcacgctccgcgctgcggccgggctgctccggctccacgctgactgggactggttcctcaccctcaatgccgccgactaccccctcgtcacacaggatggtagggcaacactggcatctatgcatctctaaggaaaaaaaatctccttggttcaatctagtaggttacaaaagaacgacactcggtagtcttcttcctttattatatggaaattacaagtagtcttctagcgatgacattgaatggaaatgtaagttctctttgtttgtcctgactgatatcaaatcaccagccctcccgccatggaagagctgcacaaccagtcatgagtcaaccatgcacatttcatacgattccagttgcctattagtcacactgtcagtcttactttgcattgatagttgtactgtcaggaataatagattgaggctccccttatttattgataagtaatgcacatgccaaaacttgtgctgttgctatacttatatctgttaaagtgtgcacccaaacatataggtctgttgtagagcctgtgccaaatgatgttcatgattacaaaatttctgttatacatcactcttgaatgctataatatatcatggttattctggttctccaaataacttttatcttctacagaaatctgcttcggtgcttcattaattattccagcaagtcatcattgtgtgattatcctcattaattgatggagatcattataaatctttatgcttttccctgatgcagacctgattcatgtcctttcttctgtcccaagggatcttaacttcattgaccacaccggtgacgttggatcaaaagaacctgagaaagttcaacaaattatagtcgatgctggaatttacttgtcagggaggaccaacttctttcgaggaacacagaaacgagcagctcctgaggcttttaagttctttacaggcatttcttgctctctgtgcttgctttgttttcattggtcttaataatttcctcaccaatttatctcctccgtaataggttctccatgggtcatattaaaccggcaatttatagagtactgcattcttgcttgggagaatctccctaggattcttctcatgtacttcaacaatgtaatacaacctcaggaagggtatttccagacagtcatctgcaactcactggacttccgtaatttcactgtgaacaatgacttgaggttcatggtgcaagatgattccgctcagaaaaagtcccttttcacgagcagggaacattatggtcacatggtggatagtggggcacccttcgcaaggccgtttcaggagaatgatcctctgctggaccagatcgacggcaatatactcaagcgttggagccatggaccagttcctggtgcttggtgcacaggaaggaagaggtggttcagtgatccatgttcccagtggggcgatgtgaatgttttgagaccaggtcctcaagcagtgatgttgcaccaatatgtaaatcggaccttagaagaagcaaagtctagcagcaattcatgcaggcggtagcagcattggcgtctagaacctcatgtcccatggttgaaagctttgagctttttccgcttatccactaagggttctccactctgctgaataaatagctgccacatgtctaagctgaaacaagcactcgtcgcacctggaacaaagccatggagggatgttcttttctgatattttcatgatgactatcatagtcacggatcaggagtttcactttggtctgtgattaatctgtgcaatccccatatttggctcatataacacttccaggcgctgataataggctgaagcttatataactactgttgtttatatgttgcggttatttgttggacagcttatattcatgctagtagatcaagttacgaatcccttatgctcccctgttgtgaggactgtagactgtagaacaagggattttgttacttgttagtcttactgaattcatgttgtgctttggacttacataatatgcctagtcctgtattgtacctaaaatgagactccagtcatctcagtttacctttgaggggtgtttggaagcatattattttttgcagtttcaaagcaatactatggtctttaagaataaaaaaaaaaaaaaaaaaaaaaaaaaaaactcgtgc

SEQ ID NO: 16436 - DNA, 1556 bp, Zea mays
ggccggcccgcaagaaagctagtttgctgaagctgctggtgcttctgctatagtaatcataaaccatgtccacgaattgtacaagatggtctgcgaaaagaatgaaaccgaccttgacataaatatacctgcagttctcctaccaaaagatgcaggttctgctttacatacacttcttacaaatggtaacacagtttctgtgcagctttactctccagatcgacctgtagttgacactgcagaggtgtttctatggcttatggctgttggcacagtacttggtgcttcctactggtcagcatggagtgctagagaagcagttattgaacaagagaagctcctcaaggatggccatgaagacctactgaatgttgaggccagaggttctagtggcatggtagatatcaatgtggcatcagcgataatgtttgtggtggttgcgtcatgcttcttaataatgctttacaaactgatgtcttactggtttgtggagctactggtggtaatcttctgcattggcggtgtagagggtctacaaacatgcttggtggctctgttatcaagatggtttaaacctgctgcagaatcttttgtgaaagtaccgttccttggagccgtttcgcatcttactctggcagtttgcccattttgcgttgcatttgctgttgtgtgggctgtttttcgccagctcccctttgcttggattgggcaagacattctgggtattgcattgatagttacagtcatccaaattgtgagagtacctaacctcaaggtgggttcggttcttctcggctgtgccttcctgtatgatatcttctgggtgtttatctccaagagatggtttcatgagagcgtgatgattgtggttgcgcgtggcgacaagaccgacgaggatggtgtgcccatgctgctaaaaatcccgcgaatgtttgatccatggggtggatacagcatcattggctttggtgatatccttcttcctggtcttttagttgctttctcgctaagatacgatttttctgcaaagaagggcttacggtctggttactttttgtgggcaatggtggcctatggctctggacttctaatcacatatgttgcgctgaacctgatggatgggcatggacaacctgcccttttgtacatcgtgcccttcactcttggcaccttgatcgcgcttggatggaagagaggggagctgcagaacctgtgggcgaggggagagccagagagagtgtgcacgcatatgcatatgccgctgctgccgacgaccccaaactaaccacagggtcagtagaaaatcagcaagggttcctagcttctgcaaaatattgtatttgcctgctggtaatatgcaaaccaaatcatgccagtttaaaaggaggcactgcttcttggagacagcaaagtctgattgtgagctaactgctgcccaatgtgcagccatgcatgtatgtaacagcacaacaataaattgagcctgtcgaacagaaatgtatgagccgtgcatagcagcagcataaaaataaactaaaaacttttttatttttttt

SEQ ID NO: 16437 - DNA, 7445 bp, Zea mays
  misc_feature (1629)..(1629): n is a, c, g, or t
  misc_feature (5358)..(5358): n is a, c, g, or t
  misc_feature (6024)..(6024): n is a, c, g, or t
  misc_feature (6333)..(6333): n is a, c, g, or t
gacaacagaacaatgagctagcgaactccagtatactctactccagtagcaatgtagcattcctttaatttgttgtccattaactgacaagtgactaaagaccatcccttatttttggcgagtccggcggatctcggttccaattccaacaccgacacgaaaggctcctacttgctgcacatatatgggtcccgcctcgccgcccggagccggcattgcattgtgcattgcattgcataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatcccggacctacacaagaagccgctcccggacgtcatctgcgcggccgtgaaccgcaccgaggacgtggtggtcgccacgtccagcaactgctcgtactacctgcaggacaggtccctgtcggcgcgggaccgcctggccatcaacgactgcctggagctgctgtccaccacgatggacgagctccgcgccagcaccgccgacctggcgtcccccgccggcagggggtcggcgtcggcgggcgtgtcgcagggcgccaggcgcgcgacgatggagcacgtgatgacggtgctttcggcggccatcaccaaccagtacacctgcctcgacggcttcgcgtaccagagcggcgggcgcgtgcggcgctacatcgagccgaccttccaccacgtgtcccgcatggtgagcaactcgctggccatggccaagaagctgcccggcgccggcgcctcagcggcgccagcgccgccgcggcagccgttcacggggtacgggcagatggtgaaggggttcccccggtgggtgcgtcccggggaccggcgcctgctgcaggccccggcgtcggccgttgccgccgacgcggtggtggccaaggacggcagcggggactacacgacggtggcggcggccgtggcagccgcccccaccaactcgaagaagcggcacgtgatctacattaaggccggcgcgtacatggagaacgtggaggtcgggaagaagcacgtcaacctcatgttcgtcggcgacggcatcggcaagaccgtcatcaaggccagccgcaacgtcgtcgacggctacaccaccttccgctcggccacagtcggtaagtacactgctactatgtttgagtgcttaattacattctaattgctcgcatcgcatcgcgcattaaattaaacgacccgatccggtactgcctgttgtgttgacacccgaatccaattcaccagttcatcattgcaaaagcgcatgcagtgtttgtactagtgggcagcacccactcgctactctgtcctgaaattttttttatctcggagcgaaaagtcagggaagaatttttttttttttgggggggggggggggggggcgtanaacaactgcataaagttaccgtaaaagagagatagagagtataaaagtataggaggaagcatgcatacaggagtatatcttagctcctaagtactgtaagtatattgcctgtgttggcatggtatttcacgggctgctaaatttctgccacgagtggcagcaagcacatgtgcagcttttgctgctgcgctggtccaaatagcaccaccaccgccggtctaccccaccgatcgatttggctgctagctagcttctttcgccgctgcaatttcacagtacaaagagcacgaagcataccgcgtgtactagattctttcgcttgccgattatatactgtgcgtgcgcgtgcgcgtgcacgcacgacggcacgagcgatcgagcatgctgaggagggagaggagaaaaggtgcatgccagcgccacacagatcctccatgcacgaggacgcgacgtgtctatccatctctgtcgtccgtccgtgagccagagtgtcggtgtgtgtagacgtgcgcgccagcattccattctagtgcgggtttgctggcggcctgcctgcctgcctgtgacaatctgaccccaaaaataaaatatcaccggttctttttttttcactaagcgctaaacgctaatttgggagctctatttttccaaataatttctattttcacaagaggaaataaactaatttaccatgagaaaatgaaaatcccttaggataatgtggtttctaattagccctaataagtcctactaattctcgattagttcttgtcacgacgtgcttaggtaatgtttatatattctaattggcgttcaaaactataaactttattttagtctatccaaaataaatattgtcctcaattccagaacgaagtggttggcaatatcactggcagtgcacatagtaatggcataaatgctgctgtggtactggtaggtgtagggccgtatatccccatcaagattaagtaataattagccgagcagcatcttcatgcatgtggcggggagagccaggcagccagggccagggccatcgacgaattgaaaggcggggcgctatgtatgtagtacgtacattgtacacgatacatacattattggctgctcagatcgcactagtactagcctccccacacgctgcatatgcggcacacacacagatcagaaaataattaaatctggctatacctgtccaagatcacgtccttaattaatcttccggaccagccaccggcaccagcattgtactgcgtgctgcacgctagctacctagcttttgtgcatatatacgcacaagagaacggacaacaccggtatataatatatatacatatatatagtacagcagtggtgcagttgatagccagtaatgtaaaaactatactagtgtcagtgtatgcatgatggaatcctgcaattaaattttgctagtaaagcaatgtgaaactatatatacagatgtgttgctgcatgcgcagacgaaaggaacggcacccgtacgtgactatatatagctacagtataccacagtacacgatcatggcatgggagtcgttagtatacggaacatagcatgcatgtgcgccctcaccgtactgttccggacgtatacagatatacgcataggcatgcatgccatttagaccgactcccacaagaatgtcaaaaaatatatccttctctactgccctatatatctaaaaaaagattacttttctatctataaatttcaacgctgttctctaaagcatcctatatatatatatatagagagagaacactcgttgatatcctctgtatattaatcggagagtctctcttttcttattatccatttgtttttatactttaaacaacagattaataaaaaagtggaatctatatatagaggaatgtgtagaggagggatatagaagacatgtggtttagagacagctttacattttactcctactgtagtacagagtaccggtactacagtagtgcccaggggccgagggcccattgtggctacgtatagctcaagccatacctaattgagaaaggtgataatagtcacaaatcatataatccataattcgccttttaagtattaagaagtcatttaagtagaatgataggcaaattcaattgtctaggtctccaagacccacctagcaaaattatcagtataacattgtattatcaaatttttaccgtgcacatgtttcttaacaatttattctcattttacataatgttctacttttatatatgtttgtgcatttttattctgcaatttaattagttgtgtgctaaatattatacgacgtagagccataccaaaaaaaaaattatacgtcgtccgccactggtagtgccattcataaacaggacagtctatacgtacgtactgcgttcttgtctgctgctaaaattaactacactgtgcgaacgaagaagtcggtgcttaccatgtcacccgtagcatcgtgctatctgtacccgactaggacgggccatgcaacggctgcatccggcatgcgccgcggcccgcagacgtacgcggcgcccgcggcctgcctcgtgcgcgtccgcatcctgccggcatgtggggccgcgcacagcttctttgcatgcagccgctagtcgtcgacccgtcccgtcccgtccctttcgccctgctggcctgggtggccctgccgtcgatgattgcggactgaatgcgattgaaaagctctcaatctgaccggggcgttatctgtataacgccggatcttttctccctttgtaaaaaactagcaaaaaaaaaaactgtaggaacagtatgtagttcggtcatccggacggacacaatcgaagctccaaaaaaatactgtattaaaaattcacgtcatacattgctatttattttgggatctaactgatctataacgtgccaactacgaatgacaaataattcctaggaatctaattgaattaggatttttacgaaacgaattataaattgggacggaagaagtattaaatatataaataaaagaatgccgttggatcaaactatagttcttagcaaacaaaggtgggttctaggtgctattgaatcgttccacgtgccactatattaaacatgggctaacaatctagggtatataattgttgggccatgtaatttcgtaactaaaatgagctaaaagcgcctttatttatctttgtagtcatacaatatatagatactatgaatgcctattttgttgtaaaattttaagaattaccccatatgtttttacacacacaaaaatatgtattttgttgtgaaatatgtgttttccacacaaaaaaagagatttgtattgagaaaacgttgcaaaaattcatagatttgagataatataatgtcgaagaaatattaaaaaatatgtatatacattgaagtcctggcaaaattaagttgtgcttgcgtgatgattgtgtttgttgtgggatgcagctgtggtgggcaacaacttcttggcccgcgacctgacgatcgagaactcggccgggccgtcgaagcaccaggcggtggcgctccgcgtgggggcggacctgtcggcgttctaccggtgcagcttcgtggggtaccaggacactctgtacgtgcactcgctgcggcagttcttccgcgactgcgacgtctacggcaccatcgacttcgtgttcggcaacgcggccgtggtgctgcagggctgcaacctgtacgcncgcaagccgctgccgaaccagagcaacatcttcacggcgcaggggcgggaggaccccaaccagaacacgggcatctccatccagaggtgcaagggtggcggcggcggccgacctcgccgccgcccagtcctccaccaagacctacctgggccgcccatggaagcagtactcccgcacggtgtacctgcagtcggagctggactcgctggtcgacccggccggctggctcgagtggaacggcagcttcgcgctcgacacgctctactacggcgagtacatgaacacggggcccggcgccggcacgtccgggcgggtcaagtggaaggggtaccgcgtcatcaccagcgccgccgaggccagcgccttcaccgttggcaacttcatcgacggcgacctctggctcgccggcacgtccatccccttcaccaccggcttgtgagcgcgcggcggtatgtatacgaggggtttcacggcaagggatgacaataaaccaaattggcggcggcggaagttcgtcgtttgtacgttcgttcatttcaatcagagctaaaaaaaaggcaccgtatcgatccggtcgatcgtgttactgtagttgattattttgtgcttggggacgcaggccaatatatttatttaatttaaccgtcccatatatatgtacacgtncttgttatgattcggtgtattatttatatgtattgatacggtatcaatatataattaataatgatacgggttctaataacgcacagtacttttccgtatattttcagcccgcctatatggtagtgggacaggttctctactgcatgctgaataggagtgagtacgcagggctgcagtgctcacggctcatgaacaaatgcatcctgccttgcgcgtgcatgcacctaaccatggatggatttgtgtgcttgccatgtgttagcctcaaaatgagaagcggaccgtggtgttacgataattaaaatcttngcatatcataatctgtacttgcaataacttgtttgatatatctagaatgtatttactaggtcaaaaattttcaaaagtgtgatgattatgtattaattataggacttagtttgacaaccttgctcgacttaaatgggagtaaatcgtctcttaagcaagtgacaagtttgtttgaagtcttcaagtgctaaaggtaacacttagaacttagagcaactttgctttctaaggtaggtcaagtggaagaattatttgaggggcgggattaacctcaaaaccctaagtgagatttgaaaaccttgttggaattatggataaacaaaacttcggttttcattcagatttgaaaagctgaaaataatataaactagtcaactttgaacccttgtaacttttgttctataaacagttgaaaatgattactataacagagctatagagctacatgaggagtatcagtttggttaagtcacttatccctaaagatattgggaacttggataaaaactggtttaaagtagagatgtcagaaagtgtggatttcagacttagtgaaaacttagggtctaaatttcagtgtttagtgcaaattttgggcctttgtaatttggaatccttgtggttttagttaatggtcactatgtcaaacttgtatatgaactttaggagtataatctttattaagaaacttgtccctaaaactatatgctactaggagaaaagttcgtccaaaaaggggttgacagatttctgagttttcatattgaaaacagtaactgaactgattttcagtgttttgagtgttgttttaaagcctacttgcgcctaatccataaggttgtgaactgtgatgtttataaaggaagtgaagaacatatgttggtgaacaactttcattaagtggatatagcttgattctacacaaaaagtggagaaaaggttggcttaagttggattgtcaggttagctgtgattgagtttgttcagttcactaaactctaaaaatcagtaaatggtgcaaagtttggagctcagttgtgaccaaatcatggggttttggactaataactatatagcaaagttggataccaaagtatggtgagcaagttttc

SEQ ID NO: 16438 - DNA, 2533 bp, Zea mays
tgcagacaacaacatacctagcaaacagccagccaccatggttgagcatgtcaacctctggactctggttcagatgacaacagaacaatgagctagcgaactccagtatactctactccagtagcaatgtagcattcctttaatttgttgtccattaactgacaagtgactaaagaccatcccttatttttggcgagtccggcggatcgcgggtccaattccttcaccgacacgaaaggctcctacttgctgcacatatataggtagggcctctctacatagaggtggcattgcattgtgcattgcattgcataaacctctcgtgggaagtgcaaacaccaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatcccggacctacacaagaagccgctcccggacgtcatctgcgcggccgtgaaccgcaccgaggacgtggtggtcgccacgtccagcaactgctcgtactacctgcaggacaggtccctgtcggcgcgggaccgcctggccatcaacgactgcctggagctgctgtccaccacgatggacgagctccgcgccagcaccgccggacctggcgtcccccgccggcagggggtcggcgtcggcggccgcgtcgcagggcgccaggcgcgcgacgatggagcacgtgatgaccgtgctttcggcggccatcaccaacccgtacaccctgccctcgacggcttccgcgtaccagagcggcgggcgcgtgcggcgctacatcgagccgaccttccaccacgtgtcccgcatggtgagcaactcgctggccatggccaagaagctgcccggcgccggcgcctcagcggcgccagcgccgccgcggcagccgttcacggggtacgggcagatggtgaaggggttcccccggtgggtgcgtcccggggaccggcgcctgctgcaggccccggcgtcggccgttgccgccgacgcggtggtggccaaggacggcagcggggactacacgacggtggcggcggccgtggcagccgcccccaccaactcgaagaagcggcacgtgatctacattaaggccggcgcgtacatggagaacgtggaggtcgggaagaagcacgtcaacctcatgttcgtcggcgacggcatcggcaagaccgtcatcaaggccagccgcaacgtcgtcgacggctacaccaccttccgctcggccacagtcgctgtggtgggcaacaacttcttggcccgcgacctgacgatcgagaactcggccgggccgtcgaagcaccaggcggtggcgctccgcgtgggggcggacctgtcggcgttctaccggtgcagcttcgtggggtaccaggacactctgtacgtgcactcgctgcggcagttcttccgcgactgcgacgtctacggcaccatcgacttcgtgttcggcaacgcggccgtggtgctgcagggctgcaacctgtacgcgcgcaggccgctgccgaaccagagcaacatcttcacggcgcaggggcgggaggaccccaaccagaacacgggcatctccatccagaggtgcaaggtggcggcggcggccgacctcgccgccgcccagtcctccaccaagacctacctgggccgcccatggaagcagtactcccgcacggtgtacctgcagtcggagctggactcgctggtcgacccggccggctggctcgagtggaacggcagcttcgcgctcgacacgctctactacggcgagtacatgaacacggggcccggcgccggcacgtccgggcgggtcaagtggaaggggtaccgcgtcatcaccagcgccgccgaggccagcgccttcaccgttggcaacttcatcgacggcgacctctggctcgccggcacgtccatccccttcaccaccggcttgtgagcgcgcggcggtatgtatacgaggggtttcacggcaagggatgacaataaaccaaattggcggcggcggaagttcgtcgtttgtacgttcgttcatttcaatcagagctaaaaaaaaggcaccgtatcgatccggtcgatcgtgttactgtagttgattattttgtgcttggggacgcaggccaatatatttatttaatttaaccgtcccatatatatgtacacgtgcttgttatgattcggtgtattatttatatgtattgatacggtatcaatatataattaataatgatacgggttctaataacgcacaaaaaaaaaccgtatattttcagcccgcctatatggtagtgggacaggttctctactgcatgctgaataggagtgagtacgcagggctgca

SEQ ID NO: 16439 - DNA, 1997 bp, Zea mays
tgttgtaacaatacatattggatggagtaaacaacaacatcagttagtcaaataaaaaaatattatgcggagagcgagacaatcaataaaaaacattgagatttttttggtagataatttacgtgggtattgttgtgagccgtcgcaatacacgggcaaccaactagtagacatttaacaaacgaaaacaacatagaccaatcaatcaaatattgagagaaaaatgtagagttttcggtgccctaggggagcctgagaagacacataaaccaaccaacttttaatttggacatttgggaggtgtcattttaaaaaatttaaaaatttcgtctgataaaaaatatagaagatcacaggtaaagagggaaatcgggtttatcgaattccgtgtcgccgataaagttttccaactgatcatgatgggaatacgaatagcacaaaaacagaggtacatggaaatgacactatgagctgacatgaagatttgggattttttttttttttttgaaggcaaagacgaagaattatttgcttattctcagctgaatcgagacacttacaaatccttcaaaacaaataatcaaccttgcacacaagaatatcaagaagagaggaacaagaccgctcaatccggagaacgcaaaattaacacacttagaatttacttgcaagaactccaaaaggctagcttgctagcttggctgcacggctttcaaggagtggccagcagcagcagtggtcatcagcttctggtcctcatcatcgaactggacccacaccgtgctgatcgtggtctccatcttgtgcgcgaacggcgaagcaccactgtcgatcgcctctgcttcaggtttggcttcgacctcttcaggatagccatcttgttccgggatcgggatcatcgtcaccggctccatcatctccagcgcaaaggcctgcgctggcgtgacgaccctgacgagcgggtactcgaggctcgtgctgctcgcgttactcctcttgcacttgaggtagaactccttgagctccggcgtctgggcgcacgccttcttcagtatctcgtgagcggtgaccctcgaaggcttgcttagcccggcgaggctcctcgacagcagcagcatgacgtcgacgcattccgcgaaggcaacgtagaccttgaagctctcacggagcacaatgccgaaggccgaccgcacggcggcgctggcgctcgtgttgttgtccggcagcagctggatggcgaggtctagcaggctctggcacatagcgagcttggacaggagcgtctcggcgctggcgtcgtgggaggaggaggaggaggaggaagaagaggaagagaagtgcgggggcttgccggcgccgtggtcagtctgtggtgtcatccgcgcgggctccaggttgccggcctggtttatgacccactgcatgcgctcctcaaggtaggccgagtagccgtggacgaaggcgcacgctccgctggcgaccgccgcacccgtgccggcggtgaggggcgagcagggcgcgtcgacgcggagctcgcgggaggcccagagtccgcggaagtcctgctcgaaatatcggtcgccggcgcggaggaggcggtgcacgaggagcaaggaccggagcgcggcggccggggcgcgtgcgttctcgaggcgcgccgtgatgcggcgggagaggaaggtgatcgcgcccggcgcgttggagacgaggaagaggatctcgtggacgtgcctgtcgtcgttgacgcctcgctgctgccggtgcaccgctcgatggccgcttcgatgtcagtgaggagcgctcggtcgggaactgcggccgccgaggaggacttggtggtggtgccggcgggatccatgagtgagcctattgctgcccaaatctttcccttgaacaccttcatgtcttatatgacctcatgagtaaatgagagagtagagagggggagaagaaagagatatttttcgattaggatgttctaggtaatggtctcgtgc

SEQ ID NO: 16440 - DNA, 1379 bp, Zea mays
gtacaatgataggggttaggttgcatatgtaccatgcttaaagaaaatgcaggctgcgacaaaataggtggtatactgcatgcccgcgtagaccgggctttcgaacggcactgcatgctacacttttttttacttttctagatatgtttttacctatatatgaacgtataataaaaactgtgtatctaaaaggccaaaacaatccataatttaggtagagagcatggacattacatggcataaaaaatcaacaattagtctatgcacgatctcctccccagtaccaagatagacgggcgaataataaaatcgcatgcttccattagggttcaggtaaccttggaatcaaatacacacttcagatagccgtcggatgccgcttccttactgtttgcaatactcaagtcacagcgccatctcaattgccaacatggactaacacaaacatgatccggggggaaaccatcttaacttgtatgtaacagtccaaatcccccagcacaccaaataagcatatcaacgtcatgttacagcccaaacaacacgagactcccacaggatgtgtgatgctcatgaccttagccttttaaggtccctttcatcacgatcatagttccggtgctcatgcgcatcctttctcttccgattgtcatgctccggagaatggtgttcctgactgtccatggatagctcaccctcttcggtattctcacggtcggtgctccgggtggtctacacggtgtgaaggatgaggccagctctgccttctctcctgcttgaccttctcatcctcaaccgccaactccacgccatgttccagctccctctcaatgaggtcatcatcatccatcacatcaacctttctcgaaaggtcaccttttgatctccgcttctccagggccgctttcaccttatccttgtttatctttttcattgcatccatcatcgaggctgacacgttgggaccctcgctgctgttagcactgtcatcccttgcttcatttgggggtaccctatagtttcgcttctccggatgagggtgatcatagccatggtggcctgacatgttctgctggctcgattgcctggttgcttggttatgttcatgggcaggaggttcatcaactactcctggaactttacccagagcacgttgattcacagcagttacagaactgccttcagtatcattaccttgtgatggtggtggttgaacacggttctgctcatagagttccaacatctggttgctaacctcttccaactgccgcggagttacatcaaactcttgccaccagaccttctcgccatctgatggaagcttgactttaagaaacttcgcagccaggaagattgcgccggcccctgggtggtgcggt

SEQ ID NO: 16441 - DNA, 1141 bp, Zea mays
  misc_feature (887)..(887): n is a, c, g, or t
  misc_feature (889)..(889): n is a, c, g, or t
  misc_feature (970)..(970): n is a, c, g, or t
aggccaaaacaatccataatttagggagagagcatggacattacatggcataaaaaatcaacaattagtctatgcacgatctcctccccagtaccaagatagacggacgaataataaaatcgcatgcttccattagggttcaggtaaccttggaatcaaatacacacttcagatagccgtcggatgctgcttccttactgtttgcaatactcaagtcacagcgccatctcaattgccaacatggactaacacaaacatgatccgtggggaaaccatcttaacttgtatgtaacagtccaaatcccctagcacaccaaataatcatatcaatgtaacagtccaaatcccccagcacaccaaataagcatatcgacgtcatgttacagcccaaacaacacgagactcccacagaatgtgtgacgctcatgaccttagccttttaaggtccctttcatcacgatcatagttccggtgctcatgcgcatcctttctcttccgattgtcatgctctggagaatggcgttcctgactgtccatggatagctcaccctcttcggtattctcacggtcggtgctccggtggtctacacggtgtgcgggatgaggccagctctgccttctctcctgcttgaccttctcatcctcaaccgccaactccacgccatgttccagctccctctcaatgatgtcatcatcatccatcacatcaacccttctcgaaaggtcaccttttgatctcctccgcttctccagggccgctttcaccttatccattgtttatctttttcattgcatctatcatcgaggctgacacgttggaaccttcgctgctgttagcactgtcatcccttgcttcatttgggggtaccctatagttttgcttctcngnatgagagtgatcatagccatggtggcatgacatgttctgctggttcgattgccttggtgcttggttatgttcatgggcagnaggttcatcaactactcctggaacttacccagagcacgttgattcacagcagttacagaattgctttcagtatcattccttgtgatggggttgtttgaacacgggttcttgctcaatagagtttccaaaatctggtttgcataaccctccggtaacgccgtggggtcgaac

SEQ ID NO: 16442 - DNA, 1677 bp, Zea mays
aaaagattgtacactactcgtcagatgacaactcaaacaacgtcagtcccactgctgctaaagctgagcccccagacccccagcagctagcagccgcctcctcgtcaggcccttcctccttcaccctcgccaaacccgcctcctccggtccgaactccgtctgcttcatctgagcgtccgggaggacaaaacacgcggcgaggaccaggatggcgattgtgcgggaggaggcagtggacacgtccatcagcccaagggtgagcgcgctgcggccgtccaaaaccatggccatcaccgatcaggccatggcgctgcggcaggccggcgtgccggttatcggtctagccgcgggggagccagacttcgacacgccgcccgcgatcgcggaggccgggatggatgcaattaggaatggttatacaagatacactcctaatgctgggactttggagctgaggaaggctatttgtactaaactccaggaggagaacggggtatcctacctcccagatgaggtgctggtgagcaatggagctaagcaatgcatcacacaagctgtgcttgcagtttgctcacctggtgatgaggttttgattccagccccatattgggtcagttatcctgagatggctagactggctgatgcgactccagtgattcttcctacaaacatatcagagaatttcttgttaaggccagagttgcttaccgacaagatcaatgagaaatcgaggctcttaattctctgctctccatctaatccaacagggtcagtatatccaaaggagttgcttgagaaaatagctgatatagtcaagaagcatccgaggcttttggttttatctgatgaaatttatgagcatattatctatcagcctgcaaaacacacaagctttgcttcactacctggaatgtgggaaagaacattaactgtaaatggtttttctaaggcttttgcaatgacgggttggcgtcttggttaccttgcagcccctaaacattttgttgcagcatgtggaaagatccaaagccagttcacctcaggtgccagcagcatatcacagaaggcaggggttgccgctctgaatcttggctatgctggtggtgaagcagtatcaactatggtcaaagcattccaggaacgccgtgactatcttgtgaaaaatttcaaggaactgcctggtgtgaaaatatcagaacctcagggtgccttttatttgttcattgacttcagcgcctactatgggtctgaagtagaggggtttggcactatcaagaattccgagtccctttgcatcttcctattagagaaagcacaggttgcccttgtccctggtgacgcatttggggatgacaagtgcattcgtatttcatatgctgcatccctaactacacttcagactgcgatgtcaaaattaaaggaagctgttgctctgctcaagccctgtgttgctgcgtagcaagatcactaaattgcaataaggagtgaccaaggcacctttaactaacctttcacattattttaaacacaatgttcgaattgttgggcagacttggtctgttgtttttatatgtaacattatggatttatgatgtgtacatgcaaataaaaatgttttgtttagaaaaaaaaaaaaaaaagccgcccgaaaaaaccgaggagaaggtgccggtacc

SEQ ID NO: 16443 - DNA, 2457 bp, Zea mays
cctcgaggccggccccgcccggaccactgttcggcagtgctgtcaccgctagcaactgcagtgtgtgagttcacagcttagtgagcagctcctgaggctctcggaggtgaaaggtgacgatttcactagtatgatagagtagatcaagcacccttttgttcaatccttcgctcaaatcggatccttttcctgccatccttttcacccttccaaatcgaccaagaaagctcatccagtttttgggggggatcacctattttggagtcaccttgccgtcgtcatcagccaatttactcacacacctgacggcctgcatgccatcaatgctcgctcccctcccctgatgactgaggtgtttatcatgtgagagcctctccgttttggcgtcacaggaaacccgctctcatggtccactgctggtggagttcggctggagttcatttattcccaatatttcagcttcggcttttggaggtccacaaattctcgagttgttgggaaaatcgggctggcctcttattagagcccttttggcccttgctcctctttccagcagaggtttcaacttctctttcccccctgaggtttcgtgagcgcagcagtaaggtttctgaaactgttcttggaggtttgctctcgccggtttccactgtccctgctttatctgcctgggacggctccaagatctgagcttgggggcgttcttggtgcaaagcggagcaatccaccaaaccgccccgggatttggagctggaataatccttccatgggttcccggtccggctgtggagcggcgatggcggcggccgcggccgcggtgttggtttcttggctgtgcttcgcggcggccggcgtcggcgcgataggggcgaactggggcacgcaggcgagccacccgctgccgccggagacggtggtgcggatgctcaaggacaatgggttccagaaggtcaagctgttcgacgccgaggagggcaccatgagcgccctcaggaagagcgggctggaggtgatggtcggcatccccaacgacttgctgtccacgatggccaccagcatgaaggccgcggagaagtgggtcgacaccaacgtctccagctacctcaacgacggcgtcagcatcaggtatgttgcagtcgggaatgagcctttcttggagacatacaacggaagcttcctgcagtccactttccccgccatcaggaacatacaaggcgcgctcataaaagccggcctgggcaaccaagtcaaggtgacatgccctctcaacgccgatgtctactcctcgacgacctccaagccttccgacggggacttccgcacggacatccacgacctgatgctgaccatagtgaagttcctgagcgacaacggcggggccttcaccgtcaacatctacccgttcataagcctctacatcgacccgaacttccccgtggactacgccttcttcgagggggcctcgtcgccgattgtggacggctccttcacctacagcaacatgttcgacgcgaaccacgacacgctgatatgggcgctgaagaagaacgggttcgggaacctgcccgtgatcgtcggcgagatcgggtggccgacggacggcgaccggaacgccaacgcccagatggcgcagcgcttcaaccagggcttcatgacccacatcgcctccgggcggggcacgccgatgcggcccggacccgtcgacgcctacctgttcagcctgatcgacgaggacgacaagagcatccagccagggaacttcgagcggcactggggcatcttcacctacgacggcctgcccaagtaccagctgaacctggggacgtcgaacgcgggcggcggtctcgtgagagccaagggcgtgaagtacctcgagaggaagtggtgcgtgctgaagccttctgtgaacctcaacgacccgaagctcgccgacaacgtgggatacgcgtgctccatggcggactgcaccagccttggctacaagacgtcgtgcgggatgctggacatccgcggcaacgtctcgtacgcgttcaacaactacttccagaagaacgaccaggacgacgtggcctgcgggttccagggcctcgcgacgaccacgggccaggaccccagcaccgggacctgcaggttcggggtcatgatcgaggtcgactccgccttctcgtggaggctgcaggggcttgggagcaacctcctcctgttcctcctgcttggggttctccagctatccctgtccttctcttagacgcagaggttctgcgagggatgggtggggtggcagtgagcgcataaacagtctgacaacagcttgaggatattagatgtgtgttgtcagtgccattcatttagaaactctttcctctaaaaaaaaaaaaaaaaaaaaaaaaaaaaaaaaaaaaaaaaaaaacccacgcgtccgcggacgcgtgggcggacgcgtgggcggacgcgtgg

SEQ ID NO: 16444 - DNA, 5925 bp, Zea mays
  misc_feature (4121)..(4121): n is a, c, g, or t
  misc_feature (4159)..(4159): n is a, c, g, or t
cacaccatcagcacgctattataatctataatacatgagttagaacaccaaagggcaaaccataccttttcttttcttttttaacaaaaaaatgatgaaacgcttaagtcctaaccaataaacaaatgcccaccagactcagctcttgtttttgtttaccatatcacgtagcatccacgcagctctgcgaactccaaataaagtagggtgggattgattatttaaactctgcaaagtacaaaaatgaaaggtttagaaatcagataggtagaaaagatagggaggtcaagagtgagatagtccatgcaccgtgtccacacgcctccatccctgctcgtgcaccacaccttacccttccctaaaccaaacaaaaaaatcgagtctttaatcctcgccagaggccgtaaagcccccctccttcctccctccctccatccctccccctaccctgcccccacacacacaccgccgcgtccgaccccctacgccgtcgactgctcggccggtcggctccgatggggtacgtgctgtcggcggtgggcagggtgctggagcagcccacggcgtggggggcggcctgggagatggcgctcctcgcggggcccctgtgggcggcggccctcctcggcctgctgctcggctgggcctggcgcccgcgctgggcagccggcctcgtcgtcgccaccgcggacgacggcggcagcgccaccaccgccgccgccgccgcgcagccgcccttcgccacgctcgacttctggaaggcccagctccccgcccgcctccgcgccccgctcggcaccgccgtgcagcagagggagggtgacaaggacgccgtgcaacggaaccgcggaacggtggcgcttggcaggtcgtcggagacggagacggcgacggcgagagaggagccggtggcggtggcggtggggatggccgacctggtgaacctctggaggctggtggagggcgcggacggtggcccggcctggaccaagatgatggagaagtcgctgcccaccatgacgtaccgggcgtggaggagggacgcccaggtgagcggatttttttttcacgagcctcagcgtcgtgtttttttttattacttgatttcatgttcatgtaacgattgaattttatttttatctggatgaatattttgtagaccgggcctccgcagtaccagagcagcagcatcttcgagaacgccagtccagaggaggtgagggacttcttcggggacgacgagttccggatgtccaacaggtgggacgacatgctcatctaccacaagaccctggaggagtgccggaccactgggacgatgaaagtgcattgggtccggaaggtaaataataaatagcgggcctctctggctgactcatcgcattgtattgtatgactcatctcttgcgctcgctgtcgcagttccccttcttctgcagcgacagggagtacataatcgcccggcggatatggaagctggggggcgcctattattgcgtcacaaaggtaaaactagacttggaaaaaaaaagaactactgcgtgttgttcttgtttggggatattgattccaggaggtagtggggtttatgcttgatccctgatgcaaaagtactatacagtttcttggatgaactttgacacatggcctgttggctatatagcttacgcttcatgcagaccgtaatctatgctgtgtctgtgttgcccgtcaactaataactccagtttggaataggcacaaggcacacagctttagaagtgcagtggcctgtttgttccctaatcctgatatttcttgatggctatgtgtgcccaatgagactgacctgaggcaacctgtccaccacctgcggagtacacttttgacaccattcaagttctgatgttagtgctgagttggtggcagcggagtctccaatcctttccatcaccattgttccttcgaaagcaagctatgcacgcaggccatcagcattgcgcaaaatacaatgcccaactgttgacgtgttggcaatgtgattgatatatgcgcagggcataccatgctcatccattccacggcgtagcagacctcggagagtcgatctgtattactcaagctggtgcatccgcgcaggtaaaccattctcctcgctcgctcgctcgctcactttgctcgaggatggtgaccaataaaaaaaaagatgaactaagaactcgatgtttcgcgaaacagtggagtccaggagagggaacggaggaggaaggggggcgacggcctgtgaggttctgctgttccaccacgaggacatgggcatcccgtacgagatcgccaagctgggcatcaggcaggggatgtgggggtgcgtgaagaggatcgagccggggctccgggcctaccagcaggcgcgggccgcgggggcgccgccgtcgcggagcgccctgatggcccggatcaacaccaaggtcagcgccgacggtttcactcgccagtcgtcgtccagttccagcggcggcgacgggccggagaccgcggacgacgcgcaggagaccgagaacaagaagcccgcgacgaggagccacgcagcggcgaggctcctcgtgctcggcggcgcggtcgctctggcctgctgcacccttgaccaggggctcctgaccaaggctctcatcttcggcgtcgcgcggaggttcgtcgggcagaggaagacgttgtagcgtcccacacaccttgtcgctcgtacggtcgtgccgtgtgctgatcgccgacgtcgagaagcgggggaaggaggtggtttgtgtgggctttgtggatgtgtaattggtgctgatgccattgtggctgaaagagagcggacgaagagcgttttggtgtctacgtgtgtatacgctgccggctgtcggatcacgagggagaggggtttcctactatatacatgtgtaaaaatttgtttcatgtaatcttgtatctgagtgaccagatcaggtgattatgcagatgagaagaacagagttttttttcggtctaacaaaacaatacttggtaaggatgagaacgaaccgggggcagtatcgtcagacagattgttttaatccatattctaggcgctgtttctttaaatgccccgatgcgagggtgttgaatgcagagtttgattgaacatcacagttctttaaatggagatggagcctccgtccagtccgtcccataaaatgaatatgagatgacgttgccctgttcccctccctcccacctagacaacagacgcgtagtagtagtagtacagtacagcgcaacccaatggcgacaggatgctcggcgccgacaactacgagcttccaggcgttctgcgggcccgacgtgttctgatatctgatactacaaaactgtagcagatgtgtaattgcaactgatatcaaaaccgacagtataacagctctgtacagagattaatcacgatgaactgcaaggatacatgccactcagccagtgctcatgtgttatactgtgcacgtattttacaatgattatgaattgaggcatcccacctttactttacattgagtatgaattgaggcatcccacctttactgcgaatgtgtccctgtacagggaccatgtcaccacgtgtatgctctgctctgtacacaaaactaatcacgatgaactgtatgaaaatttactgttacaatttcctccctagcccaaagcaccttggctccacagaacctgtaattaagcagaagatgataaacctgtaagcaacaaaggtaaagtcagccgagtcaaacagcaaactgggtcaaagtggctactgtacctctgaccatggtgcaggggaagaggatctcaccaacaggatgcatccccaagacaaaaaaaaaagctatgtactgatgggcaggctccatcacgctgacaaatttgtagtcttgaagattcgatcgtggtgatggcatgaagcaaattaacaatcagtttggatctggtttctgcaccaaacaataagagatgttggtggccagccatactgttaactgagcaagcataccaggcatgcaacaaaaaggataaacatattcgagattggccgtttgcccgcttgtcaatggagaatggaaatagcactagatgctaaattngacgctctatagtctatccaaccatcctgccagcgaanttcagtacaaactctgaactccatccaaaatttcaaatacacacgctttccttctagtcctgccaccttttctcttgatcataagtacatgtgaagccatttgtaaacagtgtctaactttgttgtgccacgctgactgtgtcatcaggtgtttcgctaagactcaaaagatggaggtttcgcatcacttcgaaagagctactgcggtgacaagttctgcctcatcgtgcatccagccgtatataggctggagacttaatatccttcttttagtattgatctcaaagacattctccatatatatcgcatatattaaaaccacacgatacaagcaagattactgaaggcgtaaagcttgaactacataccatacttaacaaatcagcaatcttttcttctattaacctgcagaggatcaaaggaagtaagcaggcaaacagaaagccacaattgaatcagcacagtgaaattaatgcctatgatgtcagtgactggaatatgaactcacgtagaaaacttgacttttgtggatgatgactcccagcctcttttgattttttctccttcatttgccaaattttctggggtttctgacttctaacagaatgtttgctagtttcaccaaccgaagtggtcctcttctgtatcttctcatggtatatagctggcggtgcaagtttcaatggaggtacggtttctatatgaaaggacttctgcgctttctgaagattattcagtatttcatactgcaaaaataaatgttatgcacatatcacataccgattagaagagacacgattgaagattaaaactaggtacagtttcacttttcacttgtcagaaaggcatccagttttagttgcaagatttattatacaacctaaaaaaaaggtaagaccatctgataatagtcatacccgtgacatctgttgaagcccacgagatctctcagcatgatcaacttcatgaatctgatacatgccatgtgacacttcatgttcagccccagaatacttcattagcccattctcaaacataggtgatttgcttcgagcttgcgtatcactcattgagagacaaacagggcatccctctttggattcctgattggatgacctggtctgctcagactcacactgaagatgtgttgcatgcccgcaactgaacaaacgtacggctgaaatagcaccttctttagaaagtgaacagttgcatatgcagcatacgaaagtctgtggggcaaacccatgacaaactcctctctttaataagctcaaggtgtaaaatgagtcatcctcaattactgacttagccgtttcctacaaataggtgaattaggtatcagagcagagaagctaagaactattctttatcagaaaaataatgggagattgccagaaactaaaagcagagatatttttcatttggccttaagtcaattggtacatgctaggtagagagctcaacacttgaatcacgaggtagatttaaatgagcaaaacaaaacaatcaattccaggagtcaatacaagaacatagatcaggtcatggacgaatgtatctagtttagggcattacaagggagtagcattattaaataacaaaattcaagggcgcattaatgaactggtctcatacttggtccctgagttactaacgaagtcacaagaatactattcaggatgaggatacaggctaacgcagccaacatggaccatacagagcggctgtttcaaacctttgctctattgcaatgagtgtcatat

SEQ ID NO: 16445 - DNA, 1767 bp, Zea mays
ggggtaccctcccccggggccggccgggaaaccttgctaccatataaaccttttcactgctccagccgccgccgccgccgtttcttcgtcttcctcgcagcgccgccgctccatcttccgctgatccgctcgctcccgcctctcgccacgcaggcggcggcgctcaggcccgtgatttcagcgacggcgtcagcggcttcccctcccgtctcttcccagtcgcctcgcgccctcgcctccggtcctccgcacaccggccggtgaccctgcatccaccatgactggtgtcagcactggattgttgacgggcttgaggagggtcatggaacagcaaaggatttcaaccgctttctgcagacaatcacgagtttcgagctctactgtttctttctctgacctcgatgagaagggtgacatggaatatgatgataactctccaaattcaaagagggagttacgaccccaaggtgtagatcccaataagggctgggaattccgtggtgtgcacagggccatcatctgtggcaaagttggacaagtccctgtgcaaaaaattttaaggaatgggcatacagtaaccgtttttactgttggaactggtggcatgtttgaccagagggtaattgggcctaaggatttgccaaagccagctcagtggcaccgcatagctgtccataatgactacttaagtgcttatgctgttcagaagctggtgaagaattctgctgtctatgttgagggtgatattgaaaccagggtctacaatgacagtgttaatgatcaagtcaaaaacatacctgagatatgtgttcgacgtgatggcaagattcaattggttaaatctggggacagtgctgctaacatatcattagatgaactaagagaaggactgttctagctatagtgaaagatgtcaggagtatgcttctggcttgaggcaagtttgagtatgtttgtgcttcttagtctcagcactactagtattagagtgatgcttcatgcttgcgtacccctctggctgggttttcattcgtttgaactctagcttatattgccaaatttacttatctgcagaatatttgagccctcaatgaaacatctctctgtgtaatttactgctactgtcttttccatgcgatgcgcatctgtcatgaactcattatctaggcctccttgatcctcatgttggctttcttttagtaaaaaaagaagtaccctttgtttccagtactatcttcaagtaccttacgattaatcaagtgaagctactgttcactcttcacaccattagaactgaatagtaagaattgactcgtggaaacaaattaccagaataaataaattgaggaaaagaaacaaaatcaccaactagatctgaaggaaacaaatgcaggaaataagaaactaaaaacagaaaataaggtagatgtatctcctgtggacggcacttgattcatgtagtgatcatgaaacctcggattaataatatcgctcatatttacagttgacatgctgcctgtattatatataaatacaatatacttatagtaggacacatacatttagtagatttgagaggctcccacatcgatgcactgaccttaaggcgactagaagcatctctgtcgacagcccttacctaccttgctatgctgggtgtgcttttgatggcgttgctggcctcctcttgtcccctgacctcctcctgagcatctccttcatgccatcggctacccggacagctgggcttgacagcgtcatcctgca

SEQ ID NO: 16446 - DNA, 3982 bp, Zea mays
cgagatcttcttcatgtcctgccgctcgtccggcccggcggcacctagtaggggcggcgcggcggaaggggaggtgtcgtcgcccgttgccggcgctggcgcgaggtgtggcactgggggcggcgtcatgggcagccgagtcaagaaggccctcggactcaggccgaggcggctgtcgccgatgatgacccgcacactgagccagacgtcggggccggcgtcccctggccgcgtgcggcggccgatgacgtcggcggagatcatgcggcaacagatgcggctcaccgaccagactgacgcgcgtctgcgccgcaccctcatgcgcaccgtcgtcggtcaggtcggcggggcgcctatgacagtcctcatctacatcttttccttgagaaatgacagagtctggtttgcacaggtgggcaggagggcggagacgatcgttctccctctggaactcctccggcagctcaagcccgcagagttcggcgacaccgaggagtaccaccaatggcagttccggcagatcaagctcctggaggccggacttatcctgcacccctccctccccctcgaccgcctccactccgccgtgctccggttccgcgaggtcatgcgcgcaacagagatccgcgcccgcgacaccagcaagaactccgacgtcatgcgcgccctaagcaacgccgtgcacgcgctctcgtggcgctctggcaccaccggtgccgctgtagaagcgtgccactgggccgacgggtacccgctcaacgtgctcctctactgctccctcctccaggccatctttgatctgagggagagcaccgtcgtgctcgacgaggttgacgagctcctggagctcatcaagaagacgtggccgacgctcggcatcaacaggatgctgcacagcgtgtgcttgtcgtgggtcttcttccagcagtacgtgatcacgggccaggtcgagccggacctcgccgctgcggcgctcgccatactcgttgacgtggcagccgacaccaagcacgggagccgtgacccgatgtacgtcaaggttctcctgagcgctctcggtgggatgcaggagtggtcggagaagcgccttctggactaccacgacagcttcgagaaggacatcggtggcgctgctacggaaggcatggagatcctgctgtctctggcgctcgccgcgggcaagatcgtcgctgaccgggaaggcgccagcgacgggaactttgctgtagaccgcgtcgattattacgtcaggtgttcgatgaagagcgccttcaccaacgtaagctcgttggattaagataatacagagtattcatgtgttcatcatcatgcatggccattcatctggttgcagatacttgagaatggactcggcgaggttgacagcgtgatcatcgaccgcgacagcgaccctggctccgtcctgattcagctcgccagggacacggagcacctggccttgttcgagcgcaggaacttcagcccggtgctgaggcggtggcaccccgcgccggtcgcggtggccgcggtcaccctgcacggctgcttcggcgtcgtgctgaggcagtacctggccaaggtgaccatcctcaccgaggagctcgtccgcgtgctccactcggcaagcaggctggagaaggcactggcgcagatgacggccgaggacgcggcggactgcgccgacggccgggccaagggtatcgtgggcgacatggagcccttcgaggtggagtccgtcgtgatgggactgctcaaggcctggatggacgacaagcttgggcttggcagggactgcctcctccgagccagagacactgaggtacgcacgcacgcacgcttggacgtacggcagagctggaagtcccatcgacaaacttactgacccgtgcctggtactggtctctgcgtgttttctagagctggatacccaagtccaaggaggaaccgttcgccgggtcggccatggagctgatgaagctggctaggttgaccatcgatgagttctccgagatcccagcgagtgcgaaagacgaggtggttcaagatctcgtcgacggcctggagtcgatcttccaggagtacatcttctttgtggcgtcttgcggtaagctcatcttgtgctgcgtgcacacaagtttgttttcatggctagtagtacatgtgaaacatggttgatgatggcacgagtacgacgagccggttcgaaacagaactacctccctccgctgccgccgctgacgaggtgcaaccaagactcgggcttcttccgactgtggaagaaggcggcgctgccgacgtgccaggcgccgccggatgccaccccgcgcggcggccgcggttcgcaccacgtcccgcggccgtccatcagccggggcacgcagcggctctacgtccgcctcaacacgctccactacgtgctgacccacctggaggccctcgacagctcgctgtcgtcctcgacctctcacctggaccgcgcacgcgccgcggcgcagtcgtcgatctcggccgtcgccgaggtcgccgcgcaccgcctcatcttcctggactcgcgccactccttgtaccagggcctgtacgcccgcagcgtggcggacgcccgcatccgccccgcgctccgcctgctgaagcagaacctgtcgttcctggtgtccgtgctcgcggaccgcgcgcagcccgtggcggtgcgggaggtgatgcgcgcctccttcgaggcgttcctgatggtgctcctggcgggcggcaacgagcggagcttcgtgcgcgccgaccacgccacggtggaggaggacttccggagcctgaggcgcgccttctccacgtgcggggaagggctggtccccgaggacgtggtggcgcgggaggcagagacggccgaggccgtcgtggagctcatggcacgctccacggactacctcatcgacgcgttcagcgtcgccacgtgcgactccatcagcgaggacggccgcgccggcgcaggcgggtgcacgccgctgccgcccacgacgcggaggtgggaccccgccgacccgaacaccatcctccgggtgctgtgccaccgcgacgacgaggccgccaaccagttcttgaagcgcacgttccagctggccaggaggcggtgaggccacggccatagcttgacttgaaggagcacgaaagatccttacgcgtcccgcgccccgcggcccgattgatgaaatgatgtgcgtggtgtttcgcatttttctcgctgaaaattgctcgcaagctgtgtcgctcgctcgcattacaggggagagaaagggaaaggggaagaaattctatatatctcgaatacaaatgacctcttttatagttcatcacatccaccacttggatgaccataaaaacaaaaacagatcaaaatttataacttaattatttagtaatttgttttttctatttatatagaccgggtggatgtgagaggtataaaagagtttctttgcatttcggatgtaaacaattttttttctgaaagggaaggcaggcacaatgagaggaggtttgcagttcaatcaccggaaacggatcgatcatcctccgaaatgaactcgtgtgattttgcttgaacgctggccgctccacgcaagttgtgaagagcccttcgaaactccaaaatacataaacgtacgggggaaatgcaaacggaacatgaacaataaaggccctcaataggccgtaaatgctggactaagtttgggtggcccagaaatacaaaggcccatcagcccattcgcttctaaatctctactcctaagggctactttgggtactattactaactttaatccacgtatattgaggtagattgaagtgtaacttaaactaatttacactttaatccacctcaacacatgttgattggagtaaatacaagagtacccaaacaaaacctaagggttttctccgtcacccctcctcactttgtgctcgtttgaactatagttgtgttgttggttac

SEQ ID NO: 16447 - DNA, 2283 bp, Zea mays
aggccggccgggcgtgccgccgggccggccggaatcagaccgccagcagtcgccagcccagcaaggcagagcagcgagcggctatgggaagagaggcgccggcgatggcggtagcgctgctggcggcgctagtcgcttccgcggccatgttggcggggaccgcgagcgcgtccccggcggaggggatccagccgctgtccaagatcgccgtccacagggccaccgtcgaaatgcagccgtcggcgtacgtgcgggcgacaccgtcgctcctcggcgagcagggagaagacaccgagtgggtgacggtgaagttcggctggaaagagccgtccgaggacgactggatcggcgtcttctctccgtctgaattcaactcgtcggctacatgtccgaacccatggccagcagaagaaccctatctctgcacagcacccatcaagtatcagttcgccaactactctgcgaactacatctactggggcaagggcagcatccggctgcagctcatcaaccagcgctccgacttctccttcgccctcttcaccggcggcctcagcaacccgaggttgatcgcggtgtcggagcccatatcgttcaagaaccccaaggcgcccgtgttcccgcgcctggcgcagggcacgtcccacgacgagatgacggtgacgtggaccagcggctacgccatcgatgaggcgtacccgttcgtggagtggggcgccctggtcgccggcggcgtccggcacaccgcgcgcgcgcccgccgggacgctcaccttcaaccgcggcagcatgtgcggcgagccggcgcgcaccgtcgggtggagggaccccgggttcatccacaccgccttcctcagggacctctggcccaacaaggagtaccactaccggatcgggcacgagctccccgacgggtcggtggtgtggggcaagccctactcgttccgggcgccgccgtcgccggggcagccgtctctgcagcgcgtgatcgtgttcggcgacatggggaaggcggagcgggacgggtcgaacgagtacgcggcgtaccagcccgggtcgctcaacaccacggacgcgctgatcgcggacctggacaactacgacatcgtgttccacatcggggacatgccctacgccaacggctacatctcgcagtgggaccagttcacggcgcaggtggcgcccatcaccgcccgcaagccctacatggtgggcagcggcaaccacgagcgggactggcccgacacggcggcgttctgggacgtgatggactcgggcggcgagtgcggcgtccccgccgagacctactactactaccccgccgagaaccgggccaacttctggtacaaggtggactacggcatgttccgcttctgcgtgggcgactcggagcacgactggcgcgtcggcacgccgcagtacgacttcatcgagcactgcctgtccacggtggaccgcaagcaccagccgtggctcatcttcgccacgcaccgcgtgctgggctactcctccaacgcctggtacgccggcgaagggtccttcgaggagcccgagggccgcgagaacctgcagcgcctgtggcagaagtaccgcgtcgacatcgccttcttcggccacgtccacaactacgagcggacctgccccatgtaccagagccagtgcatgaccagcgagaagacccactactcagggaccatgaacggcaccatcttcgtcgtcgccggcggcggcggctgccacctgtccagctacaccacggccatccccaagtggagcatctaccgcgactacgacttcggcttcgtcaagctcacggccttcaaccactcgtcgctgctgttcgagtacaagaagagcagcgacagcaaggtctacgactccttcaccatcgacagggactaccgcgacgtgctcagatgcgtgcacgacagctgcttccccaccacgctcgccacctagttaataaaactaccacttattggtagaataatgtgccccgtcgaggcacactgtactgtagctgtattcatgatagcgcacgtacgcagggagtggtgttgctgtgctctgctccctcgatctgtgtattaaatatcactagctagcccgtgcattaccacttattctcagttggtgccgtagggcttttgtgtgctggtgtggtttaatttccagataaggctatattcggtttcctggaatataatttaagacttgttcggttaagagaaaaaaagaaaaaaaaaaaaaggattggttgcgtgcaaatacttaaaaaaaaaaa

SEQ ID NO: 16448 - DNA, 2108 bp, Zea mays
tcaccttcaaccgcggcagcatgtgcggcgagccggcgcgcaccgtcgggtggagggaccccgggttcatccacaccgccttcctcagggacctctggcccaacaaggagtaccactaccggatcgggcagccgtctcggccccgcgtggccggccgcggcgacatggggaaggcggagcgggacgggtcgaacgagtacgcggcgtaccagcccgggtcgctcaacaccacggacgcgctgatcgcggacctggacaactacgacatcgtgttccacatcggggacatgccctacgccaacggctacatctcgcagtgggaccagttcacggcgcaggtggcgcccatcaccgcccgcaagccctacatggtgggcagcggcaaccacgagcgggactggcccgacacggcggcgttctgggacgtgatggactcgggcggcgagtgcggcgtccccgccgagacctactactactaccccgccgagaaccgggccaacttctggtacaaggtggactacggcatgttccgcttctgcgtgggcgactcggagcacgactggcgcgtcggcacgccgcagtacgacttcatcgagcactgcctctccacggtggaccgcaagcaccagccgtggctcatcttcgccacgcaccgcgtgctgggctactcctccaacgcctggtacgccggcgaggggtccttcgaggagcccgagggccgcgagaacctgcagcgcctgtggcagaagtaccgcgtcgacatcgccttcttcggccacgtacacaactacgagcggacctgccccatgtaccagagccagtgcatgaccagcgagaagacccactactccgggaccatgaacggcaccatcttcgtcgtcgccggcggcggcggctgccacctgtccagctacaccacggccatccccaagtggagcatctaccgcgactacgacttcggcttcgtcaagctcacggcgttcaaccactcgtcgctgctgttcgagtacaagaagagcagcgacagcaaggtctacgactccttcaccatcgacagggactaccgcgacgtgctcagatgcgtgcacgacagctgcttccccaccacgctagccacctagttaattaaactaattaatgagacgccgccagttttaattggctttcatccgaataaaactaaacgacgtgtcaaccacttattggtagaataatgtgccccgtcgaggcacactgtactgtagctgtatgcctgtattcatgatagcgcacgcagggtcagggagtggtgttgctgtgctcctgctccctcgatctctgtattaaatatcactagctagcccgtgcattaccacttattctcagttggtgccgtagggctttgtgtgctggtgtggtttaatttccagataaggaaaatgggagttcaaacccctatgctcctgttcatttcaggaaactatgaaaatatggcttctttgtagcattgattgaaatgttctaagtgtttctgccgaatacccatatactcatgtgtatatttgaatattcaggagccatacgtttggaacatacaggatcattcaattaatataaaagtgttccttttcattgtgaaagactaacatattccatgcattacaacaattaatatctgtactctgaaacaaatcttgcacttgagctgaatatgacacttccattacaatcctatcacaagtactaccagctgtctgcgatgaatatatgatcctagaacacgagcactaggtccgtctactctggaaagatgttgactcacagtaacaatcctctatgagtagtagcagtattcgtttttgttttcagctagactgcttcttttgcttctgcttccccgtggccggccctcgcaaacgatcaatcggtcacttaatttgccccgaccctacctccagtagccgtggtgtacgccagtataaaactccgctgttgcagaggctcgaaacggagaatgatcccacgctcaagggcagggtcaaccatagtgacaccaaagaattgcagagcttctaccagctctactacaagtacattcaggcgcttcaaaaagttgctggtaaagccaa

SEQ ID NO: 16449 - DNA, 3798 bp, Zea mays
  misc_feature (551)..(551): n is a, c, g, or t
  misc_feature (617)..(617): n is a, c, g, or t
  misc_feature (3628)..(3628): n is a, c, g, or t
ctccaagagcggattttcagaaaaaacttgatcgactccaaatagggccttaattggcacgatttaagtgtatggattcttgaataaaacatatactgcattccgcagatgctcacgtaataaaatgtatgtcattgctgacagcaaattcatgcactcgacgggaagcttaagtcatcgatgacgtgcgagacgaagaaaacgatcaagccaagtgacaatcgggcaccgcaggtgtagagaaatcgacaaaaacaaggagaagtgtctctcgtgggtgtggtgccgtagttttttcaacttgttgtgcagataccgacagggccagatattggcccatgaccacccgggccatgatccggatatagcctttttttttaaaaaaaaatctccttgaaaatattgaaaagctatataattaatctatctcgttctaacaatatttatatagtgtttattctaaaactcgatttacattatcatggttacatgtttcaaaatatgtctttattattttttattaggctctatctctagattttaaaatgatngatgtaaataaataaagatattgctttacaatgatatttttttatgtatgttatctatcttacatngttatataactgttaaactatatttttagtgtttttttatcccaagttgatctagggctttagtgttccgctactagatgtctacaactctagatcccagccggagctcattttttttggaccgaatttaatagaaatagttggccacttgggctttgcttcagcatctgacgaggattatgtcgttgagacgctgaagcatgaggacggtctcaccctctatataaagagagagacctgcactctcgtacttcccaagaagaacatcgccattgcagcaagtctgtatgatctgtgacagctgtcgatagaattatcacacacattcgttattcgttgaactacaaccatggcgaggccgtccgaccaaagcgtccacgtcctcctgctcccattccccacgcagggccacatcaacccgctgctccagttcggcaagcggctcgccggccgcgctggcgtccggtgcacgctcgcggcgacccgcttcgtcgtcagctcgacgaagccgaccccgagctcggtccacgtcgccgtgatctccgacggctgcgacgagggcggccccgccgaggtgggagggatgggcgcgcgctacttcgagcgcctcgaggcggccgggtccgagacgctggacgaggtcctccggtcggagtcggcgctggggcggccggtgcacgtggtggtgtacgacgcgttcgcaccctgggcgcagcgcgtggcgcggcggcgcggcgccgcgtgcgcggcgttcctcacgcagacgtgcgccgtggacatcgtgtacgcgcacgcgtgggccgggcgggtgccggtgccgcccctgccgctgcgccccgaggaggcgcggggcctggctctggctgggctgtcgacccagctcgaggtggacgacatgccgacgttcttgggcgacaccaggtttccaccgtgcttccgggagctgctgatgaaccagttcctggggctggacaccgccgaccacgtgctcgtcaactcgttctacgacctggagccgcaggtgagtgaactaccggcccagtgcaatcgcaatcgcaaatgcatgcatcgctagctgcaaaagatgcaaatgaatgcgcgtcgtcgttgagtcgtgcatgcatgatccacgcccacgcaaacaggaagcggactacctggcgtctacgtggagagccaagatggtggggccgaccgtcccgtcggcgttcctcgacaaccgcctcccggacgacgtgtcctacggcatccacctgcacgccccaatggcggcagaaagcaaggcgtggctggacgcccagcaggcgggctccgtcctgtacgtgtccttcggcagcatggcgtcgctgagcccggagcagatgggcgagatagccgagggcctctacggcagcggcaagcccttcctgtgggtcgtccgggccacggagaccgccaaggtgcccaggggcttcgccgacagggcccaggccaccagggggctcctggtgtcgtggtgcccgcagctggaggtcctggcgcaccccgccgtcggctgcttcttcacgcactgcggctggaactcgacggtggaggcgctcagcgccggcgtgcccatggtggcgatgcccgactggtcggaccagacgaccaacgccaagtacatacaggacgtgtggcgcgtcggcgtgcgggtgcgcccggacggccggggcgtggtgaggagcgaggaggtggagcggtgcgtgcgggacgtcatggagggggagatgggcgaggagtttagggccagggcttcgcactggagcagcaaggccaggaaggccatgggcgagggcggtagctcggacgtcgccatctccaactttctatcctgttttggacactccgctcacgttaccgctgccaactgattgatcatggccggatgcaccgttttaatgcctcgttcattgcttgtacggtttcacctctctctatatacaaaagatatcctcgtctcctgtacatttaaagaaatggtcgatccatatggaaaactctcaacccccagggtataaattgcacccagcaaatttgtgaacacaaaatgtaaactgttggtttatttggtagggcaatctgatgcacatggatggttggcacataacgcacatattaaatcatcaccatctatcttatatataatgtctttagttgattattatattttacaaataacactttcaaccactacgctccaccagtttggaggatgttctttataaaatatacagagcaaccggatctgttaaatctaaaagtaatggttatgatttaatatgtgcaccaaacttttatgtgccctagatatgttatctatatcataaccatccgagcggtgaagaaagtgctaaatcatgaaaaaaattctctcctattctaacagttttttttaaaaaataattcaatcagccggtgcatgtaactcacaactcaatatgatacaagaaccaaaggtgaccctaaactactcaaataatatataactaggcaaaaatggttgtagccagctcatatatcttcagtacagttacacactaaggagtgtttagttcccacttcttaatgggttcctgcaggattgtccggaagccctcttcaacgtttacctacccgagcggcttgatatggaatttaacacatcaaacctaccccctaagggcttgttcgtttgggccgggatcggccgggattgcggcttgatccacgtggaacatcccggtctagatagattcccgacccacattggaagagctgttcgattagcccactcgtgattccatcaccggcccattaccggcgaaatccttcaccccggcccgggaaccatcccacgagtctagacgtgtggaaccgatcccctggcgctagcacacggacgaagcaacacacggcggcggtggcgggggacgacgacgtcagcacggcgatcttctcagcgagcgacggctttctctccagtaaccttctggctggtaagtttattgtcnctctcttcctctttccatttccattagatctgccttctggccgccggccgcccagcgtctccatttccatctgtggttagcatgcactacctctttccatatgtgacccctccatattatgtagtaattaattaacccctggtttggtaaaaagaaaaaacttgcattgc

SEQ ID NO: 16450 - DNA, 1523 bp, Zea mays
ggcccgctttttttttttttttttccaaagaaacaagccagtatatttagaggtctcgcgttctgaatattccaactggcaacacaactagcgctgcagccaccaaaacatgagacaacttcaaccaggaacaaaggagaaaggatgaacaaaaggacagtgtcataatacagacttggtttatcataagattacagcagaaatagtacagttttcaacagcaacagcatcggtcctgaattacacacaaaacagagatatttttttgtctttgtgaaaactcagacatttaacatggcgtacaataagaggcagcaactatcatccagggaagtccatcttcgcacagctcaacaggtcccaaccagacattcatctctcgttcttgctacaacacattgccggagacacaagatattagaaccaccacagccagaggcagcaagaagatgctagctgttaaccatgccagtgtgcaagcaagactcggctctggatcatcgtttgcctctacattagtagctcacccagctacgactactgaggtgtcatccgcctgcgcttagagtggtcagcctcccttgacctgccgcgtatcccagatgatctacccctgtcccagtcttcattacgttccgaatcgcgatccctgtgcctgtgataatcgccatagcgatctctgtcatccctatgcctctccctctccctctccctctctctctccctatctctgtccctctccctatctcggtctcggtctctttccctgtcacggtctttttccctgtctctgtcatagtcacgattcctctcacggtccatgtcacgctcatcccgttgcctcctctctggccactcctgtgcagggggcgcatccttctccctttcacgcctcctctctggtgcaccagaccactccctctctggtggcctctctttcccatggctccctccttcaccatactgctgatcagaagctgcgtcatcaccgtaactcgattgttcctccccaccccaggctcccatgttgggatcaggccacattccaccggcacccattccgccacgaccaaagaaagctgggttaacatgtggagcaacaactggcgggaatggctgcatcagcccagggaatggcatagcccctggtccaccaggaaaaccaccaaatccaccacccatccttcccatagcgccgtaaccagtaggatcaaaaccctgccccagcattccacctggaggcatcattggtggcggcggcgcaaccatccccccatttcccattatcccacgaccaccaccagctgggcccatcctgttcctcatattaccaatagggcctctattccccatgcctccaccacctcttccccaatttccaccgcctccaccagctccaccaccggcaccaggtccaacaggtcctccacggccaccgccataattaccacccgcctgtggccctgcggcaccaccgctccctctaccaacctttggctgcatatttgatgtctgtccgacgc

SEQ ID NO: 16451 - DNA, 2050 bp, Zea mays
ctgtgcggcgctcgaggcggccgggcctcccccacctggcctcgcctcacttcactagagagatcccaacagttcgctgccgtcgcctactcgcctccgccagaccgccgccgcgacactacacaccagcgcccccgcagaaggagcaaggggggagaaggaaagcggcacccgccgcacatacgccgcgcggcggagccatggccgagctgcggcacgccacggcggcggcggcggcgacgcgcgccactggctccccttccaagcgcgacgccgaggccgcgtcctcgcccttggtcgcgtctccccgcgtcggcggcggcaaggacgggctccgcccccaccagaggtggccgctcccgccccccgtccgcgccctcctcgcgtgcgaggaccccaggtcccccaccgcctccgcctcctaccggatcctggtcgcggccatcgcctgcttcgccctcgctgcgctcttctccgcgccttccctctgggcacgcctcaacgcgccgtacctgtgccgcaaggaggggattcggctccactgccccagggtcagccagccagactctctgtgggagaatcctcatgcagcagcaacttcgtggaagccgtgtgctgagcgtcagagacatgaggtctcagacctcgtgtcagagaatgaaacttctgggtttatatttattcacgctgagggtggattaaaccagcaacgtatagctatatgtaatgctgttgcaattgctaagataatgaatgctacacttattctgccagtgctaaagcaggaccaaatatggaaagatcaaacgaaattcgaggacatctttgatgtagaccattttataaattatttgaaggaggatgtgcgcattgttcgagatattcctgactggtttacagaaaaggatgaccttttcactagtataaagcgcactgtgaaaaatgtcccaaagtatgcatcagcacaattttatattgataatgtgcttccaaggatcaaggagaaaaagataatgtctatcaagccatttgttgataggttaggatatgataatgttccaatggagattaaccgactgaggtgccgagttaattatcatgctttgaagtttttacctgacattgaagaaatggctgacaagctagcaacaaggatgaggaatcgaacaggaagtttaaatccatacatggctcttcacttgcgatttgagaaaggaatggtgggcctttcattttgtgattttgctggaacccgggaggagaaagctatgatggctacttacagacaacagcaatggccaaggcggtacaagaatggatcacacttatggccactagcgctacaaaagagaaaagaaggccgctgcccccttgagcctggggaaataggaatcattttgcgcgcaatggggtatacgaaggaaactcagatatatgttgcatcagggcaggtgtatggtgggaacaacagaatggcacccttgaggaatatgttccccaatatggttagcaaagaagatctcgcaagcaaggaagagatggagcctttcaagaagcatgtaaccagccttgctgcgctggacttcctggtatgcctgaagtcggacgtgttcgtcatgacccacggcggcaatttcgccaagctgatcattggctaccgtcgctacatgggccgccacaggctcaagtcaatcaagccggacaagggtctcatgtccaagttcttcggtgacccttacatgccgtgggcgacgttcgtggaggacgtggtgataacccatcagacacggaccggcctccctgaacccaccttcccgcactatgacctatgggagaaccctctcaccccttgcatgtgtagagcttaaattacagtcagcgagtgatggtgcatagttattctttgtatcatatgctgatatgcaagctgcaaattttgtccaccttgtttatttttttttaccacttctgctgtacaagtttaacaaagcaaagctcagttcatcaataaaaaaaaaaaaaaaaccctaaaaaaaaaaaaaaaaaaaaa

SEQ ID NO: 16452 - DNA, 573 bp, Zea mays
  misc_feature (34)..(34): n is a, c, g, or t
gaaagggagggggggggggggggggcttccctcntccccccccccccccaacgcgccgtacctgtgccgcaaggaggggattcggctccactgccccagggtcagccagccagactctctgtgggagaatcctcatgcagcagcaacttcgtggaagccgtgtgctgagcgtcagagccatgaggtctcagacctcgtgtcagagaatgaaacttctgggtttatatttattcacgctgagggtggattaaaccagcaacgtatagctatatgtaatgctgttgcaattgctaagataatgaatgctacacttattctgccagtgctaaagcaggaccaaatatggaaagatcaaacgaaattcgaggacacctttgatgtagaccattttataaattatttgaaggaggatgtgcgcattgttcgagatattcctgactggtttacagaaaaggatgaccttttcactagtataaagttagttgtttcattttcagctatccattgtgccttaactgctatctactgaatagctagcttgtgcaaatttacacagaggatctatactcacag

SEQ ID NO: 16453 - DNA, 682 bp, Zea mays
gccggccgggctcacttaagcccaacttggacatccacggtccagctccagctccagccccaccttccagaaactgctcgtacgatctcaagaacgccgcctccccggttcccgcacccccgtcgccgcgccggtagtctgcccgtcgccgtctcctcctccaggtgaaggcgaaggtgaagcagcaggatgggtcggaaggccggtgctttgtacataaacccaaagaagtttggtgctatggcgaagccctgcatgccggaaatggtggccttcctcaactgcctggccttaaacaaacagaacgatgacaagtgcatcaagcagaaagatcttttggttgcatgctctcaggctcagaatgggaggccaaagaacgcagccaagaccatcaattaccatctccagcgacttgggcgaggcaagttcctctaggtgctgtgtgagatcatttcctcatccagctttatgccttgtaccgaagtagaattgctgaaatggggcattaatgtgtttgcttagattggacaatggtcagcaaataattttatgtcaaacagtaatgtatgagcagtatattgatactgttttcttctcatcctatgaaggcacattacagttacgttttccatcaaaaaaaaaaaaaaaaaaccgcccgaaaaaaaaaaaaaaaaaagcggcc

SEQ ID NO: 16454 - DNA, 804 bp, Zea mays
  misc_feature (758)..(758): n is a, c, g, or t
  misc_feature (769)..(769): n is a, c, g, or t
cattgggtacctcgaggccggccgggaattaagcccacttggaatccacggtccagctccagtcccaccttccagaaactgctcgtacgatctcaagaacgccgcctccccggttcccgcacccccgtcgccgcgccggtagtctgcccgtcgccgtctcctcctccagatctgacccgcctgtcaacgtagtctgccgggagtccatcactgtgccggggcgttactcctcaccgccgctgtgttgcctcttctgcggggttgaggtgaaggcgaaggtgaagcagcaggatgggtcggaaggccggtgctttgtacataaacccaaagaagtttggtgctatggcgaagccctgcatgccggaaatggttgccttcctcaactgcctagccttaaacaaacagaacgatgacaagtgcatcaagcagaaagatcttttggttgcatgctctcaggctcagaatgggaggccaaagaacgcagccaagaccatcaattaccatctccagcgacttgggcgaggcaagttcctctaggtgctgtgtgagatcatttcttcatccagctttatgccttgtaccgaagtagaattgctgaaatggggcattaatgtgtttgcttagattggacaatgatcagcaaataattttatgtcaaacagtaatgtatgagcagtatattgatactgttttcttctcatcctatgaaggcacattacagttacgttttccactaaaaaaaaaaaaaaaaaagcggncctatactgcnctgtttggaaaaaaaaaaaaaaaaaacccgcggcc

SEQ ID NO: 16455 - DNA, 5509 bp, Zea mays
tccataccccccccccctaccgttcctaaactcatagagccccactaaaacccttctaaaaaacataaaaactttcatatataatttagtctctcctaattttttttttggctccatccgaccatccctaagcttgtataattataggtgttaataaatccgaggcacgtacaaaataaggatattataaaaaggtaaaaactgattgaaatagtcacaattctcgctattcttttagatggaatgtattcggtataactatatatttctatatagatataaatttagattttatttttacttttatattaactgtaattatttatattttaatgcatatattacttttatgcgctttctttgtcagcatacacatattcatacttcaataactacatgcagaacaacttttgctttaaaaactatggataaaaaaaagatatatactcctcaaacgaaatggcgtagttaccaaaatgcgagtttgaatcagtgctgtccattttgtattcgtatttgaaaaatattaaaatctatatttgtatccagaaaaacagtcgatttccgactaacaaatatctgagttccagcggtaccgcctgtttcatttccgcccaataactagggcctctattgttatcttggaaaaaatctagccgtccggtacaccgtacaccaagcaaatatctagctaggcttgccacgtatcccgtgtcgtgattacgaccaagtgccttttatttcttgtgggcgctaatgtacgttcaaagtacgtgttcggagtttagcacagatggcacaatggcactgtcatccgacaaggacctgtttttgtggagccacggccgatgcgatttcacataataatcacatatgattcgcgtgcagtagaatacagtaccgagtagcagcgctccacttggttccgacttgtgatccttttcgtgaacgtgtacctgagaggcatgactgtgtattccattgccaagtcataaagagatagtagcgcggtacaggcgtacagcaatccagctgccaaactacagagacctaggcaataacttgctgccaaaacttaaagctagaaaacaccttgaaaataaacccaaaacccggtgtgtgtacagcgcaagggcgcagagatccatttacgtacatgccaaaccaacaacgagaaggcagaatccggggaaaagcgagctgtagcccgtacaccaccccttgccgctccggcctccacgtgtcgaccgcccgcgcctcccctgccggcctcacgcttatctctccacggaaggatacgtcaaccacgtagaccgggcccgtccgcctccccatcccccacacaacaaacgtgccacgcccaccccaccctcgagccagccagcgagtcacagcgcccgcggagggccggtcgtttactcgtggcacgcggccgcgcgccccagatcgcttccgcctggtggacgcgcccaggcgtcgacacgcgtcccgggggcacgtaccggccatgggcgcgcgtcacgtgggccgtatcggacgccttcgccgctgtcacacaactgtacgggggccggcccggcggccgcgtggcgcgtggcatccctgctcctgccttttatacccccgcggcaccacttggaacgaaaacgcaacccctctcgctctcaagcttcaaaatcccactagcgaaaggaaaacgggagaagctaggaagcagcagccgcggcatttcttccttgagcgttcgccttcggctgctcaacgcgtgcttcgtttcaggagagccttggtggcatctctgtttcatggccgagatctgctgtgaggcggcggcggcggcggcggggtcggaccagaagggggagtgcgccggcagccgcgcggcgcggcggcggaggatggagattcggcggctcagggtggtggccgaggaggcgtccgccaagaggcggaggctggaggcggatgaggaagacgcggttggggggcgagcgccgaggtacggcgtgacgtcggtctgcgggcggcggagagacatggaggacgcggtgaccgcccgtccggagttcatcaacggccaccacttcttcggggtgttcgacggccacggctgctcacatgtaagtgccccgtgcccgctatttcttcttcaaactgttgggttcttggcatctgagctgaactgtgttcgctaattcttattcatgtgcatcacacgcaggtggcgacgtcgtgcggggagcggatgcaccagattgtggccgaggaggcgacagctgccgcaggctcgtcggttgcggacgagaccgcgcggtggaggggtgtcatggagaagagctacgcgaggatggacgccgaggccgtcgtctccagggagaccgccggcccggcgcccacctgccgttgcgagatgcagcttcccaagtgcgaccacgtgggctccactgccgtcgtggccgtggtggggcctcgccacctcgtcgtcgccaactgcggcgactcccgcgcggtcctctccagcggaggcgccacgatccctctctcagctgaccacaaggtactgcgaacaaagaaaaaacaaaaaaacgagttctgtttgttttttcccctgtcacgggctcggccgctcggtctcgtagacagatgaagtgtgttggtgcctgcgtcgttctaatcaagttcgcatgaatgatgatgattcgctgcagagattcgctgcagcctgaccgccccgacgagctcgaacggatccacgcagcgggacggccgcgtgggttctgggacggcgcccgcgtcttcggcatgctcgccatgtcccgagccatcggtgacagctacctgaagccgttcgtgatctccgacccggaggtgctggtggtggagaggaaggacggcgaggacgagttcctgatcctggccagcgacgggctgtgggacgtggtgagcaacgaggtggcgtgcaaggtcgtgcgcacctgcctccggaacagggcgccgcgcggtggccgggagcagtcgagcccgacctccaacctgagccctaggcagagcagcgccagcggcggcagcagcagcagcagcggggacgaggaggctggtgcgcccagcggcgacggcgcggggtccgagagcgacggcgagagcgccgaggacagggcgtgcgccgaggcggcgatcctgctgaccaagctagcgctggcgcggcagagcgccgacaacgtcagcgtcgtcgtcgtcaacctcaggcggcgcccgcgatcgtgatcggtggtggctctgtgatggactagccgttcttggttggtttggtttcctggccccgtccgtaagttcaaatgggagcccagttcaccttcgcttcggccgagcaaatcattggacaagatgtcaaagcgaagatcgaacaaaatagtgagatctgagatccttagcaaaattgcatgctacttccttttacagtagtacagcaggactattgtttcgttagcgttttttttatgggtgggtggagggtgcgtttctgatctggtcggacagatcatcccgcctttcttcccccggtaaattatccaaatagaaaagcgcatgcgtctccgatgtttgaagaaactttaccgtgcgtccgagagatttaattgtaatatatagtccagtgcccctttcactagccaaatgcccaaaatccttccaacctagagctctgactaagatcgtgatgtgctcctccggttccgtgtttcatgttttatataaataaatttgacccaccatgattgtccagaacgcgttcggcgacgctgcgtcagctgcgcaaccctggatacaatatcccgggggacggatgttttcttggtggcgtcccgtgtcctccaaagttttttcattaacttccagatgagatggaacacacgcacagaacaaacatgacagtgtttcctgccggctcgttcgtcgctgaaaagtccgtcggtccttgctcctttccctgtggcctgtggtgtgctggtggtggtggtgggtgagccgtgcagcagggagtcaacagacagacaaccccgggctgccgcctaataatcatggcggacacgaggcacgcatccaccccaccccatgctacgacctgaccacgacgtcgcgtcgaggaaccccccaaaaccatgataataaaaagaaaacaagactaggaacggaaagatgatcacgtttcccttaccgggagcctttttgtgccgctgacatctgttgcgcgtctcgctgcattttttgtgccttggcgatcgcgtcggagattctgctcgctcgtttcgatcgggacggcaattatcgtttcgggacacgtcaggggagggttgggtcggccgtcggcccatttttttctttctttctgttgggtccttacttttcggggacgctgatgcttttcgtccgtggagcgcgccggtggaaggttgccgtcacgctcgcacacctggcgcggaggttcatcggcttttgggtaagggatgtttaatggccctagttctagttgacgacggctctactgatgatgttgagtcgacagcattagagatccagtaccgctacgctgtggctgtaggaattccacacgtcgtcactcaagacgcgctagcagttgccccagggcgttagaaacagcatactgggatcaagcgtgcgtttcgcacaatgggtttcgtataatttttattttccccgccactttgcttcgccgcgtggagcttcagaatctgttcgccgtgaaacacgagctcttgcgtgtgcggtgtgccgctctagatcggtgggggtgtccaaccgtccaaggccacctgttcactaatgcaagcttggaatgagctccagcctgccgcctgcctttggcattttgcccttgctttgggcgactacccaacgcacgcagtgacgcagacgcagatgcgcatgcgaggcggggtgctttcgtacaggactcctgagccgtcgcagttgcagttgcacgcccccaactcatctaggcgcttcctgcttactcgtcgtcgtcctcgttcgattgcgacgcgtccctgctgatgaacgcaggggtccgtgccgtgcaggcgatcgtggtggaaggctgcaagtagtggaacgaacgcatggttgacgtgatggccatttgggcagtgcgtgtcgccggacgccccctgtaccttggctgcaagagaatcggaacgatccgaaagttgctcttgctttttcgtgacgggaaatggccacccgttcagttaccgggaatcaacgttcgtggacagggaggcgagagtgagcctagtcgcgtattcttgctccgcgtcgcactgtcgcagaatacttcggggtggtcgtggactcgtggtccacgggagtttcttgtcacacaactgttcaaacatcgattcgaggacgacgacgggactacgggacaatgccatgggtttgcattgggccggaagtgtcgattttaggcctaatatcttgggctagtatgggt

SEQ ID NO: 16456 - DNA, 1821 bp, Zea mays
  misc_feature (51)..(51): n is a, c, g, or t
cgccggcaggtgcccggcctgacttgctgggtcgacccacttttgtctttnccggggaaaacgcaacccctctcgctctcaagcttcaaaatcccactagcgaaaggaaaacgggagaagctaggaagcagcagccgcggcatttcttccttgagcgttcgccttcggctgctcaacgcgtgcttcgtttcaggagagccttggtggcatctctgtttcatggccgagatctgctgtgaggcggcggcggcggggtcggaccagaagggggagtgcgccggcagccgcgcggcgcggcggcggaggatggagattcggcggctcagggtggtggccgaggaggcgtccgccaagaggcggaggctggaggcggatgaggaagacgcggttggggggcgagcgccgaggtacggcgtgacgtcggtctgcgggcggcggagagacatggaggacgcggtgaccgcccgtccggagttcatcaacggccaccacttcttcggggtgttcgacggccacggctgctcacatgtggcgacgtcgtgcggggagcggatgcaccagattgtggccgaggaggcgacagctgccgcaggctcgtcggtttcggacgagaccgcgcggtggaggggtgtcatggagaagagctacgcgaggatggacgccgaggccgtcgtctccagggagaccgccggcccggcgcccacctgccgttgcgagatgcagcttcccaagtgcgaccacgtgggctccactgccgtcgtggccgtggtggggcctcgccacctcgtcgtcgccaactgcggcgactcccgcgcggtcctctccagcggaggcgccacgatccctctctcagctgaccacaagcctgaccgccccgacgagctcgaacggatccacgcagcgggagggcgcgtcatcttctgggacggcgcccgcgtcttcggcatgctcgccatgtcccgagccatcggtgacagctacctgaagccgttcgtgatctccgacccggaggtgctggtggtggagaggaaggacggcgaggacgagttcctgatcctggccagcgacgggctgtgggacgtggtgagcaacgaggtggcgtgcaaggtcgtgcgcacctgcctccggaacagggcgccgcgcggtggccgggagcggtcgagcccgacctccaacctgagccctaggcagagcagcgccagcggcggcagcagcagcagcggggacgaggaggctggtgggcccagcggcgacggcgcggggtccgagagcgacggcgagagcgccgaggacagggcgtgcgccgaggcggccatcctgctgaccaagctaggcctggcgcggcagagcgccgacaacgtcagcgtcgtcgtcatcaacctcaggcggcgcccgcgatcgtgatcggtggtggtggctctgtgatggactagccgttcttggttggtttggttttctggccccctccgtaagttcaaatgggagcccggttcaccttcgcttcggcagagcaatcatcagacaagatgtcaaagcgaagatcgaacaaaatgtgagatccttagcaaaattgcatgctacttccttttacagtagtacagcaggactattgtttcgttagcgtttttttatgggtgggttgaggggtgcgtttctgatctggtcggacagatcatcccgcctttcttcccccggtaaattctccaaatagaaaagcgcatgcgtctccgatgtttgaagaaactttaccgtgcgtccgagagatttaattgtaatatatagtccagtgcccctttcactagccgaaaaaaaaaaaaaaaa

SEQ ID NO: 16457 - DNA, 1727 bp, Zea mays
  misc_feature (164)..(164): n is a, c, g, or t
  misc_feature (202)..(202): n is a, c, g, or t
  misc_feature (250)..(251): n is a, c, g, or t
cggacgcgtgggtccggacgcgtggcaaaagagatgaccaagttttttagaagcaaaacagtttatccaaaatctgttctgaactctaggagacgatcaagtagcttggttataaggagaaaacaaaatctctgcacggagcgtagtggaaccaatgactatgnaagcagcagagtttgcagttctcagaagttcaaatggnaaaatcatttgacagtgattatattctatcagttgcttcaggtatcannctgatggaaaaccttcaaacaatgaagcctcattaattgaggaaaaggaaagggaagtttcagttgccactattgacactagagcatctgccaacagttctaatagaaaggttcaggttggatcacaagaatctgctgaaaagaatagtaccccttatcttgagagaaacaaatcagataatgttgatagaaatatgtgtgcatctgcaactggtgttgttagactccagtcaagaagaaaagcagagatgtttctagtacgtactgatggattttcttgtactagagaaaaagtaacagaatcatctctggcttttacgcatcctagtacccagcaacagatgcttatgtggaaatcacctccaaagactgtcttacttttgaagaaattaggagatgagctcatggaagaagctaaagaggttgcttcatttctgcatcatcaagaaaagatgaatgttcttgtggaacctgatgttcatgatacatttgctagaattccaggttatggttttgtgcaaaccttctatactcaagataccagtgaccttcatgagcgaattgattttgttacatgcttgggtggtgatggactcattttgcatgcatcaaacttatttagaacttctgtaccacctgttgtctccttcaatctcggatctcttgggttcttaacttcacataatttcgaaggtttcagacaagatttgagagatttaatccatgggaacaacacacttggaatttatataactcttagaatgcgtctaagatgtgagatctttcgcaaaggaaaatcaatgcctggtaaagtgtttgatgtgctgaatgaagttgttgttgatcgaggttccaatccatacctatcaaaaattgagtgttatgagcataaccaccttatcactaaggtgcaagctgacggggtgatagttgcaacaccaactggcagcacagcatattctactgcagcagggggatcaatggttcatccaaacgtcccatgcatgctgtttactccaatctgccctcactcactgtcatttagacctgtcatccttccggattctgcccggcttgaattaaagataccagatgaggcaagaagcaatgcatgggtttcgtttgatggcaaaaggaggcagcaactgtcaagaggagattctgttcgtatatccatgagtcagcacccactcccaactgttaataaatctgaccaaacgggtgattggttccgcagcctgatcaggtgtctcaactggaacgagagattggaccagaaggcattataggcactagaaaattttttattgtttctgtacatatgtaaatttatacacatatagttttgtttttctgccaacatgtacaacgtgtaacatcaaagaatcttgcacgtaaggagctccgtagcttactttatccaaaaaaaaaaaaaaatcacaaatcaacttatatattatatgcccgtacgttgct

SEQ ID NO: 16458 - DNA, 1047 bp, Zea mays
ccggccgggatttgctagaattccggttatggttttgtgcaaaccttctatactcaagataccaggtacaattaaacatttatgtttgtgataagtgcgaatgtgcatatattttcatgatactatttactaatgtttgtgtttcagtgaccttcatgagagagttgattttgttacatgcttgggtggtgatggactcattttgcatgcatcaaacttatttagaacttctgtaccacctcctgcctccgtctagctccgatccctggggttcttaacttcacataatttcaaagatttcagacaagacttgagagatttaatccatgggaacaacacacttggagtttatataacccttagaatgcgcctaagatgtgagatctttcgtagtggaaaagcaatgcctgataaagtgtttgatgtgctgaatgaagttgttgttgatcgaggttccaatccatacctatcaaaaattgagtgttatgagcataaccaccttatcactaaggtgcaaggtgatggggtgatagttgcaacaccaacaggcagcacggcatattctactgcagctgggggatcaatggttcatccaaatgtcccatgcatgctgtttactccaatctgccctcactcactgtcatttagacctgtcatccttccggattccgcacggcttgaattaaagataccagatgaggcaagaagcaatgcatgggtttcatttgatggcaaaaggcggcagcaactatcaagaggagactctgttcgtatatccatgagtcagcacccgctaccaactgttaataaatctgaccaaacgggtgattggttccgcagcctgatcaggtgcctcaactggaacgagagattagaccagaaggcactatagacactagaatctttttttattttttgatgtacatatgtaaattcacgcacaaatatagttttgttttttctgccaacatgtacagtgcgtaacaacaaagaactttgcatatcaaggatctaatcaggtggccccagccctaaatgagagttaat

SEQ ID NO: 16459 - DNA, 866 bp, Zea mays
  misc_feature (841)..(841): n is a, c, g, or t
ccgccccggagcccgcgcgtgggtcttccgcccccggccgggaaccaactccgcccagatcaatcaacaatccgacaaaatggcgcgccgtcccgctcgttgctaccgatactgcaagaacaagccgtatcctaagtctcggttcaaccgtggtgtccccgaccccaagatccgaatcttcgatcttggccgaaagcgcgccaacgtcgatgacttccctctctgcatccacctcgtttccaacgagtatgagcagctgagctctgaggctcttgaggccgcccgtatttgcgccaacaagtacctcgtcaagaacaccggtaaggagggtttccacctccgagtccgtgctcaccctttccacgtcgtccgtatcaacaagatgttgtcttgtgccggtgccgatagacttcagaccggtatgcgtggtgcctggggtaagcccaacggtactgtcgcccgtgtcaacattggccagattctcatgagcgtccgcactcgtgatgctaaccgtgccattgctctcgaggccctccgccgatcccagtacaagttccctggccgacaaaagatcattgtctccaagaactggggcttcactcctctccgccgtgaggagtacctcgacaagaaggctgccggccgcgtcaaggtcgacggtgcttacgtccagttcctctccaaccacggttctctggagcgcaacatccgtcgcttccccgacgctttcaagtctgaggcttaaaggatgattgataggatgggaatattgggtttttctggcgtcaaaatggcttgtcaaataaggacctcttaaaactatctagttaaagggcgtcgnattaggcaattgaaatcttacattc

SEQ ID NO: 16460 - DNA, 2492 bp, Zea mays
atctgaatcgcgtgctttccagccctctgcccgctgtgccccacccccacgcccggcgccccgcaggccgcacccacccacccacccgcacccagcgccatgtccaccgcggccaccgcgtgcgccacgcgggcggcggcgcgtccgcccctcaacacggctccggcacgccgcgcgccgccttctgccgtgcgcccgccatcggccacccccgcccgccgcgccgccggctgttgcttctgcgccgccgcctcctcggcgtcgtcgccctccacctgggattggacccgatggagccgccacttcgacgaggtcgaccaggcggagagctacgcatccctcctccagttccagctagaggaggcggtggagaacgaggatttcgcggaggccgccaaactcaagagggacatcatagaggccaccggaaacgacgctgtagcccacgtcatggccgagctcaagaatgctatagaggaacagcggtaccaggacgcgtcaaggttgacaaggcttgctgggaccagcttggtaggttggtgggtgggatatggagagctcactagtccccccccccccccccccccacgaataagccctggtgtcgggagatatgtggcgaagagctacaacccaaggcaattggtcactgcatcttcaggaactccattatttgaaattttccttgtcaaagaagatgatgagacatatacaatgaaggtggtacacatgcgaccaacaaaaggaacttcaggtgcaccatccatatcatcaacaataacagaaagcccagcaaaggtagagaatgaaaattcatcagaaagtagtgctatatctgacagtgttacagaggaggcaaatacagatactacggtaagaggaaatgaggatgctgaagagaaagcacaagatgttggtagcagcaaggatagtagtgtcgaaggattaaaaagtgttttgaatttttttaagtctcggattcctgaattcaaagttcaggtgataaatgttgatgtggctgaggaaactgaattagctgcaaattcgtctgaagaattagtgcaagatgatgtgaaaagtactccagaaagctcattggaagagccagccactgaggaactcgagcaggaggaagatgttccggaagaaaatacggatgaagaaagtaaaagcacggaagtgaagctttttattagtggagtggttcacaataaagaagatgctggagcaaaatcatatgttcgagttccagctgaaataaataacatggaaaaggactcctttgaactgtacattcctggagaaggttctgatcgtgatttggctgaaacaaaggctgcaaaacagaaagttgcagatatggctgctaaattagcctcagagcttatgccgtctgatgttgccaaggcattatggggtacagccaagagttcttcaaagataaataaagaagttcaggagcttttaaggcttacgttaagcaaggcccgagtcaagctgaccgaaaataccatttttaaacgaatcattatggacactaacagcacagatccatttaatggtctctatgtgggagcatttagtccatatggaccagaaattgtgcagcttcgtcggaagttcggccactggaacagtactgatgacgttgagtttttcgagtatgtcgaagcagtaaagttgactggtgatctgagtgttcctgctggccagataacgttccgtgctaagattgggaagggcaagcgacttgagaatcgaggagcatatccagaggaatttggtgtgattgccagttacaaaggtcagggtagaatagctcagcctggattcaaaaatcctcgatgggtggatggtgagctgttggtactcaatggcaagagtacaattccacaccttggaggcgcagagctcggtttcctgtatagtgtacctgagcagagttttctggttctcttcgatcggcttaatcttcccgagtgatgagactcctaaagggagcagactcctcacatgtagattgcatgaacgcgcagaggccggccacagctccaagtgaccgaaacaggtctggggggccgtttccccatcgtcttctgccctctgggcttcctgccaatcctttctccgcacctactttttaggagctcatgtgcttaactcgtttcagagtgtgagggaaagtcgacaccattgctggtctaaactaacggaggagtcttaatactaataatatatatgttatagcatggtagtttgctctccaatgccacagttgtagctgtattgggtatgggcatgacagttttgcgagttttacccgtcatcgttgatttcagtaattaccgaattgaataaaaatcgttctggtgtatcgtgatgttacaattataataatataaaacaaggcaaataaagtctcatgatttatgatcgtaaaaaaaaaaaaaaaaaaacagccaaaaaaaaaaaaaaaaaaaaaaactcgaggg

SEQ ID NO: 16461 - DNA, 1580 bp, Zea mays
ggtacccccgggtccggccggcaggccgcagccgcccttcccgtccttctttctcgtgaacagagcagggcaggctcaccagccagcacgcgcggccacgccacacccgcggagacgcggcacgcctccactcctcggccctcccccgactccgaggcgagcacgccgcacgctccgcctcgcagtcgcggccccgtgctctcttccttcttctccgtccaccgtcttctccttcttcgctcggagggttcgatctggtaactctggtgagaagtgaagacttagcacagtctgtgctcgtcaagtgccctggcactctggcaggatgcggtggctcggtctttcggtggcactctggtagttgtgtccatgggggacaaggttaatccctggtgccactgccattggcataatcctgcatggaaatccgacactgaaagttgtgccggcgatctccacccacctgacgctgggcatcttaccgccgattcggtcgcgttggctccaattttggaattccctccaccgtacccctcacgcaagagacctctcgttttgtaccagaaggagaagcgtgctcctgtactcccagctcctttgccgagcaagggcccgccgccgttagatcccgtgccggagctccaaggtagcaacgagactgacgtgactgatgctggagcaggagaagaaaccgaggagggtatgcacgagaacagggacgagatcaacgcgctcctggacaccgacaggcagtctggtggcgcagccttgagcgtggagtcggtggccagcgctggcgctggcgctggcgctgcgccgccgccggcagccaagaagagaaggctcagctcctgcaccgacaagtccgtcgttgacacggccagttcagcagcaaggcctcctgagcgttccatggagcaggagcagagggttgaacttgcgaacgaccgcgacgcgcagtcgtgctgcgttggggaggtggaaagcgggcgcaggtttgctctgggggaggcggaagcggaagcggcagagggcgacagccccgacgagcagaggcggaggagggagaggatccaggagactgttgccgcgctcaggaacatggtccccgggggcatcgcgaaagacgccgcggctgttctggacgaagcgatctgctacttgcagtacctgaagctgaaagtgaagacgctgggagctgtctccctctagctaagcctatctagccctctctcctcgtcgtggtggctttgttgtcgaaggccgaagccactggcttctggtgagaggagagctagcctatatcacccatctgttcagttcagtcccagaggagctcggatcttctcctacccgactcactgtcggtggctgcatcacccatcttcctcatcgtgggttggtatgcaaaagctagaaacatctttccgctgagcgtgatccaaagcgaagcccccattccatgcaaagcgctgggtcgtgccgtgcgtggggtggctcctgctttatatacgcgttgtgctcctgctttggctgatgtttgctttggtagttatatatagttctgtgtactacaaagt

SEQ ID NO: 16462 - DNA, 2574 bp, Zea mays
cagcacgccgcaggggcatttccgtcaagggccgtccataagagtcctgtccacagccctgccctcccgcaggccgcagccgcccttcccgtccttctttctcgtgaacagagcagggcaggctcaccagccagcacgcgcggccacgccacacccgcggagacgcggcacgcctccactcctcggccctcccccgactccgaggcgagcacgccgcacgctccgcctcgcagtcgcggccccgtgctctcttccttcttctccgtccaccgtcttctccttcttcgctcggagggttcgatctggtgagttctgctcatttcaaggcttggtagtaactgattttttgggctcatttgggagcgttgcgccaccattttttttagatttcgctcttagttaacccttttcgttgtgctactactgcaagggtttaaaaaggcctgcgcaatcgaattccgcgctaagctcacccggatcttggagctgcctgccaatttgacccagcacactagaatccagttggttagcctcattttgttctcggcggctcacatatgcagtagattagtagacagctagcagtagtctaacggattgcagagcgtaaatctgataccagcacacttgagtttccgtatggaagaatcgctgcgtccttccttccttccttccttccttccgtataatcaggaaaactcatcaagaacttggttctatcgattcgcgcaggtaactctggtgagaagtgaagacttagcacagtctgtgctcgtcaagtgccctggcactctggcaggatgcggtggctcggtctttcggtggcactctggtgagaactatccccgttcatctgaactttctgctttcactcatgctgctgctactaactgtttctatttgatgttggcatactaacgctcagtttcgtcttggtattctcaggtagttgtgtccatgggggacaaggttaatccctggtgccactgccattggcataatcctgcggcgcgagccgacactgaaagctgtgccggcgatctccacccacctgacgctgggcatcttaccgccgattcggtcgcgttggctccaattttggaattccctccaccgtacccctcacgcaagagacctctcgttttgtaccagaaggagaagcgtgctcctgtactcccagctcctttgccgagcaagggcccgccgccgttagatcccgtgccggagctccaaggtagcaacgagactgacgtgactgatgctggagcaggagaagaaaccgaggagggtatgcacgagaacagggacgagatcaacgcgctcctggacaccgacaggcagtctggtggcgcagccttgagcgtggagtcggtggccagcgctggcgctggcgctggcgctgcgccgccgccggcagccaagaagagaaggctcagctcctgcaccgacaagtccgtcgttgacacggccagttcagcagcaaggcctcctgagcgttccatggagcaggagcagagggttgaacttgcgaacgaccgcgacgcgcagtcgtgctgcgttggggaggtggaaagcgggcgcaggtttgctctgggggaggcggaagcggaagcggcagagggcgacagccccgacgagcagaggcggaggagggagaggatccaggagactgttgccgcgctcaggaacatggtccccgggggcatcgcgaaagacgccgcggctgttctggacgaagcgatctgctacttgcagtacctgaagctgaaagtgaagacgctgggagctgtctccctctagctaagcctatctagccctctctcctcgtcgtggtggctttgttgtcgaaggccgaagccactggcttctggtgagaggagagctagcctatatcacccatctgttcagttcagtcccagaggagctcggatcttctcctacccgactcactgtcggtggctgcatcacccatcttcctcatcgtgggttggtatgcaaaagctagaaacatctttccgctgagcgtgatccaaagcgaagcccccattccatgcaaagcgctgggtcgtgccgtgcgtggggtggctcctgctttatatacgcgttgtgctcctgctttggctgatgtttgctttggtagttatatatagttctgtgtactacaaagtaaagtaagtcttgtaaaacgtgcacatcctccaggcgggtttgtttctctgctgcccgtctcctatcctgctggccatgattctcggggggcggccgctgctgcatcatgagtcgtccgttgcccttggagagaagagaagagagggtccgtgctgcgttccactgccaggttgggaaccgcaagggtttgccgggaacggagggagggtcggaatccgactgcgagtgggcactgggcaccagcacgcgtgcggcgcgtgggggtcggagcgtgcggcgacggaatgagtggcgaggcaggccaggcgcgggggcacctgctgctttccttggcttaggttaggtgcgactggactggaccccccagctgagtccgcactagagatggcaatgggtacacgaaat

SEQ ID NO: 16463 - DNA, 1059 bp, Zea mays
actcctaagggccagtgggtacctcgaggccggccgggatcccgagggccactccagccacaaaaaaggacccaagatgcaggcgctgggcctgggccgcgggtgcagccccctccatgccagccactgccgctgcaccgcttcttcctatcctccggctccaccccgtcctcgcaatcgcaacatcacaaggctaacctgcatcgccgccgtgcgcgccagcgctgcccagtccgcgcagatggaacgcaggcaggaggcgaaggttgtgaagctgcgggcggtggaggccacgcccgagtccttcgcttcgttcgggcaggtcatcggcgcctcccccgacggcgacgagttcggcccccacgacgcccagctcgatctcagccgcggcatcccaaggttctacatcatgcggttgcagaaccggccgctgaaattctctaccatcacccaccacgccagcgtgacccagtgcctgggctccgtcggcggccaggactggtacctcggggtggccaagccgtcgatcgtggatggggcgtccgagcagagtggcccggagggaaggaagttcttgcagtctgccgcagggcactattacctgcctcctgatccagccgaggtctgcgtgttccgggtttctggccccaagtttctcaagctgaacaaggggacctggcatgccgggcctttgttcaaggcggacgccgttgatttctataatctggaactgagcaacaccaacgttgttgatcataccacacaccatttcaagaaacatgatgggataacatttgtggtggaggactaaaaaaagaacatctctcaatccgaataccactgacaagaccgctggctgatcttgtccatgtttgtagtgaacaaccaacatgtaaagtgtcatgtagaaatgcgcatctgaggtccttgttcaaacttgtgtatcgtgctttgttagaaccgaaataaaggcaaaagttcgcccctgctaaaaaaaaaatcgaaactgattatcagtactgatctgccaatgatattgccaccaaaaagttttttttg

SEQ ID NO: 16464 - DNA, 1020 bp, Zea mays
cattgggtacctcgaggccggccgggaacgacgaccttcatggcggtgccggcctccgcctccgcgtgcgcgcgcgccggcccgccgcagccccgccaccgcgcgcgtagtgccgccgcgaccgcggcggcgttcttgctccgccgccaccagcgaccgccacggcagataataaacctcgtcgacggccgccgtgccagctccgacctccgctgccggcgacggctcctcacggcgcgaggcgagcgcccgtcccacgaggatgatgaggaggaggaggagcagacgtcgtctgctggtggtggttacgggtccttcggcgcggcggtggcgctgttcaaccgcggcgagtaccacgcgtgccacgacgtggtggaggagatgtggtacagcgccgaggaccccgcccggacgctcctccacggcctcctccagtgcgccgtcggcttccaccaccaccgcggcgcgatgatggagctcggcgagggcctctgcaagctccgtaagctgcagctagacggcgacggcgacaacgacgggggcggccctttctcccggttccgggacgaggtcgccgctgtgctgcagttcctctaccgcacccagaaggagctcgccgcatgcaccgatgagctgtgcttaaccatggacggctcgccgagctcgtaccagctgctcggcaacttcgccgccggccagcaactgtaccggctggaactgctggaagcggaggaggacggggcttgttccagcatactgttctctgcgcccaacggcggcggcggcatcgctgcgcaaggagcagctcctcgcccccagagagtgaagcttccaacgctgcgtgccacggagcaacatctggtagcgcttcagtgtacatacgaatatacgtagctataccctagcattcattcatgcgggtccacctgcctgcaaacggcgaagtcataaggataacgcttaataattttactatgtgcgtgcccttgcgttgcgatggtagcttaaaaaaaagcggcc

SEQ ID NO: 16465 - DNA, 1253 bp, Zea mays
cattgggtacctcgatgccggccgggaagccactctcgacacggcacgggcaccacatcccccaaggcaaggcgtacgtggcacgcgcgcgtccagctccacaacgacgaccttctggcggtgccggcctccgcctccgcctccgcgtgcgcgcgcgccggcccgccgcagccccgccaccgcgcgcgtagtgccgccgcgaccgcggcggcgttcttgctccgccgccaccagcgaccgccacggcagataataaacatcgtcgacgaccgccgtgccagctccgatctccgctgccggcgacggctcctcacggcgcgaggcgagcgcccgtcccacgacgacgacgaggacgaggacgaggacgaggagcagacgtcgtctgctggtggtggttacgggtccttcggcgcggcggtggcgctgttcaaccgcggcgagtaccacgcgtgccacgacgtggtggaggagctgtggtacagcgccgaggaccccgcccggacgctcctccacggcctcctccagtgcgccgtcggcttccaccacctcttcaaccagaaccaccgcggcgcgatgatggagctcggcgagggcctctgcaagctccgtaagctgcagctagacggcgacggcgacaacgacgggggcggccctttctcccggttccgggacgagatcgccgctgtgctgcagttcctctaccgcacccagaaggagctcgccgcatgcaccgatgagctgtgcttaaccatggacggctcgccgagctcgtaccagctgctcggcaacttcgccgccggccagcaactgtaccggctggaactgctggaagcggaggaggacggggcttgttccagcatactgttctctgcgcccaacggcggcggcggcggcggcatcgctgcgcaaggagcagctcctcgcccccagagagtgaagcttccaacgctgcgtgccacggagcaacatctggtagcgcttcagtgtacatacgaatatacgtagctataccctagcattcattcatgcgggtccacctgcctgcaaaataggtggagtatatttcaaaaaggaaatgctcctccatcatttgctacaaagtaaaacaaactatatatagctcgatccattaattagactctgatacgacatcgaagtctgcagaaagagctgcggcctgtaaagtatacttttaaatttttattcaataataaaatactgtagggaccctcctatactacagtgaattgatc

SEQ ID NO: 16466 - DNA, 3543 bp, Zea mays
agttaggcctcccatgttttcttcacaaaacctgtcgaggaaacccttcgcaaaacccccaaaccccagcaggcatcctctcttcctctcctctccaatctccattgcagcagcactgcagcggcgggtgcgggtggcatggctatggcgtccgcgctgccgctcctcctcgcgccgcgcgccgtctttgcgtccgcggggccgtcttcgcctcatctccgctcccgccgcctcgcgctgcgtctccctccccctccccgacccgccgccctctccgcgccaccagccgccgtgcagccgcgcgaggcccggcgcgtccagccgccccgcgccgcctcctgctgccaagatcccgctccggccgcgggaggaggcgccagggactggcggatgttcttagcatggtacctaatggctctggacaagaacccgattgtgactaaggcggtcacttccgctgccctaactctggccggggacctcatctgtcagcttgttatcgatcgagttccagaacttgatttgaggagaacatttgtattcacatttttgggcggacgcgccgcccgtcccgcccttgtggggccaactttacatgtctggtacttgtatttgagcaaattagtgacaatcagtggggcatcaggtgccattgctcgccttatacttgatcagttcattttctctcccattttcattggcgtctttatgagcttactagtcaccttggagggaaagccctctcttgtggtgccaaagcttaagcaggaatggttatcatcagtgttggcgaattggcaattatggataccatttcagtttttgaatttttacttcgttcctcagaagtttcaggtccttggtgctaattttgtagcccttgcatggaatgtgattttatcatttaaagctcacaaggaagttatcgcgaaataggtatgaaggagcgcagtgaactcccccggtcggtccaggatagggataggatagtggcagctgaagctgtagggcttgtaaattgtcgccatgtgggactggagtggatcattctgatcagtagtcaacacaacactgaatggatgattgtgatggacatgcctgtgtgatctcttttgtgcatgctacaccaatacgtgtttggccagcatgtatgcctggacatgtgtgttactatttgtgctgtgatgggttgttcgagatctaggaaacacattgggttgttgatatctttaggccctgtgtggaagcgtctattttttttaagaaactggtttatagaaattgtggtggttctaaacataatagtttataactcagttcacttaaactactaaactttagtcacttttgtttcaggtctcactctttatttcaaacagtgcaaagcagtacttgacacacttatttacacggcctgttgttggagatgacctcaacgtttctaatattcgcttggactttcacttggacttcgttagatttggattgcgtggatccattttttttttgagtaatccaaattattggacatccgtttggcggtcggtgaagttgtggatcatgatctaaacgtgttcgtcgacagactcgacggcggtgccgccgctgttaacagagggtgcacggtcagggtcgggccgttctgaggcctgctgctgtgaatgtgactgtgaatttttttttttccacttcagtcaccgttaattcaccggagcatttcgctctgtcctgaggcctgctgctgtgaatgtgactgtgaattttttttttcacttcagtcaccgttaacccgtgtagccatgtcgttaaaccacggtggctctctagtcgatctgtgagactgtctatgaccaagtcgtcttgcttgcttggcgtttcgttgcgatttcaaaaaaggaaaaaaataataatattatgcatgagctcggcgttttattacaaatcgcaagttgggctgtgctaggtctggtcggcccagcagcacccacggctgctacgtcttttttttttttttttgcctgggctggagcgggaatttactcatcactagacacagacagactagtagtgctaagagtagaaggataattttgttcgcggtgcgctgcatgcagtccacacgtgcagtgagtggggagccaatcagccaagccaatgattgatgggtgctctcgtctggtggcaagccacacacgacacggcacgggcaccacatcccccaaggcaaggcgtacgtggcacgcgcgcgtccatctccacaacgacgaccttcatggcggtgccggcctccgcctccgcctccgcgtgcgcgcgcgccggcccgccgcagccccgccaccgcgcgcgtagtgccgccgcgaccgcggcggcgttcttgctccgccgccaccagcgaccgccacggcagataataaacatcgtcgacgacccccgtgccagctccgatctccgctgccggcgacggctcctcacggcgcgaggcgagcgcccgtcccacgacgacgacgaggacgaggacgaggacgaggagcagacgtcgtctgctggtggtggttacgggtccttcggcgcggcggtggcgctgttcaaccgcggcgagtaccacgcgtgccacgacgtggtggaggagctgtggtacagcgccgaggaccccgcccggacgctcctccacggcctcctccagtgcgccgtcggcttccaccacctcttcaaccaggttctttccttccattcctcctccagttaattcccttgttaatttcacacatctcacaccgatccgccagtagatcgcactctcgatgaggtgtgtgcaatgctccatcgtcgccatacatgacgatcgatcgccacgtgccctgtgcagaaccaccgcggcgcgatgatggagctcggcgagggcctctgcaagctccgtaagctgcagctagacggcgacggcgacaacgacgggggcggccctttctcccggttccgggacgagatcgccgctgtgctgcagttcctctaccgcacccagaaggagctcgccgcatgtacgtacatccatcgactaccgtcacttcgttccttccttcttcctcgtcgtcgacgtgtgacgtgctaaactaaagctcaccccggtctcggtctgcacatgtaaaaataaatctctgttctttcttttcttctaaattccattcgttcatcaggcaccgatgagctgtgcttaaccatggacggctcgccgagctcgtaccagctgctcggcaacttcgccgccggccagcaactgtaccggctggaactgctggaagcggaggaggacggggcttgttccagcatactgttctctgcgcccaacggcggcggcggcatcgctgcgcaaggagcagctcctcgcccccagagagtgaagcttccaacgctgcgtgccacggagcaacatctggtagcgcttcagtgtacatacgaatatacgtagctataccctagcattcattcatgcgggtccacctgcctgcaaacggcgaagtcataaggataacgcttaataattttcct

SEQ ID NO: 16467 - DNA, 1247 bp, Zea mays
gggtaccctcgttgtcggccggggcaaaacccccaaaccccagcaggcatcctctcttcctctcctctccaatctccattgcagcagcactgcagcggcgggtgcgggtggcatggctatggcgtccgcgctgccgctcctcctcgcgccgcgcgccgtctttgcgtccgcggggccgtcttcgcctcatctccgctcccgccgcctcgcgctgcgtctccctccccctccccgacccgccgccctctccgcgccaccagccgccgtgcagccgcgcgaggcccggcgcgtccagccgccccgcgccgcctcctgctgccaagatcccgctccggccgcgggaggaggcgccagggactggcggatgttcttagcatggtacctaatggctctggacaagaacccgattgtgactaaggcggtcacttccgctgccctaactctggccggggacctcatctgtcagctttatcgatcgagttccagaacttgatttgaggagaacatttgtattcacatttttgggccttgcccttgtggggccaactttacatgtctggtacttgtatttgagcaaattagtgacaatcagtggggcatcaggtgccattgctcgccttatgcttgatcagttcattttctctcccattttcattggcgtctttatgagcttactagtcaccttggagggaaagccctctcttgtggtgccaaagcttaagcaggaatggttatcatcggtgttggcgaattggcaattatggataccatttcagtttttgaatttttacttcgttcctcagaagtttcaggtccttggtgctaattttgtagcccttgcatggaatgtgattttatcatttaaagctcacaaggaagttatcgcgaaataggtatgaaggagcgcagtgaactcccccggtcggtccaggatagggataggcttgtaaattgtcgccatgtgggactggagtggatcattctgatcagtagtcaacacaacactgaatcgatgattgtgatggacatgcctgtgtgatctcttttgtgcatgctacaccaatacgtgtttggccagcatgtatgcctggacatgtgtgttactatttgtgctgtgatgggttgttcgagatctaggaaacacattgggttgttgatatctttaggccctgtgtggaagcgtctattttttttaaagaaactggtttatagaaattgtggtggttctaaaaaaaaaaaaaaaaaaa

SEQ ID NO: 16468 - DNA, 1549 bp, Zea mays
  misc_feature (1391)..(1391): n is a, c, g, or t
tatagagtcaaataactctcgagtttttaagattttaaagcaacaaagaaggtatctcaaaaacttataatgtagctttcaaaactctatagagtttataagttagagtgtttagcttgctatgatcagtcttcctttaaagttttgctatatagccatactaaatatctcttaaattttaatacatattaggattaaacttaacttgaaaatatagattaaaattaaattcaatatatataaaggattagaacctataagggctagtttagaaactcaaatcatattcgggattgaaaaggattttagagaaaattagttcatttccatctaaccttccttaattccgaagtggatttgaggtttataaagtagctttaagaattaaagataaacgaaatagtacaaacaatactttattgtttaattagatatagattataatcgagatgtatttaaaaataaatatatacgacaaatgaaagttgcaaccgtacgggcctcttccggcgatcacgtggacgacgcgtgcatctctttccatgccgcctcgtgtccgcgcgctcacgcgtgtcctcacacgtgctagcgaacgtgtcgacgctttccctgtcccagactcccaggcttccggctccagacgtgtgtccacgtccagttaagtctataaagtggtaacaaaaatcggaacgttgcctctcatcaaccgcagtacacggcgtatcattcccagcgaccacgagagactagctagccaagtgcatgcaaccagccatgcaggccgggaagacggcagtggaggcgacgaaggaggccgcggccaacgtcggggcctcggcgaacgccggcatgcagaagacccgtgccgccgtgcaaggccaggtggagaaggccacggcgcgcaacgcgtcggacaaggtcgcggccgaggagcgccagcgggagcgcgtgcgcgccgcggagctggagaagcaggacgccgtgcgcgccaacgcggccgcgaaggagcgcgccattggcggcgcggccacgtaccagcaccagcacccgtcgcagggcgcgcccgggatcggcgcccagcaggagtatggcggcggaagagtcgcccccgcgggcgggcacgtcgaggccggcgtcggcgagacccgtcccgtcgctaggggcaccggcacggcgcggcccagcgccgcgcacaacccgctcgtcggcagcgacttctcgcaggcgcgcggcaccggcggacagtaccagtgagctgccgcctccgcgacgtgcccgtacgtgtgacctatcatgtgtgtgagataggcatgtacacgaatggtccttgtgtgataatctatgctaaataatatgtctctaatataatagtgtaaaaaaaaaaaaaaaangtaattcccattaccttactctgtatctgatgtatactagtttcgacggtcttttgagcatcaaaagtgggagacggtttcgccctagtggcggacggttcgccttaaggtccgtccggtttatggccctacgatcagataactccggatcaatttag

SEQ ID NO: 16469 - DNA, 6029 bp, Zea mays
  misc_feature (64)..(64): n is a, c, g, or t
  misc_feature (131)..(131): n is a, c, g, or t
  misc_feature (245)..(245): n is a, c, g, or t
  misc_feature (292)..(292): n is a, c, g, or t
  misc_feature (3646)..(3646): n is a, c, g, or t
ttttgttttctctttgccggcactactatcgtaggagaagctacatgaagggctatattttcanccaaacatgatgctttttctatagcttttctttaaaataagtagtgagctattttcttaaagaagtnagagccagaacgacatctagcatagaaagaggcctactaaacggggcctaagttgagccacacacaccaatcaggcccataagaccatctccagcagcttacctatactcatanctatattcaaaccacactctataaacaatgtaatctacaatgtaaancgatgcaaaacggtgtttttagtgaccatataggtgcaatgtacattagttcacctatatggtcacaaaaacacattttgcattattttatactgtagattgtattgtttgtagagtgtagtttgaatataagtatgagtaaggtgttgggatggtctaatatccgctttggcatcttaccatctgtattttgctgaaattcagacatcgcaatctgggcttgcaaagaggaacggcccagcccaacacgtgagtctctcgaaactgggtcaacaggcagcccaaaactccaacccaactcgattcctcagtcgccgagcaagccattcctgatcccgccccaaccccaatcgacaagacgccgccccggcccctcgcgccctctccccaccggctaaccctagcagcggcacgcgggcgacggcgaccagtagagggctagtcgcgccaccggcgaagggattcagcggtctacccgtcctccgacacaggcgcggcggcgtcctgcaggtacctccatctttttctccccatgcatctctagcctgttccctctcgcgcgaggcagcgtgcccgccgccactgtatctccctctctctcgccctcgcgctcgcgcattagcagatgcctcactcactcttctctgacgccgctggcatgccctactcccttctctcactctgttttacagtttagccctaatcctggtgtgctgtgtcgggttgcctttttcttgtgcaaaccgtgcgtctttggttgcagatctctaattttctttgttaacgaattgacgcacacctctcctgcatattctcgcgaaaagatcagtttttgaacgccgcataaaaagaggtgtacgctaacattcacaaatgttaaatcgttagggatacctacacccctcaggcataaaatagtatgagttagttttttgccatcttctgtatgaaacgatatgtttaacattcacaaatgttaaatcgttagggatacctacagccctcacccctcaggcataaaatagtatgcgttagttttttaccatcttctgtatgaaacgatatgtttcaaaatatgtactaatactataaaagttagaaatccagcgactaggctgattgtgaggctgatttcgtgtgatcattagtcattacaaggtgggttgactgaacagaggttacttagggtggtatgtttcttatttgctttggtattggatgctaatatcgtttaactcaactgaacccaaaatcgatcctggatcagtcaaatctggctgttttgaacaattggcttggcagtattcaaagaactcaggcacaagaaattcagaattgcaaatttactacagcataaaggggaaaaacataggtcagcatctactagcgaataatatttttttgttcttaggactagcagtggatgccaactgcccggtgagacacagttttttggccccctgtttttttctgcttataatcgccatactgtttttttgcattcttgttcatggtagctcaaagttctgaagcgtcaatccgaagaataaaaaataattgaagcttttggtgggactctcgctttttttcagcgctatccgattataagtggaaaaacagggccttggtgtgaagggggatttatagattcattacacatgctagtttgtagggttggtcttctttccgctcactgtcaaattgagaaattcagaaaaacacacctgtgtaatttatgtgaattctatctttgctgagtgcatttactatcacttagagacttatcatgctttatccagtgaattaacaaagaactatgttcccccaacaaaaaaggcaaatatggtccattgttctgctctggttagctttataagttcgacactgtttttctttatttgaccttttccttgctgtgtagtggaaacaacatgtacttgttgtctttcaatacctgttcttcaactgacagtatattaccctgtgtcattccagattattattggtttgttgcaaaatgtctacggaagcgactttgaacaattctggtggttctgaatctgcattgctgttactggaacagcttgctgaagtttttggaaagttaaaaactcacaccgaaacatttctgcatttgcaaaatggcataaaatgggaagatattgaagggcatttcctcagccttgatgagtcgtacagaagcaagtttgatgaactggtagagaaggagaaggcattagaagaaaagaaagctgaagcttgtaggttgattgcagagaaagaggctaaagtttctacaaaagagcatgcctcactgaatcagcttcaggagctaagggatgctgctgtctcttctctagcagaggttcgacaaaaatataaggtggagcttgctgagatacttgaagcaagtggaagcaaagacaaaaaggtaagtacctcaatcaatgacaacaatgcatctcgtgcttcagaggagaatacccctgctagtgggtcgggtgaggcatctgaagctttacctgttgagactaagccgcgccctgtattgaagcaactttgtgaacagatggacaccaaaggccttctgaaatttctttcagaaaactgtagaaaacttgctagctttcgtgatgaactttctgttgcactaaaatgtgcaactgatcctgcacgcttcgtacttaattccctggagggtttcttcccaccagaccaaactaattcacctgggagtaaacataatgtccttgaggtccagcgcaagagctgcattgttttaatggatgctatagcacctgcactagggacgaaggagcctggtggcaacgacccttggagctctgaaattaaagagcaagccaaggcaattgccgaagagtggaagagtaagttagctgaggttgacctggatgcttctaatggttattcattggaggcacaggcttttctgcagcttcttacaacttttaatgctgattcggtgcttgacgaagatgaactatgcaagatcgtagttgctgtctctcgtcgcaagcagactgctgtgtcctgtcgctctcttggtcttaatgaaaaaataccaggttggtacccacccagaatgccacaaggcattctatcccttcatttgtcaggctgttgtaaaactatagccagaattccttctagggaactaaacttctttactgttttgttcaagtgcaaagcatggagtgactgcatgaaattagtgttttaagtttttctattgacattttatgttcctaggtatcattgaggagttggttaagcggcacaggcaaattgatgcagttcatttcatacaagcttttgggctttcggagacattcncccctgcacctctgctgaagacatcccttgaggaacataaggatgtcaattgaaaataatggcgatgcaactgcgatctcattaacgggtttgtttattttctcatttttgtgattttgatgcgactgtctagtggcatcatagttcattggtctaacagaactacttcattctctagtgtactgtaaaataaagcttatgaagttattttttatttcattttttgttcttaataaggtatgaaaaatttgaggtataactaacttcttatatctttttttgtggataatttggtttttttaaattatgtaacttggagggataggttttttactgaataaagaatggaaaaaagaccttttttagggtatgggtattaattggttacgagttcctcagcctgtcagctgggtcaagagaacaagggtagacccggaggccaccacatgagtggggtatgggaaaggaataaactgaggcaagtcttctttccgcaaagcgaagaggctgcttcaaacttgtgagtttgtgacctggtgactcagcgagacagctctcaccagtcaccacttcaccatgcttgctgttcttggtacaagagaacgaaatctggataataccaattcctatttgctgtaaaatgattcaaactactaagtaattgtttttaagtttgataatattgaccattgggagcccatctttaatttcttgaaatttatcttacctttacctccagaattttctagggaaatgctatattgctctcagcatataatgtttgctgtctgtgaatattactgtgcaactgttgctaggcgcttcggcttaccgcacaattgtctcgtgcattgtgggataatgaccacaatgttattagtaatgtgaaataagtccttatattaaatcatgttgtatgatagttttacatttgatttgcaattctttttttatttctattgtttgttattttataactttacaagtttgtctcatgactcgataaatccaattttcaggatgaccccaaatctagggagctaattgctttgagggctgtgattaagtgtatcgaagagcataagcttcagaaggagtgttcacttggacctctccagaagcgtgtttctgagctgaagcccaagggtgagaaaaggccatcaagtgatgctgggcgtacttatgcaaagaagcctcgaggccctgcgcatttcatttcctaggagacctgccggttctgttggttcagctgctcgcaggcctccatttccgggctatacctggcagcgtgctcctgcgccgatgccctcccgtggtcctgctccagtgccctcccgtgcccctcttcctgcccctcttcctgatagatatggagctgctgaccggtaccattacacaccaccagccccagcatacgactctggtgcattttcgtcttacagtgaacctttcagcgccccaaaaccattccagtacactccagggtcagtggcagcatcatacaattcaagcccctataaagtcgcttatggtggccctggagcaccagtcagaagcacctatccaggttatgccggcgcatctgggccggctgcttccagcagctatgcaaattatatgggatccgtatatcgccctccccagcaaccatagatttggctcctccctcaaaaaatgttgtgctggtgatgcaagacatggaaaccagtccctcccatctaactcccatggcggagatgtaaacttgagctattttcttgtttcatcgtccacaacagtgggttttggaggtgtatactgatgctctcatgtccagctacatctacatgtaccttgcactcttgtttgcttttagatgtgcttattcctgagtcgttgaatgttttatattttctttccacaagtctgtctcatgtagggaactgtctcatctaggaatataactcctttacttgctaccgttgcgattgagttggaaacgcccattgagtttggaaaccccaaaccggggcttgggtttaacagcttgcttatccctatctcatttcatttttcactttgtaatagtcaaatagtgcgtcttacattttaaattccaagtgtctctcattttaaactattctgtaacagtatgtaacagtcaacagtacaaaacacggatttgcacagccatatgcatcatctgctgaatagcatgacaatctttggtaatacttcctccattctaaaagaactaaatttgaatagggtcatgttttcgtatcttaaattttgaccaattagtttatgtaataactaaaggatagggatgaaagtggtaatccgaactgttagaacaaatttaatattttaaaatagatatgtgtaaaatttgatgttgatc

SEQ ID NO: 16470 - DNA, 2405 bp, Zea mays
ttgggtacctcgaggccgagccattcccgatcccgccccaaccccaatcgacaaacgccgccccttctcgtctcgacctctccccaccggctaaccctagcagcggcacgcgggcgacggcgaccagtagagggctagtcgcgccaccggcgaagggattcagcggtctacccgtcctccgacacaggcgcggcggcgtcctgcagattattattggtttgttgcaaaatgtctacggaagcgactttgaacaattctggtggttctgaatctgcattgctgttactggaacagcttgctgaagtttttggaaagttgaaaactcacaccgaaacatttctgcatttgcaaaatggcataaaatgggaagatattgaagggcatttcctcagccttgatgagtcgtacagaagcaagtttgatgaactggtagagaaggagaaggcattagaagaaaagaaagctgaagcttgtagattgattgcagagaaagaggctaaagtttctacaaaagagcatgcctcactgaatcagcttcaggagctaagggatgctgctgtctcttctctagcagaggttcgacaaaaatataaggtggagcttgctgagatacttgaagcaagtggaagcaaagacaaaaaggtaagtacctcaatcaatgacaacaatgcatctcgtgcttcagaggagaatacccctgctagtgggtcgggcgaggcatctgaagctttacctgttgagactaagccgcgccctgtattgaagcaactatgtgaacagatggacaccaaaggccttctgaaatttctttcagaaaactgtagaaaacttgctagctttcgtgatgaactttctgttgcactaaaatgtgcaactgatcctgcacgcttcgtacttaattccctggagggtttcttcccaccagaccaaactaattcacctgggagtaaacataatgcccttgaggtccagcgcaagagctgcattcttttaatggaagctatagcacctgcactagggatgaaggagcctggtggcgacgacccttggagctctgaaattaaggagcaagccaaggaaattgccgaagagtggaagagtaagttagctgagattgacctggatgcttctaatggctattcattggaggcacaggctttcctgcagcttcttacaacttttaatgttgattcggtgcttgacgaagatgaactatgcaagatcgtagttgctgtctctcgtcgcaagcagactgctgtatcctgtcgctctcttggtcttaatgagaaagtaccaggtatcattgaggagttggttaagcggcacaggcaaattgatgcagttcatttcatacaagcttttgggctttcggagacattcccccctgcacctctgctgaagacatatgttgaggaacaaaaggatacaattgaaaataatggcgatgcaactgcgatctcattaacggatgaccccaaatctagggagctaattgctttgagggctgtgattaagtgtatcgaagagcataagcttcagaaggagtgttcacttggacctctccagaagcgtgtttctgagctgaagcccaagggtgagaaaaggccatcaagtgatgctgggcgtacttatgcaaagaagcctcgaggccctggcatttcatttcctaggagacctgccggttctgttggttcagctgctcgcaggcctccatttccgggctatacctggcagcgtgctcctgcgccgatgccctcccgtggtcctgctccagtgccctcccgtgcccctcttcctgcccctcttcctgatagatatggagctgctgaccggtaccattacacaccaccagccccagcatacgactctggtgcattttcgtcttacagtgaacctttcagtgccccaaaaccattccagtacactccagggtcagtggcagcatcatacaattcaagcccctataaagtcgcttatggtggcccaggagcaccagtcagaagcacctatccaggttatgccagcgcatctgggccggctgcttccagcagctatgcaaattatatgggatccgtatatcgccctccccagcaaccatagattcgactcctccctcaaaaaatgttgtgctggtgatgcaagacatggaaaccagtccctcccatccaactcccatggcggagatgtaaacttgagctattttcttgtttcatcgtccacaacagtggggtttggaggtgtatactgatgctctcatgtccagctacatctacaatgtaccttgcactcttgtttgcttttagctgtgcttattcctgagtcgttgaatgttttatattttctttccacaagtctgtctcatgtagggaactgtctcatctaggaatataactcctttacttgct

SEQ ID NO: 16471 - DNA, 2154 bp, Zea mays
attggggcacgagacccttgccgaggacagcctagacaaaccatagaagccgccactcacgcctggaagcatctggaggcgtggcacggcagccgtcgcccgccacaccagcagcgaactgcttcccggtgcccgcggcggcgaagcacaggagagaggcggcgagtgaaaccgatgacgccgccgatggatccgcccgacgtcgagatggagatggagcccgcgccccagcctccggctccgacagcggtcggggaggggtggagcatgctgtcgcgcgcccgcgggctgctcgaggagggcaaaccgtccctcgctctgcaggcggttctcttggccataagatctcaaggcggtgaacaagctctcatgcagacattgaaccgtgcacgtgaactctatgcacagagattgcaggccagtcctagtgttgatgagcttgcctctttgcttgcccaatgtgccatagcagaggctcagtcatcaaatactaaccctccacaagggcctgggtcagaccctgtcaatatgctgaattctgatgaggcctgcattcttgctgagagtggaaggaagcagatcatcctggacgcatttgccgacgggagcagcttcatttgcttgaaatgtggggggctctttagcacatctcgcaaggatgagcacttagcctactggtgcgggactgcatgatcctggttacgtcttgctgtggtatatccatggtcacacctagcaatgaaccgatgatcatgatacccgtgagattttgtataaactttgttctgttccaatccgattactgcttctttactgcggggatgccagaggcacgtctgttaagtcgtagtaaatacatttgccgatgacaaactttatgaacgaaagtttccatctctatccgcttgttgtacttgtgctttcggctgatggaatgtgttgagatgtttggcatggtcataaaaaaaaaaaagttgaatgtgacgaagcaatgttcttgtggttagctctgatctgatcacgcaaatactgaagctgggtagaaagtttggaggaactgatgatatgccccttcgctttcggttttattgagttgaaaactggatttagcagtgatattcatgagaaaaatctgcaaagaagatagagcactgccatcactacctgctaccataaaaaggttggttttcacattcctctctctgtttatcaactgatcttctgtttggatgaccaacccatgcttttatgatattgttactagcgtcgccactgttgtgtcttcaaattacttgctgtcactgtaaatgtgaaatggttctggtccttttggactccacaaggaatgggcaggcaggcgatgcgtgtttcatgcccggtttttgcctaggcttcacttgaaggcaacggagagagaagctgagagccacctcctatctgcaggcctgcagctcctgccacgcctgtgccttacattctaagtgtttgcaattgctggtagcctcttacgatcagtcaatgaattccagacttcatctgttgctcggtgttgtttgtcaccaaacctgatttgcttgctccctttggtggctgcttttgtttcatatacgtctggtctggtggtggccagaaagctgctggctgcccttccaaaacctggtgtcatcttccgttgcttttcgatgatgctctccgatcatcactcaccttgcaggttggtgctactgtgcaacgccaaagaaaccatgggtccttgctctgcctgaaaaaaagtgtcatgacttggttgtccggggaatattcacattcaacccattccaatttttataggactgtttggttaacaaatttcaactttgaagcatcttcatttaggaaaggaaaaattataaattactctcctcacctatagacgatgtttatataacccttaaattattttttcgttcaatttatctctgtacgtttgagttggttcaatctattgctttacaatatttgtctttttttatttctttatgtacaaattaagttttcggtttaaattattagtctagaaaattatattatgttttttttccataaattatttggatagattaaagattaaataatataataactttaacggtataaaactaaatataaaatata

SEQ ID NO: 16472 - DNA, 2246 bp, Zea mays
  misc_feature (2170)..(2170): n is a, c, g, or t
cgaggccggccgggatagaagcagccgccactcacgcctggaagcatctggaggcgtggcacggcagccgtcgcccgccacaccagcagcgaactgcgtcccggtgcccgcggcggcgaagcacaggagagaggcggcgagtgaaaccgatgacgccgccgatggatccgcccgacgtcgagatggagatggagcccgcgccccagcctccggctccgacagcggtcggggaggggtggagcatgctgtcgcgcgcccgcgggctgctcgaggagggcaaaccgtccctcgctctgcaggcggttctcttggccataagatctcaaggcacagacatatgtagttgctgagtaatgaaaagctgttgggttgtagttggtagacccaagaaacacgaactcgactcgtccaaggtggaagttgaacaggacacagaagacagaacacaagaacactcgtcgttttcgttggacggactgaatagccagcggcaccgccttttgggtgttttcttttatcctatcgccgagacagttgcatcgcccagagcccgatccttctgccatatccgcgtcttccgccatgactcagcatgaaacacgcggaagccgctggagtggagaaaccggcaaacgcgcccacgcacgctcgatgtgcgcggtgaccgcgctccgacgtggctcatgacatgccctggcttgcgcccatttatttgcaagaattcgaactcttatctactgccaaactccatggtcagttggtcacgaagctgaagtatccaacagtagttgccgagtaatgcaaagctgccgtgttgatcattggcaactcatctatcgtatcccctcgctatactgttgatttatgtgttcttgctaattagaccgtggcactgtgcagttgcgtctagctctgttggcattgcatgcattgcatgcattgctgattcgtgacatgtggcgagtttccaatacagtacaagccctttctgttagagttttatccattttttgttttttttttccaattctgaacatgaatgatctggaaaattgaatgactaccatccggaaaattcatggatgcagtgtgttatctgagcattgatggcatccgaagtaagggcctgcaacttaatttcaagaagccgagtcaaatcgagctttaagagtaggtcttacttccctcatgtggtgaaccttactagttagcaaattatgttcctgttgattgaacactaagagctcatcagagacattatttggataaaatgcttaacacaactgaatctgatctcaacgacagcttaggtacaccttaacatgctgtgtgatcttatgtttgtgtaaaactggtggtgtcctatcccatatgtgcaggactgcagggcacatttgataatgatgttcttctattccatatcaaccattttggattgacctgttaaaaatgactatcaaaaccttttataggtgagtaagggtgaaagtagaaggcatggttggggaaagttgaagaaagccacagcccacaattagaccctgtttgagagctcatttttaaacccacagttttccaataccacagtctaataattggcatgagtgcatgacacaaccatggtttttttacagcagtcaatcgaacacctttttggtgccatggttttttatgttgtcatcaagcttcattcaaaagatgttgactggcgatcatataagtcaaataagtcacaacaattcacatggactaaaaagaaacaagtgcgtgacagtttacatgaaaaaagcacttgacagaggggtgcaccaaagtttttcatactccaaaaataccgtggtattgccaaaaccaaggtttttatatagtgtggttttaaatggtctacccagcaccttttggcctctaaaaccatggtactcttaaatagcacagtattgtcttgggactaggaaaatacagtatcttcaaacagggcctcagtgtttggtttgcttataaaattatttgagtctacactattttacataggaatacagggcaatataggcttaacgaatcttactatatatgtattagtgtgcgatgcaaaacatactctatctgagttctcgagtagcaatcctcaggttctgcgtttgaattccctgtggagtgaattttaacctgngttaaaaaaatccctttgtcgttctaagatcaagcccctgttaaggttgttctcacatgggctatatttccttgtg

SEQ ID NO: 16473 - DNA, 1241 bp, Zea mays
gccggccgggtcgcggcgccaggccgcaccgcacacacacgcacaggcagcagcacagcgatctgccttctgccccgcccccatccagcccagagcagcagcagcgcggtgccggccggcaaccgcagctggtcatcaggtctctgggcctcctcctcctcctccatcccccctcaaccctccccgtgtcggctcctcccgaatcctcacaagtagccccgcgcgccacctcgctgccggccgccggcacacagatagagaaagagagagagactgagagagagagggaggggaagcgaagagaccagaacaagagcgaagatggtcggactcctccccgagaccaatgccgcggcggagacggacgtcctcctcgacgcctgggacttcaagggccggccggccccgcgcgccaccaccggccgctggggcgccgccgccatgatcctagtggcggagctgaacgagcggctgacgacgctgggcatcgccgtgaacctggtgacgtacctgacgggcaccatgcacctgggcaacgccgagtccgccaacgtcgtcaccaacttcatgggcacctccttcatgctctgcctcctcggcggcttcgtcgccgactccttcctcggccgctacctcaccatcgccatcttcaccgccgtccaggcctcggtcagtcccctcccacaaactcgggacaaattcttttttttctttccttttatttttataataataataacaatagtaatctgctcaccgcttggacttggatcggataatcctagctagggcagctcgttcggctctgctctctctacatgtcggttagtttactggatgggtgcggtcaatctcctctgtcgaaatatctgcgtcggcttttcttcgtcttgatttttatttattttttatccccttccctggtaggactcacttaggaggagtaggactagtagtagtagcagccgttaaaaaaaaacccaaataaaaattggaactttccatgcagaagatgctcaaccctgaaaagaaccgcgcacgcgcacccaatgaaagcaaacagtttccaatccagtccatcatcgcccaatgaacgcccgcccatgcacggtggtgcggtggacagccggcgggggtctacaatttcctctttttgtttccccccattattggcagcggagttgttggattcgatccttgcatcatctgcctgtctgtcaatctacccggacgctgggtcg

SEQ ID NO: 16474 - DNA, 3094 bp, Zea mays
ccccccccccccccccccccctttcacggcgccccgcaccagtcagtcatccaccaaccgagagtactagcttcgtgccctcatcgcttcctggcgactcggacacggacagtgtgtgagactttttcacagccgcattgaaaacgtggcagcaaggcgtcggcttgaggagctgaggtactgatgaatgaacagcagcagcagtagcgtagtagacagtagggttggaaagtcgggaaccaaagttgcagtagaacattgtgtgtgccgtgtcctgtcgaacagacgtggtccaaggaatagaaagaggttcggcttgaccactgacatgccacgcctacatacatacagtcgcgagtctgacggagtgcactgcactgtacaccgaaaggcggagggggtgctgcatgattgatgatgcttttcgttgggtggcgattgaaatgtgattcagcagcggtgggcgcgaaagggcacacagtgatggacggaacgccgaacgcctgctcttgccttgccttagccttcctgtgggctggctgtgacaaccttgccttgcattgcagcagcatggtgttgtgtgtggggaacgcctagctagctgccacgccacggggcggacgagacgagagagtgggccgccatggggacggacggatggcgacgtacggccaaatctacctagagtcctagacacacgggtcggagtcggagtcggagcaaccttttgcgcccctctctcccacatgccgctgccggccggccgtcggcgttggcatggcgccctctcgccaccgcactgcgcccttttcttccttcctttctctatctctctctaggtgtggccaccatgcggcatgtccgcttgggaaaaagctgtggagaaggatcactgcactggagtggagggatcgagatcgaccgtgccgtgaccatacgcgcgcgggagtcgggagataaaaagcagcccgcgcgcacgtgccgctgccgttgccatcccgcgcccgtgctcctgaccaagattagtggctgcctgctaaccctttgcttgcctcctcctttcgttctctctgtctctctgtgatacttttacacggtcgatgctagcgagtggtggtggtggtgcctgcgttgcgtggtctcgtcggggtttgggcatggcggtcggaaggatgcttattacacctgcatcattgcatgtttgcactgaatgaacaggtgaacatcatgtccctgattgggcctcacaccaccatgtgaacatcacgcacgccgagcgaatctcttctccccttcttaatttaactagtagtactaacagacgacgatgatgatgccatgtttaataagcgataagctccggccggcgacgattctctcgcacgagtggttattgtcgacaagggcggttgcgtctggtctaccaatactatatataaaaaacagatgccctgcttcgtgctttgacgcatcgatactctctagtataattggattggaaccaacttagctttgcatgcatgcctctccgtgtcagcttgttcaagtggcccccaccccactgcactgatagcaacctcaatgtctgcaaaaaaagaacggttttcagacaacatttggacaatgaactttataaacattttgcagctaactttataattggaaccaactttataagctcttggttgattttatttacttatttcaaagaaaacgaaatggaaatgtcgcagcagctgacggtttgctggttctcccgcgtgtgtttttttcgactgggtgatcatgaacaacagcttcctgggccccgcgcccgtccgcgaggacccggcggcgggggcgagcggcagcaagtggcggctggcgacgctgacggacgtggaggaggtgaagacggtggcgcggatgctgccgatctgggcgaccacgatcatgttctggacggtgtacgcgcagatgaccaccttctcggtgtcgcaggccaccaccatggaccgccgcgtcgggggctcgttccagatccccgcgggctccctcaccgtcttcttcgtcggctccatcctgctcaccgtgcccgtctacgaccgcctcgtggtgcccgtcgcgcgccgcgtcagcggcaacccgcacggcctcaccccgctgcagcggatcgccgtcggcctcgcgctctccgtcgtcgccatggcgggcgccgcgctcacggaggtccgccgcctccgcgtcgcgcgcgagtcctccgagtccgcctccggaggcgtcgtgcccatgtccgtgttctggctcatcccgcagttcttcctcgtgggggcgggcgaggcgttcacgtacatcggccagctcgacttcttcctgcgcgagtgccccaaggggatgaagaccatgagcacggggctgttcctcagcaccctgtcgctgggattcttcgtcagctccgcgctcgtcgccgccgtgcacagggtcacgggcgaccgccacccctggatcgccaacgacctcaacaagggccgcctcgacaacttctactggctgctcgccgccgtctgcctcgccaacctactagtctacctcgtcgccgcccgctggtacaagtacaaggcgggccgccccggcgccgacggcagcgtcaacggcgtcgagatggccgacgagcccacgctccactgatccatccatgttcgatcgatcgacgaggcacgcgacggacgaccctaaattgaaccctatacaccgagcttaattatatatccgtccgatcgtcgtcggtcagattcattgctagctccgcgtgttgtaccatcgtgtcagtcagtgtatacgagtgtgtatcttttgtatccaagtacagcacgcgcgcgtgcgtaagcgtgtagttataaaaattaataacatgtttcttagaggagtgaggggggaattgtaaaaccgcttgtcaattgggctaagatcgttcgggacactgagccaaactcagaatgagttaagtttttcattttcatataaccaaccgtccccgcgctagtacttgacacctttaaatgatttagggtcgaataaagtctatctttagagaactgagtcaactcttcgatag

SEQ ID NO: 16475 - DNA, 2563 bp, Zea mays
  misc_feature (1)..(1): n is a, c, g, or t
ngccggccgggtgcggacgagagtccgcaccgcacacacacgtacaggcagcagcacagcgatctgccttctgctgtgccccgcccccatccagcccagagcagcagcgcgcagtgccggccggcaaccgcagctggtcggtcatcaggtctctgggcctccacctcctccttccccctctcaaccctccccgtgtcgcctcctcccgaatcctcacacgtagccccgcgcgccacctcgctgccggccgccggcacacagatatagagagagagagagagagagagagagactgagagagagagagggaggggaagcgaagagaccagaacaagacccacgcgggccggactcctccccgagaccaatgccgcggcggagacggacgtcctcctcgacgcctgggaccccccgggccggccggccccgcgcgccaccaccggccgctggggcgccgccgccatgatcctagtggcggagctgaacgagcggctgacgacgctgggcatcgccgtgaacctggtgacgtacctgacgggcaccatgcacctgggcaacgccgagtccgccaacgtcgtcaccaacttcatgggcacctccttcatgctctgcctcctcggcggcttcgtcgccgactccttcctcggccgctacctcaccatcgccatcttcaccgccgtccaggcctcgggcgtgacgatcctgacgatctcgacggcggcgccggggctacggccggcgtcctgctccgcgaccggcggaggcgtcgtcggggagtgcgcgcgggcgtcgggggcgcagctgggggtgctgtacctggcgctgtacctgacggcgctgggcacgggtgggctaaagtcgagcgtgtcggggttcgggtcggaccagttcgacgagtcggacggcggggagaagcggcagatgatgcgcttcttcaactggttcttcttcttcatctcgctggggtcgctgctggccgtcaccgtgctggtgtacgtccaggacaacctgggcaggcgctggggctacggcgcctgcgcctgcgccatcgccgcgggcctcctcgtcttcctggccggcacacgcaggtaccgcttcaagaagctggccggcagccccctcacgcagatcgccgccgtcgtcgtcgccgcctggcgcaagcgccgcctccctctccccgccgaccccgccatgctctacgacgtcgacgtcggcaaggccgccgccgtcgaggatgggtcctccagcaagaagagcaagcgcaaggagcgcctcccccacaccgaccagttccgcttcctggaccacgcggcgatcaacgaggacccggcggcgggggcgagcggcagcaagtggcggctggcgacgctgacggacgtggaggaggtgaagacggtggcgcggatgctgccgatctgggcgaccacgatcatgttctggacggtgtacgcgcagatgaccaccttctcggtgtcgcaggccaccaccatggaccgccgcgtcgggggctcgttccagatccccgcgggctccctcaccgtcttcttcgtcggctccatcctgctcaccgtgcccgtctacgaccgcctcgtggtgcccgtcgcgcgccgcgtcagcggcaacccgcacggcctcaccccgctgcagcggatcgccgtcggcctcgcgctctccgtcgtcgccatggcgggcgccgcgctcacggaggtccgccgcctccgcgtcgcgcgcgagtcctccgagtccgcctccggaggcgtcgtgcccatgtccgtgttctggctcatcccgcagttcttcctcgtgggggcgggcgaggcgttcacgtacatcggccagctcgacttcttcctgcgcgagtgccccaaggggatgaagaccatgagcacggggctgttcctcagcaccctgtcgctgggattcttcgtcagctccgcgctcgtcgccgccgtgcacagggtcacgggcgaccgccacccctggatcgccaacgacctcaacaagggccgcctcgacaacttctactggctgctcgccgccgtctgcctcgccaacctactagtctacctcgtcgccgcccgctggtacaagtacaaggcgggccgccccggcgccgacggcagcgtcaacggcgtcgagatggccgacgagcccacgctccactgatccatccatgttcgatcgatcgacgaggcacgcgacggacgaccctaaattgaaccctatacaccgagcttaattatatatccgtccgatcgtcgtcggtcagattcattgctagctccgcgtgttgtaccatcgtgtcagtcagtgtatacgagtgtgtatcttttgtatccaagtacagcacgcgcgcgtgcgtaagcgtgtagttataaaaattaataacatgtttcttagaggagtgaggggggaattgtaaaaccgcttgtcaattgggctaagatcgttcgggacactgagcaaactcagaatgagttaagtttttcattttcatataaccaaccgtctgtgtgctagtacttgacacctttaaatgatttagggtcgaataaagtctatc

SEQ ID NO: 16476 - DNA, 2331 bp, Zea mays
cctaaacttcctctcggtcgtcccaagcttccccgtatctctctccctcttctccgactcttcttggttccggattagcagtccatgctgctaacattcagcgatttgagtctgtcgaatagtccggtttgactgggataactattaaccgtgatgtacttaagaagcggaccacggactggagcagaccgggcggcgacatcgctcgcgcatggcagtgaccggtgctcgcgcacggagacgtcccgctcctacgcgtcaccatcgccgtcgggcctgcgcccgtgttccgtttgtgtagccgaggcaaaagggcccgagaccacgctgtggcagaccaaggaaagatccccaatagccaacaagaggagaggatccaaacacgcagctctagtgagctccgtcccacacacagactccggctccctgtggcccgcggcgtgagcgtgtcgtgtcccgcagggccacctttgctctctaaccccttccaccacacgcgaccgccgtccccgcgcgagttgccgaacccacgtctcccctcgccccgcgccgaccctaccaaccctcgggcccgcccatggagatctccgcctccgctgcgccggccgcctcctccccgcccgccaggccgctggtcctgcgcccgttcgcctcgtcatcgccccacccggctacgtcctcctcgaccaccatccgccgccgcccatcctcatcggccactgccacggtccgccgccgcgcgcgcacccgtccccgtacagggcggtccaagccccccgccgacgcgggcgactacttctccggcaacgacggccccggtctcggtggttccggcggcggtgacggaggaggacggtggagctggaacagcgggttcggctctggatcagacggccccgacgactgggagcccgatgtgccggcgccccggaggtcagcggcggatgcggcgctcggggtcgtctacgagctcatgtgcctcatcgcgctctccaactgcacccagttcgccgtccgcaggctcgcgggcctcctctccgcccgcgtcgccgcattgcgattcgtccccaccgtctgctgatcatccgtgggggtttgttttacttcctcttcctcctgcccgtctacctgaaatcgcttctgtacatatatcagcctgcaactgcggttttaggggattggggccttgggggaatcaggacctctgcctgttgttcctcggtgcgtgcctcaagcattataccgttgaacagtagcaaaattcgtcgaatccaattggagaaacacaaaaataagatcaacttgtttatcctttgttgttgtactcaagattgattgatgcctattgtgttaggatgcatcattatctgttccatgtgtatataaatgtgctgttatttattttcttggtacttcatggaatgtcaagggcagtgcgtttggggaaaaaaaaaaaaaaaagttagttgaatggaagctcaattaactagctatatggctatattaactttgcactccttatttcaatgatttctttttgaataattggatctatatcattaaaagattgcaactttagatatataccattggctccacatatcattgacttatgttgacttatgtggaccccacatgtaagtgagatagcaatggtatatatctaaagttgtaatcttttaatggtatagatctaaatttccctctttttttctataatcagctatttctttgcaattgttactcatgtggatgtgatatgctatatgcttaataatactccgcagagcaatgacttgcaccgaatgtaggatgatattactaggttgcaatggcggtatagtgcaatgactgggtggacaaatctacttttgccggagccaaattgtagtaatctgcggtttttagaaaggggtaggaataaacagggccttcttttgactattgttgaatgacctaatgtttttagtgctttctacattcatgtatcaattattactattcaacatgcttaggtctagttcgatctgaggaagagaggaaaaagcagagctgttttccaacgattttttattatcttgataacattttttatgtagttttggagtgattttcctgagagcaaaatgaaacaagagggtagcctttgttggttatttttagtctagctttttctcactcgcatgcttttaaatttttatatttttaatctggagtttgtgtaaaaacgtgtatttatactattttctcaagttcgacatcttgtccaatgctcataaattcaacgttattatgcaactattcatcttttcaagagtttcaagtttcatg

SEQ ID NO: 16477 - DNA, 4307 bp, Zea mays
  misc_feature (569)..(569): n is a, c, g, or t
  misc_feature (861)..(861): n is a, c, g, or t
catcacttttggcctcttaatcaaaatatgcataactaaaataccttccaggttctgactctaatacacttagcttgatcttatgaccatgaccattacttgacctagagaatcttgagccttatgacttgaaccatccaaatacataagaattactctgatagcttcaagtcacgtgttcaaatgttgtggtcttcaatgcaacacgacttttcacaacttgatcacctttgactcttgcaagcagtcccttcttcaccttcactttggtacctcggtcctcttgacattccccttccttggtccctcgacgttcttccttgcctttgtccttgctctaccaaactgactccaaatcatgttcattgattactaacctaatcagtgtccattcttcttcttcttaaccttcttcaacttaggatcactctcctcaatatgacttctcttgagcttgatatggttcaactcaatgcaagtacttgcttcttcaccctagcttttggtacctcggtcctctcgaccttctactttattttagttcctcgaagccacatttccttactatnttcaccttgtgaagccatcttaagtcataccatcttgaatgtacattgaatatccttatttttatatccatgatccatatttgactcagcttatatggaatatcacattgacctcatgtgttaaaccttgcatgcttttcactaagttcttgttcaacacttaacaccttggttatttctttaattgtgttgtcattcaaactccaaaacccacgagggactctcaaaggtgaaacatgagattcttgactcctctatatgtgcacacgaatgaggctctaaattttctttnaaattattagtttttttgttaggccaagtccatatatattctaacaaaatggacacacaaattttttccgctttaagccccacatctattaaatttagatgtcagcaattcaactagagttgagagttgggccgtgttgggctggcacggctcaggcccatcatgctttgtgccaatttttttgggcatcacaacacaaaataatttcagttcgggtcaaacccaaaccctaaaacataggcacgacacgacccaaaagaatggagggccgatgctcatgtcgtgacggcccaaacacgacacagaggaaaaaacttgtatatatctaaaaaatacatcttcaaattattcataactttgttatagattaaaaaatcagatagattgctatgactagcaacgtgactcaaaattgcgatatatatacatatttatttattaaaaaacatatattctactaagatgaatataagtatcaatgtcttctacaacttttgtaaagagataaaaagcattgaagcatgaaagaactatctaaacgttaatgttctaatccgtaccttagtgccttgtcgtgtcgtgtcgcccctatcgtaactaaatttaaggcacgatccagtagtcatttgggtaatggtggtccattttttttttgtgtgtcgggcaatggttcagacttgtatttttggctatccctaaacgggcgtaaatgacccggcccaaactttcaggtctaacttcaactacacaacgaattaagatgaccacaaggtccaaggtgcatgttgcgcgtgctctttagctccacatattttaaacttccgtttactccgaaactgcgcatacctatatgcatgttattacgagttacaagacagtttacccaggtttaaatatgtaacacagtaacagcaataatgttggactcgcactcactgcatctgtatctgtatatgcatcatggggattggaatgagcaacaagctgccgatggatcgagaacgcggagtaaggcccgggcgccgagctagctacaagcaagtggcagaaacgcggttaactatagtagcagtaatttagtttagtaccgtacgttaaattaacgcggagtagctttttgttcggccgttgcggtgaaacgaagcaattataatgggtaaatcaaagcgacgcgaggcgagatcgagcaggttagagctgccgccgtgattgcgtgcttagcgccggttccgcgatcccctgccgcggcaagcgcgacgcgattcggaggggcgccccggtcttggggccgttctccagcttctcctcctcaagtaactacgagctaggtcatgcaaatgggccctgcagcctctggattgatgctagctagctcgctctagatccagtagctgtgggccatctagaatgtctagatagctagatgaattagtactagtattctttgtgccaggcatgcatgcatgctgccaagtgtgtgtgcgtgtgctgctgctttgcgtggccatgaaaattgatgctgtggtacgtactcgtaatcgtgatgggcaagatcagctagttttttcgatattttctcttgaaaggaaatcatcgcgtctaagtggtctaaccgtgttgcgcgtcgaccttgtttgtatgtttccttgatcttcccagccgagtacaaataaaatcattacagcagtacgctaattgaattgggttttttttctcattttggtttcgatatatgttgaatcatatagtacatcagcaactactacgccaaacatagaaagaaaaaaaaattcctacttatttcattaatttggtgcttattgttagttattgtcaccgtacgtacgtcgcaatcttttgttacaaattactttcacgactgtttgacagcatttcagcctggtcagctgagctcgctatggctagctgcagcccaaacagttcctgcaactgcgagtcttcagcgctgagaaatgccacttgttttttatttgacgtattatagtacagtactgtatatatacagttaactagttaagtttaatattagctgctagagacgcatcatctgcatagcacaaagccttgacctagctgttccagtgtatgtctgtataatttgagatggaacgaactggatgcacgaagcaaaggcaaataatgtgaccgcgcgtgtcatgcaccatcacgaagaagcaagttgcacacaccgtagcttgcggccggccagctagctcgcacagcttgcttctctgattcaccaaagcgttttcttgccccgaaatcatgcagctcgcccttgtacatgtcacctatgacttccgtctcaatactctctctgcctacaccaccgcagctcagctataaaaggacatcggctagcttgaccaggacatagattcctcgagtcatcacaccacacgcatcacatgtagatgtagctagcttagctatgctcgcgtaaaaaccctagcggcagtcacacagcaagttgcatgtgtctcgggggcaacaagcaggcggccgaggcagcaggccgcatggagaaccaccggcgccattcgggctctccggcgagcagcaggcgacggcggctgcactacctcctcgccctggctgccgactacctcaggtacctcttcatgaagcggcgccggctcctgcacaaggtggcgcggagaacgctcgcgctcgtccaccgccacggcctgccgcagcgcggcggcaggaaccacgaccagtggcagtggcctcatcgcgcgctggcggagcacgagttctcgtgcgccgacagccccagccccgcgttcctcgcggccaagaggctgctgctgcggtcacgtcggaaaggcagtggcgccgcagccgcagcggccggggctgtgtcttcctgcttcggctcgtttcgacatccgttcgattcgcccgacggcgacgagacgatgacgttggcatctgagacagaggttgccgaagatgaggatgatcagacggaggaggaggaggaggaagaagatgatcaggtactagctgccgaggacggtggctggctacagcgcggtgagggtgagcttcttgacgtggacgacagggccgaggagttcatcaacatgttctacgagcagctcagggcgcagaactttgccgcggttttccgttactccccatgattatatttatggtgtccgccgtgtgtagcgccgtatagagtgatcttgatcttgcgagacgacgatcgttgtgatgtggtttggaggagccttcgcttctcgaggatgcctttgtgtctgtgtcggggaaaccgatcgagagtgtaatgtgtccgtacgcacgtactcctatatgttggtctacactatctgctacatgagtaaatgtgaccaatcatcgatccggtggagaataataaatgggccgcatatatattcctaaaaaaaaaaaaaaaa

SEQ ID NO: 16478 - DNA, 1392 bp, Zea mays
cattgggtacctcgaggccggccgggaagtggtctcatggccgcgtttctggaggcttcctgcgcgtggagagacgggagaacgaagcagcagcagcagcaggcgccatccgctcgcttccttccccccaccgccagcgtcgcctctccgtgtgcgcgccccgccgggggtggcgtcactgcacccttgggcagcgggcgcatacctacctacgtgcggggggagccacacgcctccctctcgcctcttggcatggacgccggcggagagaagtgcggcgacgcggcggcggagggcggggagggtggcggagacctctacgcggttctcgggctcaagaaggagtgctccgacgccgagcttaaggtcgcttaccggaagctcgccaagaaatggcacccggacaaatgctcgtcctccagcagcgtgaagcacatggaggaagccaaggagaagttccaagagatccagggcgcctattccgtactctccgacgccaataaacggctcctctacgatgtgggagtatatgacgatgaggacgacgaggaaagcatgcaggggatgggggacttcatcggtgagatggcccagatgatgagccaggcgcagccgacgaggcaagaaagctttgaggagctgcagcagctttttgtggacatgttccagtccgatattgattcaggattctgcaataggactgccaaggcccatcagtttcaggggccagccaaaagtagaacatgctcgacctcaccttcatcatcaccgtcccctcctcctaccacagcaaaggatgcagaggtgccatcatgtaatggcttcaataagcggggttcatcagctctggactcagggaagcctccaaagcctgttgaaggtggtgcaggtcagaaccaggctggattctgttttggggtgagcgacacgaagcaagcgccgaagctgccaggtcagaacgccagccggaggaggaacggccggaaacagaagctgtcatccaagcacgatgtttcatctgaagatgaaacggcggccggttcgtagcacaccagcagtttgacccattggcttcggtgatatatcattcgttggcccttggctgtgcctaggggccctagtagctagcagcagcagcagggacggcacatcatgccagctgctgtgatctgaagaggcgtttagctcatcatatgcctcaccttaggcctgtgggggattttccattcaaactcgtcgatgatactacatctttctttctccatctgtgtcgtttgtgttgtaagacagtgacttctgaagtctgatcgtctcggttctttttattaacatctgatatacgttactgccgaaaaaaaaaaaaaaaaaacggccgccgccaccgcggtggag

SEQ ID NO: 16479 - DNA, 1543 bp, Zea mays
gtttctggaggcttcctgcgcgtggagagacgggagaacgaagcagcagcagcagcaggcgccatccgctcgcttccttccccccaccgccagcgtcgcctctccgtgtgcgcgccccgccgggggtggcgtcactgcacccttgggcagcgggcgcatacctacctacgtgcggggggagccacacgcctccctctcgcctcttggcatggacgccggcggagagaagtgcggcgacgcggcggcggagggcggggagggtggcggagacctctacgcggttctcgggctcaagaaggagtgctccgacgccgagcttaaggtcgcttaccggaagctcgccaagaaatggcacccggacaaatgctcgtcctccagcagcgtgaagcacatggaggaagccaaggagaagttccaagagatccagggcgcctattccggtctcaatcttccttctctcagcacccttacacaatacacccgcctcactgctctgttccatccatattcgcaaaccaccccttcacctgtggcaactactgaccaacgacaactgataaactgaacagcagcaaacggaaccgatctagcctgttggtaaactcattgcgtggagcccttgtgctcccatcccattgttcttgtgcagtactctccgacgccaataaacggctcctctacgatgtgggagtatatgacgatgaggacgacgaggaaagcatgcaggggatgggggacttcatcggtgagatggcccagatgatgagccaggcgcagccgacgaggcaagaaagctttgaggagctgcagcagctttttgtggacatgttccagtccgatattgattcaggattctgcaataggactgccaaggcccatcagtttcaggggccaaccaaaagtagaacatgctcgacctcaccttcatcatcaccgtcccctccttctcctaccacagcaaaggatgcagaggtgccaacatgtaatggcttcaataagcggggttcatcagctctggattcagggaagcctccaaagcctgttgaaggtggtgcaggccagaaccaggctggattctgttttggggtgagcgacacgaaggaaacgccgaagctgccaggtcagaacgccagccggaggaggaacggccggaaacagaagctgtcatccaagcacgatgtttcatctgaagatgaaacggcggccggttcgtaacaccagcagtttgacccattggcttcggtgatatatcattcgttggcccttggctgtgcctaggggccctagtagctagcagcagcagcagggacggcacatcatgccagctgctgtgatctgaagaggcgtttagctcatcatatgcctcaccttaggcctgtgggggattttccattgaaactcgtcgatgatactacatctttctttctccatctgtgtcgtttgtgttgtaagacagtgacttctgaagtctgatcgtctcggttctttttattaacatctgatatacgttactgcctaaaaaaaaaaaaaaaagattaaaagg

SEQ ID NO: 16480 - DNA, 925 bp, Zea mays
attgggacctttcggcaccggatttttgaaattggtcgtgagccgctgccgcacacggcgagaggaatagggttgctccccccgttgccgactcgccgccgcatcgccgcgagcgtcatgaagaccttcccgctgtccaggggaagcaccatctccctagccctcttctccgacgtctccaacagccgggagctcctggacttgatgcagtcagggaagctggagccggcggtcgctctcctcaacgcgtcactggtgccggatgtgttccctatcctcgcggcagcgcttaaggcgctgttgtccaagactagggagtcactgaccacaaggactctgcactctgagctcgtctacaactactcggggtccaaacatataacagagtccctgaagcgctgtgggatctctgataatacaacttacatccttgctgcttgttttgatgcttccgacgaggagatgaaggcagtggagaagctcatcagtggcaccgagattgatctcacagaactggaaagaagagcaaaccagccacagatcttgaagcattacaagatacctccccaagaactatcgatatctacgttgccggacgcaattgtatgcaggattgctgctcgagatgctctctgaagtctcaataatcaccgtaagctatgtggtttcaggatgtaggtctctctctaccacatgtatggtgtgacattgacagcacaagtgcacaactagaattaggtatccgaaataccattgatgttcgcattccctgcaagcaacccagaagcacattgcgtggttaatttttcttgctaaactgtgctgcaaagcaacagttatgttaatttctcccttgaattcgatgaagcttatatgatacaatctagcaaaaaaatgtatgatgtatctgaaaaaaaaaaaaaaa

SEQ ID NO: 16481 - DNA, 1198 bp, Zea mays
ttttttttttttttttttttagagcagaaagataaaactgagtaaaaaattcaactaaagataaaaatgaggaaggtgacaaaactaagggtataaatttaaatatcccatgtgcacgccacaccatcgccaactccagctctcctttctgaatgccggtccaagtgtccaacagatgacgtcacacgaacgacgcctcctggccgtcttcaaagaaggcgccggtgaccccgcctcccggcagcagcgccaccttgaccacgttacccgcgccttcctcgggcgtcaggagccccgagcgcaaggttatgtcggtcttgatgtagccaggatgcacgcagttgacgcgcagcgtcggctgctccgccgccaggatcctcgagtacgcgttcatggccgccttgcccaccttgtacgccgcgaacgccgccggccacccgcgcgcgtcggcctcgccggcctcgaagtcctccaggaacgcgtccagcagctcgtccagcctcccctcggtcagcttctcgacgttgtgcagctcttgcttcagctcctcgtttcggaagaacctaagcagcccaaagtcggaggagacgttaacgattcttccgtcagaggaggctcggagcagaggtagcaacgcttcgatcacatgcttggtgccgtagtagttcgtcagcaggcctttctttgcagcgtcgtaagtctcccgggtattcctccacagacattcaagcctctgatccctatccatgccgctcaattcttcttcacttgtcactgacccagcagcagcagcagcaggaccccgggcgtattcgacgccgccaaacgcggcattatttatcagaatgtctagcctcccgaaacgggccttcaagaaaccggctagcctagcgatgctcgacgcgtccgtgatgtccagcagatggaaaacgacgtcggaaagacccagcgctctgagctcctccaaggcagctgcgcccctcgtctcgtccctggctgttaagacgacggtgatgccgttcccggccagctgccggcacacctctagcccaatacctttgttcccgccggtgaccacggcgatccttgcgcctggggaagtagagatgactccctccatgagcgtgcgccacgagctctgcttcttctggtcagcctggtggctggtgctgtagtgtatgcgtatgtatatgaatat

SEQ ID NO: 16482 - DNA, 1961 bp, Zea mays
tgcagcttctgtcttctgacaatcgtaaggcctgccaataaagtcaggaaagtcactctttgtatcatttaggagtagaatagataaactatgagtattattttccttttgctttcaatctaagccgggctctggtcttctctctgaaaaaaaagaccaatgcaacaaggtgtttgtgtttaattatgcagccatatcgctcccaggagaatttgtagttctggacagttaggttgcataatctatgaataaattggaataaaattcagttttctgaacatgtgctcatcaggggagaataaaacaacatcaaggatgcatatttgaagtgggcaatgcaacaaaaaaaagtaaacattactgtagcacgtagtctttcgcccatataatactttcgccggctgccatcccagattattaaaaaaaatctcttctggtgtatttggtgaaggttccactatggattgatgtaacgcctttcgtccaactgctacatcggccattcgttccgcaatactctatgaccaaagcacgttcatccgccgcaccaatgcaatattatgaagggggaaaaattatataaccattttgcagtttgcagtcctcatccatcaccatacaaatagtggtggttttacgtcagaatttttaacaacttgcttgcgtagtgtaccagcgcatttaacaagtgcagagcaggacccgcgcggccccgggcgcgtcgcgagtgctccaaacaaatagagttttccttcaccgagccagacccagaagaaggggagccggaggtagaaagaccagagaagatggcgaccaccgagccggcggcggtgaggctggtgggctccttcgccagcccgttcgtccaccgcgccgaggtggccctgcgcctcaaaggggtgccctacgagctcatcctggaggacctggccaacaagagcgagctgctgctggcacacaaccccgtgcacaaactcgtgcccgtgctcctccacggcgacagggccatctccgagtcgctcgtcatcctcgagtacgtcgacgaggccttcgacgggccgcctctcctccccgcggaaccccacgcgagggcggacgcgcggttctgggcccacttcatcgaccaaaaggtaccaccagccaccaggatcgattctgaagatgatgtggtcaacgtttgaacacctgctcgatgatgcgatcggtcctgcagttcgcgcggccgttctggatgtcgttctggacggacgacgaggagcgcagggaggctatggcgaaggaggccaaggagaacctggctctgctcgaggcgcagctcagggggcagaggttcttcggcggcgaggccatcggcttcgtcgacatcgccgcctgtgcgctggcgcactgggtcggggtcatcgaggaggccgccggggtggtcctcgtcggcggcgaggagttcccagcgctccgcgagtgggccgacgcctacatcaacgacgccaccgtgaagcagtgcttgaggagccgcgacgagctcgtcgattacttctcctccaggaaggagatgtacttgctgcgagcgagggccactccgcgcagctgatctggacccatgtttccttccgttcgcaataagccaataataaagactagtttggtaacccatttttctaaactgaaacattcagttcagtcgagctagctctcagacgccatgcgcgacacgcatttcgcattagggggagtttgaaatcagataggaagggaataagggattgatggagagttcatttcccctcagtctagagatggcaaaaggttcatgttagcgtcgatttaggcgccaatcattagggtgtatcgtctggttgtgtcatctacggcggcgtagacagtccgcagctttgagccggatagtccacgacctaggcgcaagagagacgtcttcccagtgtcggtccgtgctctggcccaga

SEQ ID NO: 16483 - DNA, 1054 bp, Zea mays
cattgggtacctcgaggccggccgggatcccatttactagttgtggttttacgtcccgaatgttagatttttaacaacttgcttgcgtagtgtaccagcgcatttaacaagtgcagagcaggagtggcaaagctcgtagtacatcacgagtgctccaaacaaatagagttttccttcaccgagccagacccagaagaaggggagccggaggtagaaagaccagagaagatggcgaccaccgagccggcggcggtgaggctggtgggctccttcgccagcccgttcgtccaccgcgccgaggtggccctgcgcctcaaaggggtgccctacgagctcatcctggaggacctgggcaacaagagcgagctgctgctggcacacaaccccgtgcacaaactcgtgcccgtgctcctccacggcgacagggccatctccgagtcgctcgtcatcctcgagtacgtcgacgaggccttcgacgggccgcctctcctccccgcggaaccccacgcgagggcggacgcgcggttctgggcccacttcatcgaccaaaagttcgcgcggccgttctggatgtcgttctggacggacgacgaggagcgcagggaggctatggcgaaggaggccaaggagaacctggctctgctcgaggcgcagctcagggggcagaggttcttcggcggcgaggccatcggcttcgtcgacatcgccgcctgtgcgctggcgcactgggtcggggtcatcgaggaggccgccggggtggtcctcgtcggcggcgaggagttcccagcgctccgcgagtgggccgacgcctacatcaacgacgccaccgtgaaggcgtgaagcagtgcttgaggagccgcgacgagctcgtcgattacttctcctccaggaaggagatgtacttgctgcgagcgagggccactccgcgcagctgatctggacccatgtttccttccgttcgcaataagccaataataaagactagtttggtaacccatttttctaaaaaaaaacatgccgttcagtcgagctagctctaagaccggacgcgtgg

SEQ ID NO: 16484 - DNA, 882 bp, Zea mays
  misc_feature (29)..(29): n is a, c, g, or t
cctcgaggccggccggggtagtacatcantagtacatcacgagtgctccaaacaaatagagttttccttcaccgagccagggagccggaggtagaaagaccagagaagatggcgaccaccgagccggcggcggtgaggctggtgggttccttcgccagcccgttcgtccaccgcgccgaggtggccctgcgcctcaaaggggtgccctacgagctcatcctggaggacctgggcaacaagagcgagctgctgctggcacacaaccccgtgcacaagctcgtgcccgtgctcctccacggcgacagggccatctccgagtcgctcgtcatcctcgagtacgtcgacgaggccttcgacgggccgcctctcctccccgcggaaccccacgcgagggcggacgcgcggttctgggcccacttcatcgaccaaaagttcgcgcggccgttctggatgtcgttctggacggacgacgaggagcgcagggaggctatggcgaaggaggccaaggagaacctggctctgctcgaggcgcagctcagggggcagaggttcttcggcggcgaggccatcggcttcgtcgacatcgccgcctgtgcgctggcgcactgggtcggggtcatcgaggaggccgccggggtggtcctcgtcggcggcgaggagttcccagcgctccgcgagtgggccgacgcctacatcaacgacgccaccgtgaagcagtgcttgaggagccgcgacgagctcgtcgattacttctccgccaggaaggagatgtacttgctgcgagcgagggccactccgcgcagctgatctggacccatgtttccttccgttcgcaataagccaataataaagactagtttggtaaaaaaaaaaaaaaaaaaa

SEQ ID NO: 16485 - DNA, 2342 bp, Zea mays
cattgggtacctcgaggccggccggggccgcttttcgggattccattccatttcgttttagcttcatcactcaagggcgaggggccagcgcgcgtgggagcgggctggatttgcgcgtcctgtaccgagcgccccatgtgacaggtcgctcgcttgcccccgctccgccgctccctccctcgtcccgcaaagcaaccgcaacgcgccgagcgggcagcggggtccccggccagccgagcaatcccccctccccaccaccccaggtgccctcccagcctccgcccggaaaaggctagtgcgcgcctcgtgctcgtgctcccccgagcagactagaccagcgcgctagcgccagcaaggccaaggcgagggaggggcgatgctcgcccgatctgctacagccgccgccgccgccgggatctggctgtgattaaggatgtcggcgtcgcggagcgggaggatcaggcgggccgggagcgtggcgctcggggactttctgcggcgggaggcgtcggcggagcgggccgcgttgggaggcggcgagcggccctcggtcgcggcggggcaggcctgccgggcgaagaagggcgaggacttcgcgctgctcaagcccgcctgcgagcgacgccccggcgcgccgtccacctccttctccgccttcgccctgttcgacgggcataacgggagcgccgcagcggtgtacgccgaggagcacctcctcgccaacgtgctcggctgcgtcccggccgatctgagcagggacgactggctcgccgcgctcccaagggcgctcgtcgccgggttcgtcaagaccgacaaggattttcaaactaaagctcattcctcggggacaaccgtgacacttgccataattgatggctccgttgtaactgttgcgtccgttggtgactcacgttgtgtccttgatgctgcgggatccatctactatttgtcggctgaccaccgctttgacgctaatgaagaggaggttggacgtgtaaccgaatgcggaggtgaagttggaaggctaaatgttgtcggtggtgctgagattggtccccttagatgttggccaggtggtctatgcctctcaagatcgattggtgatcaggacgtaggtgaatttatcattccggttccttatgtgaagcaaattaagctgtctaacgctggaggccgtcttattatttcaagtgacggtgtttgggatgctttgactgcggaaatggcttttagatgtgcacgggggcttcctcctgaggctgcagccgagcaaattgttaaagaagcagttgaatcaaaaggattgagagatgatacaacttgcattgtcattgacataatcccaccagagaaacaaaaatgcactatagaatctccaaaaacgccaggaaaaggccttgtacttctaaaaaatttcttcttaaggaaaacggcatctggttcattgtctctcgctgacaaggataattatcccgagccagatttcgtggaggaggtctttgaggatggatgcccatccctttcgaggaggcttaattctgaatatcctgtccgagatatgttcaagctttttgcatgtgcaatttgtcaaattgacttggagtctggccaaggcatatccatacacgagggttcgtcaaagacagggaagctgcgtccctgggatggccctttcctttgccacagttgccaggaaaagaaagaggcgatggaggggaagcgtcactcgcgagactcctcgtcaagaaatagcgggtcaagtgaatagtgactaaagccaggagtcatcttgaggcgaccacctagcggtgtgacgagctaactcttgttgcagttgtcattgtagcagcacttcctctatacatggattaccattggacatagacagatgttggaacttggatggtgccatgcgtacatatgttggacctaatgcggtaatggaccgtcggccaaattcaatcgcctctaggtaccacaccggcgacggcgtcttcggcaaggcttgtagcagtagctcatgcaggtagtgatgacaagggactgttagcgaagaatgtcgacagtggccaatggtcatgtaaattgttcatcgtatagaggtgcaagtgacaaatagccacggttttgtaattctgagctaggattagctattgagaccctgtaattcgtctgggcagacctcaaactagaggtcaacaacgtagcctggcctattgtagaatgtatcttgctctacagtcttcatgattcaacgctgtaattaggctgttgccagtgcttctctgtcatgttagctatcgactccactcttatcaaaaaaaaaaaaaaaaaaagcggcc

SEQ ID NO: 16486 - DNA, 2020 bp, Zea mays
aggcaggcagcgggctggcggaaaagcctagtgcgcgctcgtgctcgtgctccccgaccagactagaccagcttgctagcgccagcaaggcgagcggcgatgctcgcacgatctactacagctgccgccgcggccgccgccgggatctgcctgtgattaaggatgtcggcgtcgcggagcgggaggcggcggaccggtagcgtggcgctcggagaccttctgcagcgggaggcgtcggcggagcgggccgcgttgggatgcggcgagcggccctcggtcgcggcggggcaggcctgccgggcgaagaagggcgaggacttcgcgctgctcaagcccgcctgcgagcgacgccccggcgcgccgtccacctccttctccgccttcgccctgttcgatgggcataacgggagcgccgccgcggtgtacgccaaggagcacctcctcggcaacgtgctcagctgcgtcccgaccgatctggcctgggacgactggctcgccgcgctgccgagggccctcgtcgcggggttcgtcaagaccgacaaggatttccagactaaagctcattcctcggggacaaccgtgacgcttgccataattgatggctccgttgtaactgttgcatctgttggtgattcacgttgtgtccttgaagctgagggatccatctactatttgtcggctgaccatcgcttcgacgctaatgaagaggaggtgggacgtgtaaccgaatgtggaggtgaagttggaaggctaaatgtcgtcggtggtgctgagattggtccccttagatgttggccaggtggtttatgcctctcaagatcgattggtgatcaggatgtaggtgaatttattattccggttccttatgtgaagcaaattaagctgtctaatgctggaggccgtcttattatttcaagcgacggtgtttgggatgctttgactgcagaaatggcttttaaatgtgcacgagggcttcctcctgaggctgcagctgagcaaattgttaaagaagcagttgaagcaaaaggattgagagatgatacaacttgcattgtcattgacataatatcaccagagaaaccaaaacgcactatacaatctcaaagatcgccaagaaaaggccttgtgcttctaaaaaatttctttttaaggaaaacagcatctgactcgttgtctctccctgataaggataattatcctgagccagatttagaggaggtctttgaggacggatgcccatccctttcaaggaggcttaattctgagtatcctgtccgagacatgttcaaactttttgcatgtgcaatttgtcaaattgacttggaatctggccaaggcatatccatacacgagggtttgtcaaggccaggaaagctgcgtccctgggatggccctttcctttgtcacagctgccaggaaaagaaagaggcgatggaggggaagcgccattcacgagattcctcgtcgagaaatagcgggtcaagtgaatcgtgactgaagccgagaatcatcttgaggcaaacgcctagcggtgtgacgagctaattattgttgctgctgtcgttcttgcagcactttctcatggattaccattgaattgagacatgttggaagtcgccatgcctatatatatgttggagctgtacggtactggaccgtagagcaaatccaatcgcctctagataccacaccagcgtcttcggcagggcttgtggcagcagctcacgcagggaatgatgacaagaggttgttattattagtgaagaatgtcgacagtggccaatagtcatgtaaattattcgtcgtgtagaggtgcaagtgacaaatagccacggttttgtaattctcaactaggattaggtattgagacctgtaattcgtctgggcagacctcaaactgaaggtcaacaacgtagcctggccctattgtagaatgtatgttgccctacaatctaaatgattcaacgctgcaattaaatctaagatctttgcagacccccggaaaaaaaaaaaaaaaaaa

SEQ ID NO: 16487 - DNA, 820 bp, Zea mays
ttgggaccctcgaggccggccggaaaacacctttctcttcccaaaacatcccccacacggcccacctgcaccgagcggttgccgccgttaaaccctaccgctgctctcgtcaccatctctccgactcacccctctgtcctcgcaagccgccgccggccaagtcctgtccctctcccttgtctggttcggatcgtcgttgctagccaggtgctggatccgtagcggcggcggcggccatggacaagagcatgctcggcgacctggacggcctccccgaggaggacaagatgcggatggccgccatgatcgaccagctccagatccgcgacagcctgagaatgtacaattcgctggtggagaggtgcttcacggactgcgtggacacgttccggcgcaagaacctggacaagcaagaggagtcgtgcgtccgccggtgcgcggagaagttcctgaagcactccatgagggtcggcatgaggttcgccgagcttaaccagggtgtggccacgccggactaagaaacacgctgccgctggctggctgctctcgttgcgcgcccgccgccaggtttctggctttcgctggcacagatttgtagccgacaaaaggatttcagcacttcccctgcctgagatatatgcgttttagagccgaacgctgggtgtcagattgaataaaaactgccttgagaagtgttgtatttcgtttcatacttgtgtcaacgatttcttcttttttttacgagccacataagtgcggtttttttatataaaaaaaaaaaaaaaaaaaaaaaaaaaaaaaaaaaaaactcgaggagggg

SEQ ID NO: 16488 - DNA, 711 bp, Zea mays
gttgctagccaggtaaatctgactgattcttctccttacctgcttctcccggtgtggatctcggctctcgacgagtttcagaggggttgttcgtaacatctgctaagatccgtggcggctgtttaggtgctggatccgtagcggcggcggcggccatggacaagagcatgctcggcgacctggacggcctccccgaggaggacaagatgcggatggccgccatgatcgaccagctccagatccgcgacagcctgagaatgtacaattcgctggtggagaggtgcttcacggactgcgtggacacgttccggcggaagaacctggacaagcaagaggagtcgtgcgtccgccggtgcgcggagaagttcctgaagcactccatgagggtcggcatgaggttcgccgagcttaaccagggtgtggccacgccggactaagaaacacgctgccgctggctggctgctctcgttgcgcgcccgccgccaggtttctggctttcgctggcacagatttgtagccgacaaaaggatttcagcacttcccctgcctgagatatatgcgttttagagccgaacgctgggtgtcagattgaataaaaactgccttgacaagtgttgtatttcgtttcatacttgtgtcaacgatttttttttttttttttacgaagccaacataaagtgcggttttttttatatataagctgtttgtttt

SEQ ID NO: 16489 - DNA, 782 bp, Zea mays
gccggcccgtccggaggttgccgccgttaaaccccaccgcggcccgcgcggccgggtctccgactcatccctctgtcctcacaagccgccgccggccaagtcctgtccttctcccttgtctggttcggatcgtcgttgctagccaggtgctggatccgtagcggcggcggcggccatggacaagagcatgctcggcgacctggacggcctccccgaggaggacaagatgcggatggccgccatgatcgaccagctccagatccgcgacagcctgagaatgtacaattcgctggtggagaggtgcttcacggactgcgtggacacgttccggcgcaagaacctggacaagcaagaggagtcgtgcgtccgccggtgcgcggagaagttcctgaagcactccatgagggtcggcatgaggttcgccgagcttaaccagggcgtggccacgccggactaagaaacacgctgccgctggctggctgctcacgttgtgcgcggccgccgcgcccgccgccaggtttctggcttttgctggcacagatttgtagccgacaaaaggatttcagcacttccgctgcctgagatatacgcctcttagagccgaacgctgggtgtcagattgaataaaaactgccttgagaagtgttgtatttcgtttcatacttgttgtgtcaacggtttcattttttaggagccacataaagtgcggtttttttttataaaacaaaaaaaaaaaaaggcccctcccccagaaaaaaataaaaaaagaagcccctagggcc

SEQ ID NO: 16490 - DNA, 788 bp, Zea mays
ctcgaggccggccgggattcatatcaacttctactgtttcgttcgagccaaacaccagtatctaacccacatggcccacctgcaccgagcggttgccgccgttaaaccctaccgctgctctcgtcaccatctctccgactcacccctctgtcctcgcaagccgccgccggccaagtcctgtccctctcccttgtctggttcggatcgtcgttgctagccaggtgctggatccgtagcggcggcggcggccatggacaagagcatgctcggcgacctggacggcctccccgaggaggacaagatgcggatggccgccatgatcgaccagctccagatccgcgacagcctgagaatgtacaattcgctggtggagaggtgcttcacggactgcgtggacacgttccggcgcaagaacctggacaagcaagaggagtcttgcgtccgccggtgcgcggagaagttcctgaagcactccatgagggtcggcatgaggttcgccgagcttaaccagggcgtggccacgccggactaagaaacatgctgctgctggctgtggccgccaggtttctggctttgctggcacagatttgtagccgacaaaaggatttcagcacttccgctgcctgagatatatgcgtcttagagccgaacgctgggtgtcagattgaataaaaactgccttgagaagtgttgtatttcgtttcatacttgttgtgtcaacggtttcatttttttaggagccacataagtgcgggttttttttatatataagctgtttgttttttctc

SEQ ID NO: 16491 - DNA, 794 bp, Zea mays
  misc_feature (754)..(754): n is a, c, g, or t
  misc_feature (776)..(776): n is a, c, g, or t
cctcgaggccggccgggccgccgcccgcggcgtctgttcctttcgtgccgcttcgtggtggcgccgtggcgcccaccaccacctcacctctcaccacctatagcaataccacgagtccacgatccggccgggagactagactacaccgctcggccggtgacgacgacggcgacagccgacagtctatccccaactacgctctgtaccagcgccttatccgccgcccctggtttgttctggcgcggtggcagttgataaaggcggaagggattagagcaaggagagggatcggcgatgagcttcgcggatctggaggcgggggctctcagggcgcccctcgggaggaaagcgagagggggccccaacgacgcgcgagcgctcgtcttccagataaccaccgcggtggcctcgtaccgccgcctcctcaactcgctcggcacgcccaaggacaccatcacgcttcgtgataacctgtctctcctcgagccctcttatgctttacatatctagcgatcagcgtaaacccttgcgtaaatttgctagcttgagtactagtaagccttgcccaattcaagtttggagccttttttactttcaagtctggagcaattagtctgctcttagatcgataggatcgctaaatcatgtcttaaacaacatgttgcttttttttgctcactcatgtctctttcttagttgccttacgatctagtgctttgtttccctcgcaggcataagactagatcgtaaggcnactaagaaagagacatgagtgngcaaaaaaaaaaaaaaaa

SEQ ID NO: 16492 - DNA, 1537 bp, Zea mays
agccaagctcactactccaaattcgtgtcgtagtcgtaggaatgtgggagagaatacaggggagaagccgagagccgaacgaagagaccgagcccccgccgcccgcggcgtctgttcctttcgtgccgcttcgtggtggcgccgtggcgcccaccaccacctcacctctcagtctctcaccacctatagcaataccacgagtccacgatccatggaatagactagactacaccgctcggccggtgacgacgacggcgacagccgacagtctatccccaactacgctctgcaccagcgccttatccgccgcctggggtttgttctggcgcggtggcagttgataaaggcgggagggattagagcaaggagagggatcggcgatgagcttcgcggatctggaggcgggggctctcagggcgcccctcgggaggaaagcgagaggggggccaaacgacgcgagagcgctcgtcttccagataaccaccgcggtggcctcgtaccgccgcctcctcaactcgctcggcacgcccaaggacaccatcacgcttcgtgataacctgcataagactagtcagaacatccttcaattagcaaaggatgcgaaagataagctccaaaaggctgctgaagcagacaagagcactgatacaagtgcagacaagaggatagctgatatgaagcttgccaaagattttgctgccacaatggaggagttcaggaaacttcagagtcttgcgattcagagggagacggcatataagccagttgttccacagaatacgcagtcaaactattctacagatgagcgaagttccgaatctggtaatatgcctgagcagcgtgcattactcgctgaatcaatgagacaagaggtgctgcaattggacaatgaaattgtttacaatgaagccataattgaggaaagggagcaagccattcaagatatccaacagcagattggtgaagtacatgaagtgttcaaagatcttgctacccttgtgcattcccaaggaatcataatcgaggaaatcgacatgaacattgaaaattctgcagcagtgaccaaagaggcaaagacagaggttgccaaagcagccaagactcagaaatcgaattcgtccctgatttgcttgcttatggtcatatttggggtcgtgctgcttgttgtgattatagttttggcagcttgagacatgcaacctttcctcttacagagctattccgcggagttcagaattgaagattgttcgtggttcttatctaaccatcatatcgtgtgccaaaaaaaaatgtcaccaacggattttagaagccccccgcttttacatttcatggcttgtgagtgagcggctctctttggcatgtcatgtcatgtgtgagtcctttttttcatggcttgccttgagtgaacactgatgttcttttgcttctttggatttcggaagttcgcttggtgtgatttttgtaaccctgtaagtatcccccccgtcaaataaagcaaagagatggttacgcgtatattgaaattgtttgttgg

SEQ ID NO: 16493 - DNA, 3475 bp, Zea mays
tcgcgatcttgtactggttttttttttttaaaaaaatggaggctgctcaaataaaatatatatactctgtacgttattcttacactgcatgcattgctgcgcaccgcggattgtgctccacttgcactatccaacgaagagtctggacgacaaacatgtacgattgcgataaagaaatgcgccgtggcaacgaggattgtggtttggaagaggcacgcgagaccgatccgtgaatccgtcccgtcctcaccttcacggccataacgtgccaagccctttcatcgtctaaagaggagagaccatctcgtactcacccaacctcctccgcgaacggaacaagggtgccgccgagccaaccagctgctgcaagaacaccagggccgcaagcacgatcgccgtgcacggcacgatgacgtcccaggcgacgccgtaccggtcgtaacgcgggctcgcgaagacgatggacggcctggagctcggcacgtagccctgcgccctgatcacgtcgtacacgtggggcatcgcgcggaccacggtgctgccgatgtagaaccacggcgtcagggctccggccctgacgccgccgggcgagagcgcgttcatgacgacctgcgggagcaggaacgcgtcctgcgccagccccgcggacgacacgaggtcctcccacagcgtcgccggctccgggccgatgcggacggtgagggagttctcccgcgctgctcggagcgcgttcacgacgtggacgacgatggtcagcgctccgccgatcaggtacagcggcgcgcacagccagagcgctctcctctcggcgcgcgacgctgacgactcggccttgctctgctcggcgtccgccttccgcgccgacaaggccagctgaatgaggcgcagctgtagcagcagggcgatcagagtgggcgccctcagcatcgcctggctcagctcgtacggcacgtagctccggaacggcagcagcggcgcgtactgcctcctcctgctcagaaacagagcctcggagctgaccaccagaggcgcgacgtaccccagcgccaggacgacgagcatggtgaccgatgtggccgctgctgcctcgcttctcctcttggcgtggaagatctgcaggacggtgaagacgcacggcagcgtcgtcgagaccaccagcaggatgctctcgaagtccatcctcgagatcgactccgagatctgctcggagtacatcccggacaacatgatgtcgaccttctcgaagaagagagggtccgccgccgtcttgtttctcaggctgctgatcgctccccttccatggccttgcgccttcccgtccatcagcgaggctagataaacggtgatcagtatctggcagtccgtcgtcgagctgttgtactctcggcaggcgatcatggacaggatgcccgtcttcggattaaagacaccctctgctgccattctccgttcttcaaggctgatcatgtacgacccgttcttgggacgcacccagcccgcaggtggaacatgctcacgtatgtcgtagctgacgttcaacagctcctccgtattcatgtcgaccacggccttccgtgagaaggaatcgtcggcggccagctgatcaccatagaccatcgccgggccgatagcaaccgggtaggcgatcccactacccatcgtgccgtctttggtgtcgaagaaatggaactcgaggtcatgatcggtgtagttattaggagcgacgaacgaccccttaaccttcttcttgggcttgctcgatgcgggatcctggagacaatgctttttcgcctcctccaccatcgtgtagttgtactcgtacttcacttcagagatgttgcctctatggatgctgccatcgacgctcgacgctgatacaacaccactgacaccagagccatcacccgctttgctcgagttccagagcatgccggcgacggcactccggtcccgaatcgtccagactcccgggaaccagaaactcatgcccatgtcgcactcctcgtccaccgccatggactcccctgagcccaccaccacacggcacgccctgaggcagagcatgctccgagctgaatcccagtgcccttcggcgacgaccgcctcatctttgaccatgaatggtgggcgtggcggcaggtgcctccccatctccgtgtcgttggagaacgacgcgtatgcgcgcacggacccgtccgcggcgcactgcacctcgctgatgtgcaagcaccgatccggcggggagaccggcgcgtgcccgccgccgccgtcctgctcctgcagcttgtaagatgccgccagatggtctttcaggggcgccctcgagaggttggcgccaatagcctggagcgcgcccctcgcggccgcggcagaagatggcggcagcggcgagcaggaggcgcgcttgccatagcggtaggtgtcgccttcggcgtacgcgacgagagagatggcgtcgaagccagcgcccttgaggctgccggtgatgaaggggtccgtgatgctagatgggttggggacgcggaggtggagggcgacgtcgcggaggcgtttggtggagccgttctcctcgggataggagcctgagccagtcatgcaaagctccccggaagtggtgccggtggagtagtaaccgtcaaaggagaaggtgacagagtgactgcccacgtagcgatggtggcgtcgccgccgatgggctcccatatagtggttctcgcggtcgcggccgccggaaagggtcaacatggcgacgacgtggaagacggcggtgttggatgtccgatcggcgtggagtgggagcagagagaatgagcgggtgacataggagtaggaggatgtcacgttgctctcgtctttgaactcgatatctttgcctccgaagaagtagccggtgttgagctccaaggagcggaggagcgggagggcgtcctcgccgtctgctggcaggttttcgggagtaggggagggcttggtgcagaggggggaacctgaggcggagagagtggcagtggacaggaggaggaggaggacgcaaaggctgcaagcagccgagttgtgagctgccattatggttggattggcgacaggaggaggagggcgcaaagcctgcaagcccacggtggcgatggcgaggtgtggcagtgtggcactggcaccacaagcgcctgtgtggcgttgtgtttatatctctgaggaagatatcgatgacggtgcaacgccactactaggcctgcacgggattcgtctagttgaagtcctgagagctgaggcctgctctggattccatggctcaaatctggggtacaggggactttgaccgctggtgatggcagtcagtcgtcggcgcaccttcatacacggcaataccccacaggccacagccacaggcccaccacgaagcttccgttgatgaaccattcaaccttcgtagacttggttcaaccttcgtagacttgaccccagtgtttgatttgtg

SEQ ID NO: 16494 - DNA, 861 bp, Zea mays
  misc_feature (828)..(828): n is a, c, g, or t
  misc_feature (843)..(843): n is a, c, g, or t
aattctctcgtctgcaacccgctgcgtaacggcgaccggcgtgtgagtgccgtgagcacccgagcccgtcccccctccggcatcccccacctgcagccggtgagctgctgtgagcctatccagtggcgattccattcctctccgtgtggacgcaaggactcagtgaaccacttccagatactcgctgcttctcccgtgcccatggctacaccacttatagcaggacttgcagttgcagcagctgcccttgccggtagatatagcatccaagcttggaatgcttataaggcccggcccgtagttccaaggatgcgcaaattctatgaaggtggtttccaacctacgatgacacgaagggaagctgctttaatccttggtgtcagggaaactgccagtgcagagaaggtcaaagaagcacacaagagagtgatggtggccaatcatccagatgcgggtggaagtcattaccttgcttcaaagattaacgaggcaaaggatgtaatgacagggaaaacaaaagggggtgggtctgccttttgatcggtacacggacaacgtgttcttccactgaaagagcaattttgtgtctccagactcgcattagaagatatgccgaaatctttgtgtgttttatgaaaatttgtggacaaaaaaaaaagtagtggacctttatggagcaggcaattcgttgcttagtaaagctcggctcagttgtgcttgtgcccgaatcaattggacattgttgctaattgagtcccctgtcctttgtttttccttttttttcattgatatcctgaattccacaaacacaaagtatcatgaactgcnctttattgataaatnctgtatctggtttgacct

SEQ ID NO: 16495 - DNA, 2549 bp, Zea mays
aatccgtctttgatgtgatgtgtgatgtgcagagggccgcaccgccgcgctcgccacgctcaccaactttggcaggaagaccctccccaccgcctacttatcctaccacaagcagggatcccaccatgccgcgtcggggtggggagccatcgccgccgcagtcccagctgcaggtccgtacgcactcgtcgtcgatccgattcgacccaccccccaccactctgatctaacagtaatcgctccgattcggatcttaccgcagtcactcagatccgatatgcttatgttcattcgaatgttacgattttccctctgacaaataattccctgtctgtcctctccgcgtgtagtttacatgctccaggaccaggaggctcatgctgcagaggtaccctaccctaattctcttgtctcttctgttttttcccttgcattctgttgggtccgtgtggtccaataataccggagcaatggccaccccctctctctctaaaatcactgcttcaccaatcaccatgctgcctatatgttaggcggggtaggccaactcaaactgattgagtgggctctgggctcctcccatgtaattttggcatcctaattacagaatgccccgccttttccatgtccagttagcatgcctgtgtagagctaatgtcaggtgatttttccccttttgtcaagcttactaacagtctaacactcctctgctgtaattccagatggagcgcaccttcattgccatcaagcctgatggcgtccaaagaggcctggtcagtactagcaactgtcacaacaccatagtttcttcagatgcaattatggatcctaataaccagtatgcatgtgtgttgccacaattggtagctaagactttctttctttacagcttttgaggcctcgtgctctgttctgtcctgtcctgttcttggccatataatagtgatcatttgtaatttcttgagatgcgactctggatcctagtaacctactccatatgttccaaattataaggcatattgtacatctaagtgcatagcaaaaatctaccatctagaaaagccaaaatgtcttataatttggaatggaaggagtactagcttcatactgcttttcatatactcggttagcatgtatgctgctgcaataggctacaaactttttcctttacaattttgagaccttgtgctcttttctgttcttttttttggctatatatatatatatatatatataaatcaacccactgctgcgttcaacacgcttcacctacagtacactctgcatgttgacatttttttttgtgtgtgtctgatcttgccacatgatataccttgagatcctttagcaactattttatgctgcaaaccatgtggatacataggacagaagcctgcatacatattataaaaaagagaaatctgtgctatctatttaggtcttcgtgttcccaaattttgattttactggtatcagaagttggattctttagcccaatacattgcctggtttaagacaccaaacgaaatcttgttcatcgctgtatggtacacctctagtcatatgcaggctgacatgtgaaccatttcgcttcagatttctgagattatgagccgatttgagagaaaaggctataagcttgttgccatcaagctgattgttccatccaaagaatttactgagaagcactaccatgatctcaaggaaaggcctttcttcagtgggttgtgtgattttctcagctctggccctgtgcttgcaatggtaagaacatctgccatgtccctacagaaagtgttcttacatcaacaaaaggagaattgtgcataagttggcatgacaatttctgtaggtttgggaaggagagggtgtcatcaagtatgggagaaaactaattggtgccacagacccacagaaatctgaaccaggaaccatcaggggcgatcttgccattgttgttggaaggtatgctttcattttattttcatcctacactttagttttgagtcccatgtcttcaagcatcgggtgcaaactaattggtgccacagacccacagaaatctgaaccaggaaccatcaggggcgatcttgccattgttgttggaagaaacatcattcatggaagtgatggcccagagacagcgaaggatgagatcgctttatggtttgaacccaaggagctggtctcttacaccagcaatgcggagaagtggatctatggggtgaattaacgagagagtcaatctgttttttttccttcttttgatctcggttttcacataattgccgacagacctaggcacaaggatgtaataaagtcgctaccgtcacttctgagttggattgtgaccttcaggtgtagtaaggcacaaggaaggatggaaaggaaaggaatataccgtgaaatatagagcgtgcactgagtagtcgcgatgttcaaatcaaactatatatcaccgtcactggagtcatgtaatccaagatggcgatgcagatgtttcttagatctttggcgatgcagatgtttctttggatctatttctctag

SEQ ID NO: 16496 - DNA, 1267 bp, Zea mays
cattgggtccctccggggcatcgcgtgcttttccggccgcagcggctaacgcgtggccacgccatccctccgcgtgcctaattaattggaagcacccagcgcacatcatcagtcgaagtgagcgtcagcgagcgaccgcaccggcacggcgcccatccatccatcgccatcctctagcccagtccaaaggaaccctagccatgagcgccgcctccaagaagctcttccaggccgccaggtccctcgtcctctccgcttctaaccgctccgtcctcgccgccgagggccgcaccgccgcgctcgccacgctcaccaactttggcaggaagaccctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggtgtccaaagaggcctgatttctgagattatgagccgatttgagagaaaaggctataagcttgttgccatcaagctgattgttccatccaaagaatttgctgagaagcactaccatgatctcaaggaaaggcctttcttcagtgggttgtgtgattttctcagctctggccctgtgcttgcaatggtttgggaaggagagggtgtcatcaagtatgggagaaaactaattggtgccacagacccacagaaatctgaaccaggaaccatcaggggtgatcttgccattgttgttggaagaaacatcattcatggaagtgatggcccagagacagcgaaggatgagatcgctttatggtttgaacccaaggagctggtctcttacaccagcaatgcggagaagtggatctatggggtgaattaacgagagagtcaatctgttttttttccttcttttgatctcggttttcacataattgccgacagacctaggcacaaggatgtaataaagtcgctaccgtcacttctgagttggattgtgaccttcaggtgtagtaaggcacaaggaaggatggaaaggaaaggaatataccgtgaaatatagagcgtgcactgagtagtcgcgatgttcaaatcaaactatatatcaccgtcactggagtcatgtaatccaagatggtgatgcagatgtttctttggatctatttctctagatatccctaccatgatgatggcccgccgtctgtttttattctaaaaaaaaaaaacccgccc

SEQ ID NO: 16497 - DNA, 1206 bp, Zea mays
aacggaaacctttgcgttttttaagcgagccacgccaataacggacatgcaccgacgatcggcatttccttccagtggcggtgagaagggaaagggaggacagcagagcagaggtcgagcatcgcgcgctttgcctgccgcagcggctaacgaacgcgtggatcatcccttctattattaattaattgggaggagtgggagtgatagctgcagcacccagcgcccatcagtgagcccatccggaaccctagcctcctcgtcgttgaatccaccacaccacaccatgagcgggagcgcctccaggaagctcttccagaccgccaggtccatcgtcctctccgcttctcaacgctcctccttctccgtcctcgccgccgagggccgcaccgccgcgctcgccaactttggcaggaagatcctccccagcgcctgctcctaccacaggcagggatcccacgccgcgtcgggatggggagccatcgctgccgcagtccccgccgcagtttacatgctccaggaccaggaggctcatgctgcagagatggagcgcactttcatcgccatcaagcccgacggcgtccaaagaggcctgatttctgagattgtgaaccgattcgagagaaaaggctacaagcttgttgccatcaagctgattgtcccatccaaaggattcgctgagaagcactaccatgatctcaaggaaaggcctttcttcaacgggttgtgtgacttcctcagctctggccctgtacttgcaatggtttgggaaggagagggtgtcatcaagtatgggagaaaactaattggtgccacagacccacagaaatctgaaccaggaaccatcaggggcgatcttggcgttgttgtgggaagaaacatcattcatggaagtgatggcccggagacagcaaaggatgagatcgccttgtggtttgaacccaaggagctggtctcttataccagcaatgcggagaagtgggtctatggggtgaattaaccagcgactaaatctcttgaggtttgcttttttcttttcagttttcacataattgccgacagaccaaggcaggatgtaataaagtagctaccgtcacctattacttttgagttggattgattgtggtgcagtaaggcacaaggaaaggaaggaatacaccgtgaaatttgttaatcttcatgagtctgtttttaaaaaaaaaaaaaaaa

SEQ ID NO: 16498 - DNA, 1307 bp, Zea mays
gcacgaggcggtgagaagggaaagggaggacagcagagcagaggtcgagcatcgcatcgcatcgcatcgcgcgctttgcctgccgcagcggctaacgaacgcgtggatcatcccttctattattaattaattgggaggagtgggagtgatagctgcagcacccagcgcccatcactgagcccatccggaaccctagcctcctcgtcgttgaatccaccacaccatgagcgggagcgcctccaggaagctcttccaggccgccaggtccatcgtcctctccgcttctcaacgctcctccttctccgtcctcgccgccgcaccgccgcaccgccgcgctcaccaactttggcagcgagaccctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggtgtccaaagaggcctgatttctgagattatgagccgatttgagagaaaaggctataagcttgttgccatcaagctgattgttccatccaaagaatttgctgagaagcactaccatgatctcaaggaaaggcctttcttcagtgggttgtgtgattttctcagctctggccctgtgcttgcaatggtttgggaaggagagggtgtcatcaagtatgggagaaaactaattggtgccacagacccacagaaatctgaaccaggaaccatcaggggtgatcttgccattgttgttggaagaaacatcattcatggaagtgatggcccagagacagcgaaggatgagatcgctttatggtttgaacccaaggagctggtctcttacaccagcaatgcggagaagtggatctatggggtgaattaacgagagagtcaatctgttttttttccttcttttgatctcggttttcacataattgccgacagacctaggcacaaggatgtaataaagtcgctaccgtcacttctgagttggattgtgaccttcaggtgtagtaaggcacaaggaaggatggaaaggaaaggaatataccgtgaaatatagagcgtgcactgagtagtcgcgatgttcaaatcaaactatatatcaccgtcactggagtcatgtaatccaagatggcgatgcagatgtttctttggatctatttctctagatatccctaccatgatgatggcccaccgtctgtttgtattcttgtttttggaatccggccgtctaaaaaaaaaa

SEQ ID NO: 16499 - DNA, 1722 bp, Zea mays
gcgacgcgcagctcaaaatcctagaccgccgccgccgcgcccagcgccacggcggcgggggcccgtccccaaggcgacgccggccaacctcccacccgcgctccgctccccgtcctttcttcacccacccccgcccggatccgtcgccggcggcgtgggaggtcccgacgccgaccacgacgacgacgtcgcggccgcgctctccctcgacggcttcttccgccgcttcaccagcgaggacaacgactccttctcgcgcatcctagacaaggtgaaccagcgccgccgcgagcgctacgcgcacctgctggagccgccgccgcctaccgaggcggggagcaaagcgtcagagggcgccaagcgcgacaggatcacggacgggtacggtacatcggggcagccaccgagtacgctcgagggcgccaagttcacggcaaagaaccagctcatgtactacccggctgaccagggggaagcgcccctcacggaggaggagcgcgcagagcggctcagggggatgaccaaggagataaacaagccgaacaccaggctacatggcagagccacggctgatgacgcgaggcccaaggaggagggggccgccatactgtacgcgctagttgcaggctctactccgggagggatggcctaccacgaccctgacaagttgaagaagtacgatctggaggacctgaggaagaccccgaaccctttctacctcgagtcggacaagaaggccggcaacgggtacagttttgtgaggacgccgtcgccggcacccggcgtggacgagtcgccgttcatgacgtggggtgagatcgacggaacgccgctgaggctggaccccgacgagacgccgggcggtagcgagagagcgcatttcaagatgccgccgcctcctgctcgcgatgtcaaggcgcacctgctttcgagggacgccgctcggaaaataaaggagcggtctaagcccttccataggccgcccctaccctcccctgcgaggggtgtcagcgcgagccctagaaccctttcgccagcagcgcaaaaattcgtgaggaacgccatctccaagtcgtcaaagtcctccagcgccattgacgaatctctccgtgcaagctacagaggctcgaccccgtctgcgagcactcccaagtcaaggttttcaagagatcctggcctcgcatcgcgttctccatccacaaggcagggttccacccctccctggtgagtgttagtaaaccacttaatgttatttcataaaatgggtaggtggcccatcctgtactgtaacaaattgtataatgatggaagacatgaaatgatgaagtgatgctaatttactcttatattatctgagtcacccttaccaaaatcaatgtcatgagcatatcttttcatactaaattgctaagttccaacttgaattttaaatttcaaagtcatgcatctgggcagaccatttgtcgtctttgtaacagtgggtttggcaaaaacttccatgtcattgtattgtactccaaggcagattgtgcatctggtcttgcaaaaaaaaaaatctgataatagagtttgaaagatgtgagataaggaatgagataagggagctgctagagatagcctaatagtttggggtttatttcttatgtttgtactctttttcgcatagaagtatataacaaaatgagtacgattgtaatagtttgcctcattggggggaaacat

SEQ ID NO: 16500 - DNA, 4083 bp, Zea mays
  misc_feature (15)..(15): n is a, c, g, or t
  misc_feature (240)..(240): n is a, c, g, or t
  misc_feature (250)..(250): n is a, c, g, or t
cacaatttaccttgnaagatagaccagtgaggataacattgttctcaagagatgcaacaggcgtttaggaacaagatgtggagaagggtgcgaatttgaagcgccacagcaaattttgtagaacagaacagttggttgagtatgaagaccgcacatcctcatctatacagcttcgaggttcaattccacttctctgggagcaaatagtggatttaagctacaaaccacggcttagcattnattgaacatngaagaaactcataaggttgttcaacgccactttcatgatctttcacaacgatatggcaagataattgttgctgacttgactgataaacgaggtgatgaaggagatttgagcaatgcatttgctgctgaaatggacagaattcctggtgtcaggtatatacattttgatttccatcatgtttgtcgtggaggtaactttgacaatttgcaagctctctacaatcaaattgaggaagctattcataagcaaggatattttcttatgaacactaaaggagagattttgctggagcaaagtggtgtagttaggtccaattgcattgattgcctggaccgtacaaatgtgacacagagtttccttgcaagaaaatcattggattctcaattgcagctgatgggagcattattgtcatctgaaagcatttctctctctgataacattcatgatacattcaaaaaattatgggttgagcacggtgatgagctgagcctggagtatgctggctcttatgctttgaaaggggatctagtgagatatggaaggcagacattgcctggactaattaaagatggaatgagtgctctttcaagatattatttgaataattttcatgacggagtgcggcaagatgctcttgaccttattagcggttattatacagtcagccaaggcagctcttctccttttcataatggtgttgattcttcttcgtatctgccggtggcttcagcaatcatagttggtgggattaccgcgacaactttcactctcagtcaagttggacggaacgcgcagcacttgatctcctccattatctgtgcgggcttaacagtcggagtagtagccttggtgaaagccaatgggaaacagttttgctctaggccccgtctgtgtggtctaatctaatccttggtcttttccccccttccctttcatattgccctttgttagaaattgaatgtaaaaggattagaatgttgttttattcgttgcaagagtaaggttaaataaggaggcaggatggcctgccggtcccgtaatctgaagctgctaatttgtaagcctatagtttggatttgcacattctatttgttatactttttatgtatccatgaatagaaaattacgcctcgaaattccaaatttgtaataaatccgagagaccacatatttttttagtgtgactggttggtagcgacggtcttggcgtcttgcatagttgctgacacagaaaagacacctccgtccctctgtctggtacagtgagggtggggcatcaaaaacacaaagatgctgttcttatcaggcacagatgtttgccaagtataattccacgttgcgctatacagtcgggtttgctcgtatgcatttatgatctagatacttatgctgtctccgatccaaaaacttaggcttcgtttgttttcctttgctaaagtttaccaaacatgttaactaagagttgttgtatcgtgtactcacattaattagaggtgatgtggtaaaatttagcatttgtatcatacaactcttaagtgctaaagtttagtaaaaatttagcactatagaaacaaacatgtccttaattatgcatgctctaatagatacactcctagttaggggtgataatagattagatcgtgatccaaatacttcacaaaatggtagggacataaataaattttagttcaaaaataaatagaaatagggtccaatcttaatctaatctgattttaaattttataatataaaatttagagcatattatcaccctacttctagtatttattattttagaacaagtgcgcttttagttatgggaccacctagttctaagtagactttactactttctctattcacaaagtgcaattattacatgtgtggatagattttgctaggaggctatatatgtaattttcctagtaccgttgatctcaacaataaattgtacaaatgcatttattttagtaggacgtagagagaacgccaaaacagtgagcgaaccttttggcttgcaatacttgcaattctaaaaacaaacgagcaggcatttcatccagtctcagcctgcaatttttttggggtcatatttaaggttgtctccattagatagtgagtatgatggtgtaaaatattattttgcatcatagactacataatttatcgaatggatttgaaatagaaggtaggatatgccccctgttggagaccggctaagaggcgaagcctaagcgtgcaatttcgttgcctgattcgtggcctataatctatttcaaaagaaggaactggagatcgagctgtactgcccaaaaataagaagcaccaaattaaccctctgtggcaagccacgtttcgaggtgtctaaatgtggttagcagcaaaataaactgcccgtccaatctctttcatctgcttgcttgcttgctctcctgcattagtttccatcctcggttgcaggtagttagtcggttccggattcgcgccggcctttttgcacgacgtggatgttgcagccggagttcttgacgacggtgcccaacgaggaatagaaagggggaaaaaaagaaacgcgtatctgaattccacacggccggcgaagacacttgaacagtcttgctggcaatgggaaacaagggaccagtgccaacacaggaatcgacgaatggttctgttctgtctccctcactctctgatctctcttgtcatcccatccctgtttacgcccctggcgcatacttgagacgcaatccataatccaccgcagatgacgccgaggcaccgtcgtctacgtctgctgcgagcaatactaagagcaagacaggtacgggcaacaacaggttccagcatgtgcgtgagctcccatttctaatctaaaaatcaatgggatagtgataatagtgtccgctgctacccgctagacgtgggcccggtgcccctgttcgaaggatcaagcgacgacgacgccgcccacacgccacggaagagaagcacccaggagatcctcaccaaatacaagttcaaaggggtcgcttttcttcttctttctttctttctttctttctgcatcagtctcgccgccaacacactgatccatgtttcgaaaccgcgctcatctttgtgacgatgatgatttacatacaatcgcaggacgccgcggctgccgcggctcacgcgaagcagaagctcatggagcggcaggagaaactcgcggtagattagatagacacatagacccaccggttcatgcatgaatgactccttctgttatacataaatgaccgaccgatcgatggccatccgcgcgcctccctgtgctgtgctgtgcccagagaatcacggagcagtccgcggagctggagagcgaggccgagaacttcgccgcgctcgcgcagcagatcaggaagaacacggagacctggtggtggaagcggtgatcaacaacgtaagccatcgcctgcttacgtagctcatgcgtcgtcagcagactggcatgggacgccacgggatcatatgcatggctgtaacccggccacgctgctcggttcctctctgcacaagcgtcagcagactgtggcgctagtacgtgccgctctctctgcatctgcatcacatcactacgagccccagcaagcagaacgaaaagcaatgcgattgtgacggttcagccagcgtcggccctgctgcccctgcagcagcagcagcatgtctgttttcctacggatctttgttttaaggcttcaacaatgagagagatgtgacctgccccccagctgccggtgcataaattcagcatggctctctgatggatggtagaaagacaccaggacgga

SEQ ID NO: 16501 - DNA, 1643 bp, Zea mays
  misc_feature (18)..(18): n is a, c, g, or t
cgggaccttatatgttcnctacatgacatggagagcattgaagcatttctttggtggagcaatgggtgtgtttacaacaagaaccttgctcaactctgttggagtctcccaaagcagggctgcatctggtgctgtggctatcaactggatactcaaggatggggctgggcgtgttggaaagatgctttttgcccgccaagggaagaaatttgattatgacctgaagcaggtgcatatattaggttcaatgtgtgcccttctgcagtacttttttttctttcattctaatgactaattgaaatgaaaatttcctatagcttcgcttttctggtgatctcttgatggagttaggagccggggatagaactagctactgcagctttcccacagtttttcctaccaatggcatgcatagcaaatgttgttaagaatgttgctgctgtcacttccacctctactcgaacaccaatctacaaggcatatgccaaaggagaaaatatcggtgatgtcactgctaaaggagaaagtgttggaaacattgctgatctgttgggaactggaatgagcattctaatctctaaaagcaatccatcactggtaacttcatttgccttcttgtcgtgcggatatcttctcagttcatatcacgaggtgagatctattgtactgaatactctgaatacggcaaggttcactgtggctgtggattctttcatcaggactgggtatgtaccctcattgaaggatggaaactcacaagagacaatatttaatccaccttggcgacattcgcccgtcgcaataggatcaagatttggggaggcgtttcaagaacctgcttcgtttattgctataaaacctttgttcgaggatgagaggtatattgttacatataacccgacaaaggacaaggtctatgctttgctcaaggaccaagcaaagcctgatgacattctcaaggccgcttttcatgcacatgtgctactgcattttatcaatgctacacatgctaaccggaatgcacggaagcgcgcgaactccaatctgtcacaccagtataacccactgaacatggacttcttaccacacatcgaagagtcgtgcaagatcgttatgtcgtcttatggagttttcaagaagaaatcaagagaacagggatggatcatgtctgaatcacttctcaacccaggacgagcaagattgtgtggagtagcaccgcaatgatccaagccttttttattttttttcatgatggagatgatgagttctttcccatacaattggagtccagccctatgtgggtcagcgaaactaactttagtcaacaatcagctcaagtacataaaaatgcaccaaatcgtcatgagcccagaaggaacagtacttgaacctggagcattaggattacaccagcccccatgataaacatgctggggaggggggccctgactgaaggaccggtgaaggggctctaaactagttgcggaagaccagctaacaaactttttttttgtatattctttggagtattatataatggagatgggctatcgttcctagtgtgaccggactggggtcgtctgctgatttattttgactatttgccccccaaaaaaaaaaaaaaaaaaaaaaaaaaaaaaaaa

SEQ ID NO: 16502 - DNA, 5757 bp, Zea mays
  misc_feature (2496)..(2496): n is a, c, g, or t
  misc_feature (2600)..(2600): n is a, c, g, or t
  misc_feature (2633)..(2633): n is a, c, g, or t
  misc_feature (2910)..(2910): n is a, c, g, or t
ttgcagcgcacgcggactcggcctgccaaccattccccccgcacccgccatacaactccagcagtcctcctcatcacgccgatacatggggccaccggcttccgaccccacgctgccagtcatcagaagtaaaacatcgtctccagcccacacgggcactcctcgcctccgcgcgcgatctcctgtctgcgagtcggagacgagccgggtataaaaggcatcgtccatctctccgggcggctgcgctgcttcgctggctttcggcaacgccctttaccacatctgaatctcacccacccacccccgcgtcccccacctcatggcgccggcgatggggctgaagcggcctgcggcgggagcgggggcggcagcagcgcagaccgtcacactgtccgcgccggccgtgcgggacgcggtgcgcaccgccgtaagggaggccgaggccacggcgaaggctaccgccccggccgccagggtcccggcgacggcggcagtgccggcggagatcgctagggatggggtgctgtgcctggaggaggtcgacgggaggcggtggagctatgtggtcgacgccgctggcgccgcggtaaaggccaagggaagggcgtccgtcggcggcgccttcaaggccgtcccgctccagtccccgatgccgcccgtcgaggaaatcatgtcctttataagatcatatgttgtgcccgaaggctttccagatagtgtcacaccttcatatgttccatacatgacatggagagcattgaagcatttctttggtggagcaatgggtgtgtttacaacaaggaccttgctcaactctgttggagtctcccaaagcagggctgcatctggtgctgtggctatcaactggattctcaaggatggggctgggcgtgttggaaagatgctttttgcccgccaagggaagaaatttgattatgacctgaagcagctacgcttttctggtgatctcttgatggagttaggagctgggatagaattagctactgcagctttcccacagcttttcctaccaatggcatgcatagcaaatgttgttaagaatgttgctgctgtcacttccacctctactcgaacaccaatttacaaggcgtatgcaaaaggagaaaacatcggtgatgttactgctaaaggagaaagtgttggaaacattgctgatctgttgggaactggaatgagcatactaatctcaaagagcaatccatcactggtaacttcatttgccttcttgtcgtgtggatatcttctcagttcatatcatgaggtgagatctgttgtactaaacaccctgaatagggcaaggttcactgtggctgtggattctttcatcaggactgggtatgtaccctcgctgaaggatggaaactcacaagagacaatatttaatccaccttggcgacatgagccagttgcaataggatcaagatttggagatgcgtttcaagaacctgcttcgtttcttgctataaaacctttgttcgaggatgagaggtatattgttacatataacccaacaaaggacaaggtatatgctttgctcaaggaccaagcaaagccagatgacattctcaaagctgcttttcatgcacatgtgttactgcatttcatcaatgcctcacatgctaacctgaatgcacggaagcgcatgaactccaaccggtcgtaccagtatgacccactgaacatggactttgtaccacacatcgaagagtcgtgcaagatcgttatgtcatcttatggagttttcaagaagaaagcaagagaacagggatggataatgtctgaatcacttcttaacccgggacgagcaagattgtgtggagcagtaccacaatgatccaagcctttttcgtttttcatgatgaagaggatgagttctttttcatacaattggtatgtgagtcagcgaaactaacttaagtcgacaatcagctcaagtacataaaatgcaccaaattgtcatgagtcctgatcctgcaggaacagtacttgaacctggagcgttagatcgcaacaaccaccatgacaggggggtgctgactcaggaagggtccgtgaaggctccaaactgcggaagatcgactaacaatcagctcttgtatattcttttggtattgtataatggaggcggctatctttcctaatgttgaccggactaagtggtcatcggctgatttgttttgactatctgacaacaatcccccctgctaaccttgcggtatcgtggtcctcatttccctaatttggggagcggtacatgccagttttcgtaaagaatatcagtgtttatatgcaaattgatttgatcatttgtctcaggcctgtttggaacaagggagatgttttctgcgtatgtttcgtgaaattaaactgattcctatgattttttgcactattcctacgaattactgcacttcaaacaccctcggatgtctcgatatatatagagatagtgctctgttttgttagtcatcgtcnatgatgggctggttaccgtggctgttcttacttttctatttaggaccagtttagcggggctatgactctaaaaactctggctttagtttttgtagagaagcagnttcttcgagagaagttagtaggtttaaaatgtncattgtgaccctacgtgtctgacttgtgtatacaaaagagaaatatgatatgttgaggaattaaaatgtgacttgtgtatacaaaagagaaatatgatatgctgaggaattaaaatgtgttctgtcattctatataatagcgcgcggagggaatctcgcctcctagagcgtccacgtgtgtcgtaattctttcaaccgttcgattggacatccacggcatgtcggctaacatgcagcgcccaaatccgtcgccttccattccaagctgtcgccactngattcttcgagagatagctcactgcgctgcggcgataccgaacgtggaaaccctatcggccgctgctccttcaaggcgtcagcgtcatcttcgtcgaactgccagcaaccgtgcgttctacggttcttcggcgccgtccacggccccatcccccatgcaccctatcgccggctgcttcttcaacgcatcgtcatcgccgtcggctgcttcttccacgcgtcatcgtcgtctccgtcgaactacccatgatcgtgcactccttgcttcttcagtgccgtccatagtcctccgcaacctatcggtgcctgcttcttcaacacgtcgtcatccccgtccaactgtcggcagcggcgagctctacacaaagcttcggtggaatttctgtgcgacacaggtaccctgccctctttgctcccccccctccccatttcaagaagataatggtaccttgcttatccatccacatccagccaaacatacaaaagaactgttgtgtgatccatctgaaattttgaactaacaaaataggaatttggatggtccaatccatccgaccaaataaactggtgtgagaatcggcagcagctgctattgcagctataccatgcgcatcttcaatgtgacataggtattgaattttatttacatttcctccgaaatgcgaacaatttgtttgaatagtctaaaatttatattcatagtacttatagtttccttttttgtccaccatacacaatctgttacctatttgcatactttaattttatgctcctagcatatcactaatgcgctgcgacatgcagttacactaccggaatcgccgtctttgccgagtgcctgaagcactcggcaaagtcttaaaaacactcgacgctataaatctgtttattgctaattagctccttttgtaatctttaagaccaatgcttctaagattaagaccaccctgctcctaacctgcttctgtggtcattaacaccactgcttttgatccacattcatatagctacgcctactgtattgtaatctctaagctcttctataatataatctctaagaacttcatgctgttacatttccagaacttgaaaacttcattactacaaaaaaaagtacaatccaagttggctattatagctaccttacgtcatatattgataccttatcaaattgaactcagcgctacaaatctgtttattgcatttggctacaatgttccatcaatgctaagcttcagcacttgcattttacgtacacttagatttgtatgccgttgtctacccatctttgtccaaaaccatgaaacgctttgatttatgttgatataatgttcacaaaaaaaatttagttactatccagtttgatacaagttaattcaactgtgctcatgtaccgtttgtaccactcgcgagtttctagtaaagattaaggcccttttcgtttgttctggaacattccagctagaatggtatgtttatttatattaacatagattagccagaatagctcctggtctcaaaccgacgaggagctagactatctacagtgcatgcttcttccattcgtcctcctgtagaggcttgtcgcttcgtgccctccatggagcacactactttgcggaggtcactctctctctccaaggcaagcggcacgctattttcctttgtcacgctcactgtgaagtcgttcgtgcccacgtcccttagcctggcaggtgctatcgacgccaccatggctggggtggaggatgaagacaagttcaaggacgctccagcagtcgccgatcgccatcgcaacgatgcggcggttgtgtgggcggcgccgcgccacgacacccaatcagcattcgcagcccaccacctgcggcgccggcggagggggcgccaccctcgagcgccactgcaagtggccgttgttgacctcgtcttgagagccaaagaagaggaagttgtcgatgctgacctcgtctcgagagccaaaagaagaggaagttgggggactctgggtcggcctcgggtatgtggagtgggaacaaatggttttttttgttgacgatgatgcaatcggggtttaagaatcgattaaattttgctcctgacaatattatttagtaacaatgtcaaaataattacaattaacaataaatgtgtaaccatgtatatgatacactatttgtttatgttgaattaaaagaaagagagaaagataatagttagggtagttgagataaaaatgttatgctcttgtctgatactcaaagaaaaagcaaagaacgatcaaatttcatggtcgaattactataaatctagtgtgatttctggtgctaccaccggatatatccgatgcatacacacaatgctacactttttttttgccaatgaccagttttgaaatttgggactataaataccaacctaaccgaccatttgaactgtctaacagccaaggaacacaccaaaagagttggtgcgccacatggttattaaaacgtcatttaaacgtcgtttaatcgacgtttaaacggtaaaacgtgattagaagttgaaacatccgagcgttttgaccacatcgcgtagaacgtccgtaaaacacgtttaaatgtctgtttcgtgtcgttctgacattttgggatgttctatgcacgcttaggacgttttagactattaggcctctcatgcccatcagctctcaggtcaagacccatccttgctgcccctgtactctagccttccctcctcctatcctctagcgccgcctccctcctccctcctctagcgccaccacccatcacctgtcgctagaagccagcgtcgatcgcctccactatcgccaacatccgtgcccgtc

SEQ ID NO: 16503 - DNA, 1514 bp, Zea mays
cattgggtacctcgaggccggccgggagaagcctttgacgagtgtcagctaataatatctatggcgactgctccctcagatgtccttgctgtggagctcttgcagcgtgaatgccatgtgaaaaaaccacgcggccgcggtccctgggccgtaaaactggcagatcttgagtcagcaccagcagcgttagctcggctgttctccgttgaatggtacagaaacaggatcagcggcaagcaggaagtgatgatcgggtattcagattctggcaaggatgccggtcgtttctctgctgcttggcaactgtacaaggctcaagaggagctcattaatgtcgctaagctgtatggggttaagctaaccatgttccacggacgaggcggaactgtgggaagaggtgggggccctacccatcttgctatactgtcacaacctccagaaaccatccatggatcacttagggtaaccgttcaaggcgaagtcattgagcagtctttcggagaggagcatttgtgctttaggacactgcaacgtttcacggctgcgacccttgaacatggtatgcaccctccaatttcgccgaaaccagaatggcgtgctttgatggatgagatggctatcgtcgccacaaaggaataccggtcaatcgtatttgaggaaccgcgctttgttgaatatttccgccttgcaacgccagagatggagtatggcaggatgaacatcggaagcaggccatcgaaaagaaagccgagtgcgggcatcgagtcgctgcgcgcaatcccttggatcttcgcttggacgcagactcggttccacctgccggtgtggctgggtttcggcgcggcgttcaagcatgtcttggacaaggacatacggaatctccagacccttcaggagatgtacaaccagtggccctttttcagggtgacgatagacctggtcgagatggtgttcgccaagggtgatcctggcatcgcggcgctgtacgacaagcttctggtttcagaggatctgtggccattaggggcgcgtctcagagccaactacgaagaaacaaagcagcttctcctgcaggtcgctgggcacaaggaccttctggagggcgacccgtacctgaagcagaggctgcgcatccgtgactcgtacaccacggcgctgaacgtttgccaggcctacacgctgaagcgcatcagggaccctggcttccaggtgaagccgcggccccacctgtcgaaggacatcatggacatgggcaagccggcgtcggagctcgtgaagctgaacaccaccagcgagtacgccccggggctggaggacaccctcatcctgaccatgaagggcatcgctgccgggatgcagaacaccggctgaagccagtgtgcctgtcttctttctgtaggggatcatatcatatggcgtgatgaaccagtgaacacctggatatgtggggattagttacaccctgttgcactcgaatttatgccccgcttggccgcgcccttgtcgcatggttc

SEQ ID NO: 16504 - DNA, 1278 bp, Zea mays
atgccggtcgtttctctgctgcttggcaactgtacaaggctcaagaggagctcattaatgtcgctaagctgtatggggttaagctaaccatgttccacggacgaggcggaactgtgggaagaggtgggggccctacccatcttgctatactgtcacagcctccagaaaccatccatggatcacttagggtaaccgttcaaggcgaagtgattgagcaatctttcggagaggagcatttgtgctttaggacactgcagcgtttcacggctgcgacccttgaacatggtatgcaccctccaatttcgccgaaaccagaatggcgtgctttgatggatgagatggctatcgtcgccacaaaggaataccggtcaatcgtatttgaggaaccgcgctttgttgaatatttccgccttgcaacgccagagatggagtatggcaggatgaacatcggaagcaggccatcgaaaagaaagccgagtgcgggcatcgagtcgctgcgcgcaatcccttggatcttcgcttggacgcagactcggttccacctgccggtgtggctgggtttcggcgcggcgttcaagcatgtcttggacaaggacatacggaatctccagacccttcaggagatgtacaaccagtggccgtttttcagggtgacgatagacctggtcgagatggtgttcgccaagggtgatcctggcatcgcggcgctgtacgacaagcttctggtttcagaggacctgtggccattaggggcgcgtctcagagccaactacgaagaaacaaagcagcttctcctgcaggtcgctgggcacaaggaccttctggagggcgacccgtacctgaagcagaggctgcgcatccgtgactcgtacaccacggcgctgaacgtttgccaggcctacacgctgaagcgcatcagggaccctggcttccaggtgaagccgcggccccacctgtcgaaggacatcatggacatgggcaagccggcgtcggagctcgtgaagctgaacaccaccagcgagtacgccccggggctggaggacaccctcatcctgaccatgaagggcatcgctgccgggatgcagaacacgggctgaagccagtgtgcctgtcttctttctgtaggggatctcatatcatatggcgtgaaccgctgaacgcctggatatgtggggattagttacaccctgttgcactcgaatttatgccccgcttggccgcgcccttgtcgcatggttttcataaaaaaaaaaaaaaaaaaaaaaaaaaaaaaaaaaa

SEQ ID NO: 16505 - DNA, 2576 bp, Zea mays
tggattctcgtctcgagtgagtcttttttctcttgcagttcttggagcctcttgagctctgttacagatctctgtgtgcctgtggtgatcgctctgttgcggatggaagccttcttgacttcttaaggcaagtgtcaacatttggactatcccttgttagacttgatatcaggcaagaatctgaccggcatactgatgttatggatgctataactgaatacctcggtattggatcataccgtaaatggccagaggagaaacgccaagaatggctactatcggaacttaatggaaagaggccgttatttggtccggaccttcccaagtcagatgagattgctgatgttctagatactttccacgtattagctgaacttccatcagacagctttggtgcatatgtaatatctatggcgactgctccctcagatgttcttgctgtggagctcttgcagcgtgaatgccatgtgaaaaaaccactgagagtcgttcctttgttcgaaaaactggcagatcttgagtcagcaccagcagcgttagctcggctgttctccgttgaatggtacagaaacaggatcagcggcaagcaggaagtgatgatcgggtattcagattctggcaaggatgccggtcgtttctctgctgcttggcaactgtacaaggctcaagaggagctcattaatgtcgctaagctgtatggggttaagctaaccatgttccacggacgaggcggaactgtgggaagaggtgggggccctacccatcttgctatactgtcacaacctccagaaaccatccatggatcacttagggtaaccgttcaaggcgaagtcattgagcagtctttcggagaggagcatttgtgctttaggacactgcaacgtttcacggctgcgacccttgaacatggtatgcaccctccaatttcgccgaaaccagaatggcgtgctttgatggatgagatggctatcgtcgccacaaaggaataccggtcaatcgtatttgaggaaccgcgctttgttgaatacttccgccttgtaagtgttcacttttctttgctcgtgttttctcttttctagacaccttcacttgtctttatattgtttgtgcaattaccactatgagagcttggttgtagcttttatctagtcctttggcatttcactcctgtttttgtcaggttgggaatttatgtagctaggcctgaaggtcaatatactgtttggttattgttttttttttctctctctctcttatgccatggcattactcctttgtagtaccctgtaaaattttcatcttgttttggtagtgggtcaaattttctgcgtaactaatcctggcattcgtgtctttatttgaaacaggcaacgccagagatggagtatggcaggatgaacatcggaagcaggccatcgaaaagaaagccgagtgcgggcatcgagtcgctgcgcgcaatcccttggatcttcgcttggacgcagactcggttccacctgccggtgtggctgggtttcggcgcggcgttcaagcatgtcttggacaaggacatacggaatctccagacccttcaggagatgtacaaccagtggccctttttcagggtgacgatagacctggtcgagatggtgttcgccaagggtgatcctggcatcgcggcgctgtacgacaagcttctggtctcagaggatctgtgggcattaggggcgcgtctcagagccaactacgaagaaacaaagcagcttcgcctgcaggtgatgtgatttgtcaaagatcttgctgcgtccgtttggactgcgtgtgtgtagagactattattgtgtgtgagacactgagactgacctggcgaaagttttcaggtcgctgggcacaaggaccttctggagggcgacccgtacctgaagcagaggctgcgcatccgtgactcgtacaccacggcgctgaacgtttgccaggcctacacgctgaagcgcatcagggaccctggcttccaggtgaagccgcggccccacctgtcgaaggacatcatggacatgggcaagccggcgtcggagctcgtgaagctgaacaccaccagcgagtacgccccggggctggaggacaccctcatcctgaccatgaagggcatcgctgccgggatgcagaacaccggctgaagccagtgtgcctgtcttctttctgtaggggatcatatcatatggcgtgatgaaccagtgaacacctggatatgtggggattagttacaccctgttgcactcgaatttatgccccgcttggccgcgcccttgtcgcatggtttccatatctctcggggtcccctgctctaccgccagtacttgccacaaacaggctcatgttcggtcgcacttgtacagtaccggagcggcggaccaatcattggcgaggtaggtgtgccgaggcgagctgtggacgtcccgttcggtcgggtggaggtcgagcgaacatgcgcacaggtcaagtccattcatgccatccacagcagcacgcgaagaggagatctggcgaccgttctcagttctctcacacctttggtctggcggcacatcggcagccgg

SEQ ID NO: 16506 - DNA, 2778 bp, Zea mays
cacgcgtcagcaaacgcgtccgtaaacaaatggaaagacgtggcaaatgattcacgcaaacaattgcatgacaaagaacaggaggttctagacctgcggcaagaagttattgggttaaaacattctctaaaagaggctaacgaccagtgcatacttctgttcaatgaagttcaaaaagcctggacagtttcatcttcactccaagctgatctcaagtctgaaaatttaatgcttgcccagaagcacaagactgagaaagagcagaatagccagctaagggatcagatttctcatcttttgaaagttgaacaagagcaaaacctaaagatgcaagaacgggatttaacaattcagtcactacagactaaactcaagtccattgagtctcagcttaatgaagccctcaatgctagcgatgctagatcaactattgggtctgaatctgcttcagtaatatcttccccaaagataacagaatcaactgctgactcatcttcagtgacgaaaaggcttgaggaggaattggcaaaaagggatgcccttattgagaaattacatgaagagaatgagaagctttttgacagacttacagagaagtcaggattaggaagtgctccacaggcttcaagcccttcagcaaacaagccagctaatggtcaaggaagggagataggcaggagtgacagcagcaaaagtcgatcaccagatgtgtttgcatcaccagtgtctcaggataaaactggaaacagtggagctattgtaaaatcaagcaatgagctagcaaaaactacacctgctggggagtaccttacgtctgcactaatggattttgatcctgaccagtttgagggatttgcagcaatagctgatggtgctaataagcttttgatgctggtcttggctgcagttatcaaagctggtgcagctagggagcatgagatacttgccgagatccgtgatgctgtgttttcattcattcgaaagatggaaccgaaaaaagttatggatactatgttagtttcaagagtcaagatattatacatcagatctttgcttgctaaatcacctgaactacagtccatcaaggtctctccagttgagcgtttcttggagaaatcaaatactggtcgaagtagaagttctagtaggggaagtagtcctggcagatctcctgttcaccaccatggttatggttcccgaactgcgcttgttgatgaacatgtgcatggtttcaaggtgaacattaaacaggaaaagaaatcaaaattctcctcaattgttctgaagcttcgtggtatcgaggaggagacatggagacagcatgttactggagggaagctccgcgaaattactgaggaagctaaggccttttcaattggaaacaaggctttagctgctctctttgttcacacgccagctggtgaattacagcgccaaattcgtgcatggcttgctgaaaactttgagtttctatctgtaactggtgcggatgctgctggaggagccgcaggacagcttgaactgctgtcaaccgctattatggatggctggatggctggtcttggtacagcgcagccccctaccactgatgctttaggccagcttttatcagaatacacaaagcgtgtttacacatctcaactacaacacttgaaggacatagctggcacattggcaacggaggaggctgatgatcctgcacatgtcagtaaactccgctctgctctggagtctgtggatcacaaaaggagaaagatcatgcaacaaatgcgaactgacactgccttgttaacaaaagaagaaggtggctcaccaattcgcaatcctcttactgctgcggaggatgcacgattagcatctctcatatctctagataacatcttgaagcaagtcaaggaagtaattagacaaagctctacaggacctatgagaaaatcaaagaggaaagctttgctagagttattggatgacctcttgacacagatgccctctcttcttgatatagatcatccatgtgctcagaagcagatcatggaggcacggaaagttgtcgagtcactgcaagaagaccctgatgatcctgccccacagtctaatgcattgggagagggcgaggtttcacagtggaatgtactgcagttcaacacgggaacgactgcgcctttcatcataaagtgcggagcaaattccagtggtgaactggtgattaaggctgatctgcgagtccaggagcctaaaggtggcgaggtgatccgtgttgttccaagaccaacagttcttgcggacttgagttttgaggaaataaaaggtgtgtttgagcaattgccagaggcagttagcttgcttgccttggcacgaacagcagatggtacaagggccaggtattcaagattgtacagaaccttagccagcaaagtgacggccttgaaagagactgttgcagagatggagagaggtggtgttttcaaagatgtacgataaatgctgtgttattgtagagttatttatgatattgatgttgtatatggatgccatttgtcggcatcccttgtaactgtatttgtttttactatgtggaaacctatgttgtaacactattctttggcaagagatgagccttgcctgccccaacccgtaatactatggttgtgcaaggcattaatgtaaattgtagctgcagctgataaatgtctgcagtgctgcaagtctgaactttccaggttatggaactattcaatgtttatttgtattaagcttttaagatgttaaatgtccgct

SEQ ID NO: 16507 - DNA, 1461 bp, Zea mays
gcaacacaacacaatgagggaatgaccaaacaaggagtaccatctaatacttacattacttagtaacacatagtattatttatatacacaaattgaattgtgcggacaatcttatggagcttacatgcacgattctcacttgagcaaagggggcacatttaaaaaggtgagcctctccttatcctctggagagctccaggagcgcccagcatttcatgagctgtacacaaaatgaaaatgaaaaatactgtacaggggtgcattccgtggcatacaaagtcacatagattctagagcttgtggttcttgcgggtatcttgacaggatgatggatccatcaacttcacgaacgtagttgtatacttggttggctgcaccaatcacgaattgacaggttcctcttgaatcagcatgtagtgtgacatcatagtactcaagatgatctgctacgctcatcccatagaccgacctgctacaggtcgggtcttcaccagaatcatcacataccgtctcgtttctggtaactacatttccatctatgctctcatgaagccaaacctctctagcgaagtggtggtatgtccattcacctaggtaataataatacggtggtaaatgcggcacaatatcattctgatgggtcacacggattgttcttgggacttgttcaccaaagtatacagcaaatgcaggattgcctatccgaggctgtccaaaggtcatgagttcaacctcctgcgatccaaatttaacagatagatcaagggcacaaaacgaagctaaagcccctcccatggagtgtcccacaacatttatgggtagatttccatatgtttttcttgcccatttaatagacttcaggatctcatatcgcagagttgtattataatatgcagaataaaacccatgatggaccattgcatccggcatgcctgggtatgtcacatcaagctgcttccagaaaagatcttcgatccaatttgagacactgtgctgttgagtgcctctaaaagcaatgattatggatcgagggtcaggtgcaactccaacaaacgcctgtaagcagttctccacatctactatgatctctatgacctcaaatccctttgtgtggcctttgcaccttggacaggtccatgagaaaagtgatgtcaagtcagatgtgtacaccgcagacgcgtattcgacaagaatatgagccagagtatggttataagaatagccaccatcacagtgcttcagcctgatcactctttcctcctcctctcccgccgccgccgccgccgcgggggttgaagcggaggccagaagcaccacgagcagcagcaccagcgtctccgtccgccgcagccaggccatcgccgtcgtcgtcgtctccctcgcccgcaccggaggagactggtaagaaagaagaagaagaagacggcggcagcgagcaggacgctctcgagggtcccaatg

SEQ ID NO: 16508 - DNA, 752 bp, Zea mays
ttttttttttttttttttaagtattcacaatcacaaatattctcacataaatatgaacattcacaaatttaacatcaacatataggttctaccaacatataggttcgacggttgttgcaaactgaaattgtgtctcacaaacaagtgttgcaaagtgtttcataaaaaaacatcacgacacatcaatcatatccatcgtctggaaaattgaaacacattgctaaatagctaggataaaaggttgatgcactcagagtgaatgtacatgtggtaccaatcataatggagcatttctgtacctgtgctgttgagtgcctctaaaagcaatgattatggatcgagggtcaggtgcaactccaacaaacgcctgtaagcagttctccacatctactatgatctctatgacctcaaatccctttgtgtggcctttgcaccttggacaggtccatgagaaaagtgatgtcaagtcagatgtgtacaccgcagacgcgtattcgacaagaatatgagccagagtatggttataagaataaccaccatcacagtgcttcagcctgatcactctttcctcctcctctcccgccgccgccgccgccgcggaggttgaagcggaggccagaagcaccacgagcagcagcaccagcgtctccgtccgcctcagccaggccatcgccgtcgtcgtcgtctccctcgcccgcaccggaggagactggtcccggccgggaagaagaagacggcggcgaggtgcaagt

SEQ ID NO: 16509 - DNA, 3945 bp, Zea mays
aattcggcacgaggctctcccccaaccttctcttccaatctccgcttctctctcgcctccgcttcgcttcgcgagagacgggccgacgacggaaccctaggattcgcgcccgcctgagcggccaagccaccaggaccgcgccctccggacccgggggcgccagacaagctccggggcgcgcggatcgaccactggccggcttaccgccgccgctgccatgtcgtcgctcagccgcgagctcgtcttcctcatcctgcagttcctcgacgaggagaagttcaaggagaccgtgcacaagcttgagcaagagtcagggttcttcttcaatatgaagtacttcgaggagaaggtccatgctggggagtgggatgaggtggagagatacttgtcaggattcaccaaggtagatgacaataggtattcgatgaagatcttctttgagatcaggaagcagaagtatttggaagcgcttgataggcatgatagagcaaaggctgtagatattcttgtcaaggatcttaaagtcttctcgacattcaatgaggagttgtataaggagataacacaacttctcactcttgagaattttagggaaaatgaacagttgtctaagtatggggatactaaatcagctcgaagtattatgctggttgagctaaaaaacttattgaagcaaacccccttttccgggaaaaccttgtcttccctactcttaaggcatcacgcctccgaactctaatcaatcaaagcttgaattggcagcatcagctttgtaagaaccctcgtccaaatccagatatcaaaactttattcaccgaccatacatgttctccacccaatggagctcgtgcatcgccggtatctgtaccactggcagctgttccaaaggctggtgctgcatatccaccactcacagctcatactccgttccaacctccacctggtccatctttagctggttggatggcaaatgcagccgcctcttcatctgttcagtctgctgttgtagcagcagcatcaatacctgttccacccaatcaagctgtctccatgttgaaacgcccagctctaacagactatcaaagtgcagagtctgagcaactaatgaagcgcttgaggcctggtggacatggcattgatgaggccacatatcctgctcccacccctcaacctgcatggtcagtggatgatcttccaaggacagttgcttgttcattgtcacatggatctaatgtaactagcatggattttcatccaactcggcatacactgcttctagtgggatctgctaatggtgaatttacactttatgagatcggtctgcgtgaaacattactttcaaagcccttcaaaattcgggatataaatgcatgttcaccacaatttcagaatgctgttgtcaaagattcctccatatccattaatcaagttacctggagccctgatggagatatgattggcgttgcattcacgaaacatttgatccatctgcatggataccaaccaccaaatgagacacgacaccttctagagattgaggctcattctggaggtgtaaatgatatagcattctcccgaccaaataagcaactttgtgtggtcacttgtggagatgataaactaataaaggtatgggatatgcatggacataaattattcacgtttgaagggcatgaggcacctgtgtattctatatgtccgcatcacaaagagagtattcagttcatcttctcaacttcccttgatggaaaaattaaggcctggctttatgacaatatgggatctagggtggactacgatgctcccggcaagtggtgtactactatgctatatagtgctgatgggactaggttgttctcatgtggaactagcaaagagggagactcctatttggttgagtggaatgaaagtgaaggatctatcaagaggacatattctggattccgtaaaaggtcagctggtgttgctggtgtagtgcagtttgatacagctcagaatcacattctggctgctggtgaagataaccatattaaattttgggatgttgacaataataacatgctgatctgcaccgatgctgaaggaggcctcccagctcttcctcgcttgaggtttaataaagaaggcaatcttcttgctgttactacagcagacaatggttttaagatacttgcaaatgctgatggacttagaactctacgcgcattagggagccggcctccttttgaagcatttaggccgcaatacgaagcttcttctatgaaggtctcaggtgctcctgttgttgctagcatctctcctaacataggccgaatggatcacttggataggaattctcctgcaaagccatctcctatactgaatggtggggatacagcatcaaggagcatagatataaagccaagaatctcagaagaaaagcctgataaagcaaaaccttgggaactaatggaagttctaaatccccagcaatgccatgtagcaacaatgccagaaactccagaccaagccagaaaggttgtccgacttctgtacacaaattctggtgttgggttgctagcactagggtctaacgccattcaaaggctatggaaatggagtcgaaacgaacaaaatccgagtggaaaagccacagctagtgttgtgccacaccattggcagccaaatagtggtcttgtcatgacaaatgatacagcagataccaatccagaggaggcagttccatgcattgcactctcaaagaatgattcctatgtgatgtctgcttgtggtgggaaggtttctttgtttaacatgatgacattcaaggtgatgacaacattcatgccacctccaccagcatcaacatttttagcatttcaccctcaagacaataacatcatagcaataggaatggaagattcaaccatccacatatacaatgtcagggtagatgaggtaaaaactagactcaaaggacatcaaaggaggataactgggttggcattctccaccaaccttggcatacttgtttcttcaggcgctgatgcacagctctgtgtgtggaccaatgacacctgggaaaaaaagagaacagtctcgatacaaatgccagctggaaaaactccttcaggagatacacgggtccagtttagttctgatcaaagtcacttgctagtagtacatgagactcaactagccatatatgatgcatcaaaaatggagaggatctatcagtggataccccaggacacattgtcagcttccatatcgcatgcatcatactcatgtaacagccagctagtttttgctgccttcactgatggtaacttaggtgtttttgatgcggagaacttgagattaagatgtcgaattgcaccatcggtgataaacagcaatccacctgttcaccctcttgtcgtcgccgcacatccccacgagccaaaccaatttgcggtcgggctgtcagatgggtccgtcaaagtgctggagccattggagtccgaagggaaatggggagcgcccgctccggcagacaatggcatcattcccaatggcaagacgccagcttcgtcggctactagcaaccctgctgcggatcaaatccaaagatagattgtattccctaagcttttctttttctgcaaactttctaattacactgacttatttgtatgtggatgccgttaggatattatcgtcatttgttgtaaaaaggacagaataggttttatgttcaggtgtggttaactttcaggtactaccctagttatcctgttcatggaagattatgtttgcgatacggggtaatagtgtctataaagtatgtcgcctaaggttttctcaggtttagctcgatagctcaaatgatgtaagctatatatttcttcatgaatgtaaagcaatacatagtttttgctcaagatctattttagctggtttttttaatatagcgtgtgttcatcg

SEQ ID NO: 16510 - DNA, 1935 bp, Zea mays
tggcgcctccggcccggcgcgggccgggggggcaacgcaagcactccacactgctgtgcagaacgagagccacaccatcagtagttagagcgaccaatagatgagttcctccccgtcctttggtctcctggctgtagcagcattactcctagcactgagcttagcacaacatggctccctcgccgcaaccgtcggccccagggtcatcgtcgtcggcgccggcatgtctgggatctcggcggcgaagaggctgtcggaggccgggataaccgacctgctgattctggaagcgacggaccacatcggcgggcggatgcacaagacgaacttcgccggcatcaacgtcgagttaggcgccaactgggtggagggcgtgaacggcggcaagatgaaccccatctggcccatcgtcaactccaccctcaagctccgcaacttccgctccgacttcgactacctcgctcagaacgtctacaaggaggacggtggcgtctacgatgaagattacgtccagaagagaattgaactggcggacagcgtggaagagatgggggagaagctctctgccactttgcacgccagtggcagagacgacatgtctatccttgccatgcagcgcctcaacgaacaccagccgaacgggccggcgacgccggtggacatggtggtggactactacaagttcgactacgagttcgcggagccgccgcgcgtgaccagcctgcagaacaccgtgcctctcgcgaccttcagcgacttcggcgacgacgtctacttcgtcgccgaccagcggggctacgaggccgtcgtctactacctcgccggccagtacctcaagaccgacgataagtctggaaagatcgtcgacccgcgcctgcagctcaacaaggtggtgcgagagatcaagtattccccgggtggcgtcaccgtcaagacagaggacaactcggtgtacagcgcagactacgtcatggtttctgcgagcctgggtgtcctgcaatccgatctcattcagttcaagcccaagctacctacatggaaggttagggcgatctaccaattcgacatggccgtgtacaccaagatcttcctcaagttccccaggaagttctggcctgaagggaaaggaagggagttcttcctctacgccagcagcaggagaggttactacggagtgtggcaggagttcgagaagcagtaccctgacgccaatgtcctcctggtcaccgtgaccgacgaggagtcgaggcgcatcgagcagcagtcggacgagcagaccaaggcggagatcatgcaggtgctgcggaagatgttccccggcaaggacgtcccggacgccaccgacatccttgtcccgaggtggtggtccgacaggttctacaagggcaccttctccaactggccagttggcgtcaaccgctacgaatacgaccagcttagggcaccggttgggagggtatacttcaccggtgagcacaccagcgagcactacaatggctatgtccatggagcctatctttcaggtatcgactccgctgaaattctcatcaactgcgcccagaaaaagatgtgcaagtaccatgtccagggaaagtatgactaggaagctacagcaaattgatttaaagctccagcaaattgagcagtgtggatgttgcatttctcagttcattttttccctgttttcaacaaagtatagatgacagccatgttccctcgcggcatatgccttttcattattccaataaagctagcggctggttcgatgagcacgatttgtgatcgagtatcctgtttaataagtacggtgtttgctttttttttcatgatgaggggtgcatggcttatgatattctatctatttgctaatcaaaactttgtaccatgggaatcactagtacaaacaacattattactcgtgatttccaagaaaag

SEQ ID NO: 16511 - DNA, 3486 bp, Zea mays
catattaattcccaattgcctctcatttaattcaattgtactaatagcagagagaatattaaagatcattttagtcttcttataaatcatttagtatatttttactaattttagtccctagaaccaaacatgttatggactaaactttagtcccctaactaaactttagtctctagactaaataaaccaaacatggcctaaaacagataaaaggtcaaaaattttagaacgaatcgaaggattaagcgagtaatacgaaagtcaactcaactattataatatagtagtactacaattattagctcgcttcccttttataaagaggacgcacacgcatacattaataataaaatttggatccataatttgggggcgaaaataactattatgatacagatttgatatagtaagagcactgcaccttgggttggtaaagatggcaatcacatgttcgagtgtcatattttacctgtggttgacacatagggcccgaaacttttgtgtttttttctttctattttaatttctacctctagttagatgttttggtgcaagcttctttaaaacttattagggtaatttttgctgactatgttgtcgtcgacacaatatgtactgataaatttaagaatacatatttaatacgcagagatagatttcatggcgttggtgggacgacagagcgtagatattagtttattaggagatcgagcttttgactagtcgaaaaagtgacatgcgtatgtattaactgcagcggtggcgtctacgatgaagattacgtccagaagagaattgaactggcggacagcgtggaagagatgggggagaagctctctgccactttgcacgccagtggcagagacgacatgtctatccttgccatgcagcgcctcaacgaacagtacgtgtgtcctatatatacctgcagctcctcaactccctcctgctgccattcttgcggctccccctgaatgcaatgcactgcaatgggcatgtgcatgcagccagccgaacgggccggcgacgccggtggacatggtggtggactactacaagttcgactacgagttcgcggagccgccgcgcgtgaccagcctgcagaacaccgtgcctctcgcgaccttcagcgacttcggcgacgacgtctacttcgtcgccgaccagcggggctacgaggccgtcgtctactacctcgccggccagtacctcaagaccgacgataagtctggaaagatcgtcgacccgcgcctgcagctcaacaaggtatatatatactacatgcatgcatgcatgcatgggcattgattaagcttagctagattgctagaacacatcattaacgtacgtacatacaggtggtgcgagagatcaagtattccccgggtggcgtcaccgtcaagacagaggacaactcggtgtacagcgcagactacgtcatggtttctgcgagcctgggtgtcctgcaatccgatctcattcagttcaagcccaagctacctgtcagttagttgttcctacctacacctcgatctatcatcagctgatcgattatatcttctcaatattaattatagtatattaatttgatatatggtcgtttcctcttgtctgccccagacatggaaggttagggcgatctaccaattcgacatggccgtgtacaccaagatcttcctcaagttccccaggaagttctggcctgaagggaaaggaagggagttcttcctctacgccagcagcaggagaggttactacggagtgtggcaggtatactaattagctagctagctagcttgtagctgctgatcgatgggcagattatgatcaaataacaccgaacactttgcaacaacaacaacatgcgatctacaggagttcgagaagcagtaccctgacgccaatgtcctcctggtcaccgtgaccgacgaggagtcgaggcgcatcgagcagcagtcggacgagcagaccaaggcggagatcatgcaggtgctgcggaagatgttccccggcaaggacgtcccggacgccaccgacatccttgtcccgaggtggtggtccgacaggttctacaagggcaccttctctaactggccagttggcgtcaaccgctacgaatacgaccagcttagggcaccggttgggagggtatacttcaccggcgagcacaccagcgagcactacaatggctatgtccatggagcctatctttcaggtctgcaagtacacttgaccttcccaacaagattactagtgtagtgacataggcttgcacttacggcgtgaaatttcttccattcttgtatgtctcatggtgcctatcgttcaggtatcgactccgctgaaattctcatcaactgcgcccagaaaaagatgtgcaagtaccatgtccagggaaagtatgactaggaagctacagcaaattgatttaaagctccagcaaattgagcagtgtggatgttgcatttctcagttcattttttccctgttttcaacaaagtatagatgacagccatgttccctcgcggcatatgccttttcattattccaataaagctagcggctggttcgatgagcacgatttgtgatcgagtatcctgtttaataagtacggtgtttgcttttttttccatgatgaggggtgcatggcttatgatattctatctatttgctaatcaaaactttgtaccatgggattccctagtacccccaccattattactcgtgatttcagatctacttttaggtcttgtttaggaggaagaagacagtagagaattggtagggctagaagcatcttactatacaattttaaatagtgagttgattttagctccttcaatctcctccgatatactcgtgtttctagtttccgccgatgtgatagaccagaaaatcacacattttacaggcgtcttcttgagatccacaggcgttctcttaggctagtgtaaatcacgaactttatagacgttcgtttaagaagccaatattgaggataatttagatccttagcgtaatgctgagcttcaacaatttgcttatgtgtcagttgttttttcgaagcatgtcgaatgaggaattcaagatctctggtcgacaccgctttgggtatcgacagtgaaattttctctgacaggctctcgtttatttgctctgttgaccttatttccgaaggtccagccttagtgcaatcaggagcaacacttacgtcgatagctttttccaactctccaggtttgtctttggaaatccttgtaggaaaaggagtagccattttcgaaggcctcaaaacaacgcctagaatgctggccatccttctccctttcttgggtgtctctactaaagcagatgttattcttgacagcccttgccccaccggagaactctacggcttcggctgcttctcggccttggaactttctgtttttaatttctccatttgaatagtgggaacttcggctgctgcaggtcgacttagaggat

SEQ ID NO: 16512 - DNA, 2625 bp, Zea mays
ggagtacgatgcatgtttggcaaattgcaatttgttaggtttaagttgacctaagcggggttgtcaaacctccaagtttcatctgtaccaaaaacaaaacacagagaatcttgcacgttgttggcatccgaatcacatcaaacagggacctaaatctttttcatcagcatggttcattgaagaaggaaaaaatgtgcttattacctgctcctcatcgagctcggttcccctgtcaaaaccagaatgagaatccagactaacaatggtacaaacgggcacacagagaggttaagccccaacaccgccgtccaggctggaggcacacgttaatcgtcttcatcaacaaacaaacaaacaacgcgcaattccctagttctctcgtgaccgccttccctcctctcctgcgtcccaactgggcaattccccaaacctaactaacctttgccaccgcgggagccaccatgggtggccagatgccggacgccgacgggaaggcccgctcggcggactcctcgtcctcttacgggtacccgccgtcggcgccgccgcagcaccagtacggcacctttggccccccatccggagcctccggggagtttccgcagccggcggtcgggttcccccagccggcggcgccgcctgggatgcagcactacccgcagcctcctccggcgtcgtatgccgtctacccacccccgcagcaaccctactcggccgccgcgccgtactacgcccaaggctaccagatcgctcaaggtacggaagcgccttacgaggcgctgcatcccggttcattttttttcataggatcgatcaacgggaggcgttcttttgaccgaggagtcttgtgtggctgattcatcgtgtagatcttttcaatcgcctaacccctttgcttatttgcattacattgtaagctcaaaatttaggtgttgtcctgcccagctgtcttcctgtttatctcctgtgtatctgaatctgcagttcctgctgcatccctttttttttccccatcacttctaagttgcaggccaacggcgttggtgttgctcatcccaaattagacacttgagatcggtagttcatggagttcgagggaaactgaatttctctttgaacttcgaagtgttctgaaatgttaaagtaaatgagcaggaaatttgatttgtaggaacaaccaaatatatgcagggcagttcattttcagcgaaggattgcataaataattcaactctccaaataaatccgtaaaatgaataattcagtatataatttatatttatgttcgaaatggtggaagatatgaagtcaacaactacactggaactttgactgaacttgggtaattatttgtttgcattttggtgctttgtaggttatattcctgttgttgaaggaaggcctgttagaatccgtcctcttccatgttgtggccttggcatggggtggtttctgtatgtttgtttttcctaaatatcaatcatctcacaattcatatatgaacctgtattggtctctgaggaactgatatttccactgtttgctacaggtttataattgggttcttctttgctgccattccatggtatcttggagcttttgtgctgatttgtgtccgagtacgtgattacagggagaaaccaggatatgttgcttgcactattgctgtaagtccttcctagcaatgtatgcattgctcatatgttttccgccagctatttgttaatggattttagatgcaaaacatccattaagcatgtgagaatttagggccaatatcagggttatttaacagttttacacacacgaactgctgctgcaaatacagagtcaactcctgtcactaaactacaccattgcatttcaatagcccctataaagctattggagatggatattcaaataaaaagacttaccacatcgtatagttgaagaagtgcatgctctttatgtttccaaaaagacaaaaaaagaactttgtaagggtttaatggatttcaacatagcttttggtatctcttttttttcccgatggaagcttttggtatcatctcttacttggatgggaagcatatgtcagttcaactaaatacaattctatggaatgcgctgcataaatttagcttggcactacatggtgaaagtgtttgttactatctgaccatgtgatgtgatgtttagtagccattgttactgtagacctgtgccttctcttccaaattaatgcacaaaggttgcgctaactttgcccccaaacttttttggtgccatggacaggcctcgcttgctgcaattgctgtgctgcttggcgccacaaaaggagcggaggtgtggtgagcattatgccttcaattaccagcagtccggttaatgtaaatgtccgttgctcggctactttgttacctgtgttgtacatgtgttgtgcgtacaaaggatagggtgtaacgaaaatgatgtatgctcctatttgtagttggacatatacatttgtcaaacggagtagcatgaatgcacaccctcattaatcatttgatgtaaaatttactggaatgccaccatgttatggtagtctggtcgacaatatatccatgagtaccgttgagaccttttcgtactttatgacat

SEQ ID NO: 16513 - DNA, 2036 bp, Zea mays
actcctaagggcgattgggttcctcgaggccggccgggaagccccaacaccgccggccggccgggtcgcgcccgttaatcgtcttgatcaacaaacaagcaaacaacgcgcaattccctagttctctcgtgaccgccttccctcctctcctgcgtcccaactgggcaattccccaaacctaactaacctttgccaccgcgggagccaccatgggtggccagatgccggacgccgacgggaaggcccgctcggcggactcctcgtcctcttacgggtacccgccgtcggcgccgccgcagcaccagtacggcacctttggtcccccatccggagcctccggggagtttccgcagccggcggtcgggttcccccagccggcggcgccgcctgggatgcagcactacccgcagcctcctccggcgtcgtatgccgtctacccacccccgcagcaaccctactcggccgccgcgccgtactacgcccaaggctaccagatcgctcaaggttatattcctgttgttgaaggaaggcctgttagaatccgtcctcttccatgttgtggccttggcatggggtggtttctgtttataattgggttcttctttgctgccattccatggtatcttggagcttttgtgctgatttgtgtccgagtacgtgattacagggagaaaccaggatatgttgcttgcactattgctgcctcgcttgctgcaattgctgtgctgcttggcgccacaaaaggagcggaggtgtggtgagcattatgccttcaattaccagcagtccggttaatgtaaatgtccgttgctcggctactttgttacctgtgttgtacatgtgttgtgcgtacaaaggatagggtgtaacgaaaatgatgtatgctcctatttgtagttggacatatacatttgacaaacggagtagcatgaatgcacaccctcattaatcatttgatgtaaaatttactggaatgccaccatgttatggtagtctggtcgacaatatatccatgagtaccgttgagaccttttcgtaaaaaaaaaaaaaaatgatgggaacacatgtcactagtgtcaatagcaggttatggctttgattgtttttttgcaatacatttatacatcttgtgagggctgctagtttgacgaccctggcgcccacgtgccaggagcccaggagggatagcggagcatgtgtattcctcctctcttcctcctacccatctatcacttggcctcgttcggcataatggatttcagttccaacctgaagtcctgaacgcttccaaggcaaggatgaagtgaatccggttggttcactcaaatctgatgaccaatacatccggttagtttcagtcctgttcgtttcaggtaggaaacagtcaaacagatcaatttgagacattctctcctctggcatttcaaaaaatcacagttttctaagaagttttccaagaagttgtattccttcatatatgccgaaaaaataaaataagttttcccttcatacatatatttgatctcaactttctatgagaaggataaagacacagccatctcatatgaatcgtttcgttctattaacaagaagttgtattccttcgtatatctctgtgacaaaaactttcagcgtccaattttctaatatgttgataattattatcaacaccggtaacaaaaagactattcatatgaatcttcttctagtagtacacagtatagcaatctcggacttcaatcacccttgcctggaccaacggccaacgggcaagcaagaaaacaaaacaaaaaaaggttgccactagaaccagaaccagcacacggccatcctccactcaagaagacgatggctcttctgatgaacgacaacaagaagacaacgcaggcggtggtcctagccgtgccccaggtgttgctgttggcgcccgcgtcggccgcgatgacctgcgtgcaggtggggtcggcgctgtcgctgggcatcccgtgcgcgagcgcgacggggagggccagcgcgctcccctccgggtgctgcag

SEQ ID NO: 16514 - DNA, 2697 bp, Zea mays
tgtgcgtgtctgaagtttctgttgccatcgtgccagatcggataaacaagtttatcgaggccacagtttttttaggctacaggggattctgatatctgataagcttgctaatcgcatcgcagttgagcttgtatttcgcggcttgtgcgatcatacgggattatttttagatctgtgacattgataggaaattctagggctcgtttgtttcctttgaattgaattctattataataataataactgggaaataaattaattaagttaatatatttgtatatgtaacatatttatatattattctaaattatatgtatgttatagactagccaattatgtgtgctttgctacgattattatctatcatataaataagtatcgagatgtttatttaaatatgattattgtttatttctaagtactaagatacgtgtattctggtggttagctcttaatttctggagtttgttgttatcaaacttagtgtagaaaagtcaaacgaattataaattggaatagatttatgctaacttaataattggtttgttatttatgttaacttaataattggtttgttgttaattaatatgaagatatgatgtgattttaaaaacaattgtttattgttttaaatgctactaaaatcttttaaaatgattggttttgtcaattttgggtatatcgggtaaaacctgaaccctcttctgaattattgggtatccaaaattcgggtaacaatttctcgaggcaaaaatctggtagcagttttttatacccgaattactcgagccagatattttaggtaaaccgaatgttcttgcctagcagaaagtaggggaagctacttccaaatttgtactagaaggaaatgctttttggtagaagcaaatttagtgtcccctttggttcaacttttgtttttaaagtagaattacgtttgataagcaaaaccaaacacaccttgtattttgcacccccttgatagcatgacagttcctacatttacttttaaaatgtaaaaaagaatacaatcctccgataagttcaacaccacatccttttataattggggtctccaccaagtcatatattattctcaccaagtttttttttttttttttgactccatattatcttaatagtcctcaaagttgtctggttatccataccaaaatccacatttctatattattgaagccggttcaaaatggtccccgccgagtggggtgggaaaaaacacagacacgacaactgtttccagatatttccatcgcacacctccccatccgccgcatctcgcttcctctcccagttgcttcgtctcactttcatcctctttgcgtctctttgatttcgtcgccgtcaaggaaaactccgcttccgtctgaagacttcgacttctcttggcttgctcatcggctgcgtctctttggtgagatacaaaatttttttctttctctttcgccgtccttttcgattcggtcgacacctggttccagatccgttcgtcgatcgtatccaaagtcctctactcgagatcctcttgttttttagagatcttgttgcttcagtgcgtggagattgagatctaaaaggcaagtatttccttttggttaactggttcgcaagaagcgatggcgcgtccacgcatgcagatacactacgtcccgccgtacgctacagtgctacacactgctgtccttgcctcctccagctgagattgctagtgatttggcccacgcgcggcggcgcggaagctgttccatgttaagctgcagtcgatgctgctcctcccccttctccacctctcagagcggcgaacgcctgcaaaagaaagcaatcaaactatgatttccccatgcacgagagagattcgatgctaagccgcagtggaatgtaacgtcgaggaatgtcacttttccttgcaacctttttagcgtatatctatatctatgtaactgatacgggctgttgttgcaacaacagaccatggtgattatttaaagtaagcctaggatttagacaaccaaattcttttgaaagtatatatgcaacaatatagaaatcctttcttgctgcaaaaatgagacacattgatgttggaattgtagaacaagcctcggtctacctaatctctactatacttaaagcatcagtttcctcggtccacctaatctctactatacttaaagcatcagttttaacggtcgtcctgcgtcatctttttacaaaaaaatccttacatttcttccaaatcaacccaacgtaacccacaccctgatggaagaagtgtgggagacactagaccaagctatctaaccagcagaacatcatgtttaagtgtttataatattgaatataaattgtacatattatatatgatttttttataaaataaaaaataatcgtgtcgggatataaatgggtcatgtctcggaccggctcgctagacacgactaatttggccatctatacctccacacgataatgatggtcctcgtctcagttgccaccacctcgttcgccattctacttctttactctcccccctcatgcctccacctccgcgccaccccattcttggcagagggtgtaggagtatgcgtcttcttcccgtattcgtctgacaccagtcccaacaccgactcgcgcaatgtctattgcacgtccacaaggacgtttcacatcatgcgcata

SEQ ID NO: 16515 - DNA, 1288 bp, Zea mays
  misc_feature (1139)..(1139): n is a, c, g, or t
gaagcgctagggtctcgcttgcttgctcccggaccgagtcggatcgagtcggaggcggctctctgcttcctccgcccgatgctcggttcacttcactccaaccaagtccaaccacgcctccgctgtccgcccgtccacgctgcctgccctcctctccttgccgaaactgccacgagcacctcctgagccaagttcgtttacttttcgagtttggtgcggtgctcgcagctcgctggtgctgctgacgcggccgccgccttgattagcaacaagccacgcccgctgttcctggcttcctgctcgggctggccgctttgattattcgtctctttttctttctcggcgatcgcctttttcccgagattgcatttttctttatttgtcggcggtacggcactttggctccttccgcgaggccgccggccgtgaagatgcagcagcagcagcagaagctggtggtggcgtcgtgaacaagaaattcctccggttccacgcggtcccctcccctcgctttggccccatttattttcttccttttccgctggttttctggtggggggcggaggggttttgcgctggttgttccggttgggtttaggacgccaaccagctggttttccccaccccgcttgcgcttccatccgtgagctcatccgcccagctggaaaacaagaatcctcatgagttctagaagggaagtcgcgatctctgggtgaggtgtccgtttcctcccgttgctggatccgctgactgaccgatcggcagagccgccatggcgtcgtcgtgcatcccggccggcggcatccggctgccggacctggagatggtcaaggccgcgccgccggcgcactccgcggcgtcctccacgctctcggaggcgtccagcgcgtccgcagtctcctcgtcggccacctcgtcatcggtggcgtcgctgtcgctcaagcgcccgcgcacgccgcggaagcggtccagccagacgtacaacgaggcggcggcactgctcgcgtccatgtacccctccgtcttccccgtcgccgggggcggcgccgcgccgcgccgcctcctcggcctcgcctccgcgctcgccgacgactcgtcctgctccgacctcctcccgccgttcccagtcccccggcggncacgccgccttcctcctccgcgacctgacgccgcggatccccgccgccgaaagctgcccgtcgcccgctgccgtcagcagcgtcttcagcgagttccgcgacccggcgccgtcttctgcgacccctgacgacgctgcggcggcgcctga

SEQ ID NO: 16516 - DNA, 1958 bp, Zea mays
acaggcggttccacgcaggcagtagcagcagcaggcgctggtggtggcgctgggcgttggcgttggcgttgtgaacaagaaattcctcgggtttcacgcggctccagtcgctttggcgttttggccccttccttttcttcctttccgctagttttctggtgacggggggtttttgcgctggttcgtgttgggtttataggacggcacggcaccagctgaaaaaacttccccatccccatcccgctcccgcttgctccgtgccgtggtctccgagatcggggttcctttccttgccgatttgatccgcccagctggaaaacgaaaatcgctgatgggttttggaaggaaagtcgtcatttcttggtgaggtttccgtttctggatcgactggctgatcgatcgtactagcaaccatggcgtcgtcgtgcatcccggccggcggcatccggctgccggacctggagatggtcaaggccgcgccgccgccggcgccgccccgcccggcgcactccgcggcgtcctccacgctctcggaggcatccaactcgtccccagcctcctcctcgtcggtggcgtcgctgtcgctcaagcgcccgcgcacgccgcgaaagcggcccagccagacgtacaacgaggcggcggcgctgctcgcgtccatgtacccctccgtattccccgtcgccaggggctgggggggccccgaggcggcgccaccccgcctcctcggcctcgcctccgcgcttggcgacgacccgtcctgctccgacctcctccctccgttccccgttcccggaggccacgccgccttcctcctccgcgacctgccgacgccgccgcagagccccgccggcgtcgccaagagctgcccgtcgcccgcggccgtcagcagcgtcttcagcgagttccgcgacccggcaccatcccctgcaacccctgacgatgctgctgcggcacctgacgagcccggagagctccacttcgacgttgacgacggtttcgacgctgactctattctgtgcggcgtcgaccagagcgcggccgagggcatcgacggcatcatgggtaagctctctatggaaaacagcgggacgtccgtgtcaagctcaagcgtcaactccaacctgcccatatccaagatacacccttacctcaggaaccttatggtcctcgggctgagcttccggcacgatcagaatatcttcaaccaagcgctcaagcaccatagcgtcgatcatgaatggtggatgtgccctgccatacctgtaaaagacattacccccgccccgccaccttcagtagcaatgccgaaagtgacagacaagaagactaagaagtcactggggacaatgtacgaggagggggttcctgagtctgtcaatggcgacgctggagctttggcactgccagagacaggattggggctgagcttgaacactggcggggtgctcaaggcgtggtgcggcagaggctctgtgttcgctgatagcaatggctctgacttgccgttgtcttctgctcatgtggtagttaaacatgaagacagtgatagtgatctcttcccaaagaacggtatcagcgctgttatcagggaaggcaacattctgaagatgcagcgcaagcagaagccttgcgctcccctcccttctaataagcagagtcggtactaccggcctcgggtcaaggggaggtttgtcagcaaggcttatttcctccagcagcagcaggtattggagaaggagagctaaagaagatgggtcttgcgggcatttctggggatttactcttgctctctaggagaagcagcagagcttctcaattttcatttctgcagcgtcacagcacggcagatgtagagatgcatgtagagttgcatgtaagttgtgaccatggtttccttgcaacttctctagctccagatggcttaatggccatgaagtgatatcccaaccagttaactg

SEQ ID NO: 16517 - DNA, 766 bp, Zea mays
  misc_feature (691)..(691): n is a, c, g, or t
gggacaatatatgaggaggggagtcctgagcctgccaatggcgacgaggatggagctttggcactgccagagacaggattggggcttagcttgaatactgatggggtgctcaaggcgtggtgtggcagaggctctgcgtttgctgatggcaatgggcctgacttgccattgtcccctgctcatgtggtagttaaacatgaagacaatgatctcttcccaaagaatggtaccggcgctgttatcagggaaggcaacattctgaagatgcagcgcaagcagaagccatgcactcccctcccctccaacaagcagagtcggtactaccggcctcgggtcaaggggaggtttgtcagcaaggcttgtttcctccagcgacagcaagcgttagagaaggagagctagagaaagatggatcctgctccaaggcgcatttctggggctctcttggagaagcagcagagcttctccgttttcatctctgcggcggtacagtgcggcagatgtagagatgcctgtagagtggtgcttgtgaacctcaattctcagtttcttctatcaattccaggttcccataggcccctggggccgaacgtgcctaaagtgaagacagaaaacaacaacaacaacaacagactcctagttcacacaaaaaaaaaacagaaaacaacaacaacaacaacagactcctagntcacacagggctctgcgttgttaccactgtttaagggcgaagtctctgcgttgttaccactgtttaagggcgaat

SEQ ID NO: 16518 - DNA, 2425 bp, Zea mays
ccccgccctccgcaccgtctgtggagaagcgagaggaggaaggagacaaggaaaggaagggaggggaatcttcgtagagcactaggcagcgacggagtcagcgcagcttcgtctccttccttccttcccctttcgctggccgctggccgtcggcaccatcacctacggccacgggcgcagcgcggcgccgctccgtaccgggtccgcgggcctctcgccagggggacccgataagcctccgctgctctgctcggctgctcttaccgtctctcccgtccacggtccacttagctagaaacacacaacaaacaaggagaaatcgcaaggaggagcagcgcctgccgccgcgccgtatccagcgaggcagcccccccgccccgatctgccggcccgacacgctgggatcttcctttccttagccgaccggtcaacgccgcagatattctccttccctgcggctctggaggtttccgtaaacccgtcaccccccctccttctattccttgcaggtgaatccaccgtcgcccctttcctcgttcctcctcctcctcctcctccccttcgtctccaccccccggatctcgccttcgctcgtcgcttcccgattcgcggccggaggggcggactccggctgtgtgggtggacgcaaggtagtcggcaaaaggtgcgattttgatcttgtattcttgtttccgaggccccctgcgttgcgtgatggctggtccgtcgaaccttcgctgctcatggttttccgtgatatacgattgagtagttcgattcaatagacactagaatcgatttgggtgccgccgacctgattcttccgtcccgaatgctgttgggttggatgggggactacggggatggtattttggtgcgcggtgctgccggggcccaaagctttgcgtccaaagtcccaaattgcaggaagaggaaactttgttgtcaatttcagatttcttttctctgtggacgtgtgtgtctgtccaacaacgccttctctggagttacctgattttgctgcctgccattgataggtatcgacgatcagacggagcagttgcttcaatctcgacttcgacctccatctgcgttgaacccatttgggattttggagagggggggtgcttgcttggattgcacagcatctgcatcagttcacattctttgggcatttgctatcttgtcaagcttgctgactatacagttctggttcaaggaacgcctttctgaggtctcttggattatgggagctttctgttcatgtctgcaacctgattattcggaccaccatggaaaccaagcttcttcggcgtttaggaactgcatgtgcctcagatgctttacccagcagctgatcaatgcgtatactgttttgttccgagctggagcagtgcattctgtttcccccgctattgaagccactcctgttgattcaactgaaagctccttcgatacatatcgttcgccgccaagacctctgccctatgatgatccacgattttcccctcctgctcgtgactggttaaggagtgagaacccaagccattccccagaggaatcggaaccacttagagcaaatgaggatgatgaagaaatggaaacaccaagtataatacagaaggcaagtaaaacaaactacaacacaaaaatgaaaatctgcagctctacttatggtgataaggtgccaccaagggaacatggaaattacttcagctatttttccccatctgctgaagatgaagatgtttgtccaacttgtcttgaagattatgattctgagaatcctaggatagtaatgcagtgctcacaccatttccaccttggctgtatttatgagtggatggaaagaagtgaggcatgccctgtctgtggaaagaagatggagtttgacgagacaacataatcctctggctggactctacaccatggcccatggattaacaacaaaccttctcatatgacattctgaaaatacagatggtctagcccagcaagttctctgtaaatacgccctgtaaatattggactggtagtgtgggtccctcttggccatacgagtgctctccaaatgctggaacggtgcacataaacattcttttccgatttgttacaaatagtcggcaggggaaggttgccccccctctgcctgtctgcgcctctgcctctgccttgtcgaggcttagaggtgcattggttgtccggtgatagattcatcggaagcctgtaaattaaagacctaggctcatataataatcatatggagtcccgtggttctggaagttcttgcaatgataactatttggctccggccactgaaattctgtcatagtagtggtgtttatcatgccaacatttgtttccgtggtgttgctaattgtgactcatggacacatatgaagagttatttattacacttattgtc

SEQ ID NO: 16519 - DNA, 2573 bp, Zea mays
acacaacaagcgtcgatggacgtcccacctaatcctttctcgcactcgcaccgtctgtccggccgcgagaggagggcacgagaaaggaaaggaagggaggggaatctccgtagagcactaggcagcgacggagtcagcgcagcttcgtctccttccttccttcccctttcgctggccgctggccgtcggcaccatcacctacggccacgggcgcagcgcggcgccgctccataccgggtccgcgggcctctcgccaaggaaacccgataagcctccgctgctctgctcggctgctcttgccttctctcccgtccacggtccacttagctagaaacacacaacaaacaaggagaaatcgcaaggaggagcagcgcctgccgccgcgccgtatccagcgaggcagcccccccgccccgatctgccggcccgacacgctgggatcttcctttccttagccgaccggtcaacgccgcagatattctccttccctgcggctctggaggtttccgtaaacccgtcgcccccctccttctattccttgcaggtgaatccaccgtcgcccctttcctcgttcctccttcccttcgtctccccccaggatctcgccttcgctcggcgcttcccgattcgcggccggcggggcggactccggctgtgtgggtggacgcaaggtagtcggcaaaaggtatcgacgatcagacggagcagttgcttcaatctcgacttcgacctccatctgcattgaacccatttgggattttggagagtgggggcttgcttggattgcacatcatctgcatcagttcacattttttgggcatttgctatcttgtcaagcttgctgactatacagttctggttcaaggaacgcctttctgaggtctcttggattatgggagctttctgttcatgtctgcaacctgattattcggaccatcatggaaaccaagcttcttcggcgtttaggaactgcatgtgcctcagatgctttacccagcagctgatcaatgcgtatactgttttgttccgagctggagcagtgcattctgtttcccccgctattgaagccactccagttgattcaactgaaagctccttcgatacatatcgttcgcccccaagacctctgccctatgatgatccacgattttcccctcctgctcgtgactggttaaggagtgagaacccaagccattccccagaggaatcggaaccacttagagcaaatgaggatgatgaagaaatggaaacaccaagtataatacagaaggcaagtaaaacaaactacaacacaaaaatgaaaatctgcagctctacttatggtgataaggtgccaccaagggaacatggaaattacttcagctatttttccccatctgctgaagatgaagatgtttgtccaacttgtcttgaagattatgattctgagaatcctaggatagtaatgcagtgctcacaccatttccaccttggctgtatttatgagtggatggaaagaagtgaagcatgccctgtctgtggaaagaagatggagtttgacgagacaacataatcctctggctggactctacaccatggcccatggattaacaacaaaccttctcatatgacattctgaaaatacagatggtctagcccagcaagttctctgtaaatacgccctgtaaatattggactggtagtgtgggtccctcttggccatacgagtgctctccaaatgctggaacggtgcacataaacattcttttccgatttgttacaaatagtcggcaggggaaggttgcccccctctgcctgtctgcgcctctgcctctgccttgtggaggcttagaggtgcattggttccggtgatagattcatcggaagcctgtaaattaaagacctaggctcatataataatcatatggagtcccgtggttctggaagttcttgcaatgataactatttggcttcagagactgaaatgctgtcatagtagtggtgtttgtcatgccaacatttgcttctgtggtgtcgctaattgtgactcatggacacatatgaagagttatttattacacttaatgccactcttgaggctcaggggaccccattttttgaggttcaggggactcatttttttggctgcttccacggctcctcctatcctatccatgtggtgttgaagacttgtaagcaaattcagtccggttactccatacttctctgaaccaaaaagatcgttttgatcccggcatgaagtgtttttatcaagcaaaattaagggagtgtttggcattgctatgctccacctcagagcagctggactctaagactctgggtggagtagctctgttctagaacttagactgtatctcataatcggtggcagtcacgggtaaataactcaaaactccatgactaggttcttttggagttttcggagcagtaaaagagactccatagagtttacagctctagagttagagtgtttgatatgccctgaccagcttcttcttgaagttttgctctagaatcatgtcaaacaggccctaaatctcgaggtcaagttgtgctaaacttggactctgcag

SEQ ID NO: 16520 - DNA, 1204 bp, Zea mays
cccctgggccccgggacccacggcctcacccgtccacccacccacccgcctcgcctccatccacagcgaccacgcccatcttcgctctgtccgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgcctgagcgcgctacgtatcagctcatcgaccggcgggaagggcttgggtaaatcattattgaaagcatctcccttttacatgtaaccttgcatacaatatctgttaagatgagttcactaaataaagttgtttcaaatagtggagatgcatgttcagtcttagctagtaaagtcacatcattaaatcccaatgcagcggagtttgtaccgtcatttgttaaaccatcttttggaaatggtacagttctagataagtcagatttcaggggttcttctggaaaaacaattctagataggcctgagccatcaaagtctaataactcagatgatgaggcacaccagttttggcataagcagcttccggatgacattattccagacttcacttcttttgagaaagttgaacaagggcctgaactgtcccttgctggattatccttgaatgcaccccccttttatgggacaacttccagtcgcttctcaagagaatatcacgaattatcttctccagttaccaagggcctggaactggaactagaacatactaatatgctatatgaagataaaagcaactgggagcaaaattatattggtgatcttcatattgctaatggaaaccaggaccttcattatgattctgaatctggtgtaagcttttctgatagctttgctagtgagtatgttgccccatcagatggcctttttgctcccctggagtacttggcatctcagttccctggattttcagcagagagccttgcagagctttactacgcaaatggggtgtgatttcaaccatactattgaaatcctcacccagctagagatgcaagttgatgctacacccaatcacacactgaatctgccccacagcacaccgaacttcagcactgggggatttccctgcacttccaacagctgagggacaaa

SEQ ID NO: 16521 - DNA, 946 bp, Zea mays
gcgtcgggtaaactccccaccccatctccctcacctcacctcgccttcacctcagctcacgcgcgcccccctcgaccccgcccgggcccacccgcctcgcctccatccacagcgaccacgcccatcttcgctctgtccgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgcctgagcgcgctacgtatcagctcatcgaccggcgggaaggctgtagcgtcggttggacgtcgtgagcgtgcagagcaattaagcaaagcagggcttgggtaaatcattattgaaagcatctcccttttacatgtaaccttgcatacaatatctgttaagatgagttcactaaataaagttgtttcaaatagtggagatgcatgttcagtcttagctagtaaagtcacatcattaaatcccaatgcagcggagtttgtaccgtcatttgttaaaccatcttttggaaatggtacagttctagataagtcagatttcaggggttcttctggaaaaacaattctagataggcctgagccatcaaagtctaataactcagatgatgaggcacaccagttttggcataagcagcttccggatgacattattccagacttcacttcttttgagaaagttgaacaagggcctgagctgtcccttgctggattatccttggatgcaccccccttttatgggacaacttccagtcgcttctcaagagatatcacgaattatcttctccagttaccaagggcctggaactggaacatacttatatgctatatgaaagataaagcactggagcaaa

SEQ ID NO: 16522 - DNA, 1261 bp, Zea mays
gcacgaggtatctcagttccctggattttcagcagagagccttgcatagctttactacgcaaatgggtgtgatttcaaccatactattgaaatcctcacccagccggccggtgcttgtggatgactccacccaatcacacactgaatctgccccacagcacaccgaacttcagcactggggatttccctgcacttccaacagctgaggaccaaaatggtttcaatcagggtaatgtggatgtacttggcatgttcaatgggcgcagttcatctgcgatgcctactggagctggtgattttgtttcagccgttcgcaaacttgcatcgcagaactctggccagtggaagtttaaaaaaggtcctgagtatggtaatggcatttcagctctttctgtacccaagcagtacagttctagcactaaacaatcgtctgggaacaagtttcaaagcatcagcagtggaagagttgccccatggcttgagactggtgatgcagtggcaagtatgtactcagaatcaaggggagaggctcgtgattttgctagggtccggaatacctgctttgagcaggctagacaggcttacttggttggcaacaaggctcttgcgaaggagctcagcatgaaggggcaggcctacaatgtgcaaatgaaagcggctcatgagaaagctagagaagctatttaccgacaaaggaatcctgtttcttcccaacgtgggggtggtgaccacctgattgatttacatggcctgcatgtgaacgaagcaatccacatcctgaagggtgagctcaccgccttgaagagcgcggcgagggcagcaggggagaggatgcaagtcatggtttgcgttggaacaggccaccacaccaagggctctcgcactgcgaggttgcccatcgctgtggagcagttcctgctggatgaaggcctccagtacacgcagcctcaggcgggtctgctccgagtgatggtgtactaacatctcttaggtgagacatcacggtgaggaaaaaaactccaaaaaaagagaaaagagatgtacgaaaacgcaggaaaaaaaagcgtcgttggagcacgcactgttattccgtgtagctgtatattaaaagaggcagcaggagaatagcctgacaacaggatacagtgtaaaattatacgtagcttccttcattcaattcacattccttttccatcaaaaaaaaaaaaaaaaaagaaagcggctgctgaacactgcgacgcacttggggccatttggtgct

SEQ ID NO: 16523 - DNA, 853 bp, Zea mays
gcgggtggtggagctgggcgtcacgcacatcccgcgggaggtgttcgaggactacctccgcgacatagcgccccggtacacggccgagacctaccgcctgctcacccacaactgcaacaacttcagccacgaggtggcgcagttcctcgtcggcactggcgccggcgtgcccgactacatcctcaacctccccgccgaggtcatgtccagccccatgggcccgctcatcatgcccatgatccagaacctcgagtccacgctcaggagcaacgtcgctccgcagaccacgcagttcgtgcccacgcccgcctccgtatccgcgccgaccgaggctcccgcctccgagcgaaaagcgccggcgccggcggagaaggcttcgaaggaagctcctgcgcctgcgaagaaggaagcccctactcctgcggctgacccgctcgggagcgccagggggaaggtgcaggaggaggtgatgaaggagttcgcggccatcatggccagcggtacgctacgggccagcgaggcggcggcgctggccatgcgccgggtcatggagcgccacggcgacggcgccacgatgcagcagggctagacgaatcaggctgtgaacgcgttccggttccatgggaattggaatttgtcatctgcatgctgatgccgccgccgtatggaaaaatttggagaagttattcctgatatgttcgtgcgattatttgggttgtcattaattgcggccgccggacttgttgcccatcttattactctatgggcggttaatttggtgagatatgctaatttacgttcgctacttcatgttttaatccgtcagctatgcattggttcctgctgccaaaaa

SEQ ID NO: 16524 - DNA, 1617 bp, Zea mays
  misc_feature (1313)..(1313): n is a, c, g, or t
  misc_feature (1374)..(1374): n is a, c, g, or t
gcacgagggaacgagtactacttcggcggcgggatccagtcgtcccccgcggggacgacgccgtacgggcggccgctgcgggtggtggagctgggcgtcacgcacatcccgcgggaggtgttcgaggactacctccgcgacatcgcgccccggtacacggccgagacctaccgcctgctcacccacaactgcaacaacttcagccacgaggtggcgcagttcctcgtcggcactggcgccggcgtgcccgactacatcctcaacctccccgccgaggtcatgtccagccccatgggcccgctcatcatgcccatgatccagaacctcgagtccacgctcaggagcaacgtcgctccgcagaccacgcagttcgtgcccacgcccgcctccgtctccgcgcctaccgaggctcccgcttccgagcgaaaagcgccggcgccggcggagaaggcttcgaaggaagctcctactcctgcgcctgcgaagaaggaagcccctactcctgcggctgacccgctcgggagcgccagggggaaggtgcaggaggaggtgatgaaggagttcgcggccatcatggccagcggtacgctacgggccagcgaggcggcggcgctggccatgcgccgggtcatggagcgccacggcgacggcgccacgatgcagcagggctagacgaatcaggctgtgaacgcgttccggttccatgggaattggaatttgtcatctgcatgctgatgccgccgccgtatggaaaaaattggagaagttattcctgatatgttcgtgcgattatttgggttggcattaattgcggccgccggacttgttgcccaccgtattactctatgggcggttaatttggtgagatatgctaaaaaaaaaaaaaaaaaaaaaaaatacatgttttaatccgtcagctatgcattgttcctgctgccaatcgcttgtttgattgttgctactcccgcgagctagaatctaggacgctttaccgtgcatacatgcgccagtttggttcgctcggatgactttaatccgaaactaataacccaaattaaactcgttttcgtgcagcgctgcaacatctattaacaccaatgatcaccaaaccattttgtgtcaaacactaatgatcaccaaaccattttgtgtcaaaaaaacgctacccaccaacactttaaacctgcaaaaccgacaggtttatccaaaccaaatctgaacaaattcaaaatgggtttttgttgttgaaccgtccatataaaccgtttattgtttttacataaaaaatcataaggtcatttgtaattttctcnattcatgttccatagtaaatactaattgatctacataacttgttcatcaagatgatatacnacatatatatacaaccataaactttaattctcatgaaacaaacaaccattgaactttgtaatactcaaatacaaggtcatttattttctcttcatcctaccatttggaaagtagtagaaaatggaatgcattttgatagtaatgataatgccatatttattaatgagcaaatccataaaaatgccaatgctaccattgtccttttagcatctctatgcaggaattaatacaataaggttaatg

SEQ ID NO: 16525 - DNA, 1984 bp, Zea mays
gaggccggcagctcatcacccggccgccggatgccccccgggcgggccacgcgcaaccagcgccccctccccacgacgctgaagtcccagatctaaccacacagacacaacccaccacgtcgccaccaccaactaacccattaatccatcaacgccggtcctccacggtcacgcggaagtcaccgccgctctgccgcgctctcccgtagtcccgtaccgcatcgcgttcttcgctggcctcgctgtcgtctcatcgccattggcgtttcgcctgcagctgctcgtccgccagaaccaagcaggtgtaaacatgcttcatcattcaaatagccggaaccaaaggaacaggggatcaagaatcaaaactctactccaagcgaccttgctttcaggtgttgtcttttggctcctgtatcaggtgaagcattcctatgataagaaaaacgagtacttggatgatgctgaggaccagcttacccataatgatagaagcatattccaggcgaggaaacaaaaggcaggtagttacagtgatagcaacgtccaaatggttgtcgacaattctgatgtaacaactaaaccagaggaaggtgatgtagatcatcattctgatacttttgatcataacgagaagactgtagaaactgtgttcgataaagatagtactaacctgcatgaagatgacaagagaaacactgagagttcagaagcggaaggacaagtcaacagtggagatagtaatacagaagctaataataataagaatgaagatgaaaccaccagtcttgtagaaggacgcaagcatgatactgaatccaactctgctgctgagagtaaaagtgaagtcaattcaactggagatgaattgtcccaaaacaatcatgcacaagaggaaaacactagggaggcaagtggaatgtctcatgatgaagtagcgcatggtgacgaatcaaccagtgcaagtggaacttggaatggatcagatggagaaggtgagaaaaaggaggcagttgatactcaaactggttctgaaacccttcctgacgatgccaagaccgaagcaactgatgaccgtggtactaacagcctttctgacgaaacagggaacataccatcagttcatactgataattcacaaaatgatgccagtgaaaaccaaggagatgcaacatccactacctcagattcatctgagcatggcatcagtgaggctgtccatattgaaactggattggaacatggaagtgcaacaacatcatctgttactggatctggtgatgacagggataactcatctgatagctcctctgcaggaaaaaatacggagactctatctggtgatgataagggcatggaaacaggtacaaccactgaagcgtcatattccaaagaagagaactctgagaacagcagtgtctcaactgaagcagagaactcccgaggagattcttccattggagtgaatggttcttcagaaacgtctaccaatggtgagcaggtggatcccaagactgaaactagcacatccaccagtaacgtgcacaatgaatctcaaggggctgatggcagttctggatcaaataactcaattggtaacggccctgaacaaaccggtaaaactgaaaggcagtgataccactatctagacacgaacattgttttagtataaagatttgtttcctggagattgaagaggctagtactgaaccaagaaaaactgttcacattgtggcttatggtgattttagttgatactgctgaagtacaattgtgcacatcgcaagatcggttgtctgctatgcttattgcttatgccatgatttctcgtcaagttgtatcagaacgagtcattatagctgtacggttattaatctctactagtacaatgcccgtcccttctgttgcaatgcaaggacacacaaattattcaaatataatattagtcaaattatccaaatataatattagtgcggccccctgggcc

SEQ ID NO: 16526 - DNA, 1555 bp, Zea mays
gtcgcgcatggatagctgggatactgtggcggcaacaatggatgatgttggggtgcactcgctctcaaaaggagcgtgagcgtttcgctcgtaccctggcctacgcgcccaggcgcattgcgaatcgtgtacttttttttatttttttcactataaggttgtataagtatatttgaacacggccctcagtaagctgcgagcccttcaaatgaacatcgtgatgtacttactcagcggcagcgaaatccatgaacagccgcaggttcaaaagcagtgctactaaaacgaaacggaaacgctcacaagatacatatctcggtacatgatttgtggtcagactgggggtaaggtggtacgggcggagcgcatgaactcgggtgagtgagcccagctcacaagatccggtacaccaacagagtcgcggcagcgaggaaggtgaaggcccgtggtggtgccgagaggccggcagcggcggaacgcgctggggagggcgctggagcgccgctggtctggctccgggttgctgccggtgatcccgaaggggttgacggcgacggcgtcggcgactgcccgaagtctggggccccggacgagggagccggaacaggagacgcgctgggcacaccaggaacagaaacgtggcacttgctgacgggcggcgtcttgaccttgcacgcggcgggcagctgcagggccctggtcatgttgagcgagaggccgaagtcctggccgccctggaagagctggcagaggcaggccacctccccgcgcaccacgtccctgagccccgagcagcaggacgggtcgggcgccgccgccgtgctcccctcctgcacgtagcccaggcaccccgccagccccagcagcgcgtccgtgcagtccgccgacggccccggcgccggcgccggcgttggcgttggcgtggaggcttccacgcgcgtggtggctagtagcgctgcgactgcgagcgccaggaccagcaggcgcgagcgcgacggacggttcgccatggccgtcgtccgagccgctgcgcgctgtcgcggtggtgggttcagacgttcagcggcagctatcggcgcgaccagagtaccagaccactggtgtgtctggtgctcagcgcgtacgtgctgtgctacttgtagatgatgcactagcagctagtagcaggcggccggggtcgcggaatgtggcgcggcaatgatgaagggatccacgggacgggacgggagctatggcgtgcgtgtatttggagtcggcgctagtcggctagtgtagtgggggcgttcggttggtgtgtgtgtgtcccgctgacagataacaacaataggtgggggacgctgcgcactgcgctggtagtggcacaccacaccacttggcgctcgcttgcgtgcacactggcgttctggaccgcaggatctagctagtgtggctgcgatcgatagcagcagcagcagccaccagcgcaggcaatgccacattacagaatacaggattacctgtggctttggccggctttcgagcttcgtacgcgcgactgctcaagggccaaggcaat

SEQ ID NO: 16527 - DNA, 944 bp, Zea mays
  misc_feature (855)..(856): n is a, c, g, or t
cattgggtacctcgaggccggccggggcacaccccgccgcctcaaacctcaggacaagcttgcttctctcccgcccccccgggccccccccctcttgttcttcctctcccccatcagtctcgccgccatttccctgtcctgctgctgctactgctggtagtggttccccaaacccaagccttcgattcgcccgcccgcccgcccgcggtctcgagccagccttccgcgccgtcgtggttgctttacgcgcagctatccatggatgaggtccctgccaccgccgccgtcctcgacttccgacccggctcttctgtaccacgcgtctccgccgtcccgcgccgtgccgtgcagtgccccccggacaccggcggtgcagaggcggcgacgggaggtcgtccaggtatcgggaacactgccgccgtttccgcgaagttgacggggtcaagttcggccggtcccgatatccaggctgtggattgcgatacatcgggaggccttgccggcggtgacgctggagacgtgggggttttgtgcttagagaacgctgccgagaccgaatcggtggaaccaggtgtttcggacgtgaggttgggagctccagtggaggaacgccatggcaggacgctggatagtacgggattgggctctggtaaagctggtgagaccaatgagatttcactgggttgaggtgtcccaatcaggtgccacttcaagcctagatgccactgcgtcgattggtggtggctactccctcgtggaggggtctctgccagaggcgagtggtgcccgcagatgtaaacccgaggtccatgaagtaccaacagggacccctgccactgtgggattcccgattgnnagacgtggctatggatttgaaatcagcctaatgacgatgtggacggtacaacgaccctgcccggaggggaatggggaccgcctactga

SEQ ID NO: 16528 - DNA, 2094 bp, Zea mays
catagaattccacgccttccgaacggccgcagcgcacaccccgccgcctcaaaacctcaggccctcgtgcgctccggccgggcccccattaatctcccccctcttgttcttcctcttccccatcagtctcgccgccattcccctgtcctgctgctgctactgctggttagtggttcctcaaacccaagccttcgattcgcccgcccgcgctctcgagccagccttccgcgccgtcgtggttgctttacgcgcagctatccatggatgaggtccctgccaccgccgccgtcctcgacttccgacccggctcttctgtaccacgcgtctccgccgtcccgcgccgtgccgtgcagtgccccccggacaccggcggtgcagaggcggcgacgggaggtcgtccaggtatcgggaacactgccgccgtttccgcggagttgacggggtcaagttcggccggtcccgatatccaggctgaggattgcgatacatctggaggccttgccggcggtgacgctggagacgtgggggttttgtgcttagagaacgctgccgagcccgaatcggtggaaccaggtgtttcggacgtgaggttgggagctccagtggaggaacgccatggcaggacgctggatagtacgggattgggctctggtaaagctggtgagaccaatgagatttcactggttgaggtgtcccaatcaggtgccacttcaagcctagatgccactgcgtcgattggtggtggctactccctcgtggaggggtctctgccagaggcgagtggtgcccgcagatgtaaacctgaggtccatgaagtaccaacagtgacccctgcaactgtgggattcccgattgaggacggtggctatggatttggaattcagcctaatgacgatgtggacggtagaaacgaccctgccggaggggaatgggaaccgcctactgatggcaatgatgccgaggacgtcacagatatgggtggaatcttgtgtgacgaaagagtggagaggatggagacgaattcggtagaacgtgaggcctcgaatggttccaccgtttcttctgaggaaggagtggacaggatggggacgagcttggacgactctgaggcttccgatggctcaaccacacaagattctgatacagacgtcgagaccgagtcaagtgtttctagtatagaggagcaagaagcaggatacggagcccacatccctcaaccggatccagcagtctgcaaggtgtccaaagaaaacaacacggcaggagtgaagatctctgataggatgacttcagtgtccgaatcaacacttgtgctggcttcaggtgcatcaatgttaccgcatcctgcgaaggtacggacaggtggtgaagatgcatattttatagcttgtgatggctggtttggtgtagcagatggagttggtcagtggtcatttgaagggatcaatgccggactttatgccagagaactaatggatggctgcaaaaagatcgtggaagagacccaaggagctccggggatgagaaccgaggaagttcttgccaaggctgcagatgaagcacggtcccctggttcttccactgttttagttgctcactttgatggcaaggtccttcacgcatcaaacatcggagattctggattcctcgtgattaggaacggaggggtccataagaaatcaaacccaatgacttacggtttcaatttcccgttgcagattgagaagggcgacgaccctctaaaacttgtacagaaatacgccatctgtctacaagaaggcgacgtcgttgtaacagcgtcagacggtcttttcgacaacgtctacgaggaagaagtagcaggcatcgtctccaaatcattagaagctgatctgaagcccacggaaatggccgatttactggttgcccgagcgaaggaggtggggcggtgtgggtttggaaggagcccgttctcggactccgctctcgcggctgggtacctgggctactccggcggcaagctggatgatgtaacggttgttgtatcgattgttcggaaatctgaagtttaataaactagaaacgaactagcaaagttgagcgcacttctttttt

SEQ ID NO: 16529 - DNA, 1973 bp, Zea mays
  misc_feature (1949)..(1949): n is a, c, g, or t
gcacgagaccattaccccgcgcggccggccggcgggacatccctcaaccggtatgtgtttcgtgccaactgctgtaggaagtaggatccagcagtctgcaaggtgtccaaagaaaacaacacggcaggagtgaagatctctgataggatgacttcagtgtctgaatcaacacttgtgctggcttcaggtgcatcaatgttaccgcatcctgcgaaggtacggacaggtggtgaagatgcatattttatagcttgtgatggctggtttggtgtagcagatggagttggtcagtggtcatttgaagggatcaatgccggactttatgccagagaactaatggatggctgcaaaaagatcgtggaagagacccaaggagctccggggatgagaaccgaggaagttcttgccaaggctgcagatgaagcacggtcccctggttcttccactgttttagttgctcactttgatggcaaggtccttcacgcatcaaacatcggagattctggattcctcgtgattaggaacggaggggtccataagaaatcaaacccaatgacttacggtttcaatttcccgttgcagattgagaagggcgacgaccctctaaaacttgtacagaaatacgccatctgtctacaagaaggcgacgtcgttgtaacagcgtcagacggtcttttcgacaacgtctacgaggaagaagtagcaggcatcgtctccaaatcattagaagctgatctgaagcccacggaaatggccgatttactggttgcccgagcgaaggaggtggggcggtgtgggtttggaaggagcccgttctcggactcggctctcgcggctgggtacctgggctactccggcggcaagctggatgatgtaacggttgttgtatcgattgttcggaaatctgaagtttaataaactagaaacgaactctcaaagttgagcgcacttcttatttttttcttcttctttttctcttcttgcaacagctgcactcgctggcaaaatgcccgtgagcatttcgcacgtccctggcctacgcgcccaggcgcattgcgaaacgtgtattgtgtacacttgatacatactataaggttgtataagtatatttgaacacggccctcagtaagctgcgagcccttcaaatgaacatcgtgatgtacttactcagcggcagcgaaatccatgaacagccgcaggttcaaaagcagtgctactaaaacgaaacggaaacgctcacaagatacatatctcggtacatgatttgtggtcagactgggggtaaggtggtacgggcggagcgcatgaactcgggtgagtgagcccagctcacaagatccggtacaccaacagagtcgcggcagcgaggaaggtgaaggcccgtggtggtgccgagaggccggcagcggcggaacgcgctggggagggcgctggagcgccgctggtctggctccgggttgctgccggtgatcccgaaggggttgacggcgacggcgtcggcgactgcccgaagtctggggccccggacgagggagccggaactgaaaccccggccccgtgccggcctcgaggttgtccccactcttttaagacgcaaaagacacgcgcaatttacataccaggagacgcgctgggcacaccaggaacagaaactgcatttaagggcgaggtcactcactcgtcagtcaaacgatcgatcgctcccaccgcgcgccatcacaaaaggcaaaagcgacgagagcgtaccgtggcacttgctgacgggcggcgtcttgaccttgcacgcggcgggcagctgcagggccctggtcatgttgagcgagaggccgaagtcctggccgccctggaagagctggcagaggcaggccacctccccgcgcaccacgtccctgagccccgagcagcaggacgggtcgggcgccgccgccgtgctcccctcctgcacgtancccaggcaccccgccagccccagc

SEQ ID NO: 16530 - DNA, 1151 bp, Zea mays
cattgggtacctcgatgccggccggacacccctcttccggtatgtgtttcgagccaactgctgtaagaagatccagcagtctgcaaggtgtccaaagaaaacaacacgacaggagtgaagatctctgataggatgacttcagagtccgaatcaacgcttgtgctggcttcaggtgcatcaatagttaccgcatccttcgaaggtacggacaggtggtagaagatgcatattttatagcttgtgatggctggtttggtgtagcagatggagttggtcagtggtcatttgaagggatcaatgccggactttatgccagagaactaatggatggctgcaaaaagatcgtggaagagacccaaggagctccagggatgagaaccgaggaagttcttgccagggctgcagatgaagcacggtcccctggttcttccactgttttagttgctcactttgatggaaaggttcttcacgcatcaaacatcggagattctggattcctcgtgattaggaatggagaggtccataagaaatcaaacccaatgacttacggtttcaatttcccgttgcagattgagaagggtgacgaccctctaaaacttgtacagaaatacgccatctgtctacaagaaggcgacgtcgttgtaacagcgtcagacggtcttttcgacaacgtctacgaggaagaagtggcaggcatcgtctcgaaatcattagaagctgatctgaagcccacggaaatcgccgatttactggttgcccgagcgaaggaggtggggcggtgtgggtttggaaggagcccgttctcggactccgctctcgcggctgggtacctgggctactccggcggcaagctggatgatgtaacggttgttgtatcgattgttcggaaatctgaagtttaataaactagaaacgaactagcaaagttgagcgcacttcttttttttcttttcttttcttttttctcttcttgcaacagctgcactcgctggcaaaatgcccgtgaggcgtgagcatttcgcacatccctggcctacgcgctcaggcgcattgcgaaacgtgtattgtgtacacttgatacatactatataaggttgtataagtaagtagagagcaacacgaacgacaaaaaaaaaaaaaaaaaaaaaaaa

SEQ ID NO: 16531 - DNA, 2418 bp, Zea mays
ggactctaaattttacactacaagatttaaggagcggaacggattaggatcgggctctatttctattcatttttaactagaatttatttagggtcctaacattttgtgaagaagcattttgatcgcgatccattatcatccctatgtgcatgttacctcgcccgaggggggtgtgaatgaatagagcatggagcaaaaaaaaaagacacatcctttttcctgttttgaatgccgtattaaatccggagctggtagaggttgcataagcatatgaaaatgtgtaggacaaatcatagcaacgaggtctcaacgtgtactttttctttggccacttgtctagggtttcagatacgttctcggccggtcgcctccggccgctgtgataccccggccagaaattctgaaggagagaaggaaaccgaggcccacgtcacctggcccgaaggacacaccaatcgagctggcgcaggagaagacctacgatgaaaaggctgggatcggtatgcccgatctatagctgcggagagttcactgtaatgtgaccaggacctgacgccctgtgctgtgctgtgctgtgcttcccgcgtaataacggtgtactagttaccttctttgcagaaaatgctttctaggaatgagagcggaaatatttctaccatttatttaaggtcctgtttggaaacaacccaacagtttttaagacaccagtttttatcttttagctttgagagaccaacttcttgtttttatgaaagtgggaatcaaatttctataaactgagccataaactggtggtatctttagaaccacctcaatttttataaaccggtttgttaagaactggatgcttccatccaaacagacgctaaggcgcaatatccttaactattgctcgagacttctgaactttgaaaatcacagtttcagtcctgaaaacaaaaaagaaaaggtttacttttgggttcagtttcatccgatgattatcagagcgactatttcaatcgtcagactttgcattttgggttcaatctcatcatttaacgttcacatccccaccatgtcgacctagcagccgctcttgtgaaaccaatccctccaaccgcagcccttgccttcaaagatggtatcttcatgccctctcggcctctcctcattgcaatgctgagcaagtctgttgcgatacgcaagaaagtgcaacggcattcaccatagcatcctccattgttggacaggcagttgggtgtgtatatgtatgctgctaattgcatgtatgggtccagttttgtgaattgaaactcttccctggtccctgagaagtgaggtgatacctgctgtgttaattctggtgtatgtattagcctcatgtagccgctcgttaatttgcattgcgcagaaattttcactcctcgtcactgattttaattttctagttttttttttttttttgctcctcaataattcttggttcacatgtcatatctagaacgtgttactggtgccgtgacctgagctccgttactaaccttgtgccggcttgcagacgcgaagataccggcccttgggaggccaaaggctcctgaaatgctggcagtcatgtgctctagcagcactgcagcggcatgtccaagcacgagcagagtttcttcaccacaagaacaaaaaaaatggttctattctacactgataatgaatgctttcttctcgctacaccagcccgccgcacaaagccagacaatgcgtcgtggagaaaccaatttttagtagcaaacaagtggagccttttggtacacggaaagaacgaaccaatccagcgagatctggggaccaagaacaagatccagcgagctgcagtcgagtgcgatcgtttcaacaactccgatgccgaatcagaacgcaagcttcatgccgccgcaccaatccaccctcctacggtacagacaaggccagtcaactcccggacacgccatcgccaccgtcccccatcagcgacgcgtcagcactcgacggcggcgcacgcggcccgccggaacccgggcggcaggtcgggcgcgcggctccacctgccgccgccgatgtcgtacaccagcaccagcccttccacagcgccgcccgcggcagcgtggcccctcacggcggccacgttgaccaccgccgccacccggtcggcgcccacgccggccatcgccacgcgcaccgccacgcccagccccacggcgccgcggggcacgggcggcgcctcgagcgccacccacccgcctccgcctctgccgcctccgccgtgccaccgccagaaggagaggtccaccgcgtggctggcaaccacgtagaggtggccgtccccggcgccgcacgcgcccacgacgcagccgccgccgggcaccgcccgcggccgcgcccacgcccgggcgcccgacccca

SEQ ID NO: 16532 - DNA, 1296 bp, Zea mays
ctgcagctttgccgcgagcgaggacggcaagcgaacaagtcagagggagcggagagagaggcacgcgacgcgtcgagcgcacatgactattggagttgggggcagcttcttgtgggcctttttctaaatctaggatagtcctggcccatcatttacttgtttcggtgcgaatttttccaaatcggaaatatagcggcataggatttacgaaacagcggcccaggtattaaacattgggtacctcgaggccggccgggctcttcgctaccccagcccagtcacgtccttcgcagtttgccgtcggccacaccgcatcgagcgccgccgccactcgccctcccctgccatctctcgccggccgccgcctcccgcccaccggccaccgcagcgtgttatatttcagcccctcttgatcggccacccgaaacccgcaggagagaggctaaggaacgatggggtggaaggcggcagagaagctcatcaggcactggaaggtcctgcgtggtgacaacgtgatgatcataagaggcaaagacaagggggagtccgggctcatcaagcgggtcattcggtcgcagaatcgcgtcatcgtcgagggcaagaacttggtcaagaaacacattaagcaaggggaagggcacacaggtggtattttctcggtcgaagccccacttcatgtctcaaatgtccaggtggttgatccagtcactgggaaaccatgtaagattggatacaagtatctggaagatgggaccaaagtcaggtacgctagaggaatgtacgcatcgggcgctgtgataccccggccagaaattctgaaggagagaaggaaaccgaggcccacgtcacctggcccgaaggacacaccaatcgagctggcgcaggagaagacctacgatgaaaaggctgggatcggtatgcccgatctatagctgcggagagttcactgtaatgtgaccaggacctgacgccctgtgctgtgctgtgctgtgcttcccgcgtaataacggtgtactagttaccttcttctgcagaaaatgctttctaggaatgagagcggaaatatttgtaccatttatttaaggtcctgtttggaaacaacccaacagtttttaagacaccagtttttatcttttagctttgagagaccaacttcttgtttttatgaaagtgggaatcaaatttctataaactgagccataaactggtgatatctttagaaccacctcaatttttataaaaaaaaaaaaaaaaaaaaaaaaaaaaaaaaaaaaaaaaaaaaaaaaaaaaaaaaaa

SEQ ID NO: 16533 - DNA, 1537 bp, Zea mays
  misc_feature (9)..(9): n is a, c, g, or t
ggtaccctncgcggccgcggtcgaaactcgaaagggacaaagcagcgagcggcgccgggttccccctcccttcctcgcccctgatctacgccgatcgaaggccgggcggcgatgcttccttgcctgcacctctcggtccaacacacagattagatcagcgtcgaggacgtccgctgctgctccctgtggctgcggttttgcagcataagaaatatagctacacacagctcaatgcttgtcaggatcgatggcagatagggagcatcgaacagtatttgtcacggtggggacgacatgctttgatgctcttgtcatggcggtagattctccagaagtgaagaaggctttattgcaaaaaggttatagtaatcttcttattcagatgggccgaggaacatatgttccattgaaggtctcaggagatgctacccttcaagttgatcatttcacattttcaccaagcatcgctgacaatatgagaacagcttccctagttatcagccatgcaggttcaggaagcatatttgagactctgcgactcggcaaaccactaatcgttgttgtaaatgaagatttgatggacaatcaccagagtgaattagcagaagaattggctgaaaggaagcatctcttctgtgcacgcccacaaacattgggagagaccatccgggcaatggacctagagacactggttccttatgagccaggggatgccaaaccagtcgtcaccctgatcaacagatttcttggctttccagttgattgacgaatctattcggttgttcttcaatccatgtggattagatggtattgcgtcggtttaattccatagcaagtcaaaatacatcctaaacccactcaatccactccaatccatatggaatcatgtctaaacgaacaaggtctactcctagaccttgttcggttatttcaattccatgtggattggagtatattggaatggattgtgatgaattttgatttgctataggtttaaaccgactcaataacactcaatccacatggatcaacagtaaaacaaacaagcccttaatgagtctagttgatataaaatggattaactgacatggaaatagcagaccgttctctttgcaattttcatccattaaggcgttagctttattgcagtggccataagtcctcaacctataaggatgtttatattttcatcaaattatttaaggagtcaattcttctggtggtatgcttttgttcgttgacatgtgaagccggtttaatctcaacatgtactattggttctgttttctttgaaacagctcatggaggtatggtatccatgtgtttgtaggagtaaaaatgcatgaatgtatgcgggtgttttaagtagactatctataaattcctaacattttaagacagcagaacagtcagtttggttccttaagtattgtcccaagcttatttgttttggtcctgaattttctttttcgttcaacttcgttccctcaaatgtctcgctgacgcaatacaacgccggctgtgttgtctatgcctc

SEQ ID NO: 16534 - DNA, 3532 bp, Zea mays
  misc_feature (9)..(9): n is a, c, g, or t
tgtctagtncttttctttggacaagagtcttttgacggtaattttttaccgtgcgctctttgctggatgcaacactcggaaaaactttgttgaatataaaatagactttattgagtgtctcaggcactaagcaaagaaaacgattccagcagtgataacttgtttggaggctaaagttggaacttgttttctcattatttaataaaatgagtggtttcttttggtgaatagataacgcgggtggtttagcggtcttgtcataataatgtgaattatgattggttaagaagattgtgtggttagtcctctgaaaattaaaaggatagtcctaagcacaattggtggaagctaagtgaggtacaacatacgacacacgcactggagttccgtgaacgaagatttattattagaacctgataataatatcccataggtaaatttaaaattgagctgccatgagattttggttttctttatcatcacgggagtgtgagcctttttatgcagctatgtatatatatagtataatataataagagtgatctatagtgctttacagagtccaaaactggataaaaggagtgattttttctggcatggttaacatatacaatgctatgctagtggtttagtttagtggtcttgtcatattattaataataataatgcgatgacatgacatggctgacctgacctaactcctttgaactaggacaatattatgtacagtatttaggattgtttggatgagctaaagctagttactatttaaactaaaaattagcttaggttggctagctagttaactaacaacactatattagaagtaactccaagagactagacaaatcattttgtaaagataaatttggttcttattagaagaaaaacgtctccaatggaccctgtaaatgactctttaaatttagtagctctacattcctacacctctgctctctaatcttgagtagtctgcttcacttgtcatatatacagagctctgaatttacagggtctattggactagtctacttcttttttttatgaaaatttttgtagagattattagcgaaaattagtaaatttggttaatactttttactcatcttagagcaactactctaaggcttgaccgaaaaatagttcatctattaattctttgtttaattaaaatatatcatgactaattttagctagctagatagcaattaactgtcctaaatgaagttgtattgctgtgtcagcgtgcgtgcgacacccgtcgcaactcgcatatgcatacaacaaatccagcacatgcatgatctgaaaatcgcaaagcaaatcaacaaaaccaacggtggtcttgcactgttgtacagtctgcaattcgcagtaaacgagggcgctctggttgtattaattttttaatactgacaaagaatcttgaaaaaaaaaggagcgatgaagcccggcctcgacaacacaaatgcatacacgtattgtttaaatttttttttgaaggaatacacgtacgtacgcattgtttatcagggcacatgtttgtatctgctgcagacttttgtacgcgttagtgtcataccaaggggcatggtggtacgtcttgcattgatcgtcgatgcaagaccgtcagagacggctacacacatctaattaataataaccggataatatatagtttgccgataactaaaaatgcatggtttcgtctctactagtactagcacgtcgtcacgcgagacacaaccgtattcaaacattatctgagaacgtatagaaagaaaggatcatcttttctattgccgattgaaaggtacagcatatgcatgtactacaaggtgatgagatctgtcatcagctgcatggtcgctagaccgaagaacacatatgcatgcatgtattattattattatcaatgcaaattgtaacacacaataataacgtacgcgtgtctgctccgcgcgccgcccctagtgtaaaaatctgcccgtttattgtgatggacggctgccatgcgcctccccgcgtctccagcagccgccacagctgtaggtccggccctctgccgcagtgttctttgtcaccattcattcatgcatttatgcctgtttatttctttgccatgtggttctgcctgcctctggtcctttcaatgcatatatatatacatatagcttttacgtgtgtcctgtgtaattgacatgcgggctccagcctcggtcggctccaccaccagtcagtggctggatacagtgctggtttggtaaacgtatggaatgtgcgagctaccatctttttttattgttattttttggtgacttcaaaatttagcagcggtaatcatttcacatatcatgaccatgcgctcagcccatggaccacgccacgcctgtgcgcttcccgtctatacatacccatgctccctcacgcaccttctcgcaaagaaatagagatgagctagagggggccggggccgggagagccaagggcccgagggagatggagaaagatgtgaagctatttgcttctgagtggaatgttgtctggttcaaggtcttttgctttgtgatccatctgtgtagagcttctaagtattccttggatctgcaagatctcggaccaggcttcattcccctcagaaatagcttcaaaaatgatatcgcggagagttaggagagctactagctagtgtataaatttgttctagtttttttttgaaatatttgtttgagtgttcgtgagattcctggccgttcttagtagtatgcatggtgtggagcaccgtacttccgctcctggatctttactactactccactgtgcttttttgtttgtttgtttgcttgcttgcttgctgcgaaatcgaggagcagcgcaagattggtgtaatgatggcctgccttttgacccctcctttctctgtgcatctctgtgcatctggcaggcatgcagcaggtgatgaaagttcccatcattacctcttgattgggagaatcttcgctttctctctctcggcttcttcttcttcgtgttcattttttttcctcctctccgtcgtctctctttgtttgcagcatatggctttgctggtacggtgctcagattgtttccaagaacatggcattcacaaagctggtgcaaagctttacatctgcatcgatctgatgactatatatatattcttgttttcagatatctgttgcttatttctaagttcgaggatagtttttgcgtggtgcgctggacctgctgcttcaaagtttttggagagcttgggacgagatccactatttataggcgtgtattttcttcatattatgttgacacccatggaggttgatgtaaacaacgggagctcatgcatgcatgtattcctagagccaacaataataacatgatatataacatcgatgtataataaatataatgctccacatcaggtgtgtgtttgttcttctcatcaggcgtttctgatacatgaggtatacctgttgcctattgatgcaaaaaaaaaaaaaaaaaacggcacgag

SEQ ID NO: 16535 - DNA, 5573 bp, Zea mays
gtggcggcttctccttcttgcctgtccatgtgcattcatctcactcagccaggcacagcacaaactgcactagaccttcatttttttagaaaaaaaaagaatggcatataactagagggatgtggtgactggtgctggtgagtgaaattacagaatctttggctcactgcggcccctgctgcttaatttattgacatataaaacactgtttttcgctgtagattgcattgacatagaccagaatctacatgcattttatgttctatgtaattaacgtaattactggttactagtaatgagcagcagcaatagctttgatagatttgcatggtttgactggcccatgacttccctgaatactcacacaagaagatgagattgagatgcacatagacttggttctgtgtggtttgattcatacgcaggcatcgaccgaccggaatcacatagcacatggagtcatggtggatgcttcttgtttctctttcacctcagctgcctttcccttgcctactggactctgggagtagtagtaggagtgtacatctctgtctctctctctctctctctctctctctctctctctctctctctctatctctctctctctgttcctccatttttcaccactctgtttgccaggcagacagcacagcgcattaattcactcgtccctccccagctcccagctcccatgccagcgcagtagatgctgcgagctaccacaccgaatacccacccatgctgcacacgatacgattgcagtcgcggtctcgctgctgtgggagtccctctgctctactgccgtgagagttgagacagcagacagacagcatggtgtggaagagctggggcgctgcgccatcgctgctgctgctgcgcattgctctgctcctcctcggcgctgcggcgccactctgctccggcgccggcgacgtcgccctcagtttcgcagccaccccgcgccgcgtctccaggtccacgtccgccgccttcgccttgcgggtcctgcgcgccaccggagggccttgcgccgactgcgtcgttacctgccaggtaccacgatatacgcccggcattgctgcctgcctgcctgcctcaagcacacacggcgcagatgagcgctcaccatgcatgcatggctgcttccttgttcgtcgccctcctcctggctacttcatctgcagccatccttcttgtcctctcctagcaacgtacggaaccatatgtgctaggtggtgggttgattgaatttgatgcaggaacagcaacactaaggatcggtcggtcgatgcttgcttgtgtttgcatgtcatgtacgtccatgcagttggacggcgaggcagcgtcgctctgcggtgggacggcggcggcgagctatgcggggctcagggacggcaaccacagcttcacggcgtgcgcgagcacgacgtcagcttcgaactcgtcgtccagccccagccccacccccacctgcgccacctacgcttgggatgttggttgagtaacaaacaaaacctggctgcctgcctgccgccttcttctccgctgtgcatgtgacgactgtgaataatgacgcgagctctgcgccgttgcagacactgtccccccgacggcgtccgtgtcggcggggccggcgttcacgagcgcgtcctccaccgtgtcggcgctcgtctccttctccgagccctgccccggccgcggtggattcgtctgcaacgccacctactgcaatgtacgttactgcaccgcgctgaattgtctccgtccgtctgtctgtctgtctgcacgcgcacgcagccaaaatctgtattgtctgcgttgcagctcatcgtgtacggctccggcagtgtggatccgtcgacgctccaggtgctgagccccggcctgcgctactccctggccgtcgccatctcgccggacgccgagtacggccgcctcgtcctcgtcatgggcaggggcttctgcacggacgccgccggacacccgttcaccaggacgcccaactccactttcaccctgcgcttcggtcccccgtgtgcccccctggactgaaacacgtacgacgacgggacggggcatggatcactggtagcaccgcacgtttggtttggtttcagatcgaaggagcgactccatgaacatcaccgccaccgttgccgagaagatggtgcagatacagggcgtcaccaggctggttcaggccagcaacgaggaagagggcctgaggatatacctggccttcgcccagccggtgctcaactcgtcggagcagatcctgcgcgcgcttacagcgactgacgccgtcgccgtgcacctcacacccaccaacagaagcaccctcggcaaccgccgcttcggctacgttgtaactcctctctctctctccatgttcttcgaatcactcactgatcgcgactgctacgacagcttgttttgtttctctgacatatataactactaggtgaagaagatgtctgacgccgccgccattgtgagcgttgcctgcgacacaagctctattatcagcaggcaagggactccggtggttccagcagagccattcacgtttctttatggttagttagtccccctctgtctgctgactagcatttttcagacctactactctcacttgttgagttcttgcttggtagatacacagagaccttgggttaagctcggcacatcgactcggcggaccagctcacgcgacatcctcgtcctcatcaagtttgcaaagcctgtgttcaacttcagctcctcggcagtgcaggtgtctgggggcaatgtgttgaggcaagattatacattatatatatatgatcttaaagcaccttctctagcttattacaaacaccttgggttgtttcagctttcatgaagccagtaagagcatatacacgctgcagatacaggccgtcggtcagctggtatcggttcaggtagctgagaacgcggccatggacgtcgccgggaaccccaacctagcatcagaccgtcttcaagtcaggcactgtatgtatgagcatcttctttgcttcacacattcatacacagacactcgatcgttaggcagggcaggcagcagggcgcttgatgaactagtactactgctgctgcatgcagattctgtgcccgcgtcatcttcttggatcgcggcgatcaccaccgtcgtatttctgacaactgctgccgttgccgcgctcctcaccgtctccacgtcgtctctcgtcgctgccggagctgtctcgaggccctcttcctacatgatctcggagccatcaagaaatgtgctggtacgtagtacatgtacacgccgccgccgtcgatggccgtatactgcccatctggtgactgatcctctgtgagtttctactccatcagaggatggcgtgccacatccaaatctttgctctgtcaagatggctgtcggccaacctgccgatcgagtactacgagttcgcaaagggggtagagtggagcataccctacatgcgtcttccatgggaaggcccagccgcagatccgtacctggggtactccacgatgcctgccatcgcgtactcggagtcggagctgctcgacaggagcgccgtcggcggcgctgcaaacatctcctcctatcgtcctcgagcacagcaaggtcagccggtgacgccagcgcagatcatcccgtcggatccggtattcccgacggagatccctgaagatgggaaacccacaccgccggtgcaaactccgggaggagacgccacgccgccggtgatgccagtgcagaccccgttgccgttggacgggatgccgctgacggcaatggagtaccgttccttcttcgaggtcagacggttactgcttgcgttgcgttgcttttttttttttctgacgaagcctgaatattattattcttataacaaaattgcagaacccggacatgaagcctgaggcacaaatcatcatgaagctacaagatttggatgggtatgtatgttgcactatttgtttctcgatgcttgcttcgcatgaaagttaagtggactgtttgtttctcgttctttacatttacatacaggtggaagtacttcggcaggaacatgttctggctgggtgtcatcggcggcggcctcatcctcctgcacctcctcaccctcctctacttcaagctgaggtacagagacagggagcggcggcggcatggctacgccgcactgcttctccccaggctggagatcatggtcgtcgtcctggcgatgccgtgcgtcgcccaagcggcggcggcgctcatcaggggcgggaccacgtgcggcctggtggtcgggatcgtgctcaccgccgtcctgacgtcggtcctggtggccctgctgctgttcctgtctctgggcatcaccatgggcaagctgctgcaggtcggcggggggccccaccagggggcccaggaggagtaccactggtaccaggatctggcccgccgcacgctgggcgccggcaagcgcgggcagtggacgtggaaggacccgcgccgcgccgcctgcctgcccaggcttggcccgctcttcgaggacctgcgcggcccgcccaagtacacgcgtggcggtggaggcggcaagcgccgcgccgaaggcggcggaccagagcggcgggtcatcgcgtcggaggacgagaacgaggggtcgagggcgcccttggtgcagcagctcctcggcgtgctccgcatctacttgacgctgctggagtcggtgaagcgcgtggcggtgggcatcgtggccggcgcgcacgcgtcgtcggggcggtcgtcccgcgcgcacgccgtggcggtgctgtccgtcgcctcgttccagctcctgttcatgctgctcgggaagcccttcgtcaagaagcgggtgcagctggtggagaccctgtcggtggccagcgaggtggccgtgttcgcggcgtgcctggcgctcatcgacaggacggcatcgagtggcgggtggctgcccgacggcgaggcgcgcggcgtggggctggcgatgctgggcgccttcgtgctggggttcgcggcgcaggtgtgcaacgagtggaacgcgctgtaccggcaggcgcggctgctgagcgccgaccggagctccttcctggacggcgccaagacagcgggcctgggcctgctcgtgctggtgctgccgtcgtctgcgctcggcgaccaccgggatccgccacctcccgacggcggtggaggagccggggagagcgtgtcagcgtcgacggcggccgacgggggcaggggcgggagctccaacaacgagcggtggtggcttgggcagctgtgggagatggcgaaggctagcttcagcaaggagagtaatgcgtaagaatgtgtttggtactgtatctcggaacatgtaacatcagaaatcagcattaaacgattagaatgacagcgctcgagctcaagaaaatgtttctttttttttggtaccgattagggctggaaatggctcggttaaggatggcaatttcatccgtggatttggatatccggcggatatccgacccgacggattaggacatggatatgatttttgacccgcggg

SEQ ID NO: 16536 - DNA, 1213 bp, Zea mays
acaccaatcaccgccgcaacaacaggcatgccgcggcccccgccgccgggccgcgggaccccaggcgcaaggcggccgatccgggacttcttcgccacctggctcgccaccctccgctcaccgctcctcccgctgctccgccgcgcgctctccacctcctcctcgtccggctcctgggacgacccgctctcctccgccgccgcggctgtcgaggctcacttccaggcgcactggtccgcgctcgacgctgccgcacgccaggacccaacgcgggtcatcgccgcgggggactggcggtccccgctcgagctccccttcctgtggcttggggacgtccacccctccctccttacctcgctcctccgcacgctctcgccctcgccgcgactcctcgctgccgtcgaccgcgtcgaccgccggatccgcaccgccgtccctgccgtctccgaccgcctccgccaggcccaggaagcttttgtggccgccgaggcaaccggcgccgccgacgtggaggcgttcttggcgacaccaatcaccgtcgctctcgaagccaaccggctccgtcggggcgtactctcagacctcgtcgccgccgctggggggtaccaggcggcgctgtacctcgaggcgctctcgcgcttcgtgttgtccatgcacgaccccgaggtgctccgccgcttcgaccagtgtcgcgcctcgcctcgtagctagttacccttcttgttctcaaggcatctttgggaagcatgagatgggctagcaagtggctgaggcagtgcgaaacagaacaaaaccaagacgacgagtggccagttgggcgttaggtgctggtgagcgactcgaaaacgttagcagcagcatcctgtgggcagctgcgccctcgtgtatccgacttggactccaattccccccaaggaatcgtgtcgccagcagtcagcagaaaccatgtcgccagcagtgacgcttcagtgttaacccctcttggaattgacgtgctaccaaaagcttttagttggcaatgaataacgaaaggtgatgcatgaaagatgtcgcacgttgggttagcatctgcatgaaattggctgggcaccgaccaattaagattgtagcaccctgttgtatactttttatggagaacaagtttcttgacactgttgacagagatatgctatccaagtcccggcgagacatatgaacaaaaaaaaaaaaaaaa

SEQ ID NO: 16537 - DNA, 803 bp, Zea mays
tcctaatgaaaacttccagatgaagcagaaggcctcaacacagcagcgccaccccctctcatggccctccccgacgacgccattcacctcccccgtgtcgccttcgtcaagtacgcccctccgccttccaccccatggcggagtgctcgattccttcatccgatggcgccacccacctcccctgctctcctccgccgccgcggctgtcgaggctcacttccaggcgcactggtccgcgctcgacgctgccgcacgccaggacccggtgcgggtcatcgccgcggggggctggcggtccccgctcgagctccccttcctgtggcttggggatgtcccctggtgtcgtctctgtcagatggtttaagatgaaagcttcatatatgagtctggtccgccggcctcgcgctcaactccgacaacgccgtcttcgatctcgtcacgaatcaaggtactggagtgtgaaaacctgtgtcgtgcgaatatctaggcttcaccggctacgccctctgctccgacagcaaaactttctcgttccatcaaggaccaaggctaaagcaactgccaagaaagccaaagctatgaagaaatcttaaaggctaccaggaagcgaagcaccttcagctccgtgaacaaaaacttatgctaatatcgtaacagaaccttttaattgcagttgtaacatgagtctgtaattaaacatttgatgaaacaatgaccaaatgttgttgaatgtgtaaatattaataaaaaatgtgtgagcaatactttttccacaaaaaaaaaaaaaaaaaggcgcccaggct

SEQ ID NO: 16538 - DNA, 2706 bp, Zea mays
tgcatgcctgcagactgtttcatctcttccaggcaactcaccagctgagactgagaccggcacaagatggcggctctgaccaggtattagaggcaagccataggtcatccatgatgaatgatcaccttatatgaagctcacatttctcaatggcattccattcttgcacaatcattccagccagccaccatagctccatgtcgtcgtcgacctcacaaatggcgtcgctcgccgtgctcgtcttcctggtggtctgcgcaacgcttgcgtccggcgccgccagcgtccgcgttgggctcacgcgcatccactccgacccggacaccaccgcgccccagttcgtgcgcgacgcgctgcgccgcgacatgcaccggcagcggtcccggtcgttcggccgcgaccgcgaccgcgagctcgcggagtccgacgggcgcaccagcaccacggtgtccgcgcgcacccgcaaggacctgcccaacggcggggagtacctcatgacgctggccatcggcacgccgccgctgccgtacgcggccgtcgccgacacgggcagcgacctcatctggacgcagtgcgcgccctgcggcacccagtgcttcgagcagccggcgccgctgtacaacccagcgagctcgaccacgttcagcgtgctcccgtgcaacagctccctgagcatgtgcgcgggggcgctggcgggggccgcgccgccgcccgggtgcgcctgcatgtactaccagacgtacggcaccgggtggacggcgggcgtgcagggctccgagaccttcaccttcggctcgtccgccgccgaccaggcccgcgtccccggcgtcgccttcggctgcagcaacgccagcagcagcgactggaacgggtcggcggggctggtggggctgggcaggggcagcctgtcgctcgtctcgcagctcggcgccggcaggttctcctactgcctgacgccgttccaggacaccaacagcaccagcaccctcctcctcggcccgtcggcggcgctcaacggcaccggcgtccgctccacgccgttcgtcgctagcccggccagggcgcccatgagcacctactactacctcaacctgacgggcatatccctgggcgcgaaggcgctgcccatctctcccggcgcattctccctgaagcccgacggcacgggcggcctcatcatcgactccggcacgaccatcacctcgctggccaacgcggcgtaccagcaggtccgcgccgcggtaaagtcccagctggtcacgacgctgccaacggtcgacgggtcggactccacggggctcgacctgtgcttcgcgctgccggccccgacgtcggcgccgccggccgtgctgccgagcatgacgctccacttcgacggcgccgacatggtgctccccgcggacagctacatgatctcggggtccggcgtgtggtgcctggccatgcggaaccagacggacggcgcgatgagcacgttcgggaactaccagcagcagaacatgcacatcctctacgacgtccgggaggagacgctgtcgttcgctccggccaagtgcagcactctttgacgatgcgatagttgtacatatgtatatgtgtgcatatataggattcgtgatttttttgtatacagtggattgttaaccgaacacgctaattaattccattatattattgttgactaatgggttcagaattctgtactgaataccgcgaggggggcgtaaaatacaagggcgccataagggtttagacaagtaggcatgaaaccgatgactgaagcagcatacgttgattcaattattgaaaactgagatgtggcttaacaattacaggaacgagacgagacactcgacgtacggggttcaacaagcaaacacgaaatcgatgactgaagaatacataggtcgtctgacaacgacagacgaccaaacgatataaattccctaatctgcaaacctccgaccccgtcttctcttcccttccttttgaaagacaccaaaattaataatcggaatcagcgcagccgatggtttccgaaattaagaaccgatcggtcatgcgcatggaatcacctgatgacggacgagctgagtcagctccttgcgacacaccaaaccctgcgtagtataggctcggacagtacgacgaagtcaaacagcgcatacgtgtacgtggttccaagattgaaggagagcgatcgatggaagagatacatgaaattcacacgctttcgtcgatgatggacaatgcagcaaattattctggagcaaatgacggcatttgctgtcatcttgcagaaccatcctggatgggttggtgagtccccagttctccagaaaattctctgctgatctaagttttaaatgatttattcattgtttatgtatttgactgtttgttggagaaatatgcattttcagttttaatttaatccaaaaaatcacagtgatgtatgtgaccacatgtatgtacatatgtatatcactactcacataatcagtaaacaacaataaaatatgcacaaatacaaaaaaagattgtaccctgcgggggatcgatactcaaggcatcagtgactccattcacacgagacatatcatatgtatgttcgatgtagtcgtacgcagtcgacgcagacagatgtacgcagtgtagtcccacgaacggcgtcggcgacgaggaacttgatcagcactggtcgag

SEQ ID NO: 16539 - DNA, 2269 bp, Zea mays
ctaaacacaccacttcacaagttcgtgtgtgtggagactgaggctgaacttcagctaaacgtcttcggtcactcgtgctggtcgcgcggcgatctacgcctctccgtcctccaaacgaaaccctaacccgcgcatccaacctccatccatcctccgagccccaaactccaaaccctagacccctccccctgccttcgcggccgatgggcgcagatgagcagccatctccgacgcggaaacgcgaccgcgaggaaggggaggacctctccgacgggggcgccgccgagaagcggccgcgcgccgaggtcgcgtccctgctggggctggccacctacgaggacgaggaggaagacgaagcggccaggggtcacacgaatggccgacacgcggtggagcctgagctagaggacgacgaggatgatgatgatgaggacgacgacgtgaggagggctcctgagaggaggcccagacaggtagagctgcgccgggactgcccatacctcgacaccgtgaacagacaggttcttgattttgatttcgagaagttctgttcaatctccttgtcaaatttgaatgtgtatgcgtgcttggtctgtggaaaatatttccaaggaagagggttgaaatctcatgcatatacgcacagccttgaagcaggccatcacgtgttcattaatcttcaaactgagaaggcttactgtcttcctgatggatatgagattaatgatccatcgttagaagatattcgacatgttctgaatccaaggttcactaaggagcaggttctaaatcttgacaaaaataagcagtggtctagagcacttgatggctccaattatctacctggaatggtgggtcttaacaacatcaaggagactgattttgtgaatgtcacaatacagtcattaatgagagttacacctctgagaaatttctttctaatccctgaaaactatcagcatagcaaatcaccattggttcatcgttttggggaattgacacgtaagatttggcatgctaggaacttcaagggccaggttagtccacatgaatttctgcaagcagttatgaaggccagcgacaaaaagtttcagattggtgtacagtcagatccagtggaatttatgacatggctcttaaacacactgcatgcgaaactaaaaagttcaaagaagaaaaacagaagcataatacacgattgttttcagggagaacttgaagttgttaaggaggttcataggaagcatataatggaaaaaagagaggatggcggtgagctgaatggtgaggcaggttcagtggtgggaactgcagatggaattgttactgaaacatccaaggtcccattcctgatgctcggtcttgacctgccacctccacctcttttcaaagacgccatggagaaaaatatcattccacaggtaccattgtttaacatactgaagaagttcgatggtgagacagttacagaggttgtccgaccttccattgcccgaatgaggtaccgagtcactagactgccgaagtatctgatccttcatatgcgaaggtttaccaaaaataacttttttgtcgagaaaaaccctactctagttaattttcctgtgaagaacttggagttgaaggactacattccattacctaagccgaaagagaatcataagctacgttcaaagtatgacctcatagcaaacattgtccatgatggcaaacctggcgagggatgctacagagtatttgtacagcggaaatcagaagaggcctggtatgagatgcaggatctccatgttactgagacccttcctcaaatggttgctctctcagaaacctacatgcaaatatacgagcaacacgaatgagtaatggacagtggtcatcctatggtcagtctgtttgcttaacagagatcagaatatcacaaactaatccttatctttggagcagctttttttggggcagaattttgtagtatcttcacacatgtccagacttaatttcttgacaagcagagatcgagggaatgtacttgggtcatcaagtcaatgctatggaggctgaaacatcgtgaattgtttttagagctgctttgatagaggaacgatttcccacatatttcatgtttgtagtgcagcactgcagcctgtatctgttgtgaaccggtacgcttccaaccgttatcagcaaacttttgaagctcataaagtataattttttatgctaaaaaaaaaaaaaaaaaaaaaaagacgacagcaacggaattcgagctcgg

SEQ ID NO: 16540 - DNA, 995 bp, Zea mays
aaaacttcgcagtcagcatctggactctggagtctgttgtctgcgtgtgtgcggctggttctctctgccaccgcacgagtcgcagcagagagggaaaaaccctagcagcctcccttcgtcccaactcccaaccccgcgaccccatggccgcatctaacggcggcggcggccccggcccgatctccgcagaggcggaggcggcgcttggagaggctatcaagctggtgttcgggcggtggacggcgctgcagatggcggtggagaaccagtggggcggccgcgactcccgcgccaaggccgaccagttgggcgagtccatcctattctggttctgccgcactaagggtccatattatttcgaagacttggttgatatgatgtatgacaaaatttctgaatcttttaatgcctactttgaggataatagtattgaggaggttgctgaacagtttttgatcatacatgaagaatgcctgcaaaacaacttttcgtctatagagaagctaaggaattctcgtgttccggggaatgctgtttctcaaagtagacagatagtgggcgatgacgacgatgacagtgatagctcagatgacggtgatgacacatcgatggtggctgatgaagaggctgggccagaagagatggcagtggacagaccaaggccccccaagcctactccagacgccgatgggtggactgttgtgcctcctaggcgtggtggtcgcagcaagaaatagagtacatggtagctgctggcttttctcgcggaatgtttgttgagtgctgcggttccatattcacttgtatcgctcgatatttgacccgacatggatgttgtgagtgtgtagtatgtttggtttgccaccgcccaccaatttggtgtaaacaaggtaattattatagatgcatcctgtgatcaggttttgagtgttgcaaaaaaaaaaaaaaaaaaaaattaaaaaaaaaaccggaaaaaaaaaaaaaaaaaagcggcc

SEQ ID NO: 16541 - DNA, 685 bp, Zea mays
agcccgccgcgcggcccaatctcgcaggcgacgccgacgcgctccaccggcggcaccgatgcgggcgatctcgacggccgcggggggcatgctgcgcgcgcggctccgctccgcctcccgcgtgcgcggcggcggcggtggcgagggcgcggggcggtggacgacgccggggcacgaggagcggcccaaggggtacctcttcaaccgcccgccgccgccggcgggggagacgcggaagtgggaggactgggagcttccctgttacatcacttccttcctcaccgtcgtcatcctcggcgtcggcctcaacgccaagcccgacctcacgatcgagacctgggcgcacgagaaggcgctggaacgcctcaagcagcaggagctagccgccgtctccggaggcggtgacgccgatgccgatgccgagtgatccgctggtcagatcacccgcaactctagatatattggttttttcttttcttttcttttctttctggttccctgcttgtgtcgcgcggttcaataaggctgtctgtactgagatgcatgtcatgagattccagaaatggatggacatcagactgaacactgtatcattgttgctgtttcgctggataacttacacctcacaatctttgttagtgttgcgccgtggcgaagacgctatacaccctggatggtttgcacc

SEQ ID NO: 16542 - DNA, 847 bp, Zea mays
cattgggtacctcgaggccggccgggcagcccagcccattttcagcgcctccaggctccggccaactcgcagccagtctccacagcgcaacgaacctcgagtcctcgacaagcacccaaatcgacgaattcttcccccctctccgatctcgacgcgcaccgatgcgggcgatgtcgtcggcggttaatggtatgctgcgggcacggctgcgcggggcagcgcgcgttcgcggcggcggcggcgagggggccgggcggtggacgaccccaggtcacgaggagcgccccaaggggtacctcttcaaccggccgccgccgcctccgggggaatctcgcaagtgggaggattgggagctgccctgctacgtgacctccttcctcaccgtcgtcatcctcggcgtcggcctcaacgcgaagcccgaccttacaatcgagacgtgggcgcaccagaaggcgctcgagcgcctccagcagcaggagctcgccgctgccgacacccaggccgagtgatccgcgcgtctcaggtcctctcgaactctcggctgcctctgatttggttccaataagatggccacaatgtgcggtcctgaatgttctggacttctggtattgatggaacacgagctgaacactatgctgctgttttttctgttctgttttgaaatttgcccggtgatgatggcgaatgtcctgaatattctgaatattttgaaatgtttgactgttgtattatcatcttatccttccgttgtactaccgcatgagcacaatttaggattttacttgtttatcacttccgcaaataactctgtcgggaaaggcctaaaaaaaaaagcggcccagcggcc

SEQ ID NO: 16543 - DNA, 695 bp, Zea mays
attgtgttggggctcggcctccagggcccaatctcgcaggcgacgccgacgcgttccaccggcggcaccgatgcgggcgatctcgaccgccgcggggggcatgctgcgcgcgcggctccgctccgcctcccgcgtgcgcggcggcggcggtggcgagggcgcggggcggtggacgacgccggggcacgaggagcggcccaaggggtacctcttcaaccggccgccgccgccggcgggggagacgcggaagtgggaggactgggagctgccctgttacatcacctccttcctcaccgtcgtcatcctcggcgtcggcctcaacgccaagcccgacctcacgatcgagacctgggcgcacgagaaggcgctggaacgcctcaagcagcaggagctagccgccgtctccggaggcggtgacgccgatgccgagtgatccgctggtcagatcacccgcaattctagatatattgtttttttattttctttctggttccctgcttgtgtcgcgcggttcaataaggctgtctgtcagtctgtactgagatgcatgtcatgagattgagagattccagaaatggatggacatcagactgaacactgtatcattgttgctatttcgctggataacttacacttcacaatccttgtaattgttgcgtgatggctaaccacgctatacaccctggatggtttgc

SEQ ID NO: 16544 - DNA, 965 bp, Zea mays
ccaaatttatatatggctaggatcataaattgattatgaaatattttctcataacagtataacacacattttgtatataagttatcgtaatatactgatattatatattctcgttgcaacgcacgggcattcagctagtttttgatgaaaactctaagtctgaaaacgcaattggtagcccgtttcgtatcagcctacttcggcccgccccccggcgccgccccgcatcttgaagctccaagtgcatcccggcccagtccagtccagcctttcctctcctgccccgtctcccgttcccacagcacagcctccatctcccaatctcgcaggcgacgccgacgcgttccaccggcggcaccgatgcgggcgatctcgacggccgcggggggcatgctgcgcgcgcggctccgctcctcgtcccgcgtgcgcggcggcggcgatggcgcggggcgatggacgacgccggggcacgaggaaaggcccaaggggtacctcttcaaccgcccgccgccgccgccgggggagacgcggaagtgggaggactgggagctgccctgttacatcacctccttcctcaccgtcgtcatcctcggcgtcggcctcaacgccaagcccgacctcacgatcgagacctgggcgcacgagaaggcgctggaacgcctcaagcagcaggagctagccgccgtctccggaggcggtgacgccgatgccgacgccgagtgatccgctggtcagatcacccgcaactctagagatattgttttttcttttcttttctttctggtttcctgcttgtgtcgcgcggttcaataaggctgtctgtactgagatgcatgtcatgagattccagaaatggatggacatcagactgaacactgtatcattgttgctgtttcgctggataacttacacttcacaaaccttgtaattgtttgcacctgtgttgttgcttattgcactgaaat

SEQ ID NO: 16545 - DNA, 5492 bp, Zea mays
  misc_feature (4224)..(4224): n is a, c, g, or t
tctcactcttttttatctagttttgtactaacttttaatttgtgtgccaagtttgtgtttaagttgtgaatttcaggtatcacatattcaccgcttctaggtgactatcaacaatactgttttgttatttcagtgtttttgattcagtaatagtagtttttttgaatgtctggtcgttcgattacaaggatatttatacccgccaccatatcacgcatactcacgcttacacacctcaaatctctcaaatactccattccacgctgctatagttggtgttaggcttgatcagccgctgaccatgtcttttttctgtttccacgcttgagcggtcactgcagtactgcacttggagcttggagatggagaaaaccggtcatcttgggtcccattggtgattggccactccgaccatttccaccaacggtctggacgggtggactgaccacaagtcgccgactcgccatccgcgtcaacaccactgcaaccaccaccgccgtgtgggaggcccaaaccacgcgcctttccccactgcaccaggcaacccaccagcaggccgcagttcacgcttggctgacgaccgacccccattcgttctagccctccctccgacactccgatccattactcgctatggacgcggcgggcggcgaccagctaagcctggccgcggtgcgcgacgcgctggtgcggctggaggactccgtggtgttcgcgctcatcgagcgcgcccggcatccgcggaacgcgccagcctacgcgcccgccgccaccgctggagaacattcgctcgtggagttcttcgtccgggaagcagaggccctcaacgcaaaggcaagcctcttcctttttcgtgcttttcttgttcgtccctcagtttcctctgttattaagacttgtattgccttgcctggatgaggaactacgcggatggggccaaaccactgcgctctcaagttcttggtcgggcagaacctatcgtttgttattgtaaacgtggtcagcttacctatgattcaaggtggcaagatttttaaacgcctagacacccccgttggttgtgtttggacttcagctgaaacgtagaggctacagttatcgccattgcagattacctatttttgtctggtgaaatgctcaacttaggtttgatctaaaaaaaatttggtcggagagagaaagaccgtcctcctgatattatatttaaaaatagatcgaaacatgattacggtcgagaaaattctcgaaccgtggccccatccactctgcaacgaccaaccgaagggtgggcgggtgaggcacaacaaagggatttttttaaccaagtcagaaatttgccctcgagggggatcgagaagacaggacctagaggtgggtactcggaagcattaaccattacgctagatgcccttaagcacttaggtttgatctaactagtaaagtaaaccagctgtaaaacttcagtacgaaataagtgcttcttcttttaggttcacattatatgcaatcactccttgatgaaacccagatcttaccggggtagagatggatttggttctttgagcacccttgacacttctctacatggctttccactgtgttgatttgaagaactgaatcctatctctatttgttcgtttcaaattcacttggcacgaaaaaaataaaatgtacttcttgttatttatctaactgagtaactaatatgatcaatcattgtttactgatatttcactggacaaggagaatgccaaaacatttatttaagtggttaagaatgttcttacccaagccaaatatcacagagggtttagaggctactggtggtattgctgcacatatactgcagcaataacattctgtgatatcttcttcgcaatctgaatacatgtgtgaatttttgtatactgcaatagttaacactcttgtgcaatctctcaatacaaatgtgagttcttgtaggctggacattatcaaaagccagaagatgttccattcttccctcaagatctaccctcacctctctttcctacaaagccttccccaaaggtgcacatcatcaggcattaaccttgcaatatcaagaactgatgatatgataattgctgagatgctgaacttctattgctttttattaggtcttgcacccttttgcttcattggtcaccgtgaatgatgcaatatggaaaatgtattttgatgaattgctcccgttattcactgttgatggtgatgatggcagctatgcacaaacagttgcactggatttagcgtgtctgcaggtatgagtttatgttaaaatttctttaactacaggaataaatgcaaattgccagccttttaattggaaattgacaattgctgtatgcctgtaacatacaaggtttgtctcttgtaggttctatcacaaagaattcatattggtaaatatgttgctgaggtgaagttcaaagacgctcctcaagaatatagtcgactaataaaagaaaaggtcaatctactgaatatctcaatctcttcctcaaattaccttaaatttacaggcttggtaagttcggtagtattatgtatagcaatacaagaaatgtttggtgttcccaaaggctacacattggtgcaccttgatagttggaattcaactaagaaatcagcttagggcttgcttggatctgctagcacttaaagttagctagctaatagcggctattttttagctagctaagttttagcaggaggctgtttggatccacctgctaataggtggttggacagtgatttgaaagtgtaacatgaactattggcacctattagcaactccaaacctgctaatggaactaatacttagcagcccttcagctaataattagcagatttattagcaggactgtttggatctactagtactaactttagctgctaccttttagtgctaatggatctaaggtactaaggtactaactttagccctaatttccttcaaatgaatagcattgtatttgcatgttataaatataagtatatgctactaaggtattctatcacattaccacgtctttagactgctttgaatgtgctttagacatgaggctcaagaacacagaccaactatgctttcatctgactgtcaatgcagggtcgactaataaaagaaaaggacaccgattctctgatggatatgctgacattcaaggctgtggaagagaaggtcaagaagagagtagagaagaaggctaggacgttcgggcagaacgtcaccttggatgacaatgccactgctggtgacagcgagtgcaaggtcgatcccaaagtgctctccaagctgtatgatcagtgggtgatgccactgaccaaggatgtcgaagtcgagtatctcctgcgccgcctcgactgatcagtgatcacccgattagctgtagctgcgaactttatgtacgcgtgggtttcagtttgctttgcacatgccctttatggctttatcgttcaaactcaactacgagagaacgttaccaggatctggccttcgtctttgtcagcctgcttgcccgtcatctgcatgagtagtccaactgtaagtgacgcttggtatggaatgtaagaaaagtaatacaactggttacatgttatctttaatctcctgttgttcgtctgtaagtgactggcaacacagtagggtaccaattctctggttcagaaacgtattatgtttcttgcttacgtgacaaataccaaacaaaatagttacagctttgacatgcgtgttatcaataatttggttgactcctgtgctgatcagttaactagtcaataaattgggggaagtgggaaatactgtcaggctgaaaaactgcagagcaggtcccgatgtcgaactgtgcaagacattatttaggtacacccatatgatttacgctttagttttacgtcatcaaatgtcatggatgtttgtccattgtttgctacatgattaagttagcttccgcttgccttagttaaatggatacattatattaaaaaatagtataacaaagttccagcctctgtcatacgtagatggtacataaatggtagtcaaaatataaagtgcaggaaaaatggacctatgggccattatgttattattttgatatttgacgaacaacaagatcatttgaccagtgttttctctgagtcttttaggccctggtacaaaatataaaaatgggccctatgacctatacaaaattnggcttcacaaactttagaatatgacaaggcctatattttgttagagataaaatcttagaagaacattaactctatatgcaagtctttaccatccatattagaatattggccactcttaagtgtcatctcaagttaattaaaagaagacaatctaaaaagcatagcttatgaagtaaaaaaactcaaatatttttttatacatttaatattgtttaaaccttttagtcaatgaagttatagcttaatcagcaacgaataaaaaatatttttaaattttataaccaaaatttaggggccacgtgtcgtcgctccccttgcgctgcccaggggatatgtctgcatttgagctaatgccatttgctaatataaaaggtatagttcaaatgaatacaatgtggactcagacttaaacaaagtgatggtgttaatgatcaacacctctagcaagacattagaagccatatttgaagcatcgtgtcaccttcatgatattaaccccgcacaataggtgatcaaggtcgcttgtgatgtgattcgtgacaaggtatcgttgtaccaattaggattcaaattgtaggagtacgtagacattaaggctatcgaaggttcattctagtatgaatcgtttatccgataccatcacttgatggtggtgtggttaagcttgccatagatctgacactgaggatgagggtcattgtcacgatgatcaccacgggagggagcactgccacgggagtgaccaccatgaccatggccatgagaggggccatcgtgaccaaagtagttggcagaggcactatgttgtagctacagtctggccacatattgaagttggtaagcctcaaacacaactaggtgtacaagcacgttgttgagggaggatgatttagtcttggttgtcatggaggtgacaaataagtcatagtcggctaggagcccaaccaatagaggtgaggacctcatcacatagagcagggtcggctctggccataggccacaggggctagagcctagggcccattaaattaggggccaaaaatatgtatatatagtaatagatcggtatcgcgtcgcttcatcatcatccatccatccatcgcctattcttcgcctccttctgtgaagagtgcctattcgtctccttctgcgaagagtcgacggcaacatgcttgacagctactgcgtgcggtgcggcgcacccctttgttgattgacgtcatggccaagggctgattgagtgaagccgtgaaggacctactgtaggc

SEQ ID NO: 16546 - DNA, 1243 bp, Zea mays
ccgccacaagtcaccgactcgccatccgcgtcaacaccactgcaaccaccaccgccgtgtgggaggcccaaaccacgcgcctttccccactgcaccaggcaacccaccagcaggccgcagttcacgcttggctgacgaccgacccccattcgttctagccctccctccgacactccgatccattactcgctatggacgcggcgggcggcgaccagctaagcctggccgcggtgcgcgacgcgctggtgcggctggaggactccgtggtgttcgcgctcatcgagcgcgcccggcatccgcggaacgcgccagcctacgcgcccgccgccaccgctggagaacattcgctcgtggagttcttcgtccgggaagcagaggccctcaacgcaaaggctggacattatcaaaagccagaagatgttccattcttccctcaagatctaccctcacctctctttcctacaaagccttccccaaaggtcttgcacccttttgcttcattggtcaccgtgaatgatgcaatatggaaaatgtattttgatgaattgctcccgttattcactgttgatggtgatgatggcagctatgcacaaacagttgcactggatttagcgtgtctgcaggttctatcacaaagaattcatattggtaaatatgttgctgaggtgaagttcaaagacgctcctcaagaatatagtcgactaataaaagaaaaggacagcaattctctgatggatatgctgacattcaaggctgtggaagagaaggtcaagaagagagtagagaagaaggctaggacgttcgggcagaacgtcaccttggatgacaatgccactgctggtgacagcgagtgcaaggtcgatcccaaagtgctctccaagctgtatgatcagtgggtgatgccactgaccaaggatgtcgaagtcgagtatctcctgcgccgcctcgactgatcagtgatcacccgattagctgtagctgcgaactttatgtacgcgtgggtttcagtttgctttgcacatgccctttatggctttatcgttcaaactcaactacgagagaacgttaccaggatctggccttcgtctttgtcagcctgcttgcccgtcatctgcatgagtagtccaactgtaagtgacgcttggtatggaatgtaagaaaagtaatacaactggttacatgttatctttaagctcctgttgttcgtctgtgaaagcggccaaaaaaaaaaaaaaaaaaaaaa

SEQ ID NO: 16547 - DNA, 1656 bp, Zea mays
gccggccgggctgcggaatgattcccctgccaaatcgaaaaaatctccctgctaggctaggcaccaagccaagcaaatccactcgagaccagaccggcgacggcggccccgcgtccgtcgccatcaaagccaccgctgcggtcgctcctccgggacccctcctcctccgcggaccaccgccagcgctcgacagcaacacgcgcacgcccacgcgcgaagagtcaacaggagagagactggcggtggtggcactggcagtagaataagcttgcgtcgagtgggagttggcgaggcatcgctcgcttcccctccaccccactctgcccaccgagcgccagtggagcgcttacttgacttgacctcgccgcctcctgccctccccctcccctccccctgccggcgcccgttctttcctttcctcgctggacgcccaccgccggagcggaagaggggggaatgcagccgccgcagcaatacccgccggcgcccggctcctggggcggggtcgcgggggccagggccggcgccaccaccgtggatgaggcgtccatggaacgcagcaagagcttcatcaaggccctgcaggagctcaagaacctgcgcccgcagctctacaccgcctccgagtactgcgagaagtcctacctccacagcgagcagaagcagaaggtgctggacaacctgaaagactatgccttacgagccgtcgtcaacgcggttgatcatctgggtactgttgcgtacaaactgaccgatcttttcgagcagcaagcttccgaggtgtcgacatatgaactgaaagtcgcacgcctgaaccagcaaatcttcacatgccaagtctacacagacaaagaaggcctcaggcagcagcagatgatgggagcaaacatcaagcaccacaagcactacatcttaccccccactggttataaaagatccctggcaaatggacacctgcaagcggacactgatcaggaatccaagcctagaccttacccctccgcaaaaaccctttcctggcatctgtcttcggagaacagcaccaaagcaaacgcacataagcctacatttgccctagtggacacggcaccatcaaaaccttcatcaggtaaggagcggtctgcttctcctatgcgcaggccgctgcagttcaacaggagcaccagttctgatactacgcagaaggttggcgctaagaacatatctggtgtaaaggaactttcaacattccattccttcgacaaccccaaaggtcgtgcgatccaaaaggcccctgttggcactaaaagcatgctggcggctctcttcatcagacacaaatcgtccaaggcgaaaaggatcgcagttcgctgacgagcgggggggtgggtggccgacagcactgtaaatttcattccgtggaggaccggaagcctgttaattgtacatctggcctatcgttatgtgttggggcagagtctgtagccgtatttcatttcagaatatgacatcttgcaggtgaccgaaatgtaatgatttcgcataagctcatcttcgtcgtgtaattctgccttggcattcggcataaataaatgcatcttagaaatagcctttcagagttgttttccaaaaaaaaaaaaaaaaacggacgcgtggcccctaaggccggcgcccgct

SEQ ID NO: 16548 - DNA, 1137 bp, Zea mays
  misc_feature (1091)..(1091): n is a, c, g, or t
  misc_feature (1116)..(1116): n is a, c, g, or t
  misc_feature (1124)..(1125): n is a, c, g, or t
  misc_feature (1127)..(1128): n is a, c, g, or t
  misc_feature (1130)..(1131): n is a, c, g, or t
  misc_feature (1134)..(1134): n is a, c, g, or t
aaggaatatattatcaaaccaatcttcttctcttgcaatgactctcaagcgcctagggctgctaccctagaaccaagcctacggcagaggggtaataacctcgccggagaagacagctatcctaatggaccgaaggtccatgacataaactcagcaagactgcacacttacagattattaaggatcttcttcacggcaatctcggtcccatttaccagacgacccttgtagacaactccatagccaccctccccaagaacattactctttgcaaaccgattcgttgcacactccaggtccctcaaggtaaaccagtggccccagcctagatgtgataactcaggcaggccaaccagcggtgatgctgaatatgcatatggtgagctacctttcctagctggaccagagctgctgtgactgtaatcttcagagtatgagctcccacccttctctacgttgtacactgagctgaactggctgaaggtatcggcgtcgacggatctactctctcccaactgccctgcacctttggtctgcgtatacttatcccgcactggcatgaagggcgcttcactgtcatgtagactctgagcaccaactctgtcaacattgatttccttagaaacgatagggatctcagccagcgaactgttgtcaaaccctttcactgtcttctttttcctctggagcgaaaggcaaagcgcaatgacgagcaggatcgccatgactatcccgacagcaatggcaatcagttgccatactctcaactgaaacacgggggtcgtttctgacagtgccgcgctgacagaattgttaggcgatgacattgtccttcggcctgtctgatgagcaaactatgcggtaggttcccctaattcagaatcttgtcctgatttgacaagcaatttacaaacttatcccgaccgctttatctgaacgagaggcggagcacagcaagaggaaatgaccttggcagcacctcgcatcaaaccccactgaaggagaactcaatgaggagctttgtcctcgacccctcagttagaacaggagaagggggggggggggggggtattgtgagctctctctccccntgcagccggggggatccattagttntagagcgnncnncnncgnggg

SEQ ID NO: 16549 - DNA, 2598 bp, Zea mays
atttcgggtcacttgttcctgggattgagaaggctttgaatgacaagtcttctaccgcccccctgcggggtcccgcccgggtattaacaaggacttgttatggtcttcacattcaccatctgtgtttcatccatacatcaaggctctttctgcacctatactgtctgctatcagagatagatattataaagtcactgctgaggctttgcgggtgtgtggagagctagtccgtgtccttcgtccaaatctcgagacaacctcagttgattttaagccatacattggtccaatctataatgcaatactgggacgtttggccaatcaagatcaggatcaggaggtaaaagaatgcgccatatcttgcatgagtttggtggtctctacttttggtgatggtcttgaaagagaattaccagcatgccttcccatactcgttgacaggatgggtaatgaaattacaagacttacagctgtcaaggcattttcagttattgcgaattcacctctacgtattgatctctcgtgtgtcctggatcatgttgtttctgagctcacagctttccttcgcaaggccaacagagctcttaggcaggcgacgttgggaactctaaattctttggttgtcacatatggtggtcagattggctcttcttcgtatgagacaataatcgcggaactttcaaccctcataagtgacatggatttgcatatgaccgctcttgcattggaactttgttgcacaataatggttgacagaaaatctattcaaaacgttggtttagctgttagagataaagttttgcctcaggcccttgttttgatcaggagtgccctgttgcaagggcaggcactgcaggctcttcagaggttttttgcatcacttgttcaatctgcaaatactagctttgatgctttgttggagtcccttatttctgctgctaagccatcacattcaggtagtcttgctaagcaagcactgtcttctattgctaagtgtgttgctgttctatgcttagcagctggtgaccagaagtgtgcatctacaattgaaatgcttaaaggcattttgaaagacgacagcactactaactctgctaaacaacacatggccttattatgtctgggagaaattgggaggaggaaggacctcagcaatcatgttcaaattgagaacatcgtcattgaatcgtttcaatcaccttttgaggagattaagtccgcagcatcctatgcacttggaaacattgctgttggcaacctctccaagtatttaccatttattttggatcagattgacaatcaacagaagaagcaatatctgttgctccattcacttaaagaggtaatcgtgcgacaatctgttgatcatactggccagagtgagctacaggattcaaacattgagaagatattggcattgctcttcaatcactgtgaaagtgaggaggagggagttcggaatgttgttgcagagtgtttaggaaaaatttctctaattgaaccaaaaaaactagtccctgctttggaggtacgcacgtctagcccagcagcaaatacaagagctacggttgctattgctataaaatattcaattgttgaacgacctgagaaaatagatgaaatcatgtactccaagatatctactttcttgatgttgattaaagacagcgataggcatgtgagaagagcagcagttctggctttgagcacagcagcgcacaacaagccaaatttgattaaaggtcttcttccagagatattacctcttctatacgaccaaactgttattaagcaagagttaatcaggacagttgatcttgggcctttcaaacatgttgtagatgatggtcttgaactcaggaaagctgcctttgaatgtgtggatactttattggacagttgtcttgatcaagtgaatccatcgtccttcattgtacctttcctcttgtctggtttaggtgaccattacgacgtgaaaatgccttgccatttgattctatcaaagctagcagacaagtgcccttccgccgtccttgctgtcctggactccatagttgaaccaatcgagaaaactataagccacaaacccaagggggatgcagtgaagcaggaggttgatcggaacgaggacatgatccgcagcgctctcagggcaatatcttctctaagccgcataagcggcagcgactacagcatacggttcaagaatctgatgaacaagataacggccacccccgcgctcgccgagaagtacaactcggtgcgcggcgaatgagacctgggttcttgtacatggtagaggaataggttaaacacccagagttgtcgcgcgctcgtcaatcctgttgccgcttccccgcatggttgctgaggcaaaagtctgtactctgatgatgacggtggttgatttttgactgctggacatagttgtcttgtacaaaatctggtggtaaattcagtagaattgccgccgatacatttacctggtggttctcttgtcgcagttcagtttcagttgacctatgaagcgctgatgcagatcagactattctggcaatatgttctcttttcaaaactacgagggggggcccggtaccc

SEQ ID NO: 16550 - DNA, 1405 bp, Zea mays
cattgggtacctcgaggccggccgggatctccacctatcaccttcgattcctcctaaccaggccggtccacctgcaaccgtgacggttcttgttcttcttcccacccagccgcgctccctcttcctcttccccttctctctcggcgacgactgggtggccgtagctgcctccatacgcctggtgccctggtcttcttcgggccattcgccggccgcgagcaccaccaagtacgcccacctcatgaagggagagcttcccaggtagagaaacagtttctccgtactctagcagatggcaaggataaagcctaagcaattgctaatccaaagcaaaacaaagaaggctccatctcgaatcagctactctactatcatcacatggaacttgattgtcatattggttgtgctatctctctatgctacctacagccattggcatcaaaggtctacccaagacttcgaaatggagcttcatgaagctgagcttgctgtgagaccggaggatccaaaaatgataagtagaccaagatatgcggtaatgaacaccgcaaaaggcccaattactatagaaatatacaaagatgcttctgctgacgttgtggatagatttatcaacttgtgcaagagtaatcatttcaaaggaatgccatttcggcatatcataaaaaattttgtaattcaaggaggtgattttgatttcgatggagcttcccaagaatggataaccaaagctaaagctagtggaaaaaatgatctcagtccaaaacatgaggcatttatgattgggactgcaaagaatcctaataacaaaggatttgatttgtttatcacgacggctccaattcctgacttgaatgacaagcttgttgtatttgggcgagttatcaagggagaggacatcgttcaggagattgaagaagtcgacactgatgagcattaccagccaaaggccgccataggcatcatcgatatcgtgctaaaacaggagccttgagcctggatgcacatgatgacgttaaccacatgccgacggacttttctgtagttggaaaatctatctcatcgagttggtttttgttctggtgccttattatgtgttgttgcgtggaaagcagttgtgacgcttgttccaggagtcgttgcagcagcgtttgtgtataaaatatattcacagggtttttggctgtcagcatgcgcgagcatatgctgctacaccttgtatcgtggttgtggtaacagtaagcaggctattctctgctattgctaccagtaatcggtttgggccttacgatttgcgaatgaatccaataaaatcagcgcacgtgcttctggtcgttgaaaaaaaaaaaaaaaaaacgcgagggggggcccggtaacggccccgagcccagctgtgttcccttag

SEQ ID NO: 16551 - DNA, 1370 bp, Zea mays
cctatcaccttcgattcctcctaaccaggccggtccacctgcaaccgtgacggttcttgttcttcttcccacccagcgtgcgctccctcttcctcttccccttctctctcggcgacgactgggtggccgtagctgcctccatacgcctggtgccctggtcttcttcgggccattcgccggccgcgagcaccaccaaaagggagagcttcccaggtagagaaacagtttctccgtactctagcagatggcaaggataaagcctaagcaattgctaatccaaagcaaaacaaagaaggctccatctcgaatcagctactctactatcatcacatggaacttgattgtcatattggttgtgctatctctctatgctacctacagccattggcatcaaaggtctacccaagacttcgaaatggagcttcatgaagctgagcttgctgtgagaccggaggatccaaaaatgataagtagaccaagatatgcggtaatgaacaccgcaaaaggcccaattactatagaaatatacaaagatgcttctgctgacgttgtggatagatttatcaacttgtgcaagagtaatcatttcaaaggaatgccatttcggcatatcataaaaaattttgtaattcaaggaggtgattttgatttcgatggagcttcccaagaatggataaccaaagctaaagctagtggaaaaaatgatctcagtccaaaacatgaggcatttatgattgggactgcaaagaatcctaataacaaaggatttgatttgtttatcacgacggctccaattcctgacttgaatgacaagcttgttgtatttgggcgagttatcaagggagaggacgtcgttcaggagattgaagaagtcgacactgatgagcatttccagccaaaggccgccataggcatcatcgatatcgtgctaaaacaggagccttgagcctggatgcacatgatgacgttaaccacatgccgacggacttttctgtagttggaaaatctatctcatcgagttggtttttgttctggtgccttattatgtgttgttgcgtgggaagcagttgtgacgcttgttccaggagtcgttgcagcagcgtttgtgtataaaatatattcacagggtttttggctgtcagcatgcgcgagcatatgctgctaccccttgtatcgtggttgtggtaacagtaagcaggctattctctgctattgctaccagtaatcggtttgggccttacgatttgcgaatgatcccattaaatccgcccccgtgcttttggtaaaaaaaaaaaaaaaaaaaaaaaaaaaaaaaaaaaaaaaaaaaaaaaaataaaaaaatacgaaaaaaaaaaaaaaaaaaagcggcc

SEQ ID NO: 16552 - DNA, 576 bp, Zea mays
ccggccgggccgggatttcacctggacggggtcgacgagggatcaagaagcctcgtggcctaggccagtggcccgcattgcacatggtgggtgcgctggcttaccatctccccaagtgggagagtggacgtcataatttgtggtagagggggtacgcgttcgcgcggcccctgccaaatcttataaattttatttaagtcccctttagagatagagaagggcttgaaatgtaatctttgttattagtccccttcagtgaaaggcttgaaatggtaactttgtttcgcccgattttataaattataatttaatttacatgtcttctaaaaaaggattgcggaagtactcctggactgcttgaaagtatatctttgtgaggaagatgatgaagatgatttgttccaaagtagtcctcgcttacgtaacaattattattgtaattacaatgctgattattcaaaaaaaatgttgcagtatcaaatattgtgtaagtttataacttggataaaaaaatcacagaacagaaccaaaaactgactacaggcccctagggccaaaaaaaaggcccctagggcc

SEQ ID NO: 16553 - DNA, 1779 bp, Zea mays
  misc_feature (264)..(264): n is a, c, g, or t
gttccaaaatacatgtgacactgatctcccgactgaaacttggcttttcctttctgaaaaggtttcagctagcattcgccctactaattccagtcatgtggtatgttcttgtatacaacaagcaaacaaaagttgaggaaaatctgttgcatttcttttccggggctaaacttagcgaggcagggaggccgctcgtccgtttctccctgaaaaccagggccaccatccacaaattggcaagagcacgtcggtggtgcctccgtngacgttagctgttcagccttgctgaccaaccgctccttaaatcgcctgttaatgcccccaattaattcccaacgccgctcctgccatcaccttcttcgatcgatcgccttcgtcgtccccccacatccttcttgattgttatttctccaactcccaggccggcaggtcggaggacatgagcaaccagccaaccatggcggcggcccccgtgcgcgcttgggtgctggtgctggcgctggcgctggcgtgcgggctgctccagctccggccgtccgacgccgcggcgccagcccagccggttgcggtggcggcaacgatggtgtcgtcgggcgccgcgaagcccaagtgcgtgcccggcgccaagaacgacaaggcgtgccgcgtcggtgccgtgcacgacccggagaaccaggaggaggagggctccagcgtcaccctcaaggcgcccgccgccgcgcccgacgacagcgacggcagcgactacaacgaccccgacgagcccaacgacaaccagctcatcgtcgtcggccactgaagctgccgcgcgccgacccatggatcatgcatggagattcgactgggtggatggagtggaccggccggttaacggatctctcggtgctaattcgtgatcttgaccggtggaagcagatggggtttgcatgtttgtttcattcttgcattgattgttcgttgttaactagtgtatgatgaatcggtcgttaacgcttattaatcacaaaaaaaaaaaaaaatttgcggccttgccagggagcgatcctatctcaagattaggtttgatcaaatttaaaacaacgaacatcaacggttgttacattttattagcttgcaaacgtgcaagtttcaatatcttataaaacctcccaaatttgaatggtttttaaaatgtgtttcgaaaaaaaaaactatagtcaaatgtactcatccgagaccgtgtaaagccaaatttgtcaagtaacgtaatcactcgaatgccgttgtgtgttcaaattagacggatattgtacgatgcaataatagacgtcaaaaatggcattgcctcccgtagaacgggtctgtgttcattagtttgatgctactataaacacttcatctgtcctaaattaaaattcgttttaagcttttaattgattcatacaataattgatatatttgttttgtatgtgtagattcatcatcatctatttaaatataacataaaacccaagaactaaaacaaatgctaatttagaacgttcggagcagttcggataaaggggctttctagtttgaaaatttcttttcccaacaagtttcatttaaaagttagaattgatacatatagtacaacttcgtagagtcacatgatttggaaagttattacctatcatacatccttgaatgctgaagaatcttcgccttggggtggatcagctctagtggcggtgtcaaatttttcattatacctacaatacagtaaaaatccatttagaaattcaataaaaaatatcccac

SEQ ID NO: 16554 - DNA, 4233 bp, Zea mays
gacgattgcgtcgtgttgggttgggtttaggcggccttttactagcttgcgccaccgcccaccgctcggaatgaatacaagtgagccgtgtatagacacactttcacttgtcctcaaagcaaagaacagggagcataaaagggcacagccaaaggggaggcatccctagctcatgcccccacgtcctttcaccattgctgcgtcacaaagctaaggcccggcgggtatggatggtaagcgattcaaaattattaaagcgcggacagagaaagtggacagaaacgaaaaggcagggtatcagatcagcgcatgagagcatcgcgctgccgtggtgtgatatccagcatctgacgtagcctagctaggggtgttttgttcatggtcccgccgcacgccgggtcggcgacgtgtcttcctcatcagctgaccgcctgaccccttgtctccatcgccctgagtgccatatatagcctagctcgtgcccccctcggcttgtcgtcccactgcactcccaccgcccaagctttactacgtgatcgatccgatccgccgcggcgcgtaggaaaccatcctccccccgcgcctcgtgccatggccgtgcacgcgcagtaccacgcccacgccttcccacatgacctccgcgccatccccaggttcgtctcgtcgtcctgactcctgaatccgctcctcctattaatcttctccttctatctatattaatccgtccgccatcgctgaaaccaccgcaacgtcgccgctgcgcccatcgtcacccgcgtgctcgccttgttccgcagctgcccagcgctggacaacgccacgagcgcgtcggcgttcctcgtcgccgacgccgaccccgcacccgcggctggcggcaacacggcgctcagcggcctcacccgcaacggcaacagccacggcagaggttgcctcggcggcgcaaggaagcgcgcgcgtgtgactatggacctgcaactgcaaggccagcgcgctctgctgcccccggtgccgcaggcgttggcgtccgcggggggcgtgcagagcagggcgctctgctctggctccgcgtccaccagccagcgaccggctagcgccgcgccagtgtcgcagggcctcctcccgcacatctaccgccacagcgtcgagatcgacctgcttctccgcgtcgaggtcggatccttgaccctttttttttgtcgggggaacgcttgtcgatgctccttgttcggaggtctaacaattgattggtctgtgcggcgcagactgagcggctgcaggcagggctccaggacgcgcggcgccggcacgcccgcgccgtgctgtccgcggtgggacgcggcgcggcgcggcgcctgagggcggcggaggccgggctggagcgcgcgctggcgcgcaacgcggagctcgacgacaggctccggcagacggtggccgaggggcaggcgtggcagggcgtcgccgcggggctacgcgccacgctcgacagcctcacgcaggcgcaggcgccatgcgctggcgagggcgacgtcgaggacgcgcagtcgtgctgcttcgacctggtggagcaggaacagggagccgacgaggcgtccggcgggcggacgagggcgtgcaggtcgtgcggcgacgcggaggcgtgcgtgctgctgctgccgtgccggcacctgtgcctgtgccgcgggtgcgaggcggcggctggcgaggcgtgccccgtgtgcgcggccaccaagaacggctcgctccacgtcctcctctcctgattcattcatccatggcccgtgccaccgcgttcgcttcgaattgaaggaggcatcacgaaacgagaaccaagtggaagaggtggtggaggacatccatgggcccgatagaaatgacgcgcgaaaatcattctgctgaccgccctgctggaggttactgtgcaattgtttgggagatctaatgcttacacttcacagacagagagccacgatgaggcgctcaagcagaccaggaagggcacatgaagcgcgcgcgcaatggatgtgagcttgatctttacgagtacaattttgttcctgagcttatgagatggcaccgaccgtcggtgacaacatcatatacacccgtctgtgctgccgtgaggcgtaagctgagcagatgcagatcgactgaccaactgtcggtgaccgcgagggatacacgacacacccgtgctggcgctgcgaccaccgtgatgggctgatggccacttctgccggtaccatgcgcctacacatgtgcggtgcagtgcaggccatgcgtgaacatccaagtggtctcagagccagaggggacgaacgtgtgcatgcatgctcccgccatggatcgcagcttgagaagataaacaatcactagagtatgtcagtacactcgtgttcatgacttccattggttaacggttggtatatacaggctgcctcaataggatattttcttggtacgtcgcggcaatgttaatgcgaggtgcaagtgaatttcacggatgtttaacgcggcatctgccctcgttctctcgctctgcttgtgctgtccgggctcggtattttatccaccggaacgtttgcttggagcgaacacaacaaatccgtcgacatgcagacaacaacatcaggatgagacgaactatagattagagtgaagcgaagtctatccgattcagaagaggactgaagaccaaccaaaccgcactcgcgctgtacgattaagaaatgcgtatataattaccgatgtcgtaatgactgggctcggtttctttgccggccggccgatcacatgcatgttcagtgaggtcaatcacggcatagaccaccttagagcatctccatcagaattcagacccttgtactctctcatgtccttttaaaaagaaaatttagcggctgcaccaaaactcgtctcacatgaatttcttatgcctatatcttattattattattattattattttgcttctcctgttctacagataccggaaattgagattgattcttaggcgtcgttcttctcacgatgtcaccgacgagtccaggtttgctctcccctattggttattgccctagaaagaagctcacgggaggcaggcatgcgagcgggcgccggatctgcggtgcggcagggttgtggttgtcgccggcccgggtggtggaggacggcgattggaccagggagagacgggggaggcatggcatgggtatggctcgagctcgacaacgcttgggttattgcggcaagggcaagtagagtcaaacgcggccgccgtggatggggcagggccagcgagaagctggggcgagctgcaataacccaagcgttgggaagaggatcacttaaggttgaagacaactctgaagccgtatgactatgatctgacggctggcattcgtcgtttgatagaaaggcaaaaacaaaaacaaaaacaaaaacaaaaggcgcctattgtatggcgtttcgcatacctcctcctaaaggacaggaaagacctctctctctctcttttttctaaatcaggattagatttgagcaatccgctggagtaaaagtatcctatatcttaatgccacttttgagggatctcttaaacctagttacaggaagcaagaaacacgagatgctcttttctctggcttagggtacgtttgtttgggattataatatatctaaattatataatatagtctattttgactaacgtttagtttaaaataagtgagattatataatctgactaaattataatcccaaataaataatctctcgggatatgtgtgggggtacttctaacccagaaactagatggattcagagagcatcacggatatcagtttctttgaaagaagcagtttattaattcgagagatgtgtgaacacaagctagcagcagtcatgattcaagagtgatgcatattagtagtagtacatacagacaaaacatgacgatgacacgaactagattagagtgaagcgaagtctatccatgtgagaagaggattgcagaccaaccacattgcactcgagatatacgattaaaaatattgtaactgcaatagtgttataatatgagttttagtgataatgaccatataatttaaggattgattattttttatcaagtgtataagaatgtgaatatttagtgaggatactttttcgtctgattggttggtcgcatcgtctcgtcctgcctgcgttactgtgcgcattgattttatcttagca

SEQ ID NO: 16555 - DNA, 2310 bp, Zea mays
  misc_feature (1943)..(1943): n is a, c, g, or t
gagagagagagagagagagagagagagagagagagagagagagagagagagagagagagagagagagagagagagagagagagagagagagagagagagagagagagagcacgcacctggtttcgtccccaaatctcactcaatccccagtcccgacacccatcctctccaccgaagtcaccaccgcatggacgacgccgcgaatcccacccctccaccatccacctccgccgcatccgcggcggccgcggcggcgcaacaccagcagctccagcgccaactcttcctaatgcagcaggcgcagtcccatccgcagcagctgtcgcagcaggccatgtcccgcttcccctccaacatcgacgctcacctccgccctctagggccgcttcgcttccaacagccccagccccagccccagccgtcccactcccagggtccatctcagtcgccgtcgcaggccacgcagcaggcgtcaccccagcagcagcagcagcaggcggcggcggcggcggcagcggcgcaggcacaagcacaggcccaggcccaggcggcacgggtacgaagccccgagatggagatggcgctgcaggacgccatgcgggtctgcaatccggacgtcaagacgcccttccagtccatcgaggacgctgtcaacaggttattaccttaccatgttgttgccgactatgaggctgaagaagatgacaggatccttgatagcgacacaacaggccagatcccttctcgcctgcagcaatgggaccataatattctggtgaagattgctgagttcacgacaacttttgacaagcaagtattggcatataacataatgaccaagaaaagggccatcggtgagttcaggtcggaggagcggctcatgctggagcaagccttattgcaggaggaaaagcaagctatgctgggactgagggcagagatggagtcgagagagaaagctggtcgcgaggctgccgaagtgaagatgcgtttggcaatggagcatgctcgtgctgaggcacaagctcactctgagatgatgaatcatggtcctataagggccagtgctgttgcttcgcaaggggaggatggtccgagtcatgacatggtgcaagaacatggcgaagatgggtggggaaattctcagagggatgatgaagatccatcggaggatttcctcaacgatgagaacgaacctgagaatgggaactcagatgggcaggaggactggcgcagatctggggagtttgatctcaactctaggtaaggcagttggatttccacatgaaggtttctaggtaggctacgacatgctggtattgtatctactattctattgttgtgttcggtgaagatgtctttgtggctgtaaacatggcattcgaacaattcagtttctttgtaatttgactagtaatatttacttgagcactcaatatgtgccatttccaacttggagaaaaaaaattacaataatccacctgcattgcaccaacggaactcagttttctttccttattgttagattcacctagcatggacatgtaattacacatgtacgggatcttgaattttagccgagaacatgatcgttaaaattacttctagcagaactaggatgtggttttgatggaaacggcgtcatgaccaagtgtgtatcatgacctggtcgcgttgaagtttagcgaaagcagcttgcatgttttgggctttgttatcgacggagaatccgttggtcttcgatgaacggtccgcgacattggaaccggcataatcagttgcacagtacatgacggatggttcatcgagctgtcctcttggcaagctctgaacgaccaaaccaaaatacctttctcccccttttttctactctctagttcttgctttcaccacccctttaatctagataaagtgatgatctagataaggccataagggacacntaaaccaagatactagaagatatattgaagatccaaaagtaaatatgaaagttgaagacacaagatgggaccaaatctgaacacaaatatcaccaagaaacaagctcgcaagatgtgagaccaatcgtgaggggtgttagaccatatggctgagcaaaccctagaggggtgatcatatgagcgttaaactcgtaatcagtctaaaatataagaaaaatagacctcggtccatttgattatatgattttgatgtttgatatcaacataacatgtggactaatttgtttgctagtgtttacatttatagtttgcatgctgcggaatggttttggacactaaggcattgagtgaccaacacctcaaagaa

SEQ ID NO: 16556 - DNA, 1214 bp, Zea mays
ggacaccaaacaaacacacatatattcacctcggagttcagagtccaatcctgcgtacaatcgtacatacatgatacatgtactgtaaattcaattcaatacggaagaaccaacgcaacaatggaatgcttactttaacatgacagcaactctattgtctcacttcataaattgaagtgaaaatctaccacaggaaagatcatggagatcgtttcatgcccctcgttctccagacttacatccccagacccagaggaaccagcgtctgcatccatccatccatcgtcaccattcatcaggcaatcgctctctacttgcaccacccaaagcacgagaatttcgatgagacgtagccgtcgtcgtcgtgctgcttggggccgttggtacgcatgccgtccttgccgtacgccgctggcttccccgcctgggtcgtctgcttctcctccctcaccttgttgaagatgtgcgtgtagccgtccgccgacgccgggttggcgtcccagtcgccgaacttgggcaccgccgagcccctcgtcggcgtctcgttgccgcgcgaggcgcccttggcgcgggagcggtcgacggagctggcgacgaggccgtacccggcgctctcggagctgtaggggtgcgccggcgactggtcgacgctgtacccggcggccctccttggcggctcgccggcggcgtggcggtggtacggcgacccggcggcgtagtaggggttgggcgacatcggcggcggcggcgcgtcgctggggcggcgctcgtggcggcccggcggcggcgacggcgcggccacggagaaggcctccgggttctcggcggggtcgttggggttgatcatcctgccgccggcggctccggctcccttgcccttgcgcgcgttctcgaagaagagcgtgtacggcacgttgccgtcgctgtcccagttgccgaacttgggcacgtgcgcgttcttctgctgagccatggcagccggcgttcccagcgcagagacgagacgagacgagaagaggggtcgggctcgatccggggccgatgccttgtcgtctgtgcctccagcggctgccggcctgcagggagagggagagggagagggagagcaagatggaggagatggatggatttatgcggctggctggctggctggcgactggctcctggctattggccttgatgatcgatcccggccggcctcgaggtacccaatg

SEQ ID NO: 16557 - DNA, 1450 bp, Zea mays
atgttttgtgttcgttccacgtgtctgtgcacaggcctagctctggaaccgctctcgggagccctggcggccggcaacgccgtggtggtgaagccgtcggagctcgcgccggccacctcggcgttcctcgcggccaacatacccaagtacctggactccaaggccgtgaaggtggtggagggcgggccggaggtgggggagaagctcatggagcaccgatgggacaaggttctcttcactggtaatgaactacgtacgtaatgcatgagcgtgtatctgcgttaccacctggtgtctctctatagggcgattgggttctctcgaggccggccgaggcagccgcgttgggcgccttatcatggcccaggccgccaagcacctcaccccggtggcgctggagctcggctccaagtgcccctgcatcgtcgactggcttgacagcgacagggacagccaggtagctgtgaatcgcatcatcggagcgaaatggtccacctgttccggccaagcctgcatcgccatcgactacctgctggtggaggaggagtttgctccgattctgatcgagatgctcaagtcgacgctggagaggttcttcaccaagccagagtacatggcgcgcatcctgaacgagaagcagttccagaggctgagcggcttcctggccgaccgcagggtggcgtcttccgtggtccacggcggccacttcaaccccaagacgctgagcatggagcccacgcttctgctcaaccctccgctcgactccgacatcatgacggaggagatattcggcccgctgctcccgatcatcacggtgaagaagatcgaagacagcatcaagttcctcaggtccaagcccaagccgctggcgatctacgccttcaccaggaacgagaagctgaagcaacgcatcatagacgagacgtcgtcggggagcatcacgttcaacgacgccatcgtgcagtatggcctggacagcatcccgttcggtggcgtggggcacagcgggttcggccagtaccacggcaagtactcgtttgacatgttcagccacaagaaggcggtgctcaagaggagcttcctcgtcgagttcatgttccgctacccgccgtgggacgagaccaagatcggaatgctcaggcgcgtctaccgcttcgactacgtctcgctcttcctcgcgctcatcggcctcaggagatgaagcagacggcggagagtgcgtgaacaatcgagccaacagaatttgcacccacacccaacacacagttgctagtggtcaattgtcgttcatactgatcgatgaatatgtaattgtcccttctgtacaccaaaacgtctgtagtgtcgtttactcgttttatacgtgtctgtctatttatcgcaccaaaagatatttaataataatggattattatctttctagtaaaaaaaaaaaaattaaaaaaaaaaa

SEQ ID NO: 16558 - DNA, 1839 bp, Zea mays
  misc_feature (1715)..(1715): n is a, c, g, or t
  misc_feature (1749)..(1749): n is a, c, g, or t
  misc_feature (1760)..(1760): n is a, c, g, or t
  misc_feature (1818)..(1818): n is a, c, g, or t
  misc_feature (1827)..(1827): n is a, c, g, or t
  misc_feature (1829)..(1829): n is a, c, g, or t
ggtacctcgaggccattgggtacctcgaggccggccgggaacacagcccaggctcgagactacaacgttacagcacaacacactgctgcacgtacatacgcagatagagaccagcagcaagctcgatcgagactcgagaggcatggggagtgtaccggaggagaaggccaagctgggcttcggcggcctggtgggcgacctgagggaggtgtacgagagcggcaggacgcagggcctggagtggcggcagtcgcagctcaggggcctcgtcaggctcctggaggagaaggaggaggagatcttcgacgtgctccacgaggacctggggaagcaccgcggcgaggccttcagagacgaggttggggttctgaagaagtccgtcgtcgacaagctgcaaaacctcaagaactgggcggctccggagaaggctcacacgccgctcgttgccttcccggcgaccgcgctggtggtgccagagccgctcggggtcgtgctcgtcttctcatgctggaacctcccaataggcctagctctggaaccgctctcgggagccctggcggccggcaacgccgtggtggtgaagccgtcggagctcgcgccggccacctcggcgttcctcgcggccaacatacccaagtacctggactccaaggccgtgaaggtggtggagggcgggccggaggtgggggagaagctcatggagcaccgatgggacaaggttctcttcactggcagcagccgcgttgggcgccttatcatggcccaggccgccaagcacctcaccccggtggcgctggagctcggctccaagtgcccctgcatcgtcgactggcttgacagcgacagggacagccaggtagctgtgaatcgcatcatcggagcgaaatggtccacctgttccggccaagcctgcatcgccatcgactacctgctggtggaggaggagtttgctccgattctgatcgagatgctcaagtcgacgctggagaggttcttcaccaagccagagtacatggcgcgcatcctgaacgagaagcagttccagaggctgagcggcttcctggccgaccgcagggtggcgtcttccgtggtccacggcggccacttcaaccccaagacgctgagcatggagcccacgcttctgctcaaccctccgctcgactccgacatcatgacggaggagatattcggcccgctgctcccgatcatcacggtgaagaagatcgaagacagcatcaagttcctcaggtccaagcccaagccgctggcgatctacgccttcaccaggaacgagaagctgaagcaacgcatcatagacgagacgtcggcggggagcatcacgttcaacgacgccatcgtgcagtatggcctggacagcatcccgttcggtggcgtggggcacagcgggttcggccagtaccacggcaagtactcgtttgacatgttcagccacaagaaggcggtgctcaagaggagcttcctcgtcgagttcatgttccgctacccgccgtgggacgagaccaagatcggaatgctcaggcgcgtctaccgcttcgactacgtctcgctcttcctcgcgctcatcggcctcaggagatgaagcagccggcggagagtgcgtgaacaatcgagccaacagaatttgcacccacacccaacacacagttgctagtggtcaattgtcgttcatactgatcgatgaatatgtaattgtnccttctgtacaccaaaacgtctgtagtgtcgttnactcgttttanacgtgtctgtctatttatcgcaccaaaagatatttaataataatggatttaaaacttnctaaaaaananaaaaaaaaaa

SEQ ID NO: 16559 - DNA, 3642 bp, Zea mays
gccggccggggccccctctcccgcggccggggaagggagcaaagcacactgagcggaggcgagctgtgcgcctcgctcccctcccctgctctcgtcagatccaaaccccacgcgggaacacaaaccctagcacccgttcgcgccaccgcagaggctaagaggcgatgaggggcgttagggcggatggcggcggtggcgcgttctcttcttccaccgcagagaactcgtgcttcgatgcggcgcagtactctttctttggcaaggcgcccatggagggggcggaactcggtgggttgttggagggaggtgtcgacggcgatggtggtggattcggtggacatgatgacgctggttaccagttctcttctacaggcgaagagattgattgtatgagtaatttgtcggaaattgatgatcttgcaagcacttttgcaatgttgaaccgaaatattagcggaacaaggaaccctggcattattggtgatagacgatcaatttcgagagaaagttctttgactgctgattgggttcaagatgctgacttctccaattgggtagatcaggatatactagatggcgatgaatccctggacagcaaacaatggtgctcgcagttgcaatcttcgcctcactttggagagtctaaaccactgtctcgtacatcttcgtaccccaatcaaccactacagcaccgctcaagcgaacctattcttctacacagatctacctcgtttacatcctatcctccatcaggggaaagtcctggattgccttatcctgctcaaggtcttacacggcactcaagcattccatcaccaggtgctggtcacctcatgggttctccaagttcatcgctttctggttctccatatcatatgcctggtctatctcatggactaccttatggacgaaacatgtcttacaccactggagatctttcaacgaacaatgtcctacaaaatgagtggtcaaaccaagctggcccacttgtttttgatcatcttaaccgacggcccagttttttgcagccacacttatctctttcaagtagttcaatgtcttcattgcttttttctcagcagcaccagagattagcaccaggccagccgcctcttcagaattacataaacatgcagcctcacctgttccatcaccatcaacctcctgatgttccttcaccaagagacaaacgatcaaggtcaggaagaggaggaaagcacaacatacgcttttctcaacagccttctgatgctggtagccagcatagtgagagttcagggataaagttcagatccaagtacatgtcatctgaagagatcgaaagtatcttaaaaatgcagcactctgcaaatcacagcaatgatccttactttgatgactactaccaccaagcttgcaaagccaaaagatccgcgactcctctgccgtccacttcctgtccgatgtcaataaaggacttcccctcaaaatccaggtctggtgttgatcagcattcatatctacaggttgacgctaatggaggagtttcattctctgccatacgtagacctcgtcctcttcttgaagctgatttgcctggatctggtgatggtttttatgatcataagtcatccaagaggtcactggagaaagaaccaatgcttgcagccagaataaccgttgaagattctcttcgtcttcttctggttgttgatgatattgatcggtttttacagtctagccagccacaggacagcagtttccaactgaagcgaaggcgagaggtcctgcttgaaggcttagctacatcactccagcttgttgacccttttggccccaacaaacatggccattcgggtgggttggcccctaaggatgacctaatttttcttcgtattatttctctgcccaaaggacgtaagcttttggcacgctatcttcgacttcttttctctggaagtgagctgacccgaatagtctgcatggctgttttccgacaccttaggagcttgtttggtggcttaccgtcagactatagtgctgcagaaacaaccatcgttcttgccaaggctgtttcctcttgtgtgcgccatatggaactcagtgctctcagtgcctgtctcgcagctgttgtctgttcttcgcagcagccacctctccggccactcggtagtgcctctggtgatggggcctctctgataattaaatctgtgctggatagagcgaccgagctactggcggatccccattccgcagccaactacagcagatcagcacgttcgctttggcatgcgtcatttgatgctttctttggactgctgacgaagtactgtgacagcaagtatgaaagtatcgtgcagaggtttgccatgcagggatccaactccatgggaggacctgaaaccaccaaagcagtcagcagggagatgcccgttgagctgttacgtgcgagtcttcctcatactaatgagcagcatcgtcagacactgctagattttgctcggaaatctacgcatctgcctggtttcagccctactgctaaccgtggacttgtcaattctgaatcagttccaggttaacgccactgaagaggcctgatggtcgtctgttttgatttatatatggcacgtaaggtgtgagcttggagaagttccattggctcagcgaagctggcattcaggatatgactgtgtaggatgttatttatttatatatagaaaaccaactttatgtatgtatcctgctgtaactgtgtagtgctgaacagaacatctgttggatttggaggtaagctagttgacttatttcctcccaaagagaacaattgtgagtgcatagcaacagcttaaggcttaagcttgtttgggaacaatggaattggagaagattgagcgctggttcggaggaaatctcattctattcaattttaaataacaagagatttttttcctcgtggactccccttcaaatcccatgtcaccaaaccaactcaaatcccatgtcaccaaaccaactcataagggctaaaatcctcttgaatatcaaggggattttagacaattcaggagccgttcggttgtctaggaacggtgacctgaaaccattccgagtcggatcacttctttaatttatataagttttgatcaacgagaaaaaatctggagctattcccggagaaacgaacatggcctcaatcctcttcaatccatttgctcccaaacaagccaacgggtgtttggtgcaggagctacgtgctcgaacaatttaatcaacaggttcttctgccgcagttacggcattttctgtgctcatttatctatgctgtctgttctaaattataagacgctctgttatgtctatatttgtggcttgtattatgtatcaaacccaacatatatatctaggtgttataaaagatacagatgcagaaaagccaaaatatacggatgaagttataggttgcaaaggatgatacttagcagatactctctccgtttctttttatttgttgctggatagtgcaattttgtctgtgaaaagaaacggaggtagtacagtttagtctgtgtgcatcaaagagagttgtgtggaaacgattgttcgcagccctgtgatagacatcaagaatttggctccggtcgcttctgcttcaagccgctgcag

SEQ ID NO: 16560 - DNA, 2158 bp, Zea mays
aaaaaaaaaaacattgggtgcctccaggccgggcgggagggatcctcctctttccattccactctctcactctctctctaatcacactttcgacactgatcggctagtgtccgactcgtcacaattttagcgagagagagagagagagaccgagcgagcgagcgagcgagggagaggatgggttccacttccacggggccggtgagcgggttcgcggcgccggagcgggacatcgacgatctgccgcggaacgacgccaactacacggcgctcacgccgctctggttcctcgagcgcgcggcgctggcgcatccgggcagggcctccgtcgtgcacggccccgtgcgctacacctgggctgacacctatcgccgctgccgccgcctcgcatccgccctcgcgcgcctatccgtcggccacggaagcacggttgctgtgatagctcctaatgtcccagccgtctatgaagctcacttcggtgtcccaatgtcaggagctgttgtgaactgcgtcaatattcggctaaacgccgagacaatagcattcctccttgaacactccgtggcagaagttgtgatggtggaccaagaattcttcaccctagccgaagaatcgctgaaaataattggcaagaagaagacatcggctttcaggcggcctccaatcttgatcgtcatcggcgacccgacctgtgatcccaagtctctacagcatgctctgggaaagggagctatagagtatgaagagtttctgaaaaccggtgacccggagttcagttggaagccaccgaaggacgaatggcagagcatcgccctaggctacacttctgggactacttccagcccaaagggcgtcgtgttgcatcaccgcggtgcttatctcatggcactcagcgttgccatcgtgtgggggatgcctgaaggggctgtctacctgtggactctgcccatgttccattgcaatggttggtgctacacttgggcgctggcagcgttctgcggaacaagcatatgtcttcgccaggtgagcacaaaagctatatacgaaggcatcacgaagcaaggagtgacgcacttctgtgccgcacctgtcgtccttaacaacctgatcaacgctccggcaagcgagaccttcctgccgctgccccgcgtcgtcaatgtcaacgtggccggagccgcccccacgccgtccctgctgggcgcgctgtccatccgtgggttccgcgtcacgcacacgtacggcctgtcagagacgtacggtccctcgacggtgtgcgcgtggaagcccgagtgggacgagctgccgctggaggagcggtcccgcctgcactgccgacagggcgtcaggtacatcgcgatggagggcctggacgtcgtggaccccaagacgatggcgcccgtcccggccgacggcaagtcgtacggcgagatcgtgctgcggggcaacgccgtgatgaaggggtacctcaagaaccccagggcgaacgcggaggcgttcgcgggagggtggtaccactcgggcgacctcggcgtgaagcaccccgacgggtacgtcgaggtgagggaccggatgaaggacgtgatcatctccggaggggagaacatcagcagcctggaggtggagaaggtgctgtgcgcgcacccggcggtgctcgaggtctcggtggtcgccagggccgacgagcggtggggcgagtcgccgtgcgcgttcgtgacgctcaaggacggagcagcagccgacgggtcggacgaggcggcgctggccaacgacatcatgcgcttctgccgggagaggatgccggggtactgggtgcccaagtcggtcatcttcgggccgctgcccaagacggccacggggaagatcaagaagcacgagctgagggccagagccaaagagctcggccctgtgaagaagagcaggatgtgagagatctgggggccgacggcgatagcgtgtgatgccatggcaacaactcagaatcttgctccaagtcgcgcatataaaattcatgagttctgaagatgcctaataacttgagtgctttgcttgtatcgttctgaaaccagaagttcagaccagatccgatatataagtaagaactgtatcagattgtccggtttgcaggggttcgcaggaaactcggcccgccctaacgcaa

SEQ ID NO: 16561 - DNA, 965 bp, Zea mays
aaagatagccgcccggccgcgatcctcctctttcattccactctctcactctctctctaatcacactttcgacactgatcggtactctagtgtccgactcgtcacaattttagcgagaacgagcgagcgagcgagggagaggatgggttccacaggaccggcgagcgggttcgcggcgccggagcgggacatcgacgatctgccgcggaacgacgccaactacacggcgctcacgccgctctggttcctcgagcgcgcggcgctggcgcatccgggcagggcctccgtcgtgcacggccccgtgcgctacacctgggctgacacctatcgccgctgccgccgcctcgcatccgccctcgcgcgcctatccgtcggccacggaagcacggttgctgtgatagctcctaatgtcccagccgtctatgaagctcacttcggtgtcccaatgtcaggagctgttgtgaactgcgtcaatattcggctaaacgccgagacaatagcattcctccttgaacactccgtggcagaagttgtgatggtggaccaagaattcttcaccctagccgaagaatcgctgaaaataattggcaagaagaagacatcggctttcaggcggcctccaatcttgatcgtcatcggcgacccgacctgtgatcccaagtctctacagcatgctctgggaaagggagctatagagtatgaagagtttctgaaaaccggtgacccggagttcagttggaagccaccgaaggacgagtggcagagcatcgccctaggctacacttctgggactacttccagcccaaagggcgtcgtgttgcatcaccgcggtgcttatctcatggcactcagcgttgccatcgtgtgggggatgcctgatggagctgttttcttatggactttttccatttttatattgaatatgattttgttacactttatccttttgctatttatttgcttta

SEQ ID NO: 16562 - DNA, 3567 bp, Zea mays
cggacgcgtggcgagacgcgtggggccacacccaacaaaaggtaatccgccgcgtcgccgcccgccgccgcccgcagatccatcccctcccggcctccctagcctttcccctcgagcacgtcagcgccctcgccctgctctgtcggccggccaagctcctcaccggcgccatgaacccgtatgatctccgcttcgctgacccctcatcctaccacgacaggcgcagcgacttgaccgtggctcctacgttcgctccgccggctcccgtggctgcggcgaacctgaacccttacgccgccgcctacccgctgcctgtgcccgttcccgtgcccgcggcccccgcgggcggcgactaccagcgctacgggcagggaggcagaggccgtggtggcggtggcagaggcggtggaggagggtacggaggtggcggcagaggaggaggtcgcgggagggacgggcttgactcgctcgccctccctaagccggactttcggagcctgataccgttcgagaaaaacttctacgtggagtgtccctccgtccaggcaatgtcggaggcggatgtggcgcagtaccgccgcctccgggatatcaccatcgagggccgggatgtgcccaagccggttagatacttccaggaagccaacttcccagattactgcatgcaagctattgccaaatctggatttgtggagccaacacctattcaatctcaaggttggcctatggctttgaagggtagggacctgattggtatcgctcaaacaggctcagggaaaacattatcttatctgttacctgggttggttcatgttggtgcccagcctcggctagaacaaggcgatggcccaattgtattaattctcgctcccacgagagaactggctgttcaaatacaggaagaatctacaaaatttggatcatattcaagaactagaagcacatgtgtctatggtggtgcacctaagggtccacaaatacgggaccttagaagaggagttgaaattgtcattgcaactcctggccggttgattgatatgctggaagctggtcacacaaacctacgtagagtgacataccttgtgttggatgaggcggaccggatgctagatatggggtttgagccccaaattcggaaaatagtagcacagatccgcccagacaggcaaaccttgtactggagtgccacatggcctagagaagttgaagccttagcaagacagtttctacaaaatccttacaaggtaatcataggctcacctgaacttaaagctaatcattccatacaacaaattgttgaagttatttcagatcatgagaagtatccaagactcagtaagctcttgtctgatctaatggatgggagccgtatcttgatattcttccaaacaaaaaaggattgcgataagatcacccggcagcttagaatggatgggtggccagcattatctatacatggtgataaagctcaagctgaacgggactatgttcttgcagagtttaagagcggcaagagccccataatggctgccacagatgtggcagcacgtggtcttggtatgatgatttatttgaatattaggattaggtagtagttccaagtgctcaagggtgataagtcggagggttgttgagctgcgattggttgagtgaactgaacttgtggattggtggtgtataccaaggtgccatcatgtcaaaggtagataatttccccccgtggtttacctcatttgagcgtgagcattggcagtgttacacaggcagttcaactttgagctatcatggtaatgttccctttccgaataagccttttagggagcctacatttggataaaatggaaatcctcaaaaagtagcatgcaaccgaatatgcatttcacactatagttgatttcttagcttgatttgaattccttgatccctgcatatctgaccattttggaacatttaggtattgtgttgctgccctcttcattcattctttgtccttgtaattgaattcttttcaatccaatagtctgcttttcttgcaagtatttttggcttacctttctacattttctttgtaaatccatgtttaatttgtttagaattaattggagcaataattcttttcagagatgtattgcaaaattttaggcataaaacatttgtatacaaatgacaatatcaatttcaaatatatttgtttgcacaaatgcacattcttcatgagtagcatgtccatggatctcctttgctttcccctagttttacatgaacctttagaaagtcgttctgctttctcaatcaagctcctcatcatcggtatcactgccaagtgcgaactggtcaaaaggatggttgtaatcagcattcttttcagttgattcacgatagtgacctctgatgcagcaccttacacattacagcctacgttggactggcatgtcctacagaattttgtttgggttatggatattgatgctgttacattattggataagtggttacccaggcatgccagttgcagtcttccaacattttttgataaggctgagaggttaatcaccatcaattccacatccagcagtgattgatgcctggttcagtttttcagctccttcgacttgtgttttagaattcaaaagtgcagcactgtggactttttggtgcttgtctagaccatgtaccttctatggggatcgacaatgttgatgttccagcgtggtccagcatggtattcaggacaacacatcaattttgattaagtactgataatatttgttgattttgcagatgtgaaggacataaagtgtgtgataaattatgattttccaacaactcttgaagattatattcacaggataggtcgaactggccgtgctggtgctagcggaactgcatttacttttttcacacacgcaaatgcaaagttctcaaggaatctagtgaagattctgcgagaagctggccaagttgtgaatcctgccttagaatccatgtccaggtcttcgaactcaacgggaggaggcaattttcggtcgagaggcagaggtgggtttggtaaccggggccatatgtctggatcaaatacctttcctttaggaggaagaaggccatattgatgtgtgcaaaagaactgtgggagtatgggactatttgtatactactcggcattaagtgcattctttgggaaatttctgagaaatttcccctactaccaggattgataacaccatcgattttcgctacagtacctggagcttcttatatgaaagaacaacacatcaactatctagcaacagcatatgcattccattcagatatttcttttggaaggaccctgtcttgttttagtggagtccctgtgatcgtttaaagtcgtctgtatacttgtactgaacttcttgtggtgttactgttaggatttatggttgctctctattggtgtgcggtgttactgaacaaatttagttaagaagttaggcatttccatatttaatctgattctgaaataaactagcaaatttatgatgtacactttataatagtaaaaaatatatatatgcaaactctatatgc

SEQ ID NO: 16563 - DNA, 1604 bp, Zea mays
ggttgctagattggggtttgagccccaattcggaaaaagtagcgcagtccctcgcgggcgggcaaaccttgtactggagtgccacatggcctagagaagttgaagccttagcaagacagtttctacaaaatccttacaaggtaatcataggctcacctgaacttaaagctaatcattccatacaacaaattgttgaagttatttcagatcatgagaagtatccaagactcagtaagctcttgtctgatctaatggatgggagccgtatcttgatattcttccaaacaaaaaaggattgcgataagatcacccggcagcttagaatggatgggtggccagcattatctatacatggtgataaagctcaagctgaacgggactatgttcttgcagagtttaagagcggcaagagccccataatggctgccacagatgtggcagcacgtggtcttgatgtgaaggacataaagtgtgtgataaattatgattttccaacaactcttgaagattatattcacaggataggtcgaactggccgtgctggtgctagcggaactgcatttacttttttcacacacgcaaatgcaaagttctcaaggaatctagtgaagattctgcgagaagctggccaagttgtgaatcctgccttagaatccatgtccaggtcttcgaactcaacgggaggaggcaatttccggtcgagaggcagaggtgggtttggtaaccggggccatatgtctggatcaaatacctttcctttaggaggaagaaggccatattgatgtgtgcaaaagaactgtgggagtatgggactatttgtatactactcggcattaagtgcattctttgggaaatttctgagaaatttcccctactaccaggattgataacaccatcgattttcgctacagtacctgccccgccgccgctcgaagaacaacacatcaactatctagcaacagcatatgcattccattcagatatttcttttggaaggaccctgtcttgtccgggtggagtccctgtgatcgtttaaagtcgtctgtatacttgtactgaacttcttgtggtgttactgttaggatttatggttgctctctattggtgtgcggtgttactgaacaaatttagttaagaagttaggcatttccatatttaaaaaaaaaaaaaaaaaaacgcgagactgtctctcctcgtgcaaaaaaaaaaaaaaaaaaaaaaaaaaaaaaaaaaaaaaaaaaaaaaaaaaaaaaaaaaaaaaaaaaatttttttttttaaaaaaaaaaaagggaaagggtggtttaaaaaaacccctttttttaaaaaaaaaaaaaaaggggggcttttgcccaaaaaaccctttaacccccccccccctggggaaacggggggggggttttttaaagtccccaacccggggggaattttttttggtttaaaaacccccgccggttttttttttaaacccaaaaaaggccccttttaaaaaaaaaaaaaaaaaaaatttttgaaaaaagggaaaaattttccccgggggggggccctttttaaacccccaaaattttaaaaaattttttcaaaaacccccttttttttaccgggg

SEQ ID NO: 16564 - DNA, 2263 bp, Zea mays
cattgggaccctcgaggcccggcctcgggtctgttgtctcctagcctacacacacggtcgctcactttctctcgcctcctgtcccccccgcgtgcgcgcagcgctctctctctctccctcactctcttttgaggagtgaggacgactggggcgaacgtcgccgccgccgccctacatcaggtgcccaggtcgttgttcggcccttcgccagctctttttcgggcacttcgccggcgacgaacacccaccagttgctgatgcaaggctttcaaaagattaacagtctcacttgatgcaaaagcaacacaatcacactaaaggtttggattagacatttcagagcatgggttcgcggtttccatcccaccagctaagcaatggcttgtatgtctcgggccgacctgagcaacctaaagagaagtccccagtcatttgctcctcggctatgccgtacactggtggggacataaagaaatctggggagcttggaaagatgtttgatctccatagaaaatctggtccattgggtaatcaaacttcaaggaatacttcctttggtggtgctgcctccaactctggaccagtttctaatgctgtcggtcgctccaactactctggttctatttcgtctgcaattcctaacactggaggatcttctaggacaaaaactaattctggacctctcaataagcatggagaaccaacaaagaggtcatctggcccccaatctggtggagtaaccccgatggcccgtcagaactctggccctctgcctcctgtacttcctacaactgggctaatcacatcaggtcctatcacctctggtcagttaaattcatctggtgctcaacgcaaagtatcagggcctcttgattctagtgtatcaatgaagatgcgtaccacatcttttgcacacaacccagctgtcacaaatctcaatgtgggagatggttactcgattaagggcagcattccgaccacaataatctggttggtcgcgttgctctttttggttgggtttgtagctggtggcttcattctcgctgctattcataatcctatcttgcttatagtcgtggtggtgatatttggctttgttgctgcacttgtgacctggaacatctgctggggaacaagaggtgtgattgattttatcggtcgctattctgatgtagaccttagaactgcaaaagatggagagtatgttaaggttactggggttgttacttgtggaaatttgccccttgagtcctcattccaacgggtgccacgatgtgtgtacacttcaacttgcttgtacgagtacaggggttgggactcgaaagccgcaaacgccacacaccgacggtttacttggggtctcaggtcaatggaacggcacgcggtggacttctacatctccgatttccagtccgggctgcgagcactggtcagggcaggatccggcgcgcgcgtgaccccatacgtggacgagtccgtcgctatcgacgtaaacccagacaacaaggacatgtcgcctgagttcctccggtggctccgcggaaggaatctgtcgagcgacgaccggactatgcgcctcaaagaaggatacatcaaggagggcagcaccgtgagcgtgatgggcgtcgttcagaggaacgagaacgtgctgatgatcgttcctccagccgagcccatctccactggctgccagtggggcaagtgtgtcctcccgaccagcctcgagggccttgtcctgagatgcgaggacacgtctggcctggacgtgataccggtctagctagagaggttggttctggcgaatcctctggcgcggaaagggagtaggaaaaaaaaatgccttgacgtttggtttggtctccgtgggttgttagggttggaaggatgtgcaaatgcagggtgtgattattgggctaagtaagtaagtacaatatgagtggtcggtcggttacctggagcttgatcgtgatagtatatggtatgtaatttcctcttctcttcttttggctgagccatggatggtgtgcttgtaacaaggatggcttgatgtcagtatactaccctaccataccatggagcatatttggagattcagtgggttccagtccgtattatgctcctgtttttttttgttgtagggttccaacaatgccttgaagcctgcaatttccttgtgtacccagatctccatagaaatctatttgcctaaacatggactatagcaggtgtatggtagatggtgagaaatcgatgtgattgattc

SEQ ID NO: 16565 - DNA, 2304 bp, Zea mays
  misc_feature (1)..(1): n is a, c, g, or t
natacaaaacagggggaacctcgaggccggccgggaagcccttccggtcctgcattttgttgtcccctcccctctccgtagcggagacgttcgttcactttctctctctcgcctcccgtttgccccgcgtgcgctctgtgtcgctccctctcttgtgaggagtgaggacgactggggcgaccgccgccgccgccgccgccctacgccagatgcccaggtaggggccattcgctagctcttcttcgtgcccttcgccggcgacgagcattcaccagttgctgatgcaaggctttcaaaagtttaacagtctcacttgatgcaaaagcaacacaatcactctaaaggtttggatcagtcatttcagagcatgggttcgcggtttccatcccatcagctaagcaatggcttgtatgtctctggccgacctgagcaacctaaagagaaggccccagtcatttgctcctcggctatgccgtacactggcggggacataaagaaatctggagaacttggaaagatgtttgatctccatagaaaatctggtccattgggtaatccgccttcaaggaatacttcctttggtggtgctgccgccaactctggaccagtttccaatgctgtcggtcgctccaactactctggttctatttcgtctgcagttcctggcactggaggatcttctaggacaaaatctaactctggacctctcaacaagcatggagaaccaacaaagaggctatctggcccccaatcttctggagtaaacccgatggcccgtcagaactctggccctctacctcctgtacttcctacaactgggctaattacatcaggtcctatcacatctggtcagttgaattcgtctggtgctcaaaggaaagtatcaggccctcttgattctagtgtatcaatgaagatgcgtgttacctcttttgcacacaacccagccgtcacaaatatcaatgtgggagatggttactcgattaggggcagcattccgaccacaataatctggttggtcgcgttgctctttttggttgggtttgtagctggtggcttcattctcgctgccattcataatccgatcttgcttatagttgtggtggtgatatttggctttgttgctacactggtgatctggaacatctgctggggaagaagaggtgtgattggttttatcagtcgctatcctgatgcagaccttagaaccacaaaagatggggagtatgtgaaggttactggggttgttacttgtggaaatttgccccttgagtcctcgttccaacgggtgccgcgatgtgtgtacacttcaacttgcttgtatgagtacaggggttgggattcgaaagctgctaactccacacatcaccgatttacctggggtctcaggtcaatggagcgtcatgcagtggacttctacatctccgatttccagtctgggctgagagcgttggtcaggacagggtccggtgcacgagtatccccatatgtggacgagtctgttgttatcgacataaacccagacaacaaggacatgtcgcctgagttcctgaggtggctccgcggaaggaatctctcgagcgatgaccggattatgcgcctcaaagaagggtatatcaaggagggcagcaccgtgagcgtgatgggtgttgttcaaaggaatgagaacgtgctgatgatcgttcctccggctgaacccatctccactggctgccaatgggccaaatgcatcctcccgaccagcctcgacggtctggtcctgagatgcgaggacacgtctgacctggatgtggtaccagtctagttggttccggcgcggaggaggagaaaaagatgccttgactcgatttgagttggtttctgtgggttgttagtgttggagggaaaaaaatgtgcaaatgcagggtgtgattatgggctaagtaaagttacaatgtcagtggtcggtcagctacctggagattggtcgtacagtatgtcatgtgtaatttttgtcgtctcgttttggttgagccatgggtggtgcttgtaacaaaaggatggcttggtgtcagtactacctaccctaccatggagcctgtttggagattcagtggtctggtttcccattcatattttgttcttttttcttttggcgtagggttccgacaatgccctggaagcctgcagtttccttctgtacccagatctacatggaaatcgcttacctaaacttgagaggcatatttccggtggtgagaaaccaatgtaaaaaaaagttgattccaattcgtgttgacgcgtttccgaagcttaccggaggat

SEQ ID NO: 16566 - DNA, 2299 bp, Zea mays
  misc_feature (563)..(563): n is a, c, g, or t
ctttgccgcagaagctgggtctttataatttcggaattgcttataactgaggcattgggctccggaccgattcaatcagatctcggcccagcctggtcagccaggcccaactgccgatcgtcagttccttctccaagtagaaaccccgaaggcccgaagcgtcgctaatctcttctccggtgccgctactctctctcgaagataacgggactggggtgctgggcgggcggccatgtcgtccgcgcctctgaccgccacgccagcccctctccttcccgccaacaaacccaagagcgcagcaccgcagcacccgctcctctcccacctcccgcactgcaccagcctccgcgggctcgcccagctccacgccgccgccgttaaggccggcctcgccgcgcaccccgccttggtcaccaggctcctcacgctctgcaccggcccgggcgcgggccccgcccacctcgcctacgcccgccaggtgttcgacagggtgacccaaccgtcggacgccgtctggtacaacaccttgctccgcggctacgcgcgctcctcctcctcctccncctcctcctcggcggcggcggtgcgggtgttcgtgcggatgctggaggagggcgtcgcgcccgacacgtacacgttcgtgtcgctgctcaaggcgtgcgccgcggcgcgcgcgggggagcacgggcggcaggcgcacgccgtggcggtcaagctcggcgccgcgggccacgactacgtccgccccacgctcatcaacatgtacgccgagtgcggggacgcgcgcgccgcgcgcgtcacgtttggcagggcggacggggactgcgtggtctcgtacaacgcgatgatcgccgcggccgtcaggagcagccggcccggggaggcgctggtgctgttccgggagatgcaggccaaggggctcaacccgacgcccgtgacggtgatcagcgtgctctcggcgtgcgcgctgctcggggcgctccaacttgggaggtggctccacgattatgttcggaagctagggctcggttccctcgtcaaggtcagcactgcactggtcgacatgtatgccaagtgtgggagcctggaggacgccattgctgtgtttcaggggatggaatcaagagacaggcaagcttggtcagtgatgatcgttgcgtacgctaaccatgggtatggcagggaggccatttcgctgtttgaggagatgaagaagcaagggatgaaacccgatgatattacattccttggtctgctctatgcctgtagccactctggtctcgtgagtgaagggcttcggtattttgacgatatgaaagatcatggcattgttccagggatcaagcactatggttgcgtgacagatttactagctcgctcagggcagctggagagagcttataagttcatcgatgaactgccaataaatcccacccccatcttatggaggacgttgctttctgcttgtggaggccatggagatgtcgaacttggcaagcgtgtctttgagaggattcttgagctggacgattctcatggtggtgattatgtaatattctcgaatttgtgtgcaaacactggatactgggaagagatgaatagggtaaggaaactgatgagcgacaaaggtgtggtaaaggtgcctggctgcagctcaatcgagatagataacacggttcatgagttcttcgcaggagatggaaggcaccccaaatcacaagaagcacggaaaatggttgatgaagtgatcgatcaactaaagcttgttggttatatccctgatacctcacatgtgtttcatgtcgaaatgggtgaggaggagaaggcgataagcctaaaataccatagtgagaagctggcaattgcttttgggcttctaaatactgctccaggggctacactgcgtgttgtcaagaatctccgcgtatgcccagattgccactcgatggcaaagtttgtctcaatggtcttcaataggcgaattatactcagagatctcaatcgcttccatcactttgaaagagggatatgctcttgtggtgactattggtaaatttgtaggaacaaaattcttgcacctcgatatcttgtattgcaatgccttccactcaggttgtggtgaatctgtatatccatggaaaacctactgacgactgatgattctttctatgaatattattggcactgaatgataatatgttatgtaaccttgattttgctgttggatatccaattgtggccaaagcccatcaacttgctgattttcggagttgagtgcactacattgctgtggcagcag

SEQ ID NO: 16567 - DNA, 1066 bp, Zea mays
ttgggacctcgagcccgcgggggacctcgagccccgcggggccctctttccggccaaccacgaaccactcctcctacagaaatcacctgccggcctggcctttccgtagctacaaccgaagccaccaccagcagtccagcacgactagcggaataatatccaccggcgacgggaacgggaggcggcgcggccggagattcgaagcgatggcgttcacgatgcgggcagtgaaggtgcctccgaactcggcctcgctggaggaggcccggcaccgcgtcttcgatttcttcaagcaggcatgccgctctatccccaccgtcatggagatctacaacctcgacgacgttgtcacgccctctcagctccgctcgaccatcgctaaggagatccgtaaaaaccagaacgtcaccaaccccaaggtgattgatatgcttctgttcaacgcgacggaggagctgaacaacatagtcgaacatgcaaagcagcgccaccatgtgattgggcagtatgtgatcggccaagagggcctggtgcatgagctggggtcgaaggatctagggaactctgacttcctgaagaaattctacacaagcaattacttctgatctgtgttgcagatttacaacatctggtatactccgggtggtgctctgaataagacgacactgaggacctatcaggaccgattgtttcgcgctggaggttttgatctatttggcccttgaatcctctgttcaatgtgatactgctgtcagctgtttgtcttgtttactgttgtacttatcaaattgatgttttagtcgattcgagtctacaagattgaactttgttgctacagtgagtaccgaccagtggcctttttgttgttgttgagaaacagccctcaacctttagcagagaaagggactaaacatgtcttccaacataaaaactaagggcctgtttgtttttgtttttttttgttttttgttaagcctgtttgtttaggtttaatttgtacagacttcaactgtttctacagtgttttttattgtgtccccaggatttgaagctatggttcttgttc

SEQ ID NO: 16568 - DNA, 1027 bp, Zea mays
ttttaatgtgagaaatacaaacctccatatacttattcatttcgggccctcgtggccggccgccccccctatctgcgtcgccctcttgccggcccaaccacgaaccactcctcctacagaaatcacctgccggcctggcctttccgtagctacaaccgaagccaccaccagcagtccagcacgactagcggaataatatccaccggcgacgggaacgggaggcggcgcggccggagattcgaagcgatggcgttcacgatgcgggcagtgaaggtgcctccgaactcggcctcgctggaggaggcccggcaccgcgtcttcgatttcttcaagcaggcatgccgctctatccccaccgtcatggagatctacaacctcgacgacgttgtcacgccctctcagctccgctcgaccatcgctaaggagatccgtaaaaaccagaacgtcaccaaccccaaggtgattgatatgcttctgttcaacgcgacggaggagctgaacaacatagtcgaacatgcaaagcagcgccatcatgtgattgggcagtatgtgatcggccaagagggcctggtgcacgagctggggtcgaaggatctagggaactctgactttctgaagaaattctacacaagcaattacttctgatctgtgttgcagatttacaacatctggtatactccgggtggtgctctgaataagacgacactgaggacctatcaggaccgattgtttcgcactggaggttttgatctatttggctcttgaatcctctgttcaatgtgatactgctgtcagctgtttgtcttgtttactgttgtacttatcaaattgatgttgatgttttagtcgattcgagtaatcgagtctacaagattgaactttgttgctacagcgagtaaagaaaaaagcccccccccccccccttttttttttagaaacagccctcagcttttagtagagaaagggactaaacatgtcttccaacataaaaactaagggcctatttgttttagcttttttgtttttt

SEQ ID NO: 16569 - DNA, 1626 bp, Zea mays
aaaaaaagccctgctagacagttgcattgatgcatgaacatagttgtaaatgcatttaacctgcagacatctggaagcgtgatatcacctagcgatcgccatttgccaagttcaagtattctgaagtacatatgtacacctgcaatatagctaatgtgtctggacaaagcaaaaggcaaaggttcggctagtttgatctctgacaaattgatggacactttaggccaaaactaggcaaaagtagtcaccacgacttaacagctacaggaggacggccagaggcctaccgcacaaatcatgcaccgattacattcaattcatgagaccgttcttcactcctttctccaatattgcccaaaattttgccgttaaggaaatccatgaggacaaaggggggcaacaagacctatagttgtgcagctgcaaattgggaagttgacgaagcttaagaaacaacagcatgcttgatacaagtcagtaagtcacttgatgtatgtcatcagcagcagcaaattaatccatgaatagcctgcagcaacagtcaccgactccttggtttgattcggtagtgcttcacaccataacctattgtggaagtgattgtcgtagtagccacaagccaactcagaagtgcaatataattctgagtctcctctgtgccaaattctggctgaagaagtgcagcggcaaccaacattaattggaagactgtgtttaccttgctgatgaacagaggttcaaccttttcacgatgaataacatctaggttaacaaattctgaccaactattccacttccatcccagactagaagcccgcttgtagaaagcaccacccacaaggagcaagtctcttacgacaacgaggccaacaagaccaggatgtaaaaggtctttttcaaccatggctacagcaacacagccaatcaaaaccttgtcagccagagggtccaaatatgatccaaatacagaattgatgcccatctttctagctaaaaagccatccaaccaatcacttgcacccgagatagccaatgtggcaaaggcaggaagataccattcattcacgatcatccatccaatgaccggccctgacaccatccgtccaatcgacactaaattgggcgcattcagaaacctctcacctccatatcccacaattcccgaagacgtcgcaacctccgcttcacccctggagatccgcatgtgctcccaccccactgcggccgcgacggccagcgcgcggccgccggggagggcctgggccctgtggagcttggcgccaagggcggcagccgcggccgtgagcggtgtcgccgactgcgacagcatccatggggccgacgagaggaacagcggaccgccggaccggatggggacatgggtgtgcacagcgttggcaaacggggtggcggcggcggtagtggtgggggaggatgaatcgaggacagtgtggagggagaggagcagcctggggatagcgatcggggtggcctgcctgcgtattagagggtttagggtcttgaggaaggccatggccgtggaacgcggagcattgcagtgggtatggccgtatcggccccggcgctcggagcgaagagagattcttgaggcgggggtaggagttt

SEQ ID NO: 16570 - DNA, 4735 bp, Zea mays
ctcataaaaaagccctgctaaacagttttttttttttttttggtgcatgaacatagttgtaaatgcatttaacctgcagacatctggaagcgtgatatcacctagcgatcgccatttgccaagttcaagtattctgaagtacatatgtacacctgcaatatagctaatgtgtctggacaaagcaaaaggcaaaggttcggctagtttgatctctgacaaattgatggacactttaggccaaaactaggcaaaagtagtcaccacgacttaacagctacaggaggacggccagaggcctaccgcacaaatcatgcaccgattacattcaattcatgagaccgttcttcactcctttctccaatattgcccaaaattttgccgttaaggaaatccatgaggacaaaggggggcaacaagacctatagttgtgcagctgcaaattgggaagttgacgaagcttaagaaacaacagcatgcttgatacaagtcagtaagtcacttgatgtatgtcatcagcagcagcaaattaatccatgaatagcctgcagcaacagtcaccgactccttggtttgattcggtagtgcttcacaccataacctattgtggaagtgattgtcgtagtagccacaagccaactgcaggggtagggggtcatttagcataatacacaatgttaaaaaagtgttcggtgctaggcaggcagccaggctctgcctagcgcctagctgatgctaggcatttgcactttctgaagatagcacatcagaactaatgttaccatgcatcgataaataatatgaccacagttcatctttctccatctctaatctgtcccattttcatgcatagattaagcccaacaccttaacgctgaaacaagcctagacacaacgcctaggtgctaggcagtgcagctcgggctaacgcctagccgccgcctgtttaaaaggagataacaccatgatttaaaataatacacatcatttcattaggcattcaaatggttgcttcaactgttattctgcagtacttatagactatagtaggtgcattgtaaagatacctggtttaccaaacaaatgttcttgtaaggtcaacctttgtgttacacaaggtaaactcagtttaattagtccagtctgacataagaatgcatgcaagttcagaagacaaagactggagaaacagcggttacaatatagaaaagaaatcacctcagaagtgcaatataattctgagtctcctctgtgccaaattctggctgaagaagtgcagcggcaaccaacattaattggaagactgtgtttacctgcaatcaataactattaccatgtgtccacccgataggtaaataagcatacaagttttaatgctgtgtgaacataggcataccttgctgatgaacagaggttcaaccttttcacgatgaataacatctaggttaacaaattctgaccaactattccactgtcacaaatttgtaaaggatattcggcttaattgaaaaccttccacgatatacttgatgaatcacaaaaaagcatgtataatagtaccttccatcccagactagaagcccgcttgtagaaagcaccacccacaaggagcaagtctcttacgacaacgaggccaacaagaccagcttcaagtgaaacgagcagcacacaagttaaaatactgattacaaccagaaccttcagacaagtacaaatatgatggcaaaattatgagctattttactaagaaaattttgcaatacaaaacaaacacattgatacttgttgaactacttacgatgtaaaaggtctttttcaaccatggctacagcaacacagccaatcaaaacctaaacagcaccatagatattgtacatcagcttagcaaaacaattaacatagaaataaatctagaaagtgttagcttaaccttgtcagccagagggtccaaatatgatccaaatacagaattgatgcccatctttctagctaaaaagccatccaactatgttcaaagttcaaccagcaacgcaacagaagaaatgagtaatattataatggattttacagtttttaaaggcgcaatgcttacccaatcacttgcacccgagatagccaatgtggcaaaggcaggaagataccattcattcacgatcatcctatagtgcatgaattcccttagaaaaaaggaccatagagaatagagaatagagaataataacgtgcaacatagagagcaagataaaacattgaggacagaagaacagcaaattcatcaatatccagaacaacagaaccaaagaaggtctactttgactttttttttcacaaacatttggtagatgaaaaaggacaacacaaagtcatcaaagagatggcacaatggtaccgataagcataaagattgatgtgtacaactgaaatatgcctccaatcctccatgacttcaagttatgttgggcaacagctgcagctgattgcctgaccttagcattaaaaaatgttgacacataagctgagccatttgcgttatgaagtatcactttgcatgcaaacaacccaacttcagtgctccttcctagtatgtgccaacttgatcgatcaaattgaagcacatgtttatatgaccatagataacatcattaaatagctaacatgtttcaactccaaaacctataatcctcatgtccgtacgttgatagagtgtgcaagcctgaagcctttgtgaccagatattctaattaatattctagagcaactatattttagagaaatatgccggttcaaattgttgatctgaattctctgagtctccccaattcaaatgttctcagttcccaatccttaatcaatagaccgatacacaccatcattcaggagtattgacttcactgcctttttaagatcgtgatacatatatgccatcagctaaataaacacaatttaaacagggagatggttactggaatagaggcaggctcgaaatgaagagatcatagttatttttgctttttcaagtttgaacccccctaacgggccagaccaacggccaattgccgagcctctagtcaaactattaccacgctggatatagctctaaacacgaaaagcagatgagaacactcaccatccaatgaccggccctgacaccatccgtccaatcgacactaaattgggcgcattcagaaacctctcacctccatatcccacaattcccgaagacgtcgcaacctccgcttcacccctggagatccgcatgtgctcccaccccactgcggccgcgacggccagcgcgcggccgccggggagggcctgggccctgtggagcttggcgccaagggcggcagccgcggccgtgagcggtgtcgccgactgcgacagcatccatggggccgacgagaggaacagcggaccgccggaccggatggggacatgggtgtgcacagcgttggcaaacggggtggcggcggcggtagtggtgggggaggatgaatcgaggacagtgtggagggagaggagcagcctggggatagcgatcggggtggcctgcctgcgtattagagggtttagggtcttgaggaaggccatggccgtggaacgcggagcattgcagtgggtatggccgtatcggccccggcgctcggagcgaagagagattcttgaggcgggggtaggagtttggagtttggactcgaggctcggggagttttgtggtagggctggtgaaaaacaggtaactcgaaatctgttcgaacccggaatgatcgaatctgaatctaaaatacacaaactttcatatgacatatatttatgtcattgttaattatcaatttatacacctataattgtgtaagtgtgtatgacttatgaacttatgattatataccattttaataatttaatcaggtttttatgaagttgacacaatagttcgaaaatatctgaactagaaattccgagtacctgaatttttggttactataaaaccattctcaataaaaccaaaatttaaattatctaaattacctgaccaaaaaaattagtaacacgaacgctcacccttattttgaggaacatttgggcgacataatgagttggttcaaaatatattagtgttagagtaactacaaaagcctagatacaatcctagctaaatttaaagtattataaggactctaaaagataaacaacttcataaacgatgggtaaaccaacaaactttataaaccttgtctatccatattcgaactggctgctccttcaggaaggcagacgaagggttgtccgggaggttggccgccgcgagcaagctcctcttgagcccgtacatgtcgttgcctgccgagggagatggaggtgagggtgtggcgcgccaccacacgaagactaaagcatcgtagccgcatgaagattgaagactagacatgcggtggacgaagactgaagactggacgccgccgttgtaacatcgacgccagacatgaggacagcaagtgcatgcacgcgaggaagaagatggcaagtcgagcaagctccgcaaaaatgcctagcgccctcaatgagataccgagcggaatatagaagcgatgaaggagagtttgttggatccgattttcaccgtagttttctatttttatcgatactaattgatttagctaggcttttggagttgctcttagatcggtttgactcgatatttgaggttgtgtttgagttacagtcggggcccacgggaaca

SEQ ID NO: 16571 - DNA, 2618 bp, Zea mays
cttgcatgcctgcagttggcatgtttataaaaattgacttttatctcattgacttgtgcaaatctctatgatcatgaaggatctgtttcccacattttttttccctaggaacatgtagtgtgaaaacagtaacactgagtccctgatttccttttgctcagatagctgatatatttacttggctgatctggtctagattaaaacctaccatgtttgtctttcttggttttacagacaaattcttgatttctgagagttggcaattttctacaatcttaccatgttgttgcgtctaaatcaaagaactggcaatcctatactagtgacaagatatgatgatccttgtctgctcatccaggaaccttgaccagaccaattaggctatgtaatttctgatatttgagttagtatgcagtgttgaagggcaaactattgcacagttgttatttaatcttatttttcaaagcgtgtatattctgttctttcagaaaaaagagatcatattagttcaattttggtctttgcagatgtcttgggcgagctgttacatgccttcccctcactagcaatgacaacaaattctgtaaatgccacagctttggacactgctgcaactcagggccacattgacattgttaatcttctgctagaaacagatgcaagccttgctaggattgcaaaaaataatggaaagacagttttgcattcagcagcaagaacgggtcatgtggaggtggtcactgcactgttaaataaggatccagggcttggtttcagaacagataagaagggacaaacagctctacacatggcttcaaaaggccagaatgcagaaattctgctcgagttgttgaagcctgatgtctcagttatccatgtagaagacggcaaggggaatagaccattgcatgttgcaactcggaagggaaacaccattatggttcagaccctaatatcagttgaggggattgaaatcaacgcggttaatagagctggagagactgcttttgctattgcagagaaacaaggtaatgaagagctcgttaacatcctgagagaggctggtggagtaactgcaaaagagcaagtaaatcctcctaatccagcaaagcagcttaagcagacagtcagcgatatcaggcacgatgttcaatcacagatcaagcaaacacggcagaccaagatgcaattccagaaaatcaagaagagaatcgaaaagctccacatcggtgggctaaacaacgccatcaactccaacaccgttgtcgcggtgcttatcgccaccgttgcctttgccgccatattccagctccctggtaattttctggaggatatgagtcaggcacatggcccagacatgaccttggggcaagcatggatagccagtgagccagccttcataatcttcttggttttcgacgctctggctctcttcatctcgctcgcggtcgtcgtggtccagacgtctctgatcgtcgtcgaacagaaggccaagaagaagatggtcttcgtgataaacaagctgatgtggctcgcgtgcctctgcatctcggcggccttcatagcgctgacctacgtcgtcgtgggccgagacgacgagtggctggcctggtgtacgatggcgatcggcaccgtcatcatggtggccactctgggttcaatgtgctactgcattgtcgctcacaggatggaggagaagagcatgaggaggatcaggaggacctccacgagccagtcgtggtccatatcgatcgactccgaaacggagctgatgaacagcgagtacaagaagatgtacgccatttaggataggcaacggccatgcttgccatctgagtcctgtatatactggtacccaaagtccatggcattggattgactgagctatattttagtccgtagacatggcacctgtatgtaactgcagacagtctgcagcctccgcccacgaacgtagatagggtgtagccacctttttgttggcaaaatatgaacatttgccaagcacgatgcccctatcttatgctgtatttttgtgggtgcggcaatgaaaaccatgggattgtatctgtatagtagaatagtatggaataagttgaccttgtgtcaaaggttatgtggtcgtgcgccgatgctcttttgatgcgacattaggctggatggagtaggctgagggaaaagaaaagaaaaataacaatggtcacagatgacattttggacttggactggagcagactttgttgaccgttgtggttatgcggcatttgcagccgttctgtaaaaatgcaaatgcggagatgcctatgggctgtcttctcccgagtttaagatatgaccgaaaatttgacaaaatttccgctctttccctggagggaattaagcagatattttcgaacgcagtccatcttttttcacctctgaagtctgaagcctaatcagttcttgcgtttccgtctggttaactacttaactgcggtgtcattggcagcactctcacagattcagatccctcaagtctgccagctgtttggtagtcacgtagagcgactgaaccactgcgcacgcacaggacgactcgtggagttggcgattggaccagatcacttcagccccaggca

SEQ ID NO: 16572 - DNA, 8220 bp, Zea mays
  misc_feature (8137)..(8137): n is a, c, g, or t
aactactagggttggacgaaatattggtagcttgtcggctcgctcggtttatggtcaacttagatcggttcgttggaattttttttcacgagttgagctaacatcctatcttggttcattaacgagcgagctcggtttgttaacgagccagtttgcgagctaccacatttcagcaaaacgaaactatatgcatatcatttacataataattgatgaacatgttatatgtatgtgtggtgtatattgtctatgagttaaactagtcattgatgaactatgtctatgtgataaactaatctatgcgaatataactgtgtgttaaactgatgaacatgtatgtgaattgatgaatgatgagttgtgctaatttggtgttacattcatgtggtctgtgaaactatagatataattattattttctattgttaaattagtttaaaattaactagaaatgattgttatatacatattcaacctgtttggttggtttctctaggcaacctggctgtgtgagccaggaccgctgaagcctggctccacagatgcgaccaatctactcgtatctggtgagcctggcccagagtgctttgaggatcgtgcgagcctggatccagatatgcatgcaggcaaccaaacacagagctcgcacgcacatagcctgggtcacagcaaccaaacagcaactacccgtattccacgatgcaagcacgcgcagatgcaggcaaccaaacgcattgattattttttatgtttgggtttgtgacctaaacaagtcagctcaagcttataaacgaactgacccgaaccaaactgactcaatatctagacgtaccaactactataactaccgaacaatgccaacacaaatagtgttttctagccagaacaccgaccacctccgcaagcatgggcacagatcgtagatggagcagaacaaagataatcaacgaacaaagcctcaacaaaatatctaactaaccgagtgacaagtacatgcaaaataattacaattgcatgatccaccgccgcttgtccgctcgctaaccttgttgtaaagcacaaaaaaaaaaagtgatgacaagcagcacgatacaaatggatgtctaaaaaaagatggtagaaggaggtaaagcaggtggtgtggagtgtggacaagcaaatattatttcaaaggtatgtttcaagctttgagttggttattttgttgaattctctcattgcctctccctggtcattgtacttctctcaacagctggaaagcaaggttactttgctcccagcacacactccgcctagcgttcacaccagcgttcactttctcggaccgggatcaacggatttaggtgatttatttcgttttcgttactcgccgaaaatcgaatttcgttccggatttaagtagatttcgatttaaaatataaaagtcaaaatttggtcaacaaaacaaaattcttatctatgcaaacgaaattatagaccccggtacacacacaaaaaaaggcccttgaaaacaatatatcaagccatggttctgcagagaattttgttaatctcatggagattcattatttaaccaagggggttagaataggaagatcacattataaagagtatagtctctgagaggttttcttacctttttatattgataatatagggttagatatttatagtccaaagattcaaactcttaaaaaaaattataacaactaaatttgggttaaaaagtcaaacaaattataaattgaaacatagggagtagatgtggtctgtttgtttagaatcatatcttatactagctctattcttgaatacttatcgtcccatagttcatttttggactaaaccacgacaaataaaaaagaacgaaggaagtattaatgataaggcaacatatcatggtacatttttagcattaggagaatttagaagtggcgttgagcgctcgtctaacttgtgtaatcacttaggctttgttcggttacaatggatcaaatcatgggcgaagccagaccttattttggggtcaaccgacttcgataattttctgaacatccaatggaaaaacggtgttaataacaagagttttataataaagatccagtagataatattgatgaccccgatagaatattgctagcttcgctactggatgaaaccccactatagatttaatctatgtctggattaggtgaatccatacctcacactcaatcctatggtgagattaaatttattattaaaggtagttattttttatctatggattctattataaacttgtgcaatatctttatggatttattccatacctaatgagttatagatagaactcatgctttctatagtttaaaaaaaaccctaaatccttgggttataatccatcacgggtttaaccgaataatttttttatgtagacttggattattttgggacatggattgtgacatagatttaatttcaatctatactgattcaaagctggattagtgtagacgaacaatatcttatatggtgcaagtctacaaccaaaccctaaacatctaatttatatccaactatatctgctattttgtatttttatcctcttgcatcaccttgcatttattctgcccgtgggatattatagatagtttaatatatccaaataaattattgcagcacggtcataggtccctgactgttgtggcgccgacggaggcgcacatcgatggcgtcgggccgtcggctggctccttctccttccaagttgtcgtgggtctgcaggagtctcgcttcacgcctggcggcctccgccctccggagtccggagtcgtttgagcaggagcatgttttcctaagtttgttattgaggcatggtgcgtccacggtccacccggacttttacgcactgacattggtgatcgtgaaacgactgatttgatgtctagaaataaacatttgtttgagattaaatctggttgtttagaatgttgcagcggtagtctataaaaataaaatactatagaaatagtagatcagatcagtatagattaaagttaagtgcagatactgtgcgtacaaaaattctccaacgaaattagcacttaaaaacaacaaactgcaggcgcgcacggacaaaaccagcttgacagcaaagtactgcgaagagatatagaagtaatgcaaaaagtttgcctttttaacgcaaggaagagccgaaggaggaggtagcaaagtcgcacaattattccgtcacgggtgaaaatagaaaaatcaggtgccggagactaccgaacgtgtgctcgcttccttcagccgtcgtcgtcctcgtctcctcgatgataagaaggggaggtggatcactcgaacctaataagtgagcttccaggccggggagagggactggccggcggaccgccgatggaaaactttggaggctcctaacttccaagataccaactagctcccagcctcccaccgtcttctttccacccttggctgatgctagggagatgggatttttggagctctaagacaaatagttctgctccttgcgccctgcgtgttcttgatctggcctctaagtttgttggctgttttctcgtggtgaggaattatcttccttgttaggtgataagacgttttatagttctccttgaaatttatgcatgctaatttattgattccttttgcagtttgaggtgatatctcgattctaaaaagctaccagatttcttctccctgtttgtatggacaaatttgggaatgaaccctagtctgtgtgcaaagcagccaaattggtgttcttgcggatcaaagctaaagctgcagcagttggtgaggatacaagagatgcagggagaaacaagagaagggcttgttagattctgcagagacactcttattggttgatattttttccatcaactccggccagatttgcggaacctcgcaattttaggagccatttgatcttggacatggagaagcaacccagcgtgcgacatggtgccctagagaaactgaagagcttccgggggatggagaagcagagaagcttcaagttcttgtccatggagaagcagcagagcttcaaaaggaacaaggacagccctgggaagcggggtgacaccgcgctccacctcgcggcgagagctggcagtgtcgcacatgttcagaagatccttgcggagtgtgatccagaactggtggtggagttagctggccgcacgaatcaagacggcgagactgcgttgtatgtgtctgctgagaaagggcatgttgaggttgtgtgtgagattttgaaggcttcggatgtgcagtcagccgggatcaaggccagtaacagcttcgatgcattccatattgcggcaaagcagggccatttgggtgagctttcattccttcataattaaatagtcgagttttaggtagtgtgaattggaattcttttatatacggattcactggtttgtactggcagttctgtgatcttctgtagtactcattctgcttgcaattggtatgtttataaaacttgacttgtatcttattgacttctgcaaatctctatgaccatgaactgtttccctcatttattttccttcaggaacatggagtattaaaacagtgacactgagtccctgatttccttttgctcagatgtctgataaatttactaggctgatctggtctagattacatcctagcatttctttctttcttggttttacagacaaattgttgatttctctgagttggcaatttctatttttctacaatcttgccatgctattgtgtctaaatcaaagaactgacaatcctatatctagtgacgagatatgctccctagtacttgtctgctcagctaggaactttcaccagaccaattaggctatgaatttctgatatttgagttagtatgctgtgtttttttaatgaaaactagtcagtatgttgtgttgaagagcaaactactacacagttgttatttaatcttgttttttttcttcaaaacttgtatattctcttgtttcagagaaagagatcatattaattcagttttggtctttgcagatgtcttgaaggagctgttacaggcctttccctcattagcaatgacaacaaattctgtaaatgccacagctttggacactgctgcaactcagggccacgttgacattgttaatcttctgctagaaacagatgcaagccttgctaggattgcaagaaataatggcaagacagttttgcattcagcagcaagaatgggccatgtggaggtggtcactgcactgttaaataaggacccggggattgggtttagaacagataagaagggacaaacagctctacacatggcttcgaaaggccaaaatgcagaaattctgcttgagttgttgaagcctgatatctcagttatccatgtggaggacagcaaggggaatagaccattgcatgttgcaactcggaagggaaacaccattgtaagtgatattatctcagaatgttctgatttttaccactggtttgagtcttcctgttttacattttaacaatcagatgttttgttgtatttatcgttgaagctatgttgctcaggcgaactactaaaacagagttactcacattcgtgagatatcacttgcttaagtccccaatgttttataaaagaattctaagaagaaattacatcttttcaggaatcaaacagaagtttaattcaggttgtactaaaaaaagaatactttcttatctttttaaaagcaaggaattcagattttggattgaatatttctcaatcttaagaatagcccgcgcgtggccgcggccgaggtagaccattgcatgttgcaactcggaagggaaacaccattatggttcagaccctaatatcagttgaggggattgaaatcaatgcggttaatagagctggagagactgcttttgctattgcagataaacaaggtaatgaagagctcgtcaacatcctgagagaggtcggtggaggaactgcaaaagagcaagtaaatcctcctaatccagcaaagcagcttaagcagacagtcagcgatatcaggcatgatgttcaatcacagatgaagcaaacacgccagaccaagatgcaattccaaaaaatcaagaagaggattcagaagctccacattggtgggctaaacaatgccatcaactccaacactgttgttgcggtgcttattgccaccgttgcctttgctgccatattccaactccccggtaattttctggaggacatgactcaagcacctgacccagacatgaccttggggcaagcattgatagccagtgatccagcctttataatcttcttggttttcgatgctttggctctctttatctcgcttgctgtcgtagtagtccagacatctctaattgttgttgaacagaaggccaagaagaagatggtctttgtgataaacaagttgatgtggctcgcatgcctctgcatctcggcagccttcatagcgctaacctacgttgtcgtgggtcgagacgacgagtggctggcctggtgtactatggcaattggcactgttaccatggtggccactgtcggttccatgtgctactgcgttgtcgctcacaggatggaagagaagagcttgaggaagatcaggaggacctccatgagccagtcatggtccatatcaattgactcggaagcagagctgatgaacagtgagtacaagaagatgtatgccctttaggatgatgtctgttcttgtcggctgagtcttgtatatattggtacccatttgcctgagaccagtccatggcattgagtgggattgactcaatcagaactatatttagtcctagaacatggcacctgtatgtaactgtagtcttgcagcctccagacatgaacataggggtgaagtctaggtgataggtgtagtcactttttttgttggcaaaatacaaatattgccaagcatgatgtccctatatcatgttttgtgtgggtgtggatggcagtgaaaaatgaaaatcattagattgtatctgtatggtagaatagtatggaataagttgtctttatgtcaaaaaaaaaaaaaaaaagggcgcccttatgatgcgacatgagactgactagacggaggcaaaaaaacaatgatcacaaatgccctttgggacattggtccggagaaagctgggagactttgttggccgctgtggttatgcggcatttgcagccgttctgtgagatgcaaatgcctagaggaacttaagagtttttacccctgtttaaatatattcatgttctatttgtgatttcttgctagacgaagatagaggacgagaatgactttttttagtgcatcagaaaagttgttagagagtaaaaaggtatagaaaacggtttttatgtaaacattttttaaataataacttaaatagtgaaatttagaaagactcttatctcggagttaaaacatgaccgagaatttgacaaaattgctgctctctccgtggaaaacacaagaagatatttagagtgtagtccgtcttcgcctctgaaccctgctcagtccttgcgtttccagctggttaactgcggtgtcatcggcagcagtccacaaattcagatacctcaagtgtgccatctgtttggcccacccaccagccaccaccccagtcacgtagcgtagagcgactgaacactggctgcgcacgcacaagatgactcgtggaattggcgaccggaccagatcaattcagcccccgcaatcattcagctacaagtctgcagacaactccgcatgccgcaaacaacatgcggcaacttgctggttggtgttggtggtcaggaagaacagagaggaagcaaagaacatgaggtcagttccaagtttctagtcttcggccttcgtgattgttggcaccgatccggccgccaatcaccacgtcgagaatcggcggcgatgtcctatacaggcgcggacggtccgtggttactggtcagggatggatggtccacaacctggcacaaggctcgggtttcctggctgacgggccggacggtccgcgcgtgcgcgggggcagcggagttcgtcgatggcgcttgaatctcgctcccgagagggaccctatcagagacgagagatcctagggnttgtttttggatcgacagaccacccgagacgcctctagacgacgtagagctgaagaatgaggtgaagaaagctacgttcgtta

SEQ ID NO: 16573 - DNA, 917 bp, Zea mays
atgaccctggggcaagcatggatagccagcgagccagctttcataatcttctgggttttcgacgctctggctctcttcatctcgctcgccgtcgtcgtggtccagacgtctcttgatcgtcgtcgaacagaaggccaagaagaagatggtcttcgtgataaacaagctgatgtggctcgcgtgcctctgcatctcggcggccttcatagcgctgacctacgtcgtcgtgggccgagacgacgagtggctggcctggtgtacgatggcgatcggcaccgtcatcatggtggccactctgggttcaatgtgctactgcattgtcgctcacaggatggaggagaagagcatgaggaagatcaggaggacctccacgagccagtcgtggtccatatcgatcgactccgaaacggagctgatgaacagcgagtacaagaagatgtacgccatttaggataggcaacggccatgcttgccatctgagtcctgtatatattggtacccacttccacttgccttgcccgtgaccagtccatggcattggattgactgagctatattttagtcctggacatggcgcctgtatgtaactgcagacagtctgcagcctccgcccacgaacgtagatagggtgtagccacctttttgttggcaaaatatgaacatttgccaagcacgatgcccctaccttatgctgtattttggtgggtgcggcaatgaaaaccatgggattgtatctgtatagtagaatagtatggaataagttgcccttgtgtcaaaggttatggggtcgtgcgtggatgctcttttgatgcgacattaggctggatggtcaaaaaaattaccaatggtcacagatgacattttggactaaaaaaaaaaaaaaaaaaaaaaaaaaactcgagggggggcccggtacc

SEQ ID NO: 16574 - DNA, 572 bp, Zea mays
ttgtcgtgggtcgagacgacgagtggctggcttggtgtactatggcaattggcactgttaccatggtggccactgtcggttccatgtgctattgcgttgttgctcacaggatggaagagaagagcatgaggaagatcaggaggacctccatgagccagtcatggtccatatcaattgactcggaagcagagctgatgaacagtgagtacaagaagatgtatgccctttaggatgatgtccgtgcttgtcggctgagtcttgtatatattggtacccatttgcctgagaccagtccatggcattgagtgggattgactcaatcagaactatattttgtcctagaacatggcacctgtatgtaactgtagtcttgcagcctccagacatgaacctaggggtgaagtctaggtgataggtgtagtcacttttttgttggcaaaatacaaatattgccaagcatgatgtccctgtatcatgctcttttttgtgtgtgcgtggatggcagtgaaaaatcaaaaccattagattgtatctgtatagtagaatagtatggaataagttgtctttatgtc

SEQ ID NO: 16575 - DNA, 2618 bp, Zea mays
gtgctcttccttcagcagtcgtcgtcctcgtctccgcacgagaccattaccgagtgggtccctctcgaacgaataagtgagcttccaggccggggagagggactggccggcggaccgccgatggaaaactttggaggctcctaacttccaagataccaactagctcccagcctcccaccgtcttctttccacccttggctgatgctagggagatgggatttttggagctctaagacaaatagttctgctccttgcgccctgcgtgttcttgatctggcctctaagtttgttggctgttttctcgtgtttgaggtgatatctcgattctaaaaagctaccagatttcttctccctgtttgtatggacaaatttgggaatgaaccctagtctgtgtgcaaagcagccaaattggtgttcttgcggatcaaagctaaagctgcagcagttggtgaggatacaagagatgcagggagaaacaagagaagggcttgttagattctgcagagacactcttattggttgatattttttccatcaactccggccagatttgcggaacctcgcaattttaggagccatttgatcttggacatggagaagcaacccagcgtgcgacatggtgccctagagaaactgaagagcttccgggggatggagaagcagagaagcttcaagttcttgtccatggagaagcagcagagcttcaaaaggaacaaggacagccctgggaagcggggtgacaccgcgctccacctcgcggcgagagctggcagtgtcgcacatgttcagaagatccttgcggagtgtgatccagaactggtggtggagttagctggccgcacgaatcaagacggcgagactgcgttgtatgtgtctgctgagaaagggcatgttgaggttgtgtgtgagattttgaaggcttcggatgtgcagtcagccgggatcaaggccagtaacagcttcgatgcattccatattgcggcaaagcagggccatttggatgtcttgaaggagctgttacaggcctttccctcattagcaatgacaacaaattctgtaaatgccacagctttggacactgctgcaactcagggccacgttgacattgttaatcttctgctagaaacagatgcaagccttgctaggattgcaagaaataatggcaagacagttttgcattcagcagcaagaatgggccatgtggaggtggtcactgcactgttaaataaggacccggggattgggtttagaacagataagaagggacaaacagctctacacatggcttcgaaaggccaaaatgcagaaattctgcttgagttgttgaagcctgatatctcagttatccatgtggaggacagcaaggggaatagaccattgcatgttgcaactcggaagggaaacaccattatggttcagaccctaatatcagttgaggggattgaaatcaatgcggttaatagagctggagagactgcttttgctattgcagataaacaaggtaatgaagagctcgtcaacatcctgagagaggtcggtggaggaactgcaaaagagcaagtaaatcctcctaatccagcaaagcagcttaagcagacagtcagcgatatcaggcatgatgttcaatcacagatgaagcaaacacgccagaccaagatgcaattccaaaaaatcaagaagaggattcagaagctccacattggtgggctaaacaatgccatcaactccaacactgttgttgcggtgcttattgccaccgttgcctttgctgccatattccaactccccggtaattttctggaggacatgactcaagcacctgacccagacatgaccttggggcaagcattgatagccagtgatccagcctttataatcttcttggttttcgatgctttggctctctttatctcgcttgctgtcgtagtagtccagacatctctaattgttgttgaacagaaggccaagaagaagatggtctttgtgataaacaagttgatgtggctcgcatgcctctgcatctcggcagccttcatagcgctaacctacgttgtcgtgggtcgagacgacgagtggctggcctggtgtactatggcaattggcactgttaccatggtggccactgtcggttccatgtgctactgcgttgtcgctcacaggatggaagagaagagcttgaggaagatcaggaggacctccatgagccagtcatggtccatatcaattgactcggaagcagagctgatgaacagtgagtacaagaagatgtatgccctttaggatgatgtctgttcttgtcggctgagtcttgtatatattggtacccatttgcctgagaccagtccatggcattgagtgggattgactcaatcagaactatatttagtcctagaacatggcacctgtatgtaactgtagtcttgcagcctccagacatgaacataggggtgaagtctaggtgataggtgtagtcactttttttgttggcaaaatacaaatattgccaagcatgatgtcccgatatcatgttttgtgtgggtgtggatggcagtgaaaaatgaaaatcattagattgtatctgtatggtagaatagtatggaataagttgtctttatgtc

SEQ ID NO: 16576 - DNA, 2481 bp, Zea mays
  misc_feature (2464)..(2464): n is a, c, g, or t
tgcttacatccacaccacccgagatatcagtgcttcgatagtgcctaactcggaagtcggtctttgtcttcttggatcaggctcacccgactcggctatatcctattggtccatcccatagtatgaaccaacgttttagtgttcatgagaatccgggggatctctatcccccacaacttttcctaggcacaatctagggatcatcccaaggtccagactcactactagggcaatatagagataattagtgtttggtctaaaaagaccttaacacccacgccttctgctagctactagtatgggtgggtccctcccggcggccgcgggagatggactaatagcatctgcctgcctgcactggactcaaaaacatgcctgccgtaggatcctctgatgtgtccattcgcgtgttgagtcggcggcttgtgaaggcatccgacccctccctccagccgcacgtcgtcaccttctcaaacctagatctctacccggacaacgtgcaggcctccatagtgtgcctctaccccaagctgtcaacaaagtccggcccgggcggcggcttcgacgccgtcgtctccaccttcgaggccgtcctgccgaccttgcttaaccacttctaccctctcgccggccgcattgtcgtcaacccaagctccggcgtccccgagctccactgccacaaccagggcgcggagctcgtcgtgggagaggtcggcgtcgccctgggcagcctggattacggtctcgccgaggagtccctgaagaagatcatgatgccgtaccctgaggacgtcacgctctcggtgcagctgctgtccttcgcgtgcggcggcttctccgtcgtgtgggccaacaacaacctcctcaacgacggcaacgccatcaccatgtgcgtcaggatgtggtccgagctggcacggaccggcgggagcatcgccaccgtgggagcggtgtcagtgaaccacgaccgctcgatgttccgcccgcgcaacccgccggcctacagcgacgcgctcgacgccatgttcgccacgtacgacgaccaccggacggtgaacgccctgacggccgccgccagcttcgtggagcgcctctactacgtcgaggcggccgacatcgccaagctgcgggacatggccactgtcaccgagctccagcgtccctcacgcgtccaggcggtgtccgcctacttgtggaaggtcctcgccgccgtcgtggccgcgtgccgcgtgcccgaggagcggtgctgcatgggctggatggtggacgctcggcggcgggtgaagtcgcccgagctgatccccgcgatgcgcaactacttcggcaacgtcacggcctacgcgctgggcggcgcggccgtggaggagatccggcggaagccgctggccgaggtggcggccatggtgcgggataccatcacgtccatagactacgacgagtacctgcaggagctggtggactgggtggaggtgcacaagacggagcacgtgatggagaagggcgtcctcgggctgggctcgccgacgttgaaccagaccgtgttcgcgtcgttcccgctcgacacgaacttcggcttcggcgacgccgcgctcgcgctgcccatctgcgactatgggaggctttgttcgggctacctgtccgtcggagcgcggcctggaggcgacggctcctggctcctcagcgcctacatttggccgcagatggcggcggcgctggagtcggacggcgtctttaagcctctcacggcggagtatctcggtctcacagtcacaccctagcggcgacgtggtcgatctacatgcgctgcatgcatatcagatcagaatcatgcatgcgcgctaccttgcattgtgtacgtcgttcgtgtaataatgttgcatggtctcgggccagtgctaaataaaaatctctgttaattttcttcccaagagacatgaaagaagctcctatgagcacttcctctaatgctatctctgacagctagcttacccatctttaacaagcgagtgagctcatagatagagaaaaagagagagatgggtatactaatagaccactcattaacaagggaggcatccacctctattaatcagctattaatagaggcaagcgtcttacttgtctctcttaggacatgtacaactgtagtacagttttttcaagtaaaaggcacaactaagacatatataggtataaataagatgtatctaaacttctataaggtacgacttcatttatgtaggttgtattaggtgaagttgtgctttgggcttcgagtatcgagccagaggtgtgtctcgatgaagacatagtttcttcattttttatacctatctctctaggtccaatccatagtagcatactcatttaatacatgatacataagtatttttaataatgtggcaagagaattaagaggaaatagaagaaagttgtatgttaaaaacaagtttaataatatagncaacagatggatgtaaa

SEQ ID NO: 16577 - DNA, 1726 bp, Zea mays
gatacataaatctgcctgcctgcactggattacaaaatgcctgccgtaggatcctctgatgtgtccattcgcgtgttgagtcttcggctcgtgaaggcatccgacccctccctccagccgcacgtcgtcaccttctcaaacctagatctctacccggacaacgtgcaggcctccatagtgtgcctctaccccaagctgtcaacaaagtccggcccgggcggcggcttcgacgccgtcgtctccaccttcgaggccgtcctgccgaccttgcttaaccacttctaccctctcgccggccgcattgtcgtcaacccaagctccggcgtccccgagctccactgccacaaccagggcgcggagctcgtcgtgggagaggtcggcgtcgccctgggcagcctggattacggtctcgccgaggagtccctgaagaagatcatgatgccgtaccctgaggacgtcacgctctcggtgcagctgctgtccttcgcgtgcggcggcttctccgtcgtgtgggccaacaacaacctcctcaacgacggcaacgccatcaccatgtgcgtcaggatgtggtccgagctggcacggaccggcgggagcatcgccaccgtgggagcggggtccgtgaaccaccaccgctcgatgttccgcccgcggcaacccgccggcctacagcgacgcgctcgacgccatgttcgccacgtacgacgaccaccggacggtgaacgccctgacggccgccgccagcttcgtggagcgcctctactacgtcgaggcggccgacatcgccaagctgcgggacatggccactgtcaccgagctccagcgtccctcacgcgtccaggcggtgtccgcctacttgtggaaggtcctcgccgccgtcgtggccgcgtgccgcgtgcccgaggagcggtgctgcatgggctggatggtggacgctcggcggcgggtgaagtcgcccgagctgatccccgcgatgcgcaactacttcggcaacgtcacggcctacgcgctgggcggcgcggccgtggaggagatccggcggaagccgctggccgaggtggcggccatggtgcgggataccatcacgtccatagactacgacgagtacctgcaggagctggtggactgggtggaggtgcacaagacggagcacgtgatggagaagggcgtcctcgggctgggctcgccgacgttgaaccagaccgtgttcgcgtcgttcccgctcgacacgaacttcggcttcggcgacgccgcgctcgcgctgcccatctgcgactatgggaggctttgttcgggctacctgtccgtcggagcgcggcctggaggcgacggctcctggctcctcagcgcctacatttggccgcagatggcggcggcgctggagtcggacggcgtctttaagcctctcacggcggagtatctcggtctcacagtcacaccctagcggcgacgtggtcgatctacatgcgctgcatgcatatcagatcagaatcagatatcgttcgtattgctcattgttgattgcatgattgcgcgctaccttgtattgtgtacgtcgttcgtgtaataatgttgcatggtctcgggccagtgctaaataaaaatctctgttaattttcttccaaaaaaaaaaaaaaaaacaccaaaagaaaaaaaaaaaaaatcgacggggcggccgctctagaggataaacccccaacaaaaaaaaagggggggccgttttaaa

SEQ ID NO: 16578 - DNA, 2009 bp, Zea mays
ccctccataattttttttatccagattctgttatagatccgggcaatacagtttctatatcatataaccatcaattttaggccttttttacaaaacctcctaatgacttctctctttatctgtttgtcaacaagaacatcaaataacaaacaaaacgttgtgtacgtatttcttattttacatccagacaagccagctcacttcctcaattaaaaaaaattaagagaataataactgtgatcagttcgacgataatcaatgggtcgctggtgacagccgacaacatcctagtaaaatgtagagctgttcattggtgaagtatgtataatgtgtaagcttatactgagtactataaggtgagaattcattttatcgctcggcatacaagctaggtcttggtagcactacctatcgacttcagcttctgcacttgcagagttgttgcatgaacatatagtagtagaacctaaaaaacaggaattgagtttttaccgaaataaactgcggaggatcatcgatgctagaagagcccaagacgatttcgcgcttcattttcattgtaagcttgtgcaccgtgcgcagctgattcatatgaaatgataaatacagtatataatatgccaaccagattgggaattcgtttttttaatgcagtagtataagcacatggcgtacttcagatctagtggctccaccaatcatgaagacaaaaatccggttgcctagcctcttgaagtcacctgatgcgtgtctcaggactgaagaatcactgccaatccaatttaccatggtaataaagcggttattagttgaccaaaacaagatatgttaaaaggtttcatattgctcgagtgggtcaaatagaagactattactaccttgaagaatcatccgaattacgagattttgcccatgttggtgtcctccttgatctcatagacatcggttgtggattttgtgctggtcgtgcagttgatgatgcagtttgtgtggcatcttgagaagcagaagcagaacttggttcactcatagatgggtactcttttagaggtaattcacccttgctcagtttctcaatcagctcctgttagtgaaacaaggaactccagctattaccactcatagttcagcatgtaaccacaatttagacaaaaacccatgcaaagtaaaagtaaaaaagagaacgtctttgagaggactataggcctgcttgtttaagctgcaatatctagagctttttttgaaaagccgtttgatcatgagaagacaatggtagcttttagatgatgctattacttcctaaactaatgaagctacgtacaacgcacaaaacagagtaccagacttttcacaagctaaataaaaaagccggttgcttctttgagcttctgacttttcacgttgataagtattggactgtgaagtcttgatatattgcatagagaaggggtacatatatagacttaaccccaaccctaatgggcagacagcctaaaagtggtgccagcccataccagcccataccagcccatacacacagtctaacaacccccggcaatgcgattgggatagagatcggtgttgactccgagaagacgatagcccctgaatgacgaggtagccaaagtcgaggtggtcgtggtcgagagaaacgcagcagtagcctgttattcgggaggggtcgacattcgagcgtcaacggtcggcagggcgacacaaaagggacaacagcttcgtgggccttctggcttcttttcacgtccgatagtcgagaagcctgaccaggtaggctgacagtagagcacacgtctgcgccggtcagggcccttggcagaatgagcaccgagccatggtgtgtggcgccacacgagcttgctgttgcaccctgctcccgcagacagctagctcgatgtaccacatcttaggggccatctgccacagcacgaaacggccaggcgccgccatgtccagcgttttcttggtgaggcggtcggcggtctcgaactcgg

SEQ ID NO: 16579 - DNA, 2275 bp, Zea mays
cggccgggccgggtccctcgctgccggccgggccgggagctcccatcccagatcaggattagccgaccacccgccgaaggccagagagaaatatctcatcttctctccaccggatcggttcaatcgagagcgagggagaaagggaggtggtgcgtcgaggggggccgagattttgccggtttggagccagataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttcgtggtccttttgcgctttctcgtccctctttctctcaatctctccttattcttctccttccacggcgaagccggcggctggtatggatcccaatggcctcaaaactggaggccttttgctcccgaccatcgagaggcggtgcacgtcgcctccatccgtcattgtcatcggcggtggcatctcgggcgttgcagctgcccgtgccctctccaattcttcatttaaggtgactgttttggaatcgagagatcgtattggcgggcgcattcatactgataactcgtttggatgcccaattgatatgggagcctcatggctacacggcgtgtgcaatgagaatccactggcaccattgataagctatcttgggctgaggttataccgcacaagcgatgataactcagttctgtatgatcatgatttagaaagctatgctctctttgataaggatggtaatcaggtcccaaaggagacagtcgataaagttggagaaacattcgagagaattcttgaagagacggtgaaagtgcgcgatgagcaggaacacgacatgccactgctacaggcaatttctattgtgtttgagaggcacccccatctaaagcttgaagggctagatgatcaggtcttacaatggtgtgtctgccggcttgaggcatggtttgctgcagatgcagatgaaatatctctgaagaactgggatcaggagcgtgttcttactggtggacatggactgatggtaaatgggtactatcctgttattgaagctcttgctcaaggtcttgacatcaggcttaaccaaagggtcaccgaaattacccgccagcacaatggagtcaaggtcactactgaagatggcacaagctacttggccgacgcctgcataatctcagtgccactcggcgtgctcaaggcgaacgtaataaagttcgagcctgagctgccccagtggaagagctccgccatcgccgacctcggcgtgggcaccgagaacaagatcgccatgcacttcgacagggtcttttggcccaacgtcgaggtgctgggaatggtcgggccgacgcccaaagcctgtgggtacttcctgaacctgcacaaagccaccggcaatccggtcctcgtgtacatggccgccggaaggttcgcccaggaggtggagaagctgtcggacaaggaagccgtcggcctggtcgtttctcacctgaagaagatgctcccggatgccactgaaccgacgcagtacctggtgtcgcgatggggctccgaccccaactccctggggtcctactcgtgcgacctggtcgcgaagccggccgacgtgtgcgcgaggttcgccgcccccgtcgagaacctgcacttcgccggcgaggcggccagtgccgagcactcggggtccgtgcacggcgcctactcgtcgggcatcgccgctgccgaggaatgcaggaagcggctcctggcgctgaagggcatcccggacctggtccaggtcgcggcgtgggaggagatggccggagctgtggctcctctgcagatttgcaggacctgagtgagattggatcactggctgcctttggacattggagtggatcgtggatcgcttcgctgctccctgatggttgccgagtctttttttatatttaccttaccttgaaggccgttgtgtcttgtctggaataaatcaagattgactggcactgaaagtgtcatcgcgtcactctttcatacttattaataaatatcacaagtctgtcctgagatctcagcctggtgcctgcgtgctgcctttgccttgtatatgacgttttactttcttttagtctcaattattcaattttttttttcacaaaaaaaaaaaaaaaaaaaaaaaaaaaaaaaaaaaaaaaaaaaaactcgagggagggcgccggtac

SEQ ID NO: 16580 - DNA, 1684 bp, Zea mays
cctcgagccggcgggacacgaccgggaccttgaacccgacgagatcccagcctccatttccaaatccacacctggcccggctgccccaaatgcgtcggcatcgcgccgtcgctgctgcacaccgtcgatgactcccgccccttcgaacgccgccggcgacctcttcgctgccaacctcacgggcgcgctccttgcggttgcctcctccgccttcattggcgtcagcttcatcgtcaagaagaagggcctacgccgggccgccaccgccggcgcccgcgcaggtgttggaggctatgggtacctcttggagccactgtggtggattgggatggttacgatgctgattggggagattgccaattttgtggcctacatgtttgcgccagctattcttgtcacccctcttggtgcgctcagcataattgtcagtgctgttctagcccatttcaccctgaatgagaagctgcagcggatgggtgtgttgggctgtgtgctctgtataatcgggtcaaccataatcatcctccatgcacctgaagaagagacaccaagctcagtgacacagatctggcagttggcaacacaacctgcctttctttgttatgcggcttctgcattgactatctcactgatcttgatatttcactgtgcaccccgttatggccagacaaacatcgtggtgtatgtgggaatttgctcagtgataggatctttgacggtaatgagcatcaaggcagtaggcattgctatcaagcttacaattgagggcataaaccaggctggctatttccagacttggctgtttgcaactgtttcagctacatgcataattattcagttaatttacctgaacaaggcattggatactttcaatactgcagttgtttctcccatctactatgcgatgtttacatccctcacaattttggcaagtgccataatgttcaaggactggtctgggcagagtataagcagtattgcctctgagatttgtgggtttcttactgtgcttactggtactgttgtactgcattctacaagagaacatgatccaacccttacttcagatctgtatgctcctctttccccaatatattggcatatccaaggtaacggtgaaacaggaggaaagctgaaagaggatgatttactctctggcaatttcatcactgtggtgcgacaagactactttgtctagagaccttccacgatgctcaatgttctggattaaaagaaaagagaacaacactacggaaggatcctactgatgcccagtgtactgcggcttccccactgtgctcatgaacagacattttttcctgccttccaaacaggcccttagaatttgttgaaaagttccagtttgatcacaggcatctgggccgatgccttgtagtaagatgtaagcaatccgtcctctggccgggttgagcaaggcttggctgcagtgtatcagggtggtgcagctgatgtatttatactgtacaatctagtgtgaatgtatgaactagagctatcagaatctgcacagatatttcatgacagactctgtccagcatgttaagttatatattgctcctgacttgtgattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 16581 - DNA, 2016 bp, Zea mays
tggggtcttgatcttcttgaaatgggggggggagacacgatcttttaattcatgtctctcctttcaactccgaaaaaaacgcgctggggttgcagtggttgcgagagattcaaatgttcatgtacactgggaaaggagctgctgaaattgttcttgccttgtgcacaagtgggggtgggggggatggctcaacacatgaaatgacacctgataaggctaatcaactcaagaaacttatagaagatatggctgagcaaagtcttcgatgtattgcttttgcttatcgaaatcttgatatgaaggatgttccaagtgaggagcaaagaatcaactggcaattgccagataatgaattgactcttattggaatcatagggatgaaggatccttgtcgccctgacggacgaggcggtgtcgaactgtgcaaaaaggctggtgttaaggtacgaatggtaactggagataatctgaagacagctaaagcaatagctcttgagtgtggaatactcgatgactcagaggcatctgcacaagctataatagagggaagagttttccgtgcttacgatgatactgaaagggagaatgttgctgacaagatttctgtgatggcacgatcttctcctaatgacaaacttctcctagtaaaagctcttaagaaaataggccatgttgtagctgttactggtgatggaacgaatgatgctcctgcattgcatgaggcagatattggtctttctatgggcatccaaggaacagaagtagccaaagagagctcagacataataattctggatgacaatttttcttctgttgtgaaggtggttcgctggggtcgctctgtttatgcaaatatccaaaagtttattcagttccagcttaccgttcacgttccaagctttcttgtcttcaacagttgttgctgctgttccctcaggaaatgttcctctaaatgctgttcagcttctctgggttaatctcatcatggacacactcggtgctcttgctttggctactgaaccaccaacagatcaacttatgaggcggccaccagttggacggagagaacctcttgtgactaatatcatgtggagaaacttgtttattcaggctgtctttcaagttgctgttcttctgactctcaactttaggggtcgggatcttttgcatttgactcatgacacactaggacactctagtaaagtgaaaaatacacttatattcaacacatttgtattgtgccaggtgtttaatgaggtcaattctcgtaaaccagaagaactgaacatcttttccggagtttcaagaaatcatcttttcttggcagtagtgagcataactgttgtgatgcaggtgataattattgagttcctcgggaaatttacatcaacagtgagactcaactggaagctttggcttgtttctgtagttattgcttttctaagttggcccttggcttttgttggaaaattcattccagttccgaggactgaattgaaggatctcattgtaaggtgttggcctaaacgtggcgagagtgcagcacaacagactcaggatgacagaatggaagtatcagtgtgaagctgttcttgagcaacttctcgaaattatcagatgttagtgttggtgcacatagatggtgttggctaattttgggtgctgatttttctaaccatcctaccttgttgcctggctatgaattctatggctgtagtcagcaatcggggaggtaaacctctgctgactcgtgatctagaatttgaacactgtaaacaaaatatgtttattgtagcctaacgaaggtcaggacctccagtggtttattgcacaagttgtgcagtcggtcccagaaccatttggggaaggcgctataaacagttttttcttggcaggagtggagtgtagctctttttcgctaatatcatttttacttttagatgcaatcaagtgctttttctcaatcacgctggtacgtggtggctgattttgttaaaaaaaaaaaaaaaaaaaaaa

SEQ ID NO: 16582 - DNA, 2809 bp, Zea mays
  misc_feature (2410)..(2410): n is a, c, g, or t
cctcgggttggccgggtcagtagcacatgagaatttagctacaaagacatgtgtccacccacctactagtaaaattgatagcttgcaaccacttaaggaaagatcatgtccaacagaaagggactcaatcactcaattagagcatctgtttgaagagaatgtggtaaagagaaataacgaagtggtcaatcctgtatctgatgctgaagggattgctgtatcagatgtgttggaatcgttaacagaacaagattgtgaaaaatacagtacacatggagcgcgtggtcgcggccgcggtacacatggagcagcgcctttacaaaatttggtgccagcttcagccgaggaagaacaaccacaatgctccagtcctattgcatcgtccccttggggggaaccaagttactatcagggtgaagctgttgattctgctctatggggcgtccaggatggtaatgacatgtggtcaatgccttcaccaacacctggtctccagccttcatcagaggaggcgagagcggaccatggagatggtgcatttgtcgaaacattaccaagacaaggggacgaaaagacggaacatgcaaactcaagtgtctcaggttctggagtgccagaacaggtaaaaccaaaagcaagcactgcatcaggtccatctctagatgggagcacaaaagctttgggttggcaactgctgggctcatctctagaggggagtgcaaaagcttcaggctggaaaccgccagctttatcgattgaagggattgctaatgcctcaggttcgcaagcattgtatcctacgcaagggagcacaaaatcttcaggttgtcagcgatcaagttcatccccagatgggagtagaaaagcctcaggttggcaacagtcaagtacatcaccggtggggagtggaaaagctcatggctggcaacgatcaggttcttttacccagggtggtacaaaagctgcaggctggcaaccctctggttcttctacagatcggagtgcaaaagttgatggctggcaacgaacaagttcatctccggagggaaacagaaaagcttcaggctggcattcatcaggtcgtgagagctcaaagatcacatatggtgccagtgaaaaccgtaaatcattttctagccaccaagcgacgacaccaacagggagacactctttggcaaggaggcagggaagcagcgacaagggtgctgctggttgggaagagagtctaggaaacacttgggaagcatcaaagagacaacagagaaacagcgacaagaatgcaggctgcggagaggctctcggaagcaacaggacctggcacccatcgtctggtaaccccagtcggagcagccaggggaatcaccaacatgacaggcattctcacggcagtgattcgcggcggggtagctcaaactaccctcggaggtccgaccatcgtcatgaccatggcagtggtggttcgtcaagaccctcgtcaagagggcagccccagaggggggtttgtaaatactacgagaatggccactgctggaagggctcgaaatgccagtacctgcaccgatgactgccgtgaccgtgggaagcggaacgccctcacatttttgtatagcagcatatggtctcgtcgtagtcagtaaaaggaggaactgtgtcggcgggaccactagttcgtagtagtacatatccttcagagcaggagcatgactaaagattctccgctttggtgcaggaatgcgccccttttgttcagttaaacggaggtgtgggcatttgcaaacatggattttctccataagccagggtgttgtgcaatcgtacggaataactactgaagagctgcacgtccgattgagaatgacactacggaagaggcgcatgcaaatcgtccgaatgcctacagaagagcggctatcggctggcggtagacatgtgaacggagtgctgtccccaaactgacgcggctaatgggacgaaacctacatcaaacccatccaaacccattgcaaataacttatttttttaacccaacctaatataataatttaactgaataacccacccggaccaatagccagtggttaaacccattatctaaatccatagaagattcatgtttattaaagtggattcgctaccatattccgactttaaaatttttacaaaattaattgatttctttgcaacagcgcagagcttcggtgtgccgtcggttgggagactgccatgttagaccttgtttggttattcccattatatatggattgtatgggttggaaaaaatttagaagaactttaacttgtttgagatttaaactcactcaatcccactcaaaccatatggattgagagctaaccgaacaagcccttagatgactattggaaactagccattgtacctcaggttcggtgnaccaccggactaatctggatcgtcagttggtcgagagccaaagaaaatgctttttgcgggtgcaccactggatcggtctgatgcgtgagccgacaacccactttttgattcttcaatcttctttgcttgggccttttttgtcttatgtcttggacttgtgttgaatgtttgtaagccttctttaggtcttttaatgtcttcgtttagatgttgcactgtcagagccttagtccaatccactttatatcatgtgaattacaaaacataaacacttgcaaatatatttgtccacatgttatattgatcattaagtgctaatttgggaacctcattttcctaagagatttctatttttcccaaaggaaaattagtttattttcccttggaaaaatagaaatc

SEQ ID NO: 16583 - DNA, 4173 bp, Zea mays
  misc_feature (36)..(36): n is a, c, g, or t
  misc_feature (40)..(40): n is a, c, g, or t
  misc_feature (3999)..(3999): n is a, c, g, or t
  misc_feature (4043)..(4044): n is a, c, g, or t
tccgcggccgcgtggggtgaaaaatcatacactggngcanttgtgaaaatacagtacacatgagcagcgcctttacaaaatttggtgccagcttcagccgaggaagaacaccacatgctccagtcctattgcattgtccccttgggggggaaccaagttactatcagggtgaagctgttgattctgctctatggggcgtccaagatgaccctggtaatgacatgtggtcaatgccttctccaaaacctggtttccagccctcatcaggtgaagatgactatctttttctgtggttgctttcttaaacaactttttagtctaacaaaatcttctacaggtcttggagctgatggcaaagacgcttcatgcatcatagaggaggcgagagcggacccaggagatggtgcttttgtcaaaacattaccaacacaaggggagaaaaagatggaacatggaaattcaagtgcctcaggttctggagtgtcagaacgggtaatgttattcataactggtctgcggttccatcttgattcatcccttgaagaggaaaaaacttagtaacacaatgttctagccctcaggttccggcgcgcccgttcgggtaaaaccaaaagcaagcgctgcatcaggtccatctctagatgggagcacaaaagttatgggttggcaactgccgggctcatctctagagggcagtgcaaaagtttcaggttggaaaccaccagtcttatcacttgaagggattgctaatggttcaggttcacaagcatcgtgtccttctacgcaaaggggcacaaaatcttcaggttggcagcgatcaagttcatccccggatgggagcagaaaagcctcaggttggcaacagtcaagtacatcaccagaggggagtggaaaagcgcatggctggcaacgatcaggatcttttacccaggggggtacaaaggctgcaggtcggcaaccctctcgttcctgtacagatcggattgcaaaagttgatggctggcaacgaacaagttcatctccggagggaagcagaaaagcttcaggctggcattcgtcgggtcgtgacagctcaaagatcgcatccagtgccagcgaaaaccgtaaattgtcttctagtcaccaagcgacgacaccaacagggaggcactcgttggcaaagagacagggaagcagcgacaagggtgctgctggttgggacgaggctctggggaactcttcggaagcatcgaagagacaacagggaaacagcgacaagaatgcaggctcgggagtggctctcggaagcaacaggagctggcatccatcgtctggtaaccctagtcggggcggccaggggaatcaccaacatgacagggactctcacagcggtgattcgcggcggggtagctcgaactacccccggaggtccgacaatcgtcatgaccatggcagtggtggttcgtcacgaccctcgtcaagagggcagtcccagagggggctatgtaaacactacgagagtggccactgcgggaagggttcgaaatgccagtacctgcaccggtgatcgccgtggccgtgtggaagcgggacccctgtttgcctggccgtcctcacatttttgtatagcaggatgtggtttcgtcgtagtcagtatagtagaacgcttattaaccgtgtcggcaccactaagttggtagtagtacatatctttcagggcaggagcatgactaaagtaggatttgtaagttttattagagccactgatggccttggataaagattctccgctttttggttcgggaatgcacgctttttgttcagctaaacggagttgtgggcttctacaaacatggattttctcgctaggtcagagtgctgtgctatcgtacagaacagctgcacgtccgagtggtcacggacgaggcgcgtgcaatcgtccgaatgcctacaaaagagtggccaccggcgtgtggcagacatgtgaacggttgggcatggtttagcccacagataggagatctaaggtatggcaaaacatagcaaggatttttgactcagtgattggctccaaatccagctagctagcaagaagaccgtagtcaactgtcaacgtgccaagcaaaggctgaagggcccatagagagtagtagcctggaggctggaggcctggtaacggttcgcagcaaaacttaatttccttctatgtgcttatggtacacagtgattttggggtaaattcactagaaaattaaggtacggcggacgccatatattgctatactcagagctccgccctgtctaaccggttcactattactactgctacgatgtcgactactatattttcaccagcgaccggtaagtagttttagttttttaatattttgtataaaatattaattccagatgtcgatatgtatggactatatgtatatagcagtagttgacatggtatcgccggctacatcatgcgtacgcacgcacgcgcgggtgaattcaattcagataaaacttgaatgtttccaaccgatcactttctcaccaaccgcaagccagcacctaccacaattctctgtcccctcttgtcggccctggcgggcctgtccatatgggtcagtcgatagctagcaacacctcgaaagagtcagaatcagcagtcagcgttcgacaacacacccatcatcagatgtagcgcaaaaagccgaaaacgttggtcttctggaatggtatggaatgagttgatcgagcgacaggctagggtcagcatcgtctgcgcccgtttccaaatcatgcgtgcactagaccgagttgtgcactgtccgtataggtcctctctgttatcaatgtaaatgtgttaaggtattactgaggccgccgtgtttgatctcgatctctctcctaaggaaaataagattacggacctgtttaattactgctatattcatcttaatctacgtttgctgaagtgaattatgttgaggtgggtatattgatgtcttgtttgggagagctcaccttcgctaactccgccccaactcagctttattgtcaagttgctgtttttttttcaagtgtttggctcgcgcaggccgactttagtttcacgaatttggtagcttggttgaaaaaagtcatttttctcctgatcaaagtatattcaccacatatttttgttgcatcaatgataacataagtgatttaaaataaagtatacgtatatatgataataacaaatcaaagtcacatgactaaaggcacaacataaaacaatatttaattcaaaataaaacaaagtgattagaaatgaagtacacgaacacataatgttcaccacacaaacaaaagtgattacatgtttaaacaatcagaccatagtatctgtcgtacttatcattatattataattgaatctcattcctctgcttctcgccatgtccttgtccctagatgcatcggcggctgcacgcaggaagcgccctcccttagcgctgctaggcgcttgcggccttaaaaaacttggccggagagggaaagaccgtatttccggtattccatataggaagagaccgaaacgatggtcccgaccgagaaaatctccgaaccttggccccatcactaacgggccggcatcaactatccactctgcaactgcccaaccgaagggtggcgcacagaacatcgtaacccgacagcggataagacacagcgaggggatttttttttaaccaagcctgaaaattcgctcccgataggaatcgaacctcggacttggaggtgctactcggaagtccttaactgttaggctagaggccctttcgcggcgcttgcggcctagctaggcgacatggggaggcaggccagggcatggccaccgacgtcatgggagtacccgaaatgaaagaccgggaggaaaagaaacacttcgaaattagtcgatttgggagccacatcgtcggatcttgtcgtttgagaggtagagagagaggagtcggggcaaataggttgggtgcgaaatcnaagaaaaacccatataactatcttcagcagtttacttatattannatcatatcttctgttttaaactacactctgcaaacagtacaatctatagtgcaaaatagtgttttaggtgaccaaatggataacctgctggagacgttctaaccagcacaacggtgggtaagttcaccc

SEQ ID NO: 16584 - DNA, 3002 bp, Zea mays
gaaccttgattgttttgtaggtgtaagctatgttttcttaaataatttgattgagagatctaatagcctcctgaacttgtgggcaacatccatccgaacaggcgacctccatatatacaacatcaaacatcctattcctgaacttgtaccaccagttacattttaattttggacccagtgttgctggtggttttgcttatgttggcgggtgatatccctattgtgtattattatgatgagaacaatttgtagctataacttcatgtcagattcgtttaaataaaagtttgtgtcagggaggacgattgggtcaaaccgcagcaccctagtctcttcccttctgtggagtccactacattcttctctttcctcttttcacacaatgatattgctgtcctgatccacaggctgcggtcatatatcttggcagtggtggcttctgtcattttagtttcgtataatttctaggattatttgattgtctaattatttatctgctagctgtttgaatttaaacagatgagctttaatttctgataggtatcctagagggttgattgtagcttgcttgtaattaactattgcctggctatgcagttggcccttggcttttgttggaaaattcattccagttccgaggactgaattgaaggatctcattgtaaggtgttggcctaaacgtaaggatctcacattctcatctagtctttttttttggttaggtattgggactgtagtgcatctgcatgagctgcagtttgcttcttacgttgcttgtttattggaacagccattattgtatacttgatgaatatatgtaaccttcttgggaccccttggcctgcacgtggcgagagtgcagcccaacagactcaggatgacagaatggaagtaccagtgtgaagctgttcttgagcaacttctcgaaattatcaggtgttagtgttggtgcacatagatggtgttggctaattttgggtgctgatttttctaaccatcctaccttgttgcctggctatgaattctatggctgtagtcagcaatcggggaggtaaacctctgctgactcgtgatctagaatttgaacactgtaaacaaaatatgtttattgtagcctaacgaaggtcaggacctccagtggtttattgcacaagttgtgcagtcggtcccagaatcatttggggaaggcgctataaacagtttttcttggcaggagtggagtgtagctccttttcgctaatatcatttttacttttagatgcaatcaagaacattttgtcaaacactctaatagtaattggctgattttgttagagttgcctttgctatgccataattgtatttcagaaattgactggtggtatgtattgcgagtgtaaatccactattattggcggtatgtgataacaaaaatatttatggtgccctaagataagcaaattccgatggtgaccatcattgatgtgatacaggggggggggggggggggtagctgtgagcacatggtacggccatacatattcccaagaggagctatgtttttttataaaggaaatttttactgtttgtgttttatataaaggaaacttttattatttttcaaaaacaatacggttacgttgagttgatataaagcttcgaaaacaacatgcctaagcatgtcacaggggcgaagtatcaaatgcaaccttttgcaaaagtaccaaggtaaggcatgcaatgcgtgcaaattgtctctcgatttgtttaggggggacgtgcctaagcatgtcgcggagccaataagtagggcacatggtggtcatccatgcttccccggcccggaggaaatcatgatgcctgctttccctggacgagatgcacagcggactttttcattagtggaaacagtcgacgagaagcctggtggagctaatgggaaccgcggagagggatcggctcaatagggtactgacttaaccttggtgaactcactgaaatggagtactaatttacaaggccttggatcctgtaacacaccggatgctgttgtgccgtgtgtgcccccacctcacctggcagaaagagctctggacaatgcatggtgtgccaccatgcatcatcatggagaggtagctgccgcctgcaggagtgcagaaccaaccatgcatcagcccgttggagcaactggcagagccacagaggaatggaggcagatcgtgtacagcggctgctctgcggttgtcttgaatcaaacattttaatctttgactactgtatattcactatattttatagcaaaaggtagcgaccgaaggtttatttagactgtcgatacccaaaacgacttgtttcacaaaatcggagtacgtatgcccatagattctacctctatgaatgctcataaacaggaaaacaaactgataactggagattgattgtcatatcaccgtaaacaccttgttgttgatttgtgcattgcttaaattcaaaattgatgtcatatccacacccgacgaatccctccttttagctttctgcggttaacccccaccccaaagaccgccacctcccgatggcgcccctccctgactccttcggtccttctcttccggtcatgcccttagcatggctatgtgtcttactagtcgtgttcttacaacaagtataatagctggccgtaagccgattaaatgctgacatagaagaaagagaggaggagcgggatacaaactaatagctagcttaattatacacgggagccaggaattttgtgaaagagacaagtgaaacatatattaattgtaaaaggctaactctatatatatcggctataagatagactacaaaggtccttatagccagcagttgactatattattaaacttactcttagcatgaccatgtttgtcaatgaggagaaataaaagaaggtaggaaagaggatggcaaataggtcgtatgcatcattctataccgattgtttttattttagcacatttttttaaatttcacgtttagac

SEQ ID NO: 16585 - DNA, 2284 bp, Zea mays
atgcctgtcacctgcagcatatatagatccagcctccatccctccacgccatctgcatgcagagttgagaggcaaagaaagaaaaagaaaacaagcatgactcaagctcattcaaagtcatgcttccaacaattttgggatggagttcaagttaagaggaacagtggcagcttcaccatcgagctcctgccatctcttggcgcaacaataaaccaatctaacaagctgcggaagttcatcatatctccctacgatccctgctacagatactgggagctgttcctcatagtcctggtcatttactccgcctggttctgcccgtttgaactagcgtttttgcgggacttgccctctaagcttctgctagctgagaacatcgtcaatggcttcttcgcggttgatattgttttgacgttcttcgtagcttatgtcgacaccaaaacacaccttcttgtggatgaccagaagagaattgcagtaaggtacctatcaacctggttcatctttgatgtatgttcaacagctccatttcaaccaatcagccttctcttcacacgtaaggggaacggccttgcttttaagatactcaacatgttgaggctatggcgtcttcaccgagtcagctcgctgtttgcaaggctggagaaggacataaggttcaactatttctggactaggtgctcaaagcttatttctgttactctgttcgcggtgcactgtgcggggtgcttcaactacatgattgccgacagatatcctgatccagagaaaacatggataggtgctgtaatgcctaccttcagatcggagagcttatgggctagatatgtaactgccctttactggtcgattacaacactaacaacgacaggttatggggatctacatgctgagaacccaagagagatgctgtttgatatctgctacatgctgtttaatctgggcctgacagcctatcttattggtaatatgaccaacctggttgttcatgggaccagccgcacccggagttttagggactcaatccaatcggcatcggaatttgcatcacgaaatcagttgcctgataagataaagcagcaaatgttgtctcacttctgcctacagttcaagacagaggggctcagccagcaagctatgctaaattgtctcccaaaaggaattcgttcaagcatagcatacaacctattctttacaatcatacgaaaagcctacctctttcatggggtatctaataatttcattgcagaactggtaatggaagtacaggctgagtatttcccaccaatggaagacataatgttgcaaaatgaggcggcagcagatatttacataatagtttcaggagtagcgaatttgataacaacagcaaatggtaatgagcaggtgtacgaaaaagttgaagagggagacatgttcggagaggttggtgctctgtgtgacataccccagccatttacttgccgcaccactaccctatcacagctcttgagaataaggaagataagactgacagagatcatgcaagaacacaaggaagacagcaagattctaatgaacaatctatttcagaagctaaagctgcatgagagtttaccagaattaaaacaactagatcgaagattcatgcacaagtacgagctattccatgctcctcaagaagcatggttgttacctcagccttacctgcagtacacagagcacaaattggaagacattcggctcgtgagacgatcccaaccttttgtggagattatggttcaacaaaactagcagctgaaacaaaccaagtgaggttgacacagcaaggaaacagccatgaccatggcgattatatggcgacggatgggatggcaggcgaagaaggcgaacgcaatgaggttcacataaactgtgaaaccaaagaagtttccattcatataaaatctgaagattgtgatgcagcaagccattggcaaacagaccatgaaacggtgaggctggggtcttcccacaatacatccgatggcataactatgagcgaaaaccaagacagcagtaacataaaatcatccaacaaaagggtcacaattcacacatatcctcgtaatgcagcaggttctttagtacagaacgggaagcttatcaacctgcctggttcactggacgagatcttcgaaattggatgcatgccagaagtttccgggtctccgccctacaaaactattcagtggagactatgctgagatagatgacattagtgttatacgagatggtgaccacctattccttcttcggatgtaaa

SEQ ID NO: 16586 - DNA, 753 bp, Zea mays
ccgggcatacaatgttcgatgatgcgctataaacaaaaaaaatcccgcacccactctgtcgctaaacttatatactggagaaccgatcttctgttagccgctcctactaatatactggttagccgatcgattgttcaggtcctcggatcttgactgtatggatgcgttcttgtcatgcctggacgacggcccgacggcttcgccgccgcgcgccgccccgccgccatccccggcgcttagcgcgcgggacctctacagcttcatatgcagcggtccactggtggacaggatcggctataccaaagagaaggtcgccgactccatcggccggtggcttcgctgcggggttgacgtggcgcgcctcctccgcctcgacgagctccagctgtcggaggccgagaaggcccgggtttaccagttctacatccccgtcttcctctggtgcgaggaccaggtcatagagcacagagccaagtacagcgagggcgacgacatcccgccattggtgatcggggtcagcgctccccaaggaagtggaaagacgactctggtcttcgcacttgattatctttttcaggttgctggtaggaaatccgccacattgtctatagatgacttctatttgacagcaaaagagcagaatgaactgagggacagataccctggaaatgctcttttggagctccgtggaaatgctggaagccacaatctccaattcagtgttgaaacacttgagtcactgatgaaactaac

SEQ ID NO: 16587 - DNA, 1657 bp, Zea mays
cattgggtacctcgacctcgagcccgcccggggcgctcgaccccgccccgaaatcctaatcccctccgcctcatccccttcaaccccacgtctctctcgccgaaggctccggcctcgtcgggatccggtgctggattgacgcaatggcgccgctccacgccgcgctgccgccgccctcctccgccgccgctcaccaccacgcggcagccccgcctgtcttcctcgcccgctcgctgtaccacccccgcagggcggcggcctcctgcccgctcgccgtcgccgccgctccctcgtcgagaaaagcgttcttgtcgtgcccgctgctgggccactggaccacggccgcgccgccgcgcgccatcccctcctcgtcgtcgtcgtcgaccccggcgctcatcgcgtccgtgcaggacctgtatgacttcatctgctgcggcccgctggtggacaggatcggctacaccagtgagaagatcgccgagtccatcgaccgctggcttctcgccggggctagggtggcgcgcctcttccgcctcaacgagctccagctgtcggacgccgagaaggcccggatataccacttctacatccccgtcttcctctggtgcgaggacgaggtcatggtgcacagagccaggtacaacgacggcgatgacatcccgccattggtgatcggggtcagcgctccccaaggaagtgggaagacgactcttgtgttcgcacttgattatctttttcgggttgctggtaggaattctgccacattgtctatagacgacttctatctgacagcaaaagaacagaatgaattgagggacagaaatcctgcaaatgctcttttagagttccgcgggaatgctggaagccacgatctccaactctcagtggaaacactcgagtcactgatcaagctaacgaaggaaggtatgaagatgaaggttccacggtatgacaagtctgcgtttgggggaaggggtgaccgggctgatccttctgtatggccagaggttgaagggcccttagaggttgttctgttcgaaggatggatgcttggatttaaacctcttccaaatgaagttgtgaaagaagtggatccacagctggaggtggttaacaagaaccttgaagcatactctgatgcttgggacaggttcatccagtcatggattgttattaaaataagagaacccggtagcgtttaccagtggagactgcaggcagaggtcgctatgagagcagatggaaagcctggaatgtctgatgaggaggttatggattttgtatcacgctacctaccggcataccatgcatatctgccaacactgtacaaagaggggccgaatggttcgaatccagatcatctgctggtcatcgacatagacgaaaataggaaccctatctgtggtggatcatgggacatctcatgtttgtgaaactacttttatgatgggccgtcaaacaccactggcctcttgttgccctacactctggtagtgtaaatctgtgaattccatgtaaatatgaatttcgcttcttaaggcactttttaatctggcatggtctttagcttgaaaaaagaaaaaaaggaagcggcctcaaaccttttcctaattgattttggtggttgaattgctcaacacaaataattggactaact

SEQ ID NO: 16588 - DNA, 2343 bp, Zea mays
cggccgggccgggatctctcattggccattccgcccgcatgaagccccaaaccctcttcggcatcgccttcgccgcagcagcgcccgcgtagcccgcccctctcgcccccgcccgctcgcccgctcctcgatcccgcccgctctgcagccgatcccgccgggagcacgaccgattacgatgaacggcgccgcggcaccggagcgctcgccctcaccctcgcccccgcctccggcccaggcccaggcccaggcgccgccgtcgccctctccggctcagccgctcgagtggaggttctcccaggtgttcggtgagcgcagcgccggggaggaagtccaggaagttgacatcatctcagcaatagagttcaataaatcaggacatcatcttgccactggagacagaggtggacgagttgttttatttgaaaggactgatgtcaaagatcatgcttgtagaaaagatgctgagaaagctgatcattctatcagcaggcatcctgaatttcgctacaaaactgagtttcaaagccacgaaccagagtttgattatcttaagagcttggaaattgaagagaagattaaccaaataaaatcgtgtcaagcagcaaatggcgcattgtatcttctatccacaaatgacaaaactattaagtttttggaaggtccaagaaaagaacgtaaaaaagctatctgagatgaatttggaccgttcagctgctcctgcaaatggtagtcctggtggcgtgggatatctgagcccatctctctcaaatggcaatgctctaaaacctggcaggcttcctttgcttcgcctgcctgtggtagttacaagccaagaaacaagtcttgccacaagttgccgaagagtatatgctcatgcacatgactaccatataaattcgatatcaaataacagtgatggtgagacatttatatcagctgatgatttgcggataaatctatggaatttggaaatcagcaatcaaagtttcaatattattgatgttaagcctacaaacatggaagatctcaccgaggtgataacatctgctgaattccatcctacccactgcaatacgttggcatatagtagctctaagggatccattcgacttgttgatctgcgccaatcagccctttgcgacactcattatcaaatctttgagcagcatgaggccccaggctcaagatcatttttcactgagattatagcctcaatttcggacataaagttttcgaaggatgggaggcatcttctcagtcgcgactacatgactctgaagctttgggatgttaagatgaattccggtccagttgcaacattccaggttcatgagtatctaaggcctaagttatgtgatttatatgaaaatgactcaatttttgacaaatttgagtgttgtcaaagtggtgatggattaagagtagcaactggttcctacagcaacattttccgggtgtccgggtgcgctactggtaacagtgaggcgacaacacttgaagcaacccgaaaccctacaaggaggcagctccagaatcccactagagctaccagatccctaagttctctgacaaggacagttagacgaggtggagaaagcactggaatagatgtcaatggaaattcttatgatctgagcacaaagttgctccatttggcctggcacccatctgaaaatctaattgcatgtgctgcagccaatagcttgtacatgtactatgcataaacaagtgaaatgaacagagcgacagtatttttggtggttgctcccggtgagaaagacacttttagctcctggtggatttgaagccaggagttgctggggagatggtgtatcttgtgccagtcagatgcagttcttttcggtgccatatagagctgtccagagtccaagaggaagtgactcgatcattcccgggaagcagctttgattctgatttatttttttgtggggaaaggcttgtctttcccccataggtccatttagatttaaagataaggccctagtttggcaatttgtagtagatgttaagaggatgacgatgatccaccgttgtattcatgttgggcatgggtttgtaacttcagggtggtcgttgaagctttcgataattttatcttacatacggatcaacctttttttttcctatttatgtgaggaaccttattttcgaggaataccaggaccttcgccatgtttaatgcgaaccctagaataggtaatatgctgtgtcattttattgtacgtacattttaaaatagctgcaagtggttctactgtttagttattataagtaaaaaagagagaaagagaaaaaactcgaggggggggcccgggtacc

SEQ ID NO: 16589 - DNA, 2287 bp, Zea mays
ccggccgggattggccatcccgcccgcatgaaaccccaaaccctcgccggcatcgccgtcgccgcagcagcgcccgcgtagcccgcccctctcgccctcgcccccctccccgcgccccgatcccgcccgctccgcagccgatcctgccgggagcacgaccgatgacgatgaacggcgccgctgcaccggagcgctcgcccccagcctcgcccccgcctctggtccaggcccaggcgcctccgtcgccatctccgactcagccgctcgagtggaggttctcgcaggtgttcggtgagcgcagcgccggggaggaagtccaggatgttgacatcatctcagcaatagagttcaataaatcgggacatcatcttgccactggagacaggggtggacgagttgttttatttgaaaggactgatgtcaaagatcttgcctctagaaaagatgctgagaaagctgattattctatcagcaggcatcctgagtttcgctacaaaactgagtttcaaagccatgagccagagtttgattaccttaagagcttggaaattgaagagaagattaatcaaataaagtggtgtcaagcaacaaattgtgcattgtttcttctatccacaaatgacaaaacgataaagttttggaaggtccaagaaaagaaagtaaaaaaggtatctgagatgaatttggaccgttcaactgctcctacaaatggtagtcctggtggtacgggatatccgcgcccatctctctcaaatggcaatgttctaaaacctggcggacttcctttgctacgccttcctgtggttacaacccaagaaacaagccttgctgcgagttgccgaagagtatatgctcatgcacatgactatcatataaattcaatatcaaataacagtgatggtgagacatttatatcagctgatgatttgcggataaatctttggaatttggaaatcagcaatcaaagtttcaatattattgatgttaagcctacaaacatggaagatctcactgaggtgataacatctgctgaattccatcctactcattgcaatacattggcgtatagtagctctaagggctccattcgacttgttgatctgcggcaatcagccctttgcgacactcattcccaaatctttgagcagcatgaggccccaggttcaagatcatttttcactgagattatagcttcaatttcggacataaaattttcgaaggatgggaggcatattctcagtcgtgactacatgactctgaagctttgggatgttaagatgaattctggtcctgttgcaacattccaggttcatgagtatctaaggcctaagttatgtgatttatatgaaaatgactcaattttcgacaaatttgagtgttgtcaaagtggtgatggattaagagtagcaactggttcctacagcaacatttttcgtgtgtttggttgccgttctggtagcagtgaagcaacaacacttgaagcaacccgaaaccctacaaggcggcaggtccagactacctctagagctaccagatccctaagtactctgacaagggccgttagacgaggtggagagagcactggaatagatgccaatggaaattcctatgatctgagcacaaagttgctccatttggcctggcacccatctgaaaatctaattgcttgtgctgcagccaatagcttgtacatgtactacgcataaacaagcgaaacgaacagagcgacagtttttttttgttggttgctcccggtgagaaagacacgtttagccaatggtggattgaagccaggagttggtggagatggtgtattttgtgccagtcggaagcagttcttttcggtgccatatagagctgtccagagtccaagaggaagtgactcgatcattcccgggaagcagctttgattctgattattattattttttgtgtggggaaaggcttgtctttcccccataggttcatttagatttaaagataaggtcctagcttgacaacatctgggcatctgtagtagacgatgttaaggggatggcgacgatccaccgttgtattcatgttgccatgggtttgtaacttcagggtggccgttggagcttttcatagttttatcttacatacagatcgaccttattttttctcccttcttgcgtggggaaccttgttttcgaagaatgccaggaccttcgtcatgtttgatgcgaaccctagaataggtaacatactgccattttatcgtatgtacatttttaataggttggagtggttctactgttgtttagct

SEQ ID NO: 16590 - DNA, 1611 bp, Zea mays
ttttttttttttttttaggaaaaggggtgcgtgactccctttcgatctcttttagtgtcatcttccttattttaaattcacttagatacatcaatcaaattacactccaagcgcagcgccatgcaagagcatgcaaatcctctttacaaaaaataaaaccccatttaacacgcacactcttagccttttagtcttcaattcactccacaaagcccaaaccaaaaaccaaaaaaaataaaggttaaatcaatatgagaaaaatgaaaaatccagcaaaaataaattatgcgccttggacaacaacctcattattgcatgtatggacacagatcagcagatcgggtgagagagctagaggtagcagatcagatcaagaagagagggggatagatgcgcatgcacaccaataataagctagctttttcgtcatgtatggtcatttggtcccataaaaaggagggagtgagctgtactttccatggcttccaggttggacggtgttagttcttggtcatcgtcccacatcagcaggtgccgcgccgactcgtcgtcccactggtcctcctgccccagcgacggctgctgctcctcctcctgctgcttttgcagctgcccgtagcagcagccgttcgccatgccggccgccgccgcctccgcctgaccattgttgttgccgccggcaacgcggtggtcatggcctagagcgccgcagtccatggctgctggcatgcccattcccatgccgtccaccaagggcggcagatggaagcccatcggcgcgttgtcgtccatcgccgccgccgccgtgaaggtgaggaacgggtgctgcaggtggtgtgctgcggccgcgggcgacggcgggctgacgctgacgctcgtgtcgaacatgaagaaggggcagtgcgggggcagcggcggggactcttggccgccgccgccgccgccgccggagcccagcttcggcggcggcaaggcaaggctctggctgaggatggcgtcgagccggtgctccgccgcgctgaacggcgtctgcaggtgacgaccaagcgccgcgtccgacgccgccgtgctgcacggagggctcgccgccgtcacggccgagctcgtcgtcgtcgtgctcatcgccggctttcggatcttcttcttgatccacgagttccagtagttcttgatctcgttgtccgtccgcccgggcaagtggctggcaatgtgtgcccacctgttgccaacaatggcgtgcaggctgatgatgagcttctcctcctccgccgtgaaccggcctcggcggatgtccggcctgaggtagttgatccaccgcagccggcagctcttcccgcagcgttgtaggccggccttctcggggacctcgctccagcacccgtagccatgggtggtgatgtacctgatgagcttctcgtcctcctcaggggaccagagccccctcttcaccttctgctggttgcagcaggagtgatgccccatgcacgcacacacagaccgacctccagctgaataatcggaggctatgtgctgcctggtgcctgctagctagctgtacgttgctgggtgcaaaatttttcgattaggatgttctaggtaatggtctcgtgc

SEQ ID NO: 16591 - DNA, 1806 bp, Zea mays
cattgggtacctcggggcccgccgggccggccgcccccggcccgcgcctcgctctctcttgtctcgcccgctagctcccatcccagcctcccaccgcgcccgcctgccccaacatcccccctccccgctccgctccacgcacggctccagatctgctacggcggcggccggtggacgccgcgccgcgcgtgccggaggcggtgacgtgagcggcggatcctgcccggccgtgccatcctggcgacgatgacagcgtaagcgggcggcggacgaccgcgcccccccggcccctactcccgaggtcattggcgtgtgctccttggcagaaaatggcgatgatggtggatccccccaatggcatggcaagtcaaggaaagcattactatactatgtggcagacactgtttgagatcgacaccaagtacgtgccgatcaagcccatcggaagaggagcttacggaatcgtttgctcatctgttaaccgcgagaccaatgaaaaagtcgcgataaaaaagataaacaacgtctttgacaaccgtgtggatgcgctaaggacgctgagagagctgaaactccttcggcacctgaggcacgagaatgttattgctctcaaggacataatgatgcctgcgcatagaaggagcttcaaggacgtttacttggtttatgagctcatggacactgatctgcatcaaataattaagtcatctcaaccactatccaatgaccactgccagtatttcctttttcagctgctccgaggcctgaagtacctccattcagccgggatactccacagagacctaaagccagggaacctcctggtcaacgcaaactgtgacctgaagatatgcgacttcgggctcgcccgcacgaacaacaccaagggccagttcatgacggagtacgtggtgacccgctggtacagggcacccgagctgctgctctgctgcgacaactacggcacgtccattgacgtctggtctgtggggtgcatattcgcggagctgcttggccgcaagccgatcttcccaggaaccgagtgcctgaaccagctcaagctcatcgtcaacgtcctcggcaccatgggcgaggccgacctcgcgttcatcgacaacccgaaggcccgcaagtacatcaagtcccttccgtacgccccgggcgcccccttcaccggcatgtaccctcaggcgcaccctctcgccatcgacctgctgcagaagatgctcgtgttcgacccgtccaagaggatcagcgtcaccgaggcgctggagcacccgtacatgtctccgctctatgacccgagcgcgaaccctcccgcgcaggtgccgatcgacctcgacatcgacgagaacctcggcgtcgacatgatcagggagatgatgtggcaggagatgatccactaccaccccgaggtcctcacgagaatcagcatgtgagtatgtgatgtgaccagacaggcagcaatgaaacatgtggacagaggtctgctgcgccaggatcatcacatgttcgcccttcttacgagcttaactgcgattacggcaccgagtcgaggtatcactacatgtatcggaaccgtcaggcggtctcttgtgtaaatatgcgctgaataagatgtgtggcaatctcttgttttttgggttgtacatggacctcgctgttgtacgagtctgtgaagtggaaccctggtactaagacctgtaatttcagaccctaatctgttgtatggaaatctgaaggccttgactcccaaaaaaaaaaaaaaaaaaaggccgctcgcgatctagaacgggctcgtgcaaa

SEQ ID NO: 16592 - DNA, 645 bp, Zea mays
ctctcggcccgcgcctcgctctctcttgtctcgcccgctagctcccatcccagcctcccaccgcgcccgcctgccccaacctcccccctcccctccccgctccgctccgctccacgcacggcgccagatctgctgctgctgcggcggccggtggacgccgcgccgcgcgtgccggcggcggtgacgtgagcggcggatcctgcccggccgtgccatcccggcgacgatgacagcgtaagcgggcggcggacgaccgcgcccccccggcccctactcccgaggtcattggcgtgtgctccttggcagaaaatggcgatgatggtggatccccccaatggcatggcaagtcaaggaaagcattactatactatgtggcagacactgtttgagatcgacaccaagtacgtgccgatcaagcccatcggaagaggagcttacggaatcgtttgctcatctgttaaccgcgagaccaatgaaaaagtcgcgataaaaaagataaacaacgtctttgacaaccgtgtggatgcgctaaggacgctgagagagctgaaactccttcggcacctgaggcacgagaatgttattgctctcaaggacataatgatccctggcgcatagaaggagcttcaaggacgttttactggg

SEQ ID NO: 16593 - DNA, 1863 bp, Zea mays
atcaactctatccagtttcctgtctcgtttcatattgttttcccagaaatggaccggatgtgatttgtattcgtttttatccctaaatctgagtttagggggatttttagggaaataatggaggtgctgtaagtacccttccgtctgtctctccctcactcccttcgcgacgactacgcccggtgctcttcttcggccccaggtagctttcgctgccgtcctacggcaggtgcccaagtcttcttcgggcccttcaacgacgacgagcactaccagtttgttgaagatggaaaataaagagttgttcaagatgggaagtgcagatacagatactgctgcactgcacaaggagtgggatgatgttctctgtccgatatgcatggaccatccgcacaatgctgtccttctgttgtgcagctcccatgacaaaggatgccgatcctatatatgtgatacaagctataggcattcaaattgcctagataggttcaagaaaatgaaagtgaatgatgaggacagtccttcacagtcaagctcgtccatgcctaggggtacaggaaaccaaaatgttgtccagagatctcgttttggtcccactagagagagccccaggctacacatagacatatctgtacccgatgaaacttccgatcatcaagatgccagccacagacctgctgccatagttggagaacaggaagaaaacatctacaatgaaggcccagatttgacattggaaactcacgaggttgggatcaatggttcttcagtgtcaagcgacgtgtcaagcttaaatcaattgttgtgcccactgtgcagaggggtggttagtggctggaagatcatcaaagaagctagacagtatttggatgggaaatccagagcttgctcacgagaagcctgcatgttttctggtaactacagggagatccgtagacatgccagaagggtgcaccccacaacaaggcctgctgatgttgatccatcaagacgtcgtgcgtggcaccacctggagcatcagcgggattatgctgacatagtaagcgcaataaggtccgctatgcctggggcagttgtgcttggtgattatgctattgaaggcggagaaatattttcacatgaccgggaaaccagtgaaccaagtgggtctcttctgacaacattctttctatttcatatgctcagcagtagtccgattagatcaggtgatgagccaagaggcacatcaaggggcctgagaaggcagaggagacgctatctgtggggagagaatttgttaggtctccaatatgatgatgatgatgacgacgacgataacgaaggggaggaggatgaagtggatgctgtggatgaagttcagagaccaaggagtcgccggaggttcataagatcaagatcagaggagcgggcctaatacattgtggagatgtggatgatgtgcttccttgcttggttaaaatgctgtgcgcatccctgcaatcaaagaccaaaaggcaaatggacctcaagttcaagtttagatgatttggatgcgtctgacaccatccatgtgccctctttaatctgacgatcataagaaacactcattcttagggcaaagctggactgctctcagaccagaactgacatggaagctagcgtttggagatgctcgctccatcacaacagctggtgccgtcactcattcaccatgcctttttacctttgcactgcgtgtcatctgcatctgtagtatattctttccgtattacgtctcattgagtccatgctgctactgttctggttgatatccttgttcaaaggctataaaatttattatattttcatagaatgataatgaaatgcccaaaaaaaaaaaaaaaa

SEQ ID NO: 16594 - DNA, 1040 bp, Zea mays
ctggagcatcagcgggattatgctgacatagtaagcgcaataaggtccgctatgcctggggcagttgtgcttggtgattatgctattgaaggcgggagaaatattttcacatgaccgggaaaccagtgaaccaagtgggtctcttctgacaacattctttctatttcatatgctcagcagtagtccgattagatcaggtgatgagccaagaggcacatcaaggggcctgagaaggcagaggagacgctatctgtggggagagaatttgttaggtctccaatatgatgatgatgatgacgacgacgataacgaaggggaggaggatgaagtggatgctgtggatgaagttcagagaccaaggagtcgtcggaggttcataagatcaagatcagaggagcgggcctaatacattggtacctgtggtaattacattctgtactgctgtgaagttctattaccatgaactcatgatgactccttgcatgatctttgcatgccagtggagatgtggatgatgtgcttccttgcttggttaaaatgctgtgcgcatccctgcaatcaaagaccaaaaggcaaatggacctcaagttcaagtttagatgatttggatgcgtctgacaccatccatgtgccctctttaatctgacgatcataagaaacactcattcttagggcaaagctggactgctctcagaccagaactgacatggaagctagcgtttggagatgctcgctccatcacaacagctggtgccgtcactcattcaccatgcctttttacctttgcactgcgtgtcatctgcatctgtagtatattcttcccgtattacgtctcattgagtccatgctgctactgttctggttgatatccttgttcaaaggctataaaatttattatattttcatgtgatgatgttgtaatgctctataatttatcataccaagccttaatccacttttaaataaattaaaatcatttaatcaacactaattactcgctattccatcattagcaaagactaataattacaacaacagag

SEQ ID NO: 16595 - DNA, 812 bp, Zea mays
  misc_feature (724)..(724): n is a, c, g, or t
cattggtacctcgagccggcgggaagggccctttcacagtttccctcccccaaaactactttcccacaaacccagaccagagcagcttgcgtctatcgtttcttttcttgttggccttctccttgccttgcttttgcttgctcgttgcttcttgagctcgagcccgccccttctgcgccttgcccaagtctctgtgtgttttttataggcttgagagcttggaatagcggggggtggaggaagcggaagaggagcttcgttttgtgttctagagggagtcatgttccatggcggcaggcctctgtccctccgggggtctctcaaggcgcttgaagctgatatccaccatgccaacaccctggcgcatgctatacacagggcgtatgggggtgcctgcgtgcagatgaggctgtcctacagctccatggctccaatctttctcaaccttatccaatggatggactgcagctgctccctgtcatacacgctccctagctaccttggcctgctcgaggttctcgtctacaaggtttatgtcgatgaagatgcctccatatccaccatagaaaggagggcgagcctgaaggaattctacactatcatataccctttcttgcaacaactggaggacaacttgatggacaaggactgcaaggacaaagggtggtctgctgctgccggcggcggcggcggcggtcggtcgcttgttgccgaaatgacaggnaggatgagtgtggcatttgcctggagactgcaccaagatggtccttccgaattgcaaccatgccatgtgcatcaactggtaccgagac

SEQ ID NO: 16596 - DNA, 870 bp, Zea mays
ccggccgggaaagggcccccctttacagtttccctcccccaaactactttcccacaaacccagaccagagcagcttgcgttgcgtctctcgtttcttttcttgttggccttctccttgccttgcttttgcttgctcgttgcttcttgagctcgagcccgccccttctgcgccttgcccaagtctctgtgtgttttttataggcttgagagcttggaatagcggggggtggaggaagcggaagaggagcttcgttttgtgttctagagggagtcatgttccatggcggcaggcctctgtccctccgggggtctctcaaggcgcttgaagctgatatccaccatgccaacaccctggcgcatgctatacacagggcgtatgggggtgcctgcgtgcagatgaggctgtcctacagctccatggctccaatctttctcaaccttatccaatggatggactgcagctgctccctgtcatacacgctccctagctaccttggcctgctcgaggttctcgtctacaaggtttatgtcgatgaagatgcctccatatccaccatagaaaggagggcgagcctgaaggaattctacagtatgcttactatccaccatagaaactagtgattaagaagctttttttttctgttcaagatttttttttgttgatgctgctgctgctgctgcagcagtggtttaatatagttttgggaccccatggaatgcagctatcatataccctttcttgcaacaactggaggacaacttgatggacaaggactgcaaggacaaagggtggtctgctgctgccgccgccggcggcggcggcggtcggaagcttgttgccgaagatgacagggaggatgagtgtggcat

SEQ ID NO: 16597 - DNA, 1895 bp, Zea mays
  misc_feature (18)..(18): n is a, c, g, or t
  misc_feature (35)..(35): n is a, c, g, or t
  misc_feature (1855)..(1855): n is a, c, g, or t
gattaagaagcttttttnttctgttcaagattttntttttgttgatgctgctgctgctgctgcagcagtggtttaatatagttttgggaccccatggaatgcagctatcatataccctttcttgcaacaactggaggacaacttgatggacaaggactgcaaggacaaagggtggtctgctgctgccgccgccggcggcggcggcggtcggaagcttgttgccgaagatgacagggaggatgagtgtggcatttgcctggagacctgccccaagagccggggccccgtccgaattgcaaccatgccatgtgcatcaactgttaccgagactggtacacaaggtcccagtcatgcccgttctgccgcgggagcctgaagagggtccggtccagagacctgtgggtgctcaccggcgacgacgacgtgatcgacacggtgacgctggagaaggagaacgtgaagcacttcctcagcttcatcgacagcctgcccctgatcgtccccgacaacatgctgctggtctactacgactacctagtctagcaaggctcctccccccaccccccactctgaagctctggaagaggaagggggtctgggaagaagacgcggcgtacaagcgacaagggttacccgcagccgaccatcctctgcggatcgagttggcaaagcgaagccgttgccgaccaacagacgatactctcgtgggcatgccacgccgttgcgctggctttattgcatggtggcgttgctcgctgtaatggttgtaaataaagaaggaaaatgtctcgggttttatatataatatactagcttgacatttctcgtctggcgaattgccggactgttcagaatgaagaaatcagggggcctctacttctctgctctatatatatcgtcttcaattctcgtggccacctgcaccattcataatcgtgagcgttgttgaggattcatccgttcctctccttctagaggttccagaagaaagaagacacatgtggtcaggtcatgccatcgaaccgtctccactccgtgcaaggcactttgcttgaggcgttctcccaccactacattttggccatcggttttttattcatgattgggcactgaaaactgaaactctgctcggttgacatggacctgatagcgaccgttcaatctgtgctgtacagtagtgcacaggtgagtgcctgacagtgaccttggcaactcctccattcggtatttcggttgctgaaatgaattggaatcgctccagccacacgctcccaaatactactaactccagctccaggaccgaaaattgcctgcacgggggtgggggacagctcggggccgctccttgacgctcaccctaccctcagggtttgttgatgcacaagccatgagctcatccagtccggaaagctggcaccttgcacgggtggtgccgtgaggccggccaccatgggttcaagtgtctgcctccaccagtccaccgccgaaatcgagattcgagaaggaccagaaccctaactcagcaggagaagcacgggccggagaacgacgctggagcatctagggttttgttttctgttagcatgaatcaaagctaagctttggtcatcttaattatattaattatcaaaaaaaagaaagagaaagaaaaggatccaagacctgaccagactcgacgacggcctggctaggtgtgtgcaccatactttacagtaatggccgataaggttacttctggcccagcccacaccagccctgcagcccatcttagatgtgcgctgtggctccaactgcgagcccttttatcccttatccaacctgatccaccacaccaccattcccgagcacactagtntctcttccctgcgcttgctcgctccttcttgcccccatgg

SEQ ID NO: 16598 - DNA, 1403 bp, Zea mays
ctcgaggccggccgggaaagggccccctttacagtttccctcccccaaccccccggtcaccacctccccacaacccagaccagagcagcttgcgttgcgtctctcgtttcttttcttgttggccttctccttgccttgcttttgcttgctcgttgcttcttgagctcgagcccgccccttgtgcgccttgcccaagtctctgtgtgttttttataggcttgagagcttggaatagcggggggtggaggaagcggaagaggagcttcgttttgtgttctagaggggagtcatgttccatggcggcaggcctctgtccctccgggggtctctcaaggcgcttgaagctgatatccaccatgccaacaccctggcgcatgctatacacagggcgtatgggggtgcctgcgtgcagatgaggctgtcctacagctccatggctccaatctttctcaaccttatccaatggatggactgcagctgctccctgtcatacacgctccctagctaccttggcctgctcgaggttctcgtctacaaggtttatgtcgatgaagatgcctccatatccaccatagaaaggagggcgagcctgaaggaattctacactatcatataccctttcttgcaacaactggaggacaacttgatggacaaggactgcaaggacaaagggtggtctgctgctgccggcggcggcggcggcggtcggaagcttgttgccgaagatgacagggaggatgagtgtggcatttgcctggagacctgcaccaagatggtccttccgaattgcaaccatgccatgtgcatcaactgttaccgagactggtacacaaggtcccagtcatgcccgttctgccgcgggagcctgaagagggtccggtccagagacctgtgggtgctcaccggcgacgacgacgtgatcgacacggtgacgctggagaaggagaacgtgaagcacttcctcagcttcatcgacagcctgcccctgatcgtccccgacaacatgctgctggtctactacgactacctagtctagcaaggctcctccccccaccccccactctgaagctctggaagaggaagggggtctgggaagaagacgcggcgtacaagcgacaagggttcccgcagccgaccatcctctgcggatcgagttggcaaagcgaagccgttgccgaccaacagacgatactctcgtgggcatgccacgccgttgcgctggctttattgcatggtggcgttgctcgctgtaatggttgtaaataaagaaggaaaatgtctcgggttttatatataatatactagcttgacatttctcgtctggcgaattgccggactgttcagaatgaagaaatcaggggcctctacttccctgctctgaaaaaaaaaaaaaaaaaaaaaaa

SEQ ID NO: 16599 - DNA, 1468 bp, Zea mays
  misc_feature (1420)..(1422): n is a, c, g, or t
  misc_feature (1427)..(1427): n is a, c, g, or t
  misc_feature (1429)..(1429): n is a, c, g, or t
  misc_feature (1432)..(1433): n is a, c, g, or t
  misc_feature (1437)..(1440): n is a, c, g, or t
  misc_feature (1443)..(1443): n is a, c, g, or t
  misc_feature (1447)..(1447): n is a, c, g, or t
  misc_feature (1449)..(1451): n is a, c, g, or t
  misc_feature (1453)..(1453): n is a, c, g, or t
  misc_feature (1455)..(1455): n is a, c, g, or t
  misc_feature (1460)..(1460): n is a, c, g, or t
  misc_feature (1462)..(1462): n is a, c, g, or t
  misc_feature (1464)..(1464): n is a, c, g, or t
cccacgcgtccgcccacccggccgccccagcgtccgcccaagcatccagcaaaataaaagccaggcggcggcatatggcgctcagcaaggagcaaaaactcacaattcctgatcaacaacacacaacaagcagcgaacagcaggtggcgctggatgccgagctccagctgtggaaccacactttcggctacgtcaagtccatggcgctcaaggccgcgctcgacctcggcatacccgatgccatccaccagcacggcggctcggccaccatcccacagatagtcaccaggatcacgctccacccgtccaagacaccatgcctgcggcgcctcatgcgcgtgctcaccctcaccggcgtcttcggcacccaggagccgcacgatgacgggggcggctgtgacgacgagctcgtctacacgctcacgccggcgtcccgtctccttgtcggcccatcggggcagaacgtgagccctttactgaacgtgatgctctgccccatcttggtgtcgtccttcctcgacctccgcgggtggttccagcacgagatgccggacccgtcccccttcaaggtgacgcacgggcgggacatatgggagctggccgcccacgacgccggcttcagaaggctcttcgacgctggcatggtcgcggacagcggcttcatcatgaacgtcgtggtcagggagtgcggcgccgtcttccaggggatcagctccctcgtcgacgtcggcggcgggttcggtggcgccacacaggccatcgcgaaagcgttcccgcacctggagtgcagcgtgctagatctcccgaacgtcgtcgccggcgctcctgctgataccgccgtgaagtatgtcgccggtgacatgttcgagagcgtttcgtcggcagacgctgtcttcctcaagtggattatacatgactggggtgatgccgactgtgtcaagatactgaagaactgcaagaaggccataccagctcaaggaggcaaggtgataatactggatatcgtggttggagcaggatcgtcgtcgtgcgaccggaagaacgtggagacgcaatgcttgtttgatctctacatcatgactatcaacggtgtcgagcgagatgagcgagagtggaagaagatcatctttgaagccgggtttacatcttacaagatcatacctgttctgggcactcgatccataattgaagtctgcccatagaaaccaatataattaaggatggcaacagcctcccatcgcccttgcgagtataattccaaaccagcacttgaatacttgaatccgtgaggttttcaggtcacctaggtgtttttactcattgtacgtttttaaacaataactagtcagttgtgcgtgctttgatacggttgttatatatatatatcatataaataaatattaagatatttatttaaatnnnaaaananagnncaannnnccngaanannnananggaanananaaaa

SEQ ID NO: 16600 - DNA, 1385 bp, Zea mays
ctcgaggccggccgggacctcgaggccggccgggaatccatgcggcggcatatggcgcccatcaaggagcaaaaacacacgacaagcgcagaacagcaggtgatgctggatgccgagctccagctgtggaaccacaccttcggctacgtcaagtccatggcgctcaaggccgcgatcgacctcggcatacccgaggccatccaccagcacggcggcacggccaccctcccacaaatagtcaccagggtcacgctccacccgtccaagacaccatgcctgcggcgcctcatgcgcgtgctcaccctcaccggcgtcttcggcgcgcaggaggcgcacgacgacgacggcggctgtgacgacgagctcgtctacacgctcacgccggcgtcccgtctcctcgtcggctcaccggggcagaacgtgggccctttcctgaccctgatgctcggccccatcttcgtgtcgtccttcctcgacctccgcgggtggttccagcacgagacgccggacccgtcccccttcaagatgacgcacgggcgggacatatgggagctggccgcccacgacgccgccttcggcaggctcttcgacgccggcatggtcgctgacagcagcttcatcatggacgtcgtggtcagggagtgcggcggcgtgtttgaggggatcagctccctcgtcgacgtcgccggcgggctcggtggcgccacacagaccatcgcgaaggcgttcccgaacctggagtgcagcgtgctggatctcccaaacgtcgtcgccagcgctcccgctgataccgccgtgaagtatgtccccggtgacatgttcgagagcgttccggcggcagacgctgtcttcctcaagtggattatgcatgactggggtgatgccgactgtgtcaagatactgaagaactgcaagaaggccataccggctcaaggaggcaaggtgataatactggatatcgtggttggagcagggtcgtcatgcgaccggaagaatgtggagacgcaatgcttgtttgatctcttcatcatgtttatcaacggtgccgaacgagatgagcgacagtggaagaagatcatctttgaagccggctttacatcttacaagatcatacctgtcctgggcattagatccataattgaagtctgcctatagaaactaatataattaaggatgaaaacgggtcaggttcgggttgagttgagcaaaattctacccgggatggcatccttaaagtctacataaacccacccacgatcgtacccacgagtgcaattctaaacccgcacctgaacccgtcaggtttgaggtattgtatacttttaaataataattcaactatctctactactgtacgccaaaaaaaaaaaaaaaaaaggccccta

SEQ ID NO: 16601 - DNA, 1964 bp, Zea mays
cccggccggggaaaaaaaaaaagcctatatataggatccccgacggccggccgggcgggacaatccatgcggcggcatatggcgcccatcaaggagcaaaaacacacgacaagcgcagaacagcaggtgatgctggatgccgagctccagctgtggaaccacaccttcggctacgtcaagtccatggcgctcaaggccgcgatcgacctcggcatacccgaggccatccaccagcacggcggcacggccaccctcccacaaatagtcaccagggtcaagctccacccgtccaagacaccatgcctgcggcgcctcatgcgcgtgctcaccctcaccggcgtcttcggcgcgcaggagccgcacgatgacgacggcggctgtgacgacgagctcgtctacacgctcacgccggcgtcccgtctcctcgtcggctcaccggggcagaacgtgggccctttcctgaccctgatgctcggccccatcttcgtgtcgtccttcctcgacctccgcgggtggttccagcacgagacgccggacccgtcccccttcaagatgacgcacgggcgggacatatgggagctggccgcccacgacgccgccttcggcaggctcttcgacgccggcatggtcgctgacagcagcttcatcatggacgtcgtggtcagggagtgcggcggcgtctttgaggggatcagctccctcgtcgacgtcgccggcgggctcggtggcgccacacagaccatcgcgaaggcgttcccgaacctggagtgcagcgtgctggatctcccaaacgtcgtcgccagcgctcccgctgataccgccgtgaagtatgtcccggtgacatgttcgagagcgttccggcggcagacgctgtcttcctcaaggtaggactgttttgtgaaatttataggaacaaaaaggtcaataacaacaatggtggcatgcagacaacgagtcatacttatataaattttggtctctttcggtagtatatattattattgtttattgtgatgctaccttatttaatttgtgttcacctttcatcagtggattatgcatgactggggtgatgccgactgtgtcaagatactgaagaactgcgggacccccttcccggctctcccgggcaaggtgataatactggatatcgtggttggagcagggtcgtcatgcgaccggaagaatgtggagacgcaatgcttgtttgatctcttcatcatgtttatcaacggtgccgaacgagatgagcgacagtggaagaagatcatctttgaagccggctttacatcttacaagatcatacctgtcctgggcattagatccataattgaagtctgcctatagaagctaatataattaaggatgaaaacgggtcaggttcgggttgagttgagcaaaattctacccgggatggcatccttaaagtctacataaacccacccacgatcgtacccacgagtgcaattctaaacccgcacctgaacccgtcgggtttgaggtattgtatacttttaaataataattcaactctctctactactgtacgtcacaccttttccttcgttcacctctccttgctcccccatatttaaatagtaataaagttaaaattattcacgttgcaacgacacacgaaatattttacaaaatgtttttgcacaacgattacatgacaatgaccaacatatatattcatcagcttcaatatatcacaaattatgtcaacaaccaatctctactataaagcattagtttgcacatgctttgttggaactctaaagttcgttgcacaatcagaatagcataacctaaagtccaatccttatggtggctgatggtacaaagctacaaaagagaatcaaataagtacaatctcaagaagaaaagcacccttgaagatgacatctagtctatctgtgcagtagctcagaagataattgtggcatgatcctgagctggcc

SEQ ID NO: 16602 - DNA, 2530 bp, Zea mays
tattttacgtggtgccctggtcccgtcctcgtcagggcctcgccgtcgcctcctcttttttcccccctcctcgacggctcctcctcacaggctcacagcctcacactcacgcggagagcgctcgcgcgggcgcacacgcggaggggacgttcacaggagggggagggaggagatgccggggagccagaacggggggccgaggcctcggccggtcaaagccgagaccatccacgatcttgcgcgcgccggcgacctcgccggcgtccagaggaagctgctggagaacccctccctcctcaatgacaaaaatcccgtgatgtgtcaaacaccacttcatgttgctgctggctacaataatacagaaatagtcaagttcttgcttaaccagcaaggtacagaaacagttgatctggaggcaaagaacatgtatggggagactcctctgcatatggcagtgaagaacagttcttgtggatcaacaaatctactccttgaacatggtgcacacatagaagccaaagccaataatggcatgacaccattgcatttagctgtctggcatgcaattcaagctggagacttcagcacagttagcgtgttactaagctacaaccctgattgctttgtgaaagatgatgaaggcaaaatgcccttaaatcatattccaggaggagctggtagcgagaagctgctgaaactcctcactcatcatatggaagagcaaagaaaacggaaagctctcatgtcatgcctcgaagggaaagcaatgtcagagtttgaagaggcaatgtcacaaattgttggattgcaggagctaaaaatgcaattgcgccgatgggcacgaggaatgttttttgatgagaagcgacgggctatgggcttggggattgctaaaaggagagctccccatatggcatttcttggcaatccaggaactggcaaaactatggttgctcgaattcttggaaagctcctccacatggttggaattctccctactgacaaagtaactgaagttcagcgaactgatcttgttggagaatttgtggggcatactggaccaaagactaggaggaagatacatgatgcagagggaggtattctcttcgtggatgaagcttacaggttgataccaatgcaaaaatccgatgacaaggattatggtttagaagccttggaggagataatgtctgtaatggacagtggcaagatagttgtcgtatttgctgggtactgtgagccaatgaagcgagtcatcgcctcgaatgatggcttctgcaggcgggtcacgaaattcttctatttcgatgatttcagtacgacagaactagcagagatcctacatatgaagatgaagagtccaagtgactgtagcttgctttacgggtttaagctgcacccaagctgcagcattgaagccattggagagctgattgccagggagatcactgaagagcagaggaagcagatgaatggaggccttgtagacacgctgctcatcaatgcccgcgagaacctggattcgcggcttgatttcagctgcaacgatgccgatactatgatcacgatcacgttggaagacctggaggcagggcttcgtcagatttccagacaacgtcacctgcagtgacatgtaaatttaggagaattttttctcgatgatctcatgcttgtctccaagggcgaagttatggctgtatcgtctcatccaacgtttttggctattctgactgtgttgtatctagtcgttgctatatagcagtaaaatgcatgtggtatatacaattatacatcatgccctaacaatatttgacatctgtggaatagccagtaccacatacggatttcagtacgtgcataatcaattcagatttgatggttgaagtgattgaatttgaatcctaactaaaccttgacgaccgatttttctttttacgaatccattcctttacatcactccattgtcatctgatgacattcactttcaaaaaaaaaaaaaggagagagaagtggctgttcacatgccattgagctgtgctcaagtgcatgagcgcatctgtatgtggcaagaccatacatgcactaaaaattaaagcaagcaacctcatgtgcctccagaatagtgtagatcccagacttgccgtcttgcactgcattgccgttcggtggaatggaatcttgctttactgctagcagtggaaagtagatctgcagcgtggatgcctacgcaaggtctgtttggttgagttagtttttcttaaaaaaaactaatatgatctatggattataaagtgttcaacaagttacccacacccacatgatcatccaaaatactgtttcacactgtataatacactgttcatataatgaagtttgtaatagaagataagatgagagataggatggataacctgttggagatagtctaagggcctttttaacatggcttttgcatcaccagctctagctttggctcatctagaaaaatagctccttatttttaggagactttggaggatcattttgttgg

SEQ ID NO: 16603 - DNA, 2225 bp, Zea mays
ccggccgggtcccaaaaagaaaaccagaccattctcctctccgaattcaataattcctccgccgcaccacgcttcctcctcctctgctccgcctcttcatccagcgagcgtcctccgattgctgacggatccctcctcgccgccgccgcgggccgaccgtggggagaggaggggaggcgggagtgatggaggccgccgaccacgggaagctctttgtcggcggcatctcgtgggagacgagcgaggaccgcctccgcgagtacttcggccgcttcggcgaggtcaccgaggccgtcatcatgcgggaccgcagcacggggcgtgcccgcgggttcggcttcgtggtcttcgccgatgccgctgtcgccgagcgcgtcactacggaaaaacatatgatcgacggacgaatggtggaagcaaagaaggctgttcccagggacgaccacagtattgtgaccaagagcaacgccagcagcatagggtcacctggaccgggacgcaccaggaagatctttgttggaggcctgccctcgaacgtcacggaggctgacttcagaaggtactttgagcagtttggcgtcatcaccgatgtggttgtgatgtacgaccacaacacgcagaggccgaggggctttggattcatcaccttcgattcagaagacgccgtggacaaagccctgcacaagagcttccatgagctcaatggtaaaatggttgaggtcaagagggctgttccaaaggagcagtcgcctggacctgccgcacgctcacctgtgggagtggggcagaactatgctatgaacagggttcatagcttcctcaatggcttcaaccagggttacaatccgaaccccataggaggttacggcatgagggtggatggaaggtatggcttgatttcaggtgcacgaaatgggttctcttcttttggcccagggtatgggatgggcatgaatgttgaaggtgggatgggcggaacatttggtgcaagctctggtttcatcagcaactccaacgggaggcaaatgggttcgtacttcaatgcaagttcgaacagattgggtagccctattgggtaccttggtcttaatgatgttccgggatcaatgttgagttccatgtctaggaatgtttggggtaatgggagtctaaactacccgagcaatcctacaaatatgagtgcttttgcttcacctaggaatgggggccaagtcagtcttcccagtgacaattggggaggtcttccttctgctcatgggatggacaacatttcaagccttgggtcagggaaccttggtcgtggaactggagataataactttggtttgccttctggtagctatggcaggaacaactcaactggtacaattggtgagcctttttctgcagcaggcaatacatatgaagtaaacaatcgagatacatatgggagcagctctatttatggtggcacagcctggaggttcgcatcatctgaggttgacatgccttcttttgttcatgatattggaaatgttgatccgactattaaatgatacatgtcagcaagtcacatgggcaactaccctgttaacaacaatcagccaagcagaggcatcagttcctagggggcggcgagtattacacttgggggtagtagaaggaagaaacacccattcagccaggcaatcccggcgcacacggctgtgaatcggtcggtgatttgtcaggttaatacacaggttagtttttgtgtagctaacccagcggcgtggtttgcgaacaccgacatgctagaggtggaagctgctaggctagctagaggaaaggagcgcggatggatatacagaaacatttcgtgaaggttttgttttgtttcttgttttttgttttgtttttggcggggggtggtggtcatgttctagttttggttcgtacgcgcgtggtgaggccttttggagttttgaatgagatgtagtagtaattgttgcggcacatattttagaagtgaagccatgttccaacagaagctggaaagagatgtctgctgtatacgggtgagcatgtataccaaccaaagggatgctgtattatacattagcctgtgtgtgtgtgtgcgtgtttttttttggtttgatccggtttttagccatttgtcttttttttcactctggagattttgctgacttgctctgaattattatgcatgcagtggtgtttattttgttctccccatgtggtgtgat

SEQ ID NO: 16604 - DNA, 2191 bp, Zea mays
gccggccgggctcgggatttgctccatttccatttaaacacacaagcacacgcagggcccccccggattcagatttcatcctcggcgtcgtctcctgtcctctccacgccaagcaacctccccaccccgccccaccctccatgctcgcctcgagatcttagcgggcagctccggagagcgccgacgagccccctgatccctcctcgccgccgccgccaaccgaccgggggaggagaggaggggaggggagcgatggagaccgccgactactccgggaagctcttcgtcggcggcatctcatgggagacggacgaggaccgcctccgcgagtacttcggccgcttcggtgaggtcactgaggccgtcatcatgcgggaccgcagcacgggccgcgctcgagggttcggtttcgtggtcttcgctgacgccacggtcgccgagcgcgtcaccatcgaaaaacacatgatcgacggccgaatggtggaggccaagaaggctgttcccagggatgaccacagtattgtgagcaagagcaacacaagcagcatagggtcacctgggccgggccgtaccagaaagatctttgttggaggtctgccctcaaatgttacagaggctgacttcagggggtattttgagcagttcggtgtcataactgatgtggttgtgatgtatgatcacaacacacagagaccgaggggctttggattcatcacctatgattcagaagatgctgtggacaaagccctgcacaagagctttcatgagctaaatggtaaaatggttgaggtcaagaaggctgttccaaaggagcagtctcctggacctgttgcacgctcacctgcaggagtggggcagaactatgctatgaacagggttcatagcttcttgaatgacttcaaccaaggttacaatccgaaccctataggaggttatggcatgagggtggatggaaggtttggccagctttcaggtgcacgaaatgggctctcttcttttggcccaggttatgggatgggtatgaacgttgaaggtaggatgagtggaacttttggtgcaaactctggtttcatcagtaactccaatgggaggcaaatgggttcatacttcaatggaagttcgaatagattgagtagttctattgggtatcttggttatgactcaggatcgatgttgagttccatgtctaggaattttaatgcaggtgtaaactacccgatcaatcctacaaacatgagtgcttttgctgcccttggaaatgggggtggcgtcaattatatgggtctcccttctattgcccctgagttggcccagttgggcaacatttcaagccttgggtcagggaactttagccgtggagctggagttaataacttaagcttaccttctggctcctatgggaggagcaattcaactggtacaattggtgagcctttttctgcatcaggcaatgcatatgaagtgaacaacccagatacatatgggaacaagctctatttatggtggcacatcctggaggttcccttcatctgaagttgacgtgccttctttcagtcatgatcttggaaatgttgatccgaatatgaaatcagacatatcagcaaattacatgggaaattattctgttagcaacaatcagccaagcagaggtatcacttcatagtgggagtattactacacattcatatatgacttgggatagatgaagcacccattcagtcaggcagccaggtgcgtgcatggcaactgtgaatgggtgatatgtcaggttagttttgtctagctgaccagcggtgtggtttacaacaccaacatgctagaggaggaggaagcggatacagaaacattttctgaggggcttcttttctttgagtcatgtttttagttttgattcctgcgcgtggctagctccttttggtttttgaatgagatgtgtagtggtgattattgcggcgcatattttagagatcgtggttcttccaacataagctggaaaaagaagtctgtatacggatgaacatgtataccaaccaaagggatgctgtattatcttgcccatttgttactacattagcctgtgttttatatcgttctgaaccgttcggttttgcactctggaggttttgttggtttgttcgtgagattatctcggccgggggcccggttcttctaaaaaaaaaaaaaaaaaaaa

SEQ ID NO: 16605 - DNA, 3797 bp, Zea mays
  misc_feature (2960)..(2960): n is a, c, g, or t
tgcgagaactttttgtgagtaaaatacactaccggtccctaaatttgtagaggtatgtcatcttgacccctaaactcccaaagtgtacatcttggtccctaaacttatgaagttgtatcgccctagcttttaaattttcaacatacacattctagtccctatacttgtatggttgtgtcatctaggtccataaggtctaaactaattggacctgtgatgacactaaaaacaagtttagaaacctagatgacacaaccatacaagtataaggaccgaaatatgcacgttgaaagtttagaatccatgatgatataattttacaactttaggaacctggatgtgcattttggaagtttaaggaccggaacaatacaacgctataagtttatggacgacagtgtattttactctttttttgtcgagaaagattatgacagtagtatgttcactgagatttgagtcatctgctgagttagtgttctagaaatgtatgatttagattttaaattggacgagcagaatcttcatgcaaggagcatctggctggagtgccaatttaattacggtgtatgcaaggcctgcttacacgagctgtagtccaccctgaacatgaacttttcagtaccttttttttggtatcagatatcgaactgtgtgtatggttttttgtgtctttattttttagaaatgaacttagtttgtttgttacataatttgagacaaatcaaacttcaagttctaacaatgataattgatatgatggctccttttgcaggtaccacttcctagggtgagtattactatatccacatatgccttggtgtagatgaaacacccattcagtcaggcatccgggtgcgcggccgtgaatcggtgattgtcagattaatatacaggttagttttgtctagctaaccagcgggtgtggtttgcgaacaccaacatgctagagatggagctgctagaggagaagcggatacagaaacactttgtggagggtttgtttttttggggtcatgttttagttttgattcttacgcgtgcgtgggtgaggccttttggtttttgaatgagatgtaattattgcggcacatatttagaagccatgttccaaccggggattacattttcgttttgtaatcccaaaaactgttttgttgaccaaagtttccctttatatttttcccccctaaactgaaatacaaaaaataaaaatccggaccggaccgaaaacggtaaattttaccgccacttgaagtttaaccctggttccaacatgagctggaaatatctctgtatacggatgcacatgtataccaaccaaaggggtgttgtattatacattagcttgtgtgttttttatccgtttttaacctattgttttcactctggagattttgctgacttgctctgaattatgcatgcagtggtgttttctccctttttaggcctggatcggttattcctgtcatacatgaattagatgtgattagaaaaaattaagaagtttaacttttttggaatttaaacttacttaatccacatgaatgagagcgaaccgaataagtccttatgtggtatgataatatatatacccttttttttatttcactgactccttgcattttacattttacagttcatttttagcaggagtaaaaagagatttgtgctacagtagcaaatagttcagttacgtgatgaggagccacaacaggctagagcccgtggtcgcgcatacttcgtgttaacgctagcaaacatggcaagatttatgactttaaaatatgtcaagattctctaagtctgttgtggcgataaatttgagcgactaaccttaagtaattgtgacataaaatatataacaatttatgacactttagacatacgaccaaatatctaagtctgttgtcttttacatgcatgcaatgtctcagaaattgttggtctccaagcatgcttgtctagtcccaaattttagtgacttttgccaagtagttttttacatacaatgtgacttttgtcaagtagtaatggtatttttgtttgatgtttgggcccagaggacgtacaaagacgagatttttaatttcaacccttttaaaaatatctataaaaatagcattagagatcaggcaaaccaaattatagtattgatttttttggcatggttggctagctgcatgttgattcttgtcacgctgccgactcggacacggtaatcggctaatcgtgccatcccatttttgtgtgagcgacttgagaaccctcggtgtcattacagagatctacggatccatttgagtttgagtgtagtgacaaaaactataggaacacctaacactaaaagagtgtgaactagacaatctatttatcactaaactaaggtgctttatttctcataataaaaatactatacaacatgtaaactatcttatgcacgactacgatttttactaaatgttgctacctctaccataaagagttatgcaacacaggttctaaacctatccattaccttataacatttgagattattacatatttacttagagagggtcaatagttactctcctcagttcaccaaaggcttgttcttcccaggaccaaattcacgagatctccattcacatatactgggtttccaccatggaaactcataccgtctcatacccatctctcttgatgcgaattctatgacattacgtggtagcccctttgtaaatggatttgctagatttttatctattgaaatataagtcacacttataactttgaagtttctcaacttcctaatagacttcaatcgccttttgacatgtcttgatgacttcccattatccttagaaaatgtcactttggcaatctattatcatcgtattttagcaagacctgagacatgctgcaacacaggatgggccgcgaagagcggcctagaggagcggaaggatatgcctcgngcaggggcattccaagataagcatccacaaattgtgtgatgataggttggcttaagaataggaggatagagtccgactgttacactagggttagagagagtccgtgggactataaatatgtatctgtagaaacttatgagggggatcgtaatttctccactaattgcgaccgcaagctttggcgcatcgccacccctgttctcagggttctctacaagtaagtgtcacgccgccctaattgtgtcctacgatcagggcagtgctgttcttactcattgaattttagtgttttcttgtactgaagcgtttttgatggtgagatgcactagctatcgtagaatataggattatgcgtcgatggagttgttacgtatgcatgttgcctgccaattacgagcaatgtaccaccccttgcacaaggttctctagcgcgacaatagtgccctgttttgatcccacttggtagatctgatctgtcatggttagtatttggtctatcaaagatctattcaatatccatacagctagtccttgcatggtggtggacgttccggtgacgtgtcgggcagttggcgttggtttggagtggggattgttctgggagtcgactcagaccgacttttaagcctccgttctagacgtcgtttgggtgcctgccacgatcattaggcccagccacgtgcaagatgttccggttgtatgatgaagctttaactgtaatggttcggagcctgctcagtgcagataaaatgggatttccagaggctatcggctctttgcgtcaccaaggcgtggatctcatgtgagcccatggagaacgattgactctttatgccg

SEQ ID NO: 16606 - DNA, 1484 bp, Zea mays
gaggccggcgttacgccgcaccactcttcttcctctgctccgcctcttcacccagcgtcttccgattgctgacggatccctcttcgccgcggccgccgccgcggaccgaccgtgggagagaaggcgaggcgggagcgatggaggccgccgactacggcaagctcttcgtcggcggcatctcatgggagacgagcgaggaccgcctccgcgagtacttcggccgctttggcgaggtcaccgaggccgtcatcatgcgggatcgcagcacggggcgtgcccgtgggtttgggttcgtggtcttcgccgacgctgcggtcgccgagcgcgtcactatggacaaacacactatcgacggacgaatggtggaagcaaagaaggctgttcccagggacgaccacagtattgtgagcaagagcaacggcagcagcacagggtcacctggtccaggacgcaccaggaagatctttgttggaggcctgccctcgagtgtcacagaggctgacttcagaaggtatttcgagcagtttggcatcatcaccgatgtggtcgtgatgtacgaccacaacacgcagaggccgaggggctttgggttcatcacttacgattcagaagacgccgtggacaaagccctgcacaagagcttccatgagctcaatggtaagatggttgaggtcttccttctgctcatgggatgggcaacatttcaagccttgggtcagggaaccttgctcgtggagctggagataataacttcggtttgccttctggcagctatggaaggagcaactcaactggtacaattggcgagcctttttctgcagcaggcaatacatatgatgtaaacaatccagatacatatgggagcagctctatttatggtggcacagcctggaggttcacatcatctgaggttgacatgccttttggtcatgatattggaaattttgatccgacaatcaaatgagacatgtcagcaagtcacatgtgcaactatcctgttaacaacaatcagccaagcagaggtaccacttcctagggtgagtattactatatccacatatgacttggtgtagatgaaacacccattcagtcaggcatccgggtgcgcggccgtgaatcggtgattgtcagattaatatacaggttagttttgtctagctaaccagcgggtgtggtttgcgaacaccaacatgctagagatggagctgctagaggagaagcggatacagaaacactttgtggagggtttgtttttttggggtcatgttttagttttgattcttacgcgtgcgtgggtgaggccttttggtttttgaatgagatgtaattattgcggcacatatttagaagccatgttccaaccggggattacattttcgttttgtactcccaaaaactgttttgttgccctaagtttgactttatatgcggccattctaaactgaaatacaaaaaaagaaaaaaaaactcgagggggggcccgt

SEQ ID NO: 16607 - DNA, 2879 bp, Zea mays
gccggccggtccggggtccccccgcagcagcgccggccgggctggcatcgcctccttgtccggttctaccgtcccatctggattcctcttctgctccccttctcctcccttcccttcccttcctcgacttcacctcaccaccatctccagctccatccgcacgcagccgtttaccaaccgacgcagcgaggagatgaacgcgtcgcagttcatggacaagcagatcctcggcctggctgcctccgcttccccctccggcggcggcgcggggggcggtgggggtgtggatctcagcgatctgatgataccgatcccccaggacgacggcgagaaccgcctcggtcgccggcgtagcagcaccagcgtcaacggaaccgcatgcgacatgctacccagttatgacttccagcccatccgcactagtgacggcgccgcggccgccgccgcgcctcaggcctcgtgggggtcgctcgactccaaggcaccctctgcctcatacaacctcaagagtgctggtatattggagccacacgtgctgaagaaagttagtcatgaggaagacaggagtaactttcctacagttactattgcggatattgatcgaaccatgaagaagtactctgataaccttttgcatgcactggaaggtgtaagctcaaggctttcacagatggagggtagaacacaccaactcgaaaactctgttgacgagttgaagttaacaatcggtaactataatggtagcactgatggaaaactgaggaaccttgagaacatgctcagggaggtccaagcaggtgtgcagattttgcgagataagcaggaaattgtcgagacacagctccaccttgcgaagctccagacaaacaaaaccgatggccaatcatcagaaaatagtgggtctggacaagctggcttacagcagcagccggtggttcctccacaagcagccattcagccacaacaagtccgctccccttcgcaaccacctgcacttcctgcccttcctgctccaaatgcaccgcctccacctccaacgcttcaaaaccaatcatcattacagtttccaagtcatttacaacattcacaggtaccatctgtgccttctgttgcactggcacccacagttccagctttaccaagggatgcttactatgccccatctgctcagccgaccgagaccatgcaccagcagtatcaagctccgccagttccacagccacaggcacctcctgcaccacctcagcagtacctcgcccaaacccagtcccctcaatatgcacagccacctcagcctgcaaatgttaacccttcaactccccatgtgccccatgcaccccagcaaccagaggaaactatgccttatgcaccagctcagagctatccacctaatgcaatccctccaccttatatgcaaccacctagtggacctgctcctccttactatgggcagcaaaaccctagcatgtatgaacctcctgcaggccgggctaaccctgggccaccatcatcctacggttctgctgggtacgggccacagggtggaggtagtttctctgaatcttatggttacactggatctccttcccaccgtggcaatgctggaatgaagcagtcttcaccttttgctcaatcctctggaggaagcggcagctatggcagtggcaagctccctactgcccagatgcttccacaagcagtgccgatcagctcctccagcaccagcggttcttctggcaatagagtgccacttgacgatgtagtggagaaggttgctacgatgggattctcaagagagcaggtgagagcaaccgtgcggaggctgactgaaaacgggcagaacgtggacctgaatgtggtgctcgacaagctgatgaacggatgataagttgagcaatactgtcatttcacagtcccgcacagtactatggaaacttggaaagtgtcagctcatcagctgaaacgatttttctgtctgcaacgttgcatacctgattgtgcctggagaacaataatggccgaacagccgctcatcctgattgccggtcacggttgcttcatctggaatggaaacagctcagtgtgccttcagtgaattacagtatcacaatctgaatacgttgtccattttatgtatatgtggcgatgagacattctaaaacatatactgtggtttcttgtgatatgttaataagcagctttactctgtttttaggcagtgtttcagccttgctggaaagtgctttcgctacataaaagcggaacatcaaccaaactcaacaaagtgtcctttcccaatagcccttgttttcatatagtatatttttcatacttcagcgctccttttaccaaaaaggagattagggtggctatcttgggtttggattataacaaagctcctagttttgatggtttttcagccgaatattacatgaatttttggaaaaaccattaagccagacttgtcaagaatgcttgaggcgcaaggggtaccttccacgttttagcctaaactttggtgcaattacacttatctcaagagaatgtgatccaacaatataggtccatctgccttctgcacttaactcatgaggttaatgtgatccaacaatataggtccatctaccttctgaatggcttcaaaatattcactaaagtggccactatcagacttaattatgcagcgtaccatgttatcaatcattcttaaacaacatttatgaggatgaaacatcatagagggcgttgttatcttacatgatgtcgttcatgagctacatagaaaaaaaacaaaagtggtatcaccttcaaaattgattttgagaaggcttacaataaagtaaaatggttctttcttttctaagcactacgcatgaagg

SEQ ID NO: 16608 - DNA, 2699 bp, Zea mays
ggtaccctcggtcctgccgggagaacacggaccggccggcagggggattacgcttccgctccccttcccctcctcacctcaccaccatctccagctccatccgcaccaacatctccaccaaccgacacggcgaggagatgaacgcgtcgcagttcatggacaagcagatcctcggcctcgccgcctccgcctccccgtccggcggcggcgcggggggcggtgggggtgtggatctcagcgatctgatgatcccgatcccccaggaggacggcgaggaccgtctccgtcgccggcgtagcagtagcagcgtcaacggcacatcagacgacatgctacccagctacgatttccagccgatccgcaccggcggcgccaccgccgccgcccccgtgtctcaggcctcgtggggatcgctcgactccaaggcaccctccgcctctgcctctgcctccgccgccgcctcatacaacctcaagagtgctggtatattggagccacatgtgctgaagaaagttagtcatgaggaagacaggagtaacttccctacagttactattgcagatattgatcgaaccatgaagaagtactctgataaccttttgcatgcactggaaggtgtaagttcaaggctttcacagatggagggcagaacacaccaactagaaaactctgttgatgagttgaagttaacaattggtaactataatggtagcactgatggaaaactcaggcaccttgagaacatgctcagagaggtccaagcaggtgtgcagattttacgagacaagcaggaaattgtcgaggcgcaactccaccttgcaaagctccagacaaccaaaactgatgcccactcatcagaaaatagtgggtctggacatgctggctctcagccggtgcctcctccacaagcagccattcagccacagcaagtcttaaccccttcgcaaccacctgcacttcctgcccttcctgctccaaatgcaccacttccaacgcttcaaagccaaccaccatcacagtttccaagtcatttacaacattcacaggtaccatctgtgccttctgttgcaccggttccctcagttccggctttaccaagggatgcttactatgctccatcttctcagccgaccgaaaccatgcaccagcagtatcaagctccgccagttccacagcctcaggcccctcctgcacctcagcaataccaatccccatcccagttccctcaatattcacagccatctcagccttcaaacgttaaccctccaactccacatgtgcctcctgcaccccagcaaccagaggaaactatgccttacccaccgcctcagagctatgcacctaatgcacgtcctccttcaccttatatgcaaccgcctagtggacctgctcctccttactatggacaacaaaaccctaccatgtatgaacctcccgcaggccgggctaaccctgggccgccatcatcatacggttctggtggctatggaccacagggtgggagtggtttctctgactcatatggttacgctggatctccttcccaccgcggcaatgctggaatgaagccgtctacaccttttgctcaatcctctgggggaagtggcggctatggcagtggcaggctccccacggctcagatactaccacaagcagtgccggtaagctcctccagcaccagcggtgcttcaggcaatagagtgccacttgacgatgtagttgagaaggttgccacgatgggattctcgagagagcaggtgagagcaaccgtgcggaggctgacggaaaatgggcagaatgtggacctgaacgtggttctcgacaagctgatgaacggcagataagttgagcagtagtgccatttcaacagtatgtgtatagtatggagacttgggaagtgtcagctgaaccgattttctgtctgcaactttgtaaacctggagaactctgatgaccgaacagccgctcatcctgattgccggtcatggttgctccacctgaaatggaaacagcccagtgtgcctgtcagtgaactatagtattattgcaatctgaatacgttattcatttgatgtatatgtggtgctgatgatattttaaaacatataccgtggtttcttgtgatatgttaataagaagcctttactgtgttttttaggctgcgctacagaaaaacggaacgtcaaccaagcccaaccaaacaagttttcgtgtcgtataattttcatagcaccttgaatctattttcggcttatgttattttaattgggtggagcggagtgctttcggcttatgttagttctataaataggtggaaatataaatatgtttttatagttgttttgacggggagacataaagggggtgttcagttcagttttctttaaccaaacagatttaaacttttacacatactgtagtttatattatgagctgtatttaacgtttcagctgaaataaaatccttgaactcctctatgtatccaccatctgtcatccctaacagtgagtggcacgcagcagaatccagaacgaatggcagcagccagagggggagggggtcagtctcggtcctgtctctgtgtatttaagtggccacgtgtccgacctttgaggccacgaacgagcataagagaagctccatcgatgtcggtcaggctacactcttgcaccgcaaaccagagttcaccgaaccgttc

SEQ ID NO: 16609 - DNA, 2905 bp, Zea mays
gcttgcatgcctgcagtagcagtctcccctcccgccccctccgcctcctccgtcgatttggattcgcagcggcggcggcggccaatcaaagcaatcatcacccagtcgcccagcccaacagacgctccagtccccagccctcccacccgcatcgatcgatgcgaggcacaatgccggccaccgactcctcctcctcgtcgtcgccggcggcggcgccgctgtcctctatcggccgctccatccgctcgctccgccgtgaccagaaccagatccactccttcccgccgccgccagacgccacagacgccttccagcgccgcgccgcccaactcctggccgacctcccggcagccgacgacgtcctctccctcgcctggacgcgccgcctcctcgaatccttcctcctctgcctcgaggagttccgcgccctgctcttcggctccggggactcgcccgccgctcgccccccgctcgaccgcctcgtcgccgacttctccgaccgcgccgtcaaggcgctcgacctctgcaacgccgtccgcgacggcctcgacctcgtccgccagtggcgcaagcacctcgccatcgccgcagccgtcctcgcctcgtcctctgattcctcctcgccgctcggggaggcccagatccgccgcgcccgcaaggcgctcaccgacctcaccatcctcatgctcgacgacagggacggcgggggcgtcgtcggccagcgcaaccgatccttcggccgcgccaacgagaagccccctcgccaccaccgccggagcagcagcggcgggagctccggctccggctccggctcccacctcaggtccctctcctggagcgtgtcccgggcctggtccgccgcgcgccagctgcaggccatcgggggaggactccccgtgccccgcccgcacgacaacgctgccacgggaggcctcgcctccgccgtctacaccatgggcgccgtcctcttcatcgtcgccttcgcgctcgtcgccgcaatcccgtgccaggaccgcggcctccacgcgcatttctccgtcatcaggaacctcccctgctcggcccccatcacaacgctctacgagcgcatcctcgacgagtccaagaagaaggaccgcaagaactcgtgcggcctgctcaaggagatccaccagattgagctctgctccaggcacctcatggagatcactgacgccgccgacttcccgttgcgcgaggacaaggacgccgtcttgcgggaggccgcgcaggacctagtgcacctgtgcgaatccatcaaggaagggctcgacccgctcgagcgccaggtcagagagatgttccacaggattgtgcgcacccgcacagaaatccttgactgcttgagtaagccacatggcaccgggtgatgggatacaggagattgccagcccgtttgcttgctgtgatgccccttaaccaaacattcttgtgaaatgcagcagcggtgttcagatgaggtagccttttctctgcataagttagcaactactgcatcatacaaatgcgtcttcatagaggcttgtccttctgtttgatataaattggtttgtttattatttttatttcatttcctcatctgtgtagattgtgaatccatacttggcagtgcttcgtagtcaaaaaaaaaaactatttgttcccttcctttcatctggtttgatgtggtagtgattagttaatgtttatatggttagcatctgtgccaacacagaaacgaagcaggcttagtgcccgttcgtttatctcagattgagaccaggaactatttgagctaatcataccattccagagtaaacgaacagggccttatggtgctatgataaggtgagagtgttgagaggtgatgcttttgacaccaccaccatttttttggtacccaaagattagcgaatgtacatagtctgatcacaaaggagatgacgcttcattgatcactcaacgtgaacttatgttggcttagtccattgcagtgctgattcgttctctcatcctgtttttgcgtgtttagactttgtgtaggcaaatggacagaaacaactgacgtagttaatttctttgtcaatgaactgatttgggtgagtggaacctttgatcctgtattttaatctggtagtatctttgatatgtgttctgtccttgtacacagactatacttaaaaagagatatacagaagtactgttgcatttcagagtgcttagtgcaactggtaggttcgtcattgagctgcacatcacatcctgtatgaaactttgctagctgtagagaacttgggtggtcagctaagagcatctccaaatagttcccagaaaattagttggtaaaccactggagttttagaagtggctaaaaaagcaatgagagtatgtttgttggtttcctggtgaatcactgagttttagaagtggctaaaaaacgagagtatgtgtattggtttccttctaaaatatagaaaacaaatttgtatcaggagtcatgaactatttctaaattactccaaaccatttttatactttgtttctctctcttatacattatacatttgcattaggaaccctgtcttactctttcttatcacttctttcacctctagattgacacatcgacacttgagagcgtatatttctgcacagttagatcgattttcccgatagcggaaagattaagagttcagatagaaacttgttggagaacagtttttctctctcttcaaatcttgctaaacaaatctagattgggagttggttgtggtaactcttggaggtgctccaacatgtgtgatgggttgtttagatggagttgtaatttgtattgttgccacaatacttcagtttgttacatgacatttgattgcccttgagctgagtcaactcagcgccaatcaag

SEQ ID NO: 16610 - DNA, 1790 bp, Zea mays
ctgcagcacatgtgcgtaacgtaaccgagcagagtagtaaactagtaactgacgaccattgataaaaaaaatcctgtgggctatacgcagagaagttttgataaaccattgctgatcagcccataaagcccgacactagcttttctgcacaggttgtgggctcgcttcaaaccatagcaccacgcgctttcgactcggcccatacagcccacagacacttccttcctccacgcttgggcacggcagcggcgccgcaaagccgaacgagagagagaagcagagaacccctcctcgacctcggcctctcctcttcctcctccgctcccaaaatcctagggttttgctcgccgcggcgcgatggagcccacctcatcggcgtcgatcgcgcggcagacgtgggagctggagaacaatatccccgcggcggcctccgacccggacgcgatggacgcgatctaccgctacgacgacgcgtctcaggcgcgggcgcagcaggagaagccttgggccaacgacccgcaccacttccgccgcaccaagatctccgcgctcgcgctgctcaagatggttgtccacgcccgcgccgggggcaccatcgaggtcatggggctcatgcagggcaagtgcgagggcgacgccatcatcgttatggacgcattcgcgctccccgttgagggcaccgagaccagggtcaatgcccaggccgatgcctacgagtacatggttgactactcaaccatcaacaagcaggctggaaggttggagaatgtggttggctggtatcactcacaccctggctatggatgctggctgtcaggaatcgacgtgtcaactcagatgctcaatcaacaattcacagaaccattcttggctgttgtgatagaccccacaaggaccgtttctgctggtaaagtggagattggagcctttagaacatacccaaaagattacaagccaccagatgagcctgtatctgagtatcagactattccactcaacaagatagaagattttggtgtccattgcaaatcgtactatgctttggatataacttatttcaagtcatccctggattctcacctccttgatctgctctggaacaaatattgggtcaacacgctatcttcatcatcgcttctgggcaacagagattatgttgctgggcagatctttgatttagctgataaactagagcaagctgaaggccagctggcacacagtcgatttggtggtatgattatgccatcgcaacgaaagaaagagcaagaagagtctccactggctaaggtaacacgagatagctccaaaatcacagctgagcaggttcacggcctcatgtcacaggtcataaaagacatccttttcaactctgttcacccgtcaagcaaggcaagcacaagtgctccaccagattcatccggtcctgagcctatggttgaagcctgagttccagcggaaggggacaatggatatttgtgttatgttatctgattcagaaggtgcaaaacaagttatcttttgagtacagaatcatcatgtaattatgagttgccatcttgggctgccactgagagggtgtgatttgggtccggttagcaatctcatgtattggatttcggatcagtattcgaagctttcataacgaggagccatcatcttattttaaaaaaaaaaaaaaaaaaaaaccccaaccgcggcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 16611 - DNA, 4453 bp, Zea mays
gtgctagagccagagctagagccggtgaagctactatctgtggcttcttattcatagcacaaaaattactctatttttaggtgcttttcgcagtaagccattttaaaaaacaatgtgtggtagagctttgactttttccagagagaaggcagagacgaagccctgtgaaacggtctcctaatacgaccatatgactgtgtgcctctatagtataggtccccctattcttgtgcgcttttgatctagttcacctctcactttcttccagtgatccagtcagttgcattgtttattcatctttcactcgtttacccgccgggaagaatttttctcattttacattcccgtgaggaataaacttcgcattcccatcccttaagggctagtttgggagacataaaaccggaggggattgaaggggctagattttccttcttattcaaaattgaataagaagggaaacctagccccttaagggcttgttcggttattttcaatccatatggattggaggggattgatacggattggaggggattttgacttactagggattgaaaccccctcaatccccctcaatccatatggattggggcagaaccaaataagccctaaggctttattcgtttcatccctaatccacgaggattgagggggattggagtggattgagggggattttgacttgtaggagattcaacctctttcaatcctcatgggtttgataaaaacgaacatggcctaaattgaataagaaggggaatctagcctcttcaatttcctctgattttcatgctatcaaactagtcctaatagaagaattccccgtggagaatcggggatcaactctcattgccatctctagtaacaagttgacctcaaaataaaagcaaacaaaaaggaaaaagtcatggggcatgtacaaaaagaacctttgcttccattgaccctttagccttttttttttacactttcgccgataaaaggagcaaagcgcggtgcttgggccgagatcttcagggatcaggatgcactagccggaaagggaaggttagctctgaagcgttctccgcagagcacggagcaccgtattgctggtgtacgtacatgtaaagcaacttggttgtactgcagagagagcaccctagcctgcatgtaaagcaagctgctagtttaggagattctgattgatgtagggtttacggagggattgtggataataatcggctattgaaccgcagtccgcagggctactgctcagcatttgaactcctccttccccacacggccacaccccatccgattcgattcaattcaactcaataaattctcttggcaataactcagcccgattccgatccctatacctatacctactttaatatacaaatgcgtaatacaccaggtcaccagctagctcggggtccaaccatctctttctccctcccctcccctgcttgcggtaggatggggtgggtggacttctcaccaacacccatcccactgaccgtgggtcggacgttgcatcgaccccacttaccagcggctgctagcctgggaccctctcgcccgctctggaacccgtccgtcgtagcggagcggcgacggagcgaagcacgcgcgcaggcatctgggtgaggggaaatggtggaaagccaacgcacttttcgcctcgctccgctgctccgctttgcggtgctcccccactccccccgtcggcttgtcttttccgcggcccgcctgcgcccctccggccccctggctcctaaaccccccgcatcccgcgcccggtgatgccctcgcggcagcctacgccgtcgccgggcccggccgccgccgtcgcggtctcggacccccgatcccgcgggccccgccaccgccgggccccgcccgccggccccgtcgccgcgggcgcgtcggccgcggcgctggtcttggtggctgccgtcgcgctgctgctgctgctgctgtggcggaggcgccgccgccggaagctcaccgtggcggccggcgcgcagcccgccgccgacctgcggaggttgtcgtaccagcagctgcgccgcgccacgggcggcttcgcggcggggagcaagctggggcagggcggcttcggcccggtcttccgcggcgcgctgcctcggtcggggcagcccgtcgccgtcaaggtcatggacgccgcgggctccctccagggcgagcgcgagttccacaacgagctctccctggcctcccacctcctcggctgcgccgccacggcccacggcggaggaggagggggagggccccccgcacccgacccgccccccatcctgctcccgttcgcctactccctctccacgcagccacgccgctgccggatgatgcttgtgtacgacctcatgcccaacggctcgctgcaggacgcgctgctcgggaagaggtgccccgacctggtgtccggctggccgcgccgcctctccgtcgcccgagacgtcgccaccgcgctccactaccttcattccgttgtgcagccgcccgtcatccacggggacgtcaagcccagcaatgtgttgctggatgcggatctccgcgcccgcctctcagatttcggactcgcacggatcaggtctgaagaggaggatgagttggggagcggtgccattggggccgacgcagacggtaacgccaatcccagcggtggatgtgacgaggatatgtcagtggctggcgagagcaccactgctgtcgtggttaatggggaagacaatgctgccaagtccccggaggatgatgaggcactcaccacggcgtctcctgctgcagaggctgtgtccacttccggatgtgacaagactagtgttggtagtggatgtaatgcccgaagctgcaatgggggaggtgcaggaggatcaggaactgggagtgactggtggtggcgtcaggacaatggtggtggtggtagtggcggcggcggcagtggcggcgttaaggactatgtgatggaatggattagatcggagatcaagaaggagcgaccgaagaatgactggattgcagggccatctgcagtaacccctgttgctccaacagagaggaagaagccaaagaggagggcacgggagtggtggcgcgaggagtatgcagaggagctcacgaagaagcaaaaacgaagggcacttgccaagtcaaaaagtgatgctggtgcgatgtctggtttgcaatggtgggagagggattgtgattttgaggagaagggccattcaaggtggacgatgatgaaaagctggagccggaggagcagcaatggcaatggcaatagcaattccagcatcagttggtgggtggacggtgtgagaaggagcagcagggattgggccagcggggaatttgtgcctaagagtggtggagcagtgagcagcacaccgagcatgcgtggcacagtctgctatgtggctcctgagtatggtggaggagggcctctatcagaaaaatgcgacatttacagctttggtgtgttgttgttggtccttatatctggacgacgcccactccaaatgacaacctcaccaatgtcagagtttgagaaagcgagcctcatttcgtgggcaaggcatcttgctcaagttggccgcttgcttgatcttgtagaccctgcactgcaggatgttgaccgagaccaagcgctgctatgcattactgttgcactcctttgcattcagaggtcaccagctcgccgcccatcaagtgcagaggtgcttgatatgcttgctggtgagggtgagccaccgcctcttccgatagagttctcaccatcacctcctggcggattccccttcaagtcacgaaggaaaggccggtgagtttagtttgttggttagatgaaaaggcagtgttagtattctatccttatgtttgtttcttcttgtactcaactcctaattttatctgtttaatttgttgatgtataaagatcttggtgggacaaaaaagtatccaattgggttcagatttgacaagaattgatgtgccccattaatcaattggataatcttagtttggttaaaaaaaaaaaaaaaacctttctatctagtgaaatatcgattgcaaacaaatatgaatttcagttgtaattgacaagaattgtgttctcaaccaacatgctttagcgtttatttgttaacagcaggaatgccaagttgatttgatacttgcatggccgcatgaggtttggagttccccctgttttttttgctgggaaatagagaagcatgttgccatttggacatgctttcggtgttttggatgtagtgcccttccaggccctagtgcagtggattttcaccccgtttgacaaccattttcttctaaacaagaacatccacttgtgtgatgatttcaactttcaagcttttgctgttcacggctccctgtcacttttctctttccactagggtggtacactcacttctccagc

SEQ ID NO: 16612 - DNA, 2476 bp, Zea mays
gggcgccccgcgccccccgaccaaagccgggcatacgcccccaagtccaaaagccctctccgccccgctctcccactcgtaggtgttctccccgtctccgcccgcactcgctcgtccgcgcgcaggaaggttgacctgtcgagggccggcgagcccggtaagtaagagtgaaaatggatggaagtagtaaagggagtgggcattctgaagcattaaggaactacaacctgggaagaactttaggtatcggtacatttggaaaagtgaagattgcagagcataagcttactggacatagggttgctataaagatcatcaactgccgccaaatgagaaatatggaaatggaagagaaagcaaagagagaattcaagatattgaagttgttcattcacccccatatcattcggctttatgaggtcatatacacacctacagatatatatgttgtgatggaatattgtaagtatggcgagttatttgattacattgttgagaaaggcagattacaggaagatgaagctcgtcgaatcttccagcagatcatatctggcgtcgaatactgccatagaaacatggttgtccaccgtgacctaaagccggaaaacttgttacttgattcaaagtataatgtaaaacttgcggattttggtctgagcaatgtcatgcatgatggccattttctgaagactagctgtgggagtccgaactatgctgctccagaggtaatatctggtaaactatatgctggacctgaggtcgatgtatggagttgtggggtgattctttatgctcttctttgtggaactcttccatttgatgatgagaatattcccaatctgttcaaaaaaattaagggaggtatctacacacttccaagtcatttgtctgctttggccagggatttgatcccacgaatgcttgttgttgagcctatgaagagaatcacaattagggaaattcgggagcatcaatggttccagattcgccttccacgttacttggcagtgcctccaccagatacgacacaacaagccaaaatgattgatgaagatacacttcgagatgttgttaatatgggatttaacaagaaccatgtgtgtgaatcactgtgcagcagacttcaaaatgaggcaactgttgcatattatttactattggacaatcggtttagagcaactagtggctatcttggggcagattatcaagaatcaatggacaggaatttaaatcagctggcgtcatctgaatcatctagttctggtacgaggaattatgttccaggaagcagtgatcctcatagcagtggtttgcggccatattatcctgttgaaagaaaatgggcgcttggacttcagtctcgggcccaccctcgtgaaataatggttgaggtcttaaaagcacttcaagaattaaacgtcagatggaagaagaatgggcactacaacgtgaaatgcagatggtgcccagggtttcctgaagttaatgacacgttagatgccagcaacagctttcttggtgactctaccatcatggataatgatgatgcaaatgggaggctacctactgtgatcaagtttgaattccagctttacaagacgaaggacgacaagtacctcctagatatgcagagagttactggacctcagctgctcttccttgacttctgtgcggccttccttaccaagcttagggttctatagtggtctaccatgtgcaaattttcactgtggtgatgaataaccgaaagcatgtaaataggaaccttgttctcgtcttttggacaacgaacatgtttgagtgactggtcttgtgttgagcgcctaaaggtcatgtatacttaggttagtactatttccgttcttaaatatttgtcgcctgctagtgatagttcatttttgaactaatacgttacgaataaaaaaagagtatattactgtctgcatggacatggctgtttcagtaggccgtggcaccgcagatggcgatgctcactgcaacctattatgaaaaaaaatgccagaggccgcccgccgtctacttgcgcctttgtgaatcctattttttaaaggatttctatttttctaaggaaaattagtttatttttctttggtaaaataggaatcttctagaaaaatgtagttaccaaaccgacccttaatgtacatatctaatgtgttgcaaacttgcacttatggtgtaaatccttatggatcttgctacttcaaataaacatgatatgtctgttgccgacttctttcacaagatcacatggctcatcatcgagctcgtcggatgcccctctgcaatgagaaggtccccgcctatttgttggtggggttcggactcactatgactctatgcatcacctctatgacaatgaagaccgagcctctctctcgacgatatgttcgcacacatgattgtgtttgaggcttgccaactccaacacgtagttgaattgcagggggatcct

SEQ ID NO: 16613 - DNA, 2278 bp, Zea mays
  misc_feature (2248)..(2248): n is a, c, g, or t
  misc_feature (2268)..(2268): n is a, c, g, or t
gagagagagagagagaactcattagtccccccccccccccgcctttctccgccccgctctcccactcgtaggtgttctccccgtctccgcccgcactcgctcgtccgcgcgcaggaaggttgacctgtcgagggccggcgaacccggtaagtaagagtgaaaatggatggaagtagtaaagggagtgggcattctgaagcattaaggaactacaacctgggaagaactttaggtatcggtacatttggaagtgaagattgcagagcataagcttactggacatagggttgctataaagatcatcaactgccgccaaatgagaaatatggaaatggaagagaaagcaaagagagaattcaagatattgaagttgttcattcacccccatatcattcggctttatgaggtcatatacacacctacagatatatatgttgtgatggaatattgtaagtatggcgagttatttgattacattgttgagaaaggcagattacaggaagatgaagctcgtcgaatcttccagcaggtatttatcacttttcttggctggttacttctagtaacatgctttttttgagtcacaataggtagttatcaaagaacggttttatcttgttgctttgaattttgatatttatggatagtgcattcatattcttcatttgtttctgttgtgtttaatgtgctctcattaagtatctggattagttttgccttgccttatttttatcttctgatctgccaccattttgacttgcaagcatgatgtggtaattgctttgtcttagggtatcactattgcatgtagttcagaatttcaaatcatgatttaaacattacatctttccatggaggatacgacaattaaaatattcctttttcttttatatctaaattccaggtttgttttattagttgttttttcacattggaaaaattcatgaacagatcatatctggcgtcgaatactgccatagaaacatggttgtccaccgtgacctaaagccggaaaacttgttacttgattcaaagtataatgtaaaacttgcggattttggtctgagcaatgtcatgcatgatggccattttctgaagactagctgtgggagtccgaactatgctgctccagaggtaatatctggtaaactatatgctggacctgaggtcgatgtatggagttgtggggtgattctttatgctcttctttgtggaactcttccatttgatgatgagaatattcccaatctgttcaaaaaaaattaagggaggtatctacacagttccaagtcatttgtctgctttggccagggatttgatcccacgaatgcttgttgttgagcctatgaagagaatcacaattagggaaattcgggagcatcaatggttccagattcgccttccacgttacttggcagtgcctccaccagatacgacacaacaagccaaaatgattgatgaagatacacttcgagatgttgttaatatgggatttaacaagaaccatgtgtgtgaatcactgtgcagcagacttcaaaatgaggcaactgttgcatattatttactattggacaatcggtttagagcaactagtggctatcttggggcagattatcaagaatcaatggacaggaatttaaatcagctggcgtcatctgaatcatctagttctggtacgaggaattatgttccaggaagcagtgatcctcatagcagtggtttgcggccatattatcctgttgaaagaaaatgggcgcttggacttcagtctcgggcccaccctcgtgaaataatggttgaggtcttaaaagcacttcaagaattaaacgtcagatggaagaagaatgggcactacaacgtgaaatgcagatggtgcccagggtttcctgaagttaatgacacgttagatgccagcaacagctttcttggtgactctaccatcatggataatgatgatgctaatgggaggctacctactgtgatcaagtttgaattccagctttacaagacgaaggacgacaagtacctcttagatatgcagagagttactggacctcagctgctcttccttgacttctgtgcggccttccttaccaagcttagggttctatagtggtctaccatgtgcaaattttcactgtggtgatgaataaccgaaagcatgtaaataggaaccttgttctcgtcttttggaccacgaaaaaaaaaaaaaaaaaaaacctcgaggggggggcccggtaccattcgnccttatagtgagcgtatacnattccactgg

SEQ ID NO: 16614 - DNA, 5180 bp, Zea mays
  misc_feature (1342)..(1342): n is a, c, g, or t
ctattggcgtcgttacgttccacttggatgttgagaaggacagggtttctagtgatctcgaatctgacactgtccaagttactctagttgttcaggaacaaagtccatttgaccctagtctacttcagttaagccacatcgctcatgtttctattaggtgcgctcaagacagatttagtctgctataggacattgctattatttgatacaagggatttatccattattcatatagtaatatttttagaaaaacaaacacaactctctaacaatttcgtcttcggttagttgtttgttctcttctaccttctgatcgaccaatttcagtgtagttgaatttgttcaagtagccacctcagacgcagttggctcattatttcctgaactcacgtgagtcctggcaactctataaccaagtctatgcattttctatttttattatatattttttgatgtagtgatgtagcagcagccttcaaatatttttgttcattcttttattcaaaatgctcgcataagacaagtgttgaattcttattctagtctatgttttgttattcgagtaattttcttatttttttaaaaaaacacctattcataattttttaaataagtttgttactgtagggggtggctatagtatttcctttttttctttcatattataaaggagaaagagagggatatgtcacgagtttacatatatagtcattacaacgcttgcactcatgttcttacagagtcggtcatcatttttttccattctacaggagttgagtatcagcttctggggaaacatttccttgcaccggtttattgtgggtgagacttcttcaaagatcctgttatttctacatttctatatgcaccacaacatgattataattacttccatcgaccatggtttgtgaagatctgacatcatcttttgcactgtccaatgggggttgcatgtcttgtagggtgacatcaacaatttgcgggcacctgcgtgcgaaaactgcatctaaagaaaagataggaccaagtttctatcctttgccttatgcaattttatatgattcaaactccatatgtctcctcaagagcactttcctcatgttgagtttgtcatgcagaagcagccaaaaaagagtttttgttttggttgacactttgttttctataggctgtggggttgacgtggatcagtttgtatgccttttgagaagagtaattcgaggaccccagttgtatctccattcgtcttttccatccaacagtggggtattttggagctcattgcctagaagctgaaattgtgcaaacgcttcagcagcagatagcggcaaagtggaagagntccgcagaaacccaggcttttttgtttgctgaatagtgatgtttttgttgattgcataggaaaatagttctggatacagttcttgatgcaccttgttccccaagctgtcaaaccatagttgcatagaacgaccatcaccaatcagtggtttagtcgttctcttatacatgtctatcttagacatatttaagagcaaaagataaagatcacaaagtagcacattgaaaccgcacttgctatagtttaacgaacaagatagacaaaaaaaaaaaaaaaaaaaaaaacagcgaaaccaccttcctcatcgtgagccactttttctcctgccttgttatcatcttgcgtcgccgtttttgaacaaaagaaggcacagtacatcaggagcgcagggtctctcgatagtcaccgatccagcaagcctccgccttccaagccaataagccatcttcttccatctgtgaagaaatccaaagatcttgtgattgtgagccaccattttcggtgatttgataggcgcgttagagaaaaacccagccatcatctgggttttccaccacgcctaggtcagtcaccctgcaagcacaaaaaaacagccactcggtcttttttttatccacgctcctctaaagactcttcttcttttttttagaaaaaagtgtaggggctcgtttatctccatatagcatattagcatggggttcagcagaatggcgaaccacgagcctacaaacatagctaccgggatatgctgcggtggggtgttttcaggttctttaaaagcaagttttgtttcagaaaaaaaatagaactggggcttctttagccttgacgtcaagcgacaggctcctttcgtccccatcatctcagcgccaagacttgggatggcatctggctgcactggacgaattcaattcagtccagtcaaatttccccacacccattgaccgctacgatcgtcactcgggagtgccgagtcccagatttctcctcagatcgacccgtgcaggcacgtccggacgcccacggcgaattggtttggtcatggccgtgtctggactggaccaaatctccttccctgtgcacaacaccaggtccaggagaaagaaaaaaaatgaaatctcaaagccagcgaagtcaagaaagaagctttgaattccctggacctgtcacgaccacgtctccccaaggttccaaccccatccacggaagattgttggtttccggatggatgattactcgcctgcgaccgtgacatccccaggtgacaaccagaggggtccaaatgcatgcagcatgccaaatactactccagccagactgtgacatcccctgcaggtgacaaccagaggagtatactactgtatgtttatgaaatcatgagtggttccttttgtttttagcgtacccaaaaaaaaagagcacgatcgaggatgcagtgtatacagtacttaagttcagttggtcactgaatcagaggccagcccggccccatgtgaaaccgcgggaagtttttcgccgcgtgtgatggcacgcggtcatcgggtcgtggtgcccgatttgcttgacgaatgcttcccacggggggtgggtgggtgacccttgttcacgcggccgctgattttactgacatcgagagctatatgtgtgtgacgccatcattttgaccaactgtggccttccagtttcaatggaaacaaaagagacaaggaaaggagggtttggtatcatccacttcccattttcgatcgatgggggcggggaggcacatgaccgtggcgtgccaccatcgacaacacccaaagttagcatcgtatcgtaccgtctagtggccggctaatttgcttgccagaacgcgcaaaggcggcacggaaaggattcatccaaggaatcgaaaaggggtaccacatcaggacaggacgacgcgtcaccacgatagcgccgaaagtcgctcagccactcttggccttggtggctccaattactcatgcccagcccgacgtgcgctgcgagcctgccacgcgttttttcttcttctgtagaaccggtgcggaggacaggaaaacctggtgcagggaacgtaggcaacaaaagaaaaaaaaaaccggacccgactcgagcgatcagcagcggcaccgctacggaagccgtgacgcgtcccgagtccggacgcgttgacatctcggcggtgtggccgtccgtctatccgttcagagggaaagctgcggctgccggctggctacggtacgcgttgcgtcatctgggctgtctctggcccatcaggcggctgcctctgccttccagttccagccgcgtcgctgcctatcacacacgtcatcggacgtgacctcctcacccgcagccgcggtggggcccgtctaggacgtgctcctttccctccacggctttgacatcgcgtcacgccggccggcctctgcctgacctgcctcggcgcagccccacgcgacgtacgccacggaacgacgcgccgaccgagccaagccagtactaccacgtccccccagccaaaccaaacgcaggcacggcacggcacggcgcggtgctcattcgcattccccagccccaccgatcggatcggcaaaatccctcccaccagctccccacagatcccggcgtccccaccgcacatccctccctgcttccttcccccatcgccccggccgcggaggcggagcttccccccacgccacgatggcggagtgccgcagcctcatcgagttcctccgcgcgttcgagcaccaccgcagggcggccgacatctccgcctccgcgtgctcccgatccaggcgggccggggcctcctccgccgcaggcggctccttctgcgacagcgccccgatggccgtggtcgacgcggtcatgctcctcgccgtcgtcaccgcgctcggcttcctcctgatcccctacctcaagctgctgctcctcgagatgggcgcgctgctccaccccgccgcgtcctgcctcccggccgccgccttcttcggggccgccgtcgccgtcgccgcggccgtcgtcgcctgggagctgctgggccaccacgcgcgcaagtgcggcaagcccaggtgcaggggcctcaagaaggccgtcgagttcgacatccagctggagaccgaggagtgcgtgcgcggccgccccggccccgcggcgcgatcggcgctgctggccgcggcgggggcgcgccccgtcgacctaggcgacgaccagcgggagctggaggccgagctgctcaagatggcgccgcccaacggccgtaccgtcctcatcttccgcgccccctgcggctgccccaagggccgcatggaggtctggggcgccaagaaggtgcgccggatcaagaagtgaaggggggaacaaggatcggatggttacttgttagtgcaatagtactagcgcactcttgttcctacctcgatcctcgtaagtagctactgctaggaaaaaaaatcctcagtaataataagtataagtatagggagacgaaataaacggaacacagaaccagttattatcacagatagcttatatagacaataatatactccttgtattatgaaccagtggcgaatttggacagaaatacatgctgtttacttgtccattctctaattttcatgggatcctggataattgatacagtagcaacatagacaatatcttagtcagtagctgcttgctcctttggctgtcttttgggtccttcatttttatccatattgtggtacaggtttagttgctacttacctgtcttatatgacatgttttttgctgttgattcaatgatattggggtgaagttttagctcaaaaaaaaaaaaaaaaaa

SEQ ID NO: 16615 - DNA, 865 bp, Zea mays
  misc_feature (139)..(139): n is a, c, g, or t
  misc_feature (193)..(193): n is a, c, g, or t
gatttcgattctttctttttcccccacgtgcgccgccgcgaccttcctcgatcccatctcccaacgcccccgcctcgcctcgggatcccgccgccgctccatctgcctttgctcccccacccgcagcagcgagcgacanccctggcgagggatggccaaggccaggtcgttggcgaacgagaagcaggcgcanaatcaaacggcggcggcggccacgcgctgtcctccaagctcgcccggtacctcgacccggagcctccttggacaaggaccaactgctggacgcggtgcactggatccgccagcggtggggctcatatgcgggcctgctctggggagccgtccccctcgtcggcgccgtctggatcgcactatttatggccatctcgactggcattatctattggtacttacacctcttgctgaaggttgccgaggaggaatatggaggccatggggcgcttcttcagaagggtcttttcgattcattacacccttttcatgctttcgtggactgctagtatacagtctggctcacttctaagaagctacctttggcgcacatacctttgttcagtgtgccagacagaaaagactcaccaggacagtgtagactaaggagcattttagaacgagcgttgtatcaaaacggttctgagctgtaatgttatttcccatacccccagtgtaatcttggtgctatgggattagttcggtgctaagcagaacaaaaatgttgcatactaagcgtttttcagtcaaatcgacatcctcttgcattaggaactgaattccatcctcttgcattaggatctgaattccatggacaattttaacgcacggaagaccatttggttcgctgcct

SEQ ID NO: 16616 - DNA, 1018 bp, Zea mays
  misc_feature (984)..(984): n is a, c, g, or t
ccggccgggtcgggttaggtgatggcggtgaccacttagccgtggtggcttctgagttggcccgggatttcgattctttctttttcccccacgtgcgccgccgcgaccttcctcgatcccatctcccaacgcccccgcctcgcctcgggatcccgccgccgctccatctgcctttgctcccccacccgcaggcagcgagcgacagcgacggcgagggatggccaaggccaggtcgttggcgaagcagaagcaggcgcagcaatcaaacggcggcggcggccacgcgctgtcctccaagctcgcccggtacctcgacccggaggcctccttggacaaggaccaactgctggacgcggtgcactggatccgccaggcggtggggctcatatgcggcctgctctggggagccgtccccctcgtcggcgccgtctggatcgcactatttatggccatctcgactggcattatctattggtactacacctacttgctgaaggttgacgaggaggaatatggaggccatggggcgcttcttcaggagggtcttttcgcttcattcacccttttcctgctttcgtggactctagtatacagtctggctcacttctgagaagctcctttggcgcacatacctttgttcactgtgccagacagaaaagactcaccaggacagtgtagactaaggagcattttagaacgagcgttgtatcaaaacggttctgagctgtaatgttatttcccaacccccagtgtaatcttggtgctatgggattagttcggtgctaagcagaacaaaaatgttgcatactacgcgtttttcagtcaaacgacatcctcttgcattaggaactgaattccatcctcttgcattaggatctgaattccatggacaacttttaacgcacggaagacctatttggttcgctgcctaaaaaaaaaaaaaaaaaaaaaaaaaaaaaaaaaaaaaaaaaaaaaaaaacaaanctcgagactagttctctctctctctctctcgtgc

SEQ ID NO: 16617 - DNA, 1907 bp, Zea mays
aagcattagtggtgggcttatttgggccatataatctctagtgcacccggcccatcgacgatccgacggcggacgccttaaacccttctccttcctttggtccgcctcctccccgcccctccgcagccgcagtgccgcagcatcgtcgccatggctctcctcaagaactccctcatgctccaggggcggttgcgccatgcggcggcggcgctcactgcgcggcgccacgcggcgacgtcgacggaagagtacgcgcgccggaactacgccgataacaactccgagtacaacacggtcatcggatcgctcgtcgctcagcgcaggccctaccttctgcgtgatgcttacgacgacatgatgcttgatggcgtgaagcctgagcgggaaacattccacacactcatagtcggtaccatgaaaggcagccggctacaagatgcgctttacttccgtgatcagatgaaagaaatgggtttgaagcctgatgttaacctttacaacttcttgatctccacttgtggaaaatgcaagaactcagatgcagcaatcatgcttttagaagaaatgaaggcacatgatgttaagttgaaaggagaaacctacatttgtctactgaatgcacttgcatcaacagggcaaactgatcaagtttatgccatagttagtgatatgagtgctgctggacttggattaaacaagttttgttatgctggattgataactgcattcaagaacaagacaccaaccactgaggaaactatggcgaagattcttgacttcgtcgggcagtcgaaaggttggcaatatgttgaaagagtatcaaaggacattgctgagaatataatgatgaatgtgtcagaggaagaactgtacaacctcccaacagcagaatatgtaaataggcgaggaggatttgtctttaaacaacatacagtttatcatgttgctctccaagcttgtgcagaattgcgaagcaaagagacacttgaagcacttctggaaatgttcaataaggataatagagatggatctacttatgatgcctacatggtgatgcaagctatgaggtgttacctacgatgtggagatattgattctgctgttaagatgtttgaagagtattcaagctcgaggtccccacccgctgagttgtatgcgacacttgctgagggagctatgattgggtacactccaagaggaatgcaacttgctcaagaaactatagagaagatgacttcaagaaattttttcttgaatgccaagatgggaactgatctcctacttgcagctgccggtgaaacggctggtggatatacgactgcaaattatgtctgggatctcctgcaaagccgtaaaatcactccaacacttcctgctgttgaggcataccacaagggtctgacggcgcgagagattccttctgacgatccacgacttctcaatgttacccgtgttttggacaacctgaagctccgatttggaccaagaagaaacactcagtaacttagaaacaatattgtccctgatacgatgcaatcagtaatttgtctttgttaggtttctggatgcgaaggcatgtttacagtccgaaaaaccaaggaagttcatcaggatgacgtaaagcagaaccaccaggcatttgaggggcatggcaggtgtgggaatcaaggtccggaaacggaagccagttgtttccagggttttctcgagaaatcttcacctgccaagcctgaagacctgaactcggatgcactgggttttgatttgaaatttaatgtatcctatgttgcctaccattgtttgacaaccatttatccgaacttttgatctagaagacagcgggaatatagttgtgcgcgagccaagctgtaaaaaaaacgttttgacgcttcctctctatgtactat

SEQ ID NO: 16618 - DNA, 2879 bp, Zea mays
ggatgatgggccagaagagcaagctgatgatgggccgagaaggggcgttctgtcaaaggaaaatgaacccacgatgcacaagcagaaactagagtatatatatatagtaggaatgtgttgcggtagagggtatgaaatgtaataacctaaacttccacttgtttccggccgtcacggcgctaccagctctctaccgtatctctctgtttctctgtatcttcctcttctctcatacatctccactagtaatctgttaacaattggtatcagattcgttcgatccttggagttttctaccttaatccactttcctcaacttcaccgcatcgccatgtcactcgacacgacccgccgcctcgacgccattagcgagttctttgacaagttcgacgcgcggtgggccgtgcgggaggcatccaggcgcgtccctgttccgacccagtccacggctgccggagccgacgtggtcgccgacaactggggcgacctctttgacagtggcaacgactccaccgagaagcactatgcggatcctatcatcaccgacaactggggcggattcttcgatggagcggacgcggctgtcgacgccgatttcgccggccactgggacagcccttcctccaaccccgacgcgactacctgcgtcacaccagaggttgcggtggaatcggtgcacccggccgcacgcggacgcttcttcaacgacgattcgggtgcaccgcttgactcggacgacgacaactccgtccacagcgaccacggatccgtgatgtcccatctcctggagcgtgagaccgacatcgccgtccttccccactcggatcagcgggatggagtcgaggcgcggctcatcctgcgcgggtgcactcctgcctccttcaccgtcgcctccatcggccccaacaacgagatctcgggcgccgtccccccggacgcgctcgccaaggccgcgcccgcgctcttcgcttcgagggcgcctagaccatcgctcaagtacctggagctgctcctcccagcggaaatcggctccgaccacatcgaactaccgaccgctgccaccgcgaggcacatcgtcgcccaagtcaccggcagcaacatggtgtccgtggcagagggccaactccggtgcgccctcgtaatcacgcataacttcctgtcaggccaccaccaggccgtcagcaaggagtgggacgtggtcgccttcgcgcacccagtgtgcaacctggaggaaaagacggtggacaccatctgcactggaccctccgggctcccgcggcagtagtacctcaagtccttcacctaccttgattggtgccaagctgtttgtggggctgcagcactgccatgagcagggcatccttcaccaggacatcaagggctccaatctgctgatcgactaccccgacatgctcaagattggtgacttcggcctcgccaactacggcgctgggtgccgacaaccgctcaccagccgcgtcgtcacgctctggtaccgcacacctgtgctgctgctgaactccaccagctacagcgtcggcttcgacctctggagcgtgggttgcctcaacgagatcttcttcggcaagcccctcatgcccggcagtggcgagatgtaccagctgctgaagatcttcaagctgtgtgggtcacctccggatatggtcgaactccaacagcacatcaacaatggtcacgcggttctagttctaggtgcccaccgtgtgtttcaggaattgtcatcacatgttattgccacctgcaacaatggtgttggctcgacgatgcaagacctggcacatgctatcggtaatactgaagtgcggccaataccatggccatctttcagtttctctccaattggattggctccactattagcattggaatcaattgcagtggtaggtggaaggtgcatgctgcagaagagtgtgaaattcaagattatctataggctgagtagtgtgttggcttggtttgttggttctggtgaccaggaacttagatggttgtctagttatctattcatacattatggtaattcctggaagttagttgtgtatgatggccaagggcacatattggtgacaatgttgagctcaatttctattcgagaagtgggttccttgaaaaaaaaaaaaaaaatcatatgggtgcctattctggtcgtgggtgtcctagacttcatgatggtactatccatgattctacaacagtgtgatacaaaatcatctcgcagagtggagaaaagggagatttctaaaattacagatgcaacgatcatgcttttagaagaaatgaagccacatggtattaagtggaaaggagaaacctaccattgtccactgaatgcacttgcaacaacaaggcaaactgatcaagcttatgtcatatttagtggtacgagtgttgctgggcttatgcacagagattctgttcaattcaggccaataccatggtttttcttcagattgtgtagtgaggttggttacaggtcctataattggactgagcgaatatctgaacccacagaacaactcatgatggtgttgtcatctctagcttggtcaggtactcagacagttcccacactaaaattacaaagatcaaatgcagcagcaagacattatgggtgctcatggactctggatcttctcatacttttatcagtgacaaattgcgaccaatgttatcgggtgtggaacctctggttaacccaatcacagttcaactggctattagacaagttattccttgccattaccatttgccttcagccaagtggagtatgtcgggctgtcacttttcagcagacctgaagttcttgccaataccttcatttggtcaagttattacttgcaattatcaggtgccttcag

SEQ ID NO: 16619 - DNA, 1595 bp, Zea mays
tacctcgaggccggccgggattcgtcttctatgagaagtcagagccagctcccaacaacaaacctcatgggtatacatgcacagatgccttcgtctggaatgggtctgacctcacctagatatccttctaggatgtacccagacaacagattatatgggcagtatggtcagtatgggaacacactgaagggtggccttggttttggatcaaacatgtatagctcgagaaacaatgggaggtggggagttgtggataccaaatacaagcccagagggcgtgcaccttttggttttagtggtgagaaccaagatggctttaccgagctgaacagaggaccaaggtctggtggtttcaagcaccaaaaacaattcggtcctactgtaactattgctgtgaagggccaagccctcccttcagtggggaaacagaacagtactcttccagacaaaggccaatttaaccaggaagggtttcctttaacctacaaggatgcaaagttctttgttatcaaatcatatagtgaggatgatgtgcacaagagtataaaatacaatgtgtgggctagcactcctaatggaaataagaagctggatgctgggtaccgagaggctcaggagaaatccagtgactgcccggtgttcttgtttttctctgtgaacacaagtggtcagtttgttggtgttgctgaaatggttggtcctgtcgactttgataagactgtggagtattggcaacaagacaagtggaatggttgttttccactcaagtggcacatagtcaaggatgtgcccaacaacactttgaagcatattacactggataacaatgataataagcctgtgacaaacagccgtgacacacaagaggttaagctggaacaaggtcttgaaatgttgaagattttcaaagaacatgttactaaaacgtcaattttggatgattttggtttttacgagaatcgccaaaagttgatgcaggaaaagagggcgaatcagcaactgcttcaaggccaggggggcgatgtttctcaagagaaagacaaggatgcgactaatggcaaaccagggtcacagaaacaggcaacgagcaaggaaggcactcctgctgaggtggcggcggatgcctccaaaccagtagctgaaagtggaatatcaaatgacaactaagcatcatgcatactggtcggcaccataccggtgcaaatgctgcaggttttgcggtatctgcaaatcaaaacctattgattctgcctgaattctggacttctttcggtactggagttcgtgagatggggctcatcatgggagtgaatcagattttacttattgtcgctttgctagttgtgtgactggtttttggtgtcttggaacccgtgttaggcttcttacatacccctgtgacgacaccgagtttgttgtaacccttgttttttttgcctttttgttttagttctatcattgttaacgaagcagcctatttcctatactttgaacaacattaaggtagttttttttgcatgttgcggtactgtggagagtaataagacaaaaagactctaggtttaaaccaaaaaaaaaaaaaaaggcggccgctc

SEQ ID NO: 16620 - DNA, 3411 bp, Zea mays
ggccccccgaacagaacccaaacctcgccgattcgctccccttcctcaccgcgcgcgtacgccgccgccgcgctcacctcaccgaaccctaaacctgagccaccgccctcccccggaggtccgccgctccgtgtgggactctaggcgtcgccggagccccctccaggggctagcggcggaggaagtcggaaaccgattacccctcccctccccttaccgggggagggagaaactagcggaggaggcgaatcaggtcagagtggggcacgatgaggatcatgatcaagggaggcgtgtggaagaacacggaggacgagatcctcaaggcggccgtgatgaagtacggcaagaaccagtgggcgcgcatctcgtcgctgctcgtccgcaagtccgccaagcagtgcaaggcccgctggtacgagtggctcgatccgtccatcaagaagaccgagtggacaagggaggaggatgagaaattacttcatcttgctaaactcatgcctactcagtggaggacaattgcacctattgtaggtcgaacaccatctcagtgtcttgaacgttatgaaaagctgcttgacgccgcatgtgcaaaggatgaaaattatgaggctaatgatgatcctaggaagctgcggcctggcgagattgacccaaaccctgagtcaaagcccgcacgtcctgatcctgttgatatggatgaagatgaaaaagaaatgctttctgaggctagggcccgcttagctaacactaggggtaaaaaggccaaacggaaggcaagggagaaacaacttgaagaagcaagaaggcttgcttcactacaaaaaaggagagaattgaaggcagctggtattgatacacgccacagaaaaagaaagagaaaggggattgactacaatgctgagattccatttgaaaagagaccaccttcaggtttttatgatactgttggtgaggacagaccacctgaacatgtacagtttccaacaaccattgaggggcttgaagggaagagaagagcagatatagaggcacaattaagaaaacaggatattgccaggaacaagatcctgcagcgacaggatgcccctgctgctataatgcaagcgaataaactaaatgatccagaagctgtcacaaagaggtcaaagctaatgctgccgcctcctcaaatttctgaccacgagctagaggagatagcaaagatgggcagtgctggtgatcctgctttagctgatgagcttggtgaaggaagcactgccacaagaaccttgcttgccagctattctcagactccaaggcttggtatgacaccattgcgaactccgcagcgaactccagctgggaagggtgatgcaatcatgatggaggcagaaaatcttgcacgtctcagagaatcacaaacgcctctattaggaggtgataacccagagcttcatccatcagatttctctggtgttacaccacgcaagaaggagatacagactccaaatccaatggcaacacctttagcaagccctggccctggtatcactccaaggattagtatgacaccatccagagaggggcacagctttggtttaacaccgaaagcaactcctcttcgtgatgaacttaacataaatgaagtggaaatgcaggacaacactaaacttgagcttcgtaggcaagccgaactgaggaaaagcctgcgatctggttttgcttctattccacaaccaaagaatgagtaccagatagtcatgccacctattacggaagatgagaaagaagaagctgaagagaaaattgaagaggacatgtcagacagactggcacgagaaagggctgaggaacaagctaggcatgaggcattgctcagaaagagatccaaagtgttgcagaggagtctgcctaggccaccggctgtttcagtagagattatccggcaatctcttattagaagtggagaaagcagaagcagaagcacctttatgcctcctacatcacttgaacaagctgatgaactaataaatgaggaactccttaggcttcttgagcatgataatgcaaaatatcctcttgatgaaaaaactcaaaaagagaaaaagaaaggaagcaagcgtcagcaaaatggaggacctcttgtccctgaaattgatgattttgatgaagatgaactaaaagaggctagctctatggttgaagaggagattcaataccttcgagtggccatgggtcatgaaaatgaatcttttgaggacttcgtgaaagcacatgatgcatgccaagacgaccttatgttttttcctaccagcaatagctatggtttagctagtgtggctggaaatgctgataagatttctgctttgcaaaatgagtttgaaactgtgaagaagcgaatggatgatgaagctaagaaggcttctcggcttgagcagaagattaagcttctgacacaaggatatcagatacgggctggaaaactgtggtcacaggtccaagatacattcaagcagatggacactgccgcaacagagctcgaatgcttccaagagctgcagaaacaggaacatctcgctgcttcatatcgaatccaaaatttgtctgaagaagtgagtaaacagaaggcactagaaaggaccctccagagccgctacggcgagctggtttctggtttccagaggatccaagaacaggtcgaggagcacaagaggcaactcaaggtacaagaggcggtagaagccgaaagtcacgctcaggaagaggaagctgcggcatcaaatcatgctgctgctgaggaagaggatgaaaggaaggaagatgatgaaaggaaggaagaggatggaagcaagtctctcagctctgaagagaaaccacagcagacaagtacggctaccgatgaagaacctgcaggaagcaaaggaaccaccgaggatcagatggacgtggacagcgggaatggagagggtggagttgtaggccctgtcccaccagcaccagacactgaagggggtaatgacgaagtatcggttcaagagatcagtgaagcccagcccttgccttgaagacggcgctcctttcccttaaagctccgctttcttctcccgcacctggcgatcttcacgatgttgttgttgcacagcaggtccggactgagtatttcctatttggttctatttttagtgcactataatatcacaagcgaagctacaattggttgtgagctatattggcatatccttccctttgttgtattcccttgaacaatgaatcagaacaactgtttaccatttttctaaaggatcgactgcttatgtactcatgcagaactgcctcattgtgcctctggctgaacagcagccaagtaagcatgacatgttctttgttcaaaaaaaaaaaaagaaaaaaaaaaaaaaaaaacggcacgag

SEQ ID NO: 16621 - DNA, 2386 bp, Zea mays
aagagatcagtgaagcccagcccttgccttgaagacggcgctcctttcccccaccagcaccagacactgaagggggtaatgatgaagtatcagttcaagagatcagtgaagcccagcccttgccttgaagacggcgctcctttcccttcaagctccgctttcttctcccgcacctggcgatcttcacgatgttgttgttgcacagcaggtccggactgagtatttcctatttggttctatttttagtgcactataatatcgcaagcgaacctacaattggttgtgagctatattggcatatccttccctttgttgtattcccgcgtggggccccccggggccggccggggtgccagcttgagcattccactttgctagccagcatatacttacacgtagctagcttaataatcagcagctggtgcagcaagagtaacagctagcgacgacgaccatatggcggcgaagcagccagtcgtcgctgctgctgcctccggccaccccaagatgggggaggagaagctgatcatccggccggagaaggtgcggttcatagacgtgctgtcgatgctgctcctgaggcgccccatcaccagctacgcattcgtggaggccggcgaccggaccgccgccgacctgggcagcacgcccggcgactggctcgtcgcgctcacgcaggtcatccagaaggcgctcgccggcgcctactacccggctctcgtggtcggcgccgtcgtcgagttcctcctcaacttcgtcgcgctcaacaatggcatactcggcatctttctcaacctcttcagatgtaagctggtgatcccactgaaccgggaggcgcccaacttccggtccatgatcgggatgatcgacgggaggacggagctgaagccgctgccagccagcggcggcccagaggaccggcggctgcaggtggtgggcgtctccgccgccgccggatccggcggcgatgactactacttggacgtggagagcggcagcgcggcggtgccgctggtgcagcagcagtacgtgaacgggcggctcgtccgcctccgcaccttctccgtgttcgaggtgagcatgatggccgccaagatcgcctacgagaacgccgcctacatcgagaacgtcgtcaacaacgtctggaagttccacttcgtggggttctacaactgctggaacaagttcgtgggcgaccacacgacgcaggcgttcgtgttcaccgacaaggcagaggacgcgagcgtggtggtggtgtcgttccggggcacggagcccttcaacatgcgggactggtccacggacgtaaacctgtcgtggctgggcatgggcgagctgggccacgtccacgtcggcttcctcaaggcgctgggcctgcaggaggaggacggcaaggacgccacgcgggcgttccccaaggccgcccccaacgccgtcccgggcaagccgctggcctactacgcgctgcgcgaggaggtccagaagcagctgcagaagcacccgaacgccaacgtcgtggtcaccggccacagcctcggcgccgcgctggcgaccatcttcccggcgctgctggcgttccacggggagcggggcgtcctggaccgcctgctctccgtggtcacctacgggcagccgcgcgtgggcgacaaggtgttcgcgggctacgtgcgcgccaacgtgcccgtggagccgctccgggtggtgtaccgctacgacgtggtcccgcgcgtgcccttcgacgcgccgcccgtcgccgacttcgcgcacggcggcacctgcgtctacttcgacggctggtacaagggccgcgagatcgccaagggcggcgacgcgcccaacaagaactacttcgaccccaggtacctgctgtccatgtacggcaacgcgtggggggacctcttcaagggcgccttcctgtgggccaaggagggcaaggactaccgcgagggcgccgtctcgctgctctaccgcgccaccggcctgctcgtgcccggcatcgcgtcgcacagccccagggactacgtcaacgccgtccgcctcggcagcgtcgcctcggcgtagcttttggattgcatgttcgtttccatgcatgtgtatcattgcatgcaataattggatgaaataaacagcaataagcttcatcagtattattattgttgttgttgaatatatgcatcctctcctctctatatagaattatagatacatgaggcctggccggccgcgcacgttgctgaacagttgaagcgcttcccaaaaaaaaatgtatcaactgtgaagcatatatatcctgaaaaaaaaaaaaaaacgaattttttgtttttagccctttttgggataaaaatttacaattagacccggaaaacttatatgcattttttgactc

SEQ ID NO: 16622 - DNA, 1724 bp, Zea mays
gcacgagaccattacctagaacatcctaatcgaaaaagaaaatacgcacctgctcctcactcttctttatatttttttctccatttggcaacttttgcttgtcgttcatgtatatgcatgaccctttcacacatatgatcagaagataagcacatgcaagacgatctcgcgtggatatgatgcatggatcagacctaacctctatatcatcaccaaacgctcgtagatgatgctatacaattccatgattaaattatatataagtaaaaaaaaaagaaccgtacgtgcatacataaaattaagaattaatggctgccaatggacgacatatgcatggacaggtaagctggtgatcccactgaaccgggaggcgcccaacttccggtccatgatcgggatgatcgacgggaggacggagctgaagccgctgccagccagcggcggcccagaggaccggcggctgcaggtggtgggcgtctccgccgccgccggatccggcggcgatgactactacttggacgtggagagcggcagcgcggcggtgccgctggtgcagcagcagtacgtgaacgggcggctcgtccgcctccgcaccttctccgtgttcgaggtgagcatgatggccgccaagatcgcctacgagaacgccgcctacatcgagaacgtcgtcaacaacgtctggaagttccacttcgtggggttctacaactgctggaacaagttcgtgggcgaccacacgacgcaggcgttcgtgttcaccgacaaggcagaggacgcgagcgtggtggtggtgtcgttccggggcacggagcccttcaacatgcgggactggtccacggacgtaaacctgtcgtggctgggcatgggcgagctgggccacgtccacgtcggcttcctcaaggcgctgggcctgcaggaggaggacggcaaggacgccacgcgggcgttccccaaggccgcccccaacgccgtcccgggcaagccgctggcctactacgcgctgcgcgaggaggtccagaagcagctgcagaagcacccgaacgccaacgtcgtggtcaccggccacagcctcggcgccgcgctggcgaccatcttcccggcgctgctggcgttccacggggagcggggcgtcctggaccgcctgctctccgtggtcacctacgggcagccgcgcgtgggcgacaaggtgttcgcgggctacgtgcgcgccaacgtgcccgtggagccgctccgggtggtgtaccgctacgacgtggtcccgcgcgtgcccttcgacgcgccgcccgtcgccgacttcgcgcacggcggcacctgcgtctacttcgacggctggtacaagggccgcgagatcgccaagggcggcgacgcgcccaacaagaactacttcgaccccaggtacctgctgtccatgtacggcaacgcgtggggggacctcttcaagggcgccttcctgtgggccaaggagggcaaggactaccgcgagggcgccgtctcgctgctctaccgcgccaccggcctgctcgtgcccggcatcgcgtcgcacagccccagggactacgtcaacgccgtccgcctcggcagcgtcgcctcggcgtagcttttggattgcatgttcgtttccatgcatgtgtatcattgcatgcaataattggatgaaataaacagcaataagcttcatcagtattattattgttgttgttgaatatatgcatcctctcctctct

SEQ ID NO: 16623 - DNA, 2527 bp, Zea mays
ccggccgggagtcgcccccgtctaactacgggtagactcgccaggacgccagcacaggtccacgcgggcgcggaggcaacgctatggtggctcgccgcttcgtggtccggcatggccccgcagccggaggatcagccgaggcggcggaggagcaacagcacgaggtggagtacgacacggagcacggcctcgacgtcctccgcctccagatcttttccctcaccgccgtcccgcccgacctccagaagatcgtggtggaggcggatgggtcggtggtggacgacggcaccgacctggaagccgtctctgagcgcctgcgcctccttgctatcggcgaggagggggaggacgacggggcagcggccagggcgcaggagaagtccgacgaggaattcgcacggatgcttcaggcggaagaagaggcacttctcctacaacagtacaatatacaaaatgatggtggagatgtgtttagacaaagagttgagccttacatgcaccaggttctgatgtatgaagattcagtgggacaagaggcagcacaaaagacagttccgatatgcgaactggaggagaaggcattagtttcactggccaaggaagggaatttcaatccttcgaaagatgaagagaagcatgcctttctgctgcaattgcttttttggtttaagcaatcattcagatgggttaatgcagcaccttgtgacagctgtggccgtgagacatccaatgttggaatgggcaccccacttacctcagaaatcaaatttggcgcttcacgtgttgagatgtataggtgtaaccattgttctagtatcacccgtttcccaaggtacaacgatcctcgtaagcttatacaaactaggagaggtcgctgtggagaatgggcgaattgcttcacattctattgtcgagcttttggatatgatgctcgtttgattctggatttcactgatcacgtgtggacagaatgtttttcaaacttgtatggaagatggatgcacctagatccatgcgaaggagtctatgataatcccttactgtacgagaaagggtggaacaagaagttaaattatgttattgcgatttctaaagatggagtacgggacgtaacaaaacgctacaccagaaagtggcatgaggttctctctaggcgaataattacctccgaagaaactgttgtgtctgttctatcatctataacagggaagtatcgcacaggtttgtcacctgatgctctatcagtcatagaaaaccgtgaaaaggaggagtctgaggaacttagaaaatctgcttatcttcaagttgaaacggctttatccttacctggaaggcttagtggttctgtggaatggaggaaagcaaggtcagagttgggccaagcagattcactaagttgctcatcctgccctattcggaagtgtgtggatggtcatgtttcaaatatatatgatgctctttctgcttttctttcacatttttgacaaaaaaatccctaaagaaagaattattgaagcttttgaggcattgaagactttgatgctaactcttaaaagttccaactttaagagcagaagtgctacattagaccagaaagcacaccatctatttgaggagatatttccttccattgaaagattgttatctgctatttcactgaaagcagaattgggaactgctggataccaatctgtgaccgtgtctggaaatccagtacactcatccttagcgttaccagtagcactggatgcagttaatgagatattgagtaattataagaataatacctttttcacagaaggcaatcatttcccaagagggaacagagtatgctcaggttcagtccttgcaagcagggaacaacttccaataggaattgcaacagcagcttttgacggcattcactcctccaaatgggaagagcctgatggagccaaaggatgttggctgatttatacaatgcaagatggcaaaagttgcgagttggagtcatatgatttgatgtcagctaatgatgctccagagagggatccaatggactgggttcttgaagggagcgcagacggaggctccacctggaatatacttgatgctcggaattcagaaatgttcgagagccgtttcttgaggaaaacatttacagtggataagagatataaggcaaatgctttcaggtttaggtttctacgcgtaagagattctcattctaatccaaggtttcagataggatcaattgatctatatgggaaaaccatatgaactccccccggagctgtgtttcacttttcggctttctgaactgctcggtctcacgagcctgtgtagtatcataaattcataatattgtaatgcgagcatttactgtggacgcaacgctctcttcagtatgaatagatactgaataattaagagcatgatatatattgtttgcgcgcgcgattgagttctgaaatataagtgaagtccctcgacatgatcaaaaaaaaaaaaaaaaaaaccgaagcgggaaaaactttaaaaaagaata

SEQ ID NO: 16624 - DNA, 1116 bp, Zea mays
gcacgaggtggatccacatccaccctagctgcctcccgatcccacgcccaaagcttcctataaattcgcattgggtccccccagcgccgccgggtccgggatctcccacctcgatccctgcgctgcaagcaacaaagttctactctgtccacccgtccatctagctcccaagaaccaacccgtaccagcgctatccggccggccatggcggcggcgcgccggctctccctgcccctcgtcctgctggtcgtcctggccgtcgccgggcgcgcggcggcgcaggactacgacttcttctacctcgtgctgcagtggccgggggcctactgcgacaccaagcagagctgctgctaccccaagtccggcaagccggcggcggacttcgggatccacggcctctggcccaaccgcgacgacggcacgtacccgcagaactgcagccccgacaacgccttcaacccgtcgaaggtgagcgacctgctgagcagcctccgcgccaagtggccgacgctggcgtgcccgtccaacgacgggctgcgcttctggggccacgagtgggagaagcacggcacctgcgcagccgacgtcttcgacgagcacggctacttccaggccgcgctgcgcctccgcgaccagctgggagtcctcggcgcgctcacctccgccggcgtcaagcccgacggcggctactacacgctgagccagatcaagggcgccatccgccagggcaccggcttcgagccctacgtggagtgcaaccgcgacgaggccggcaacagccagctctaccagctctacttctgcgtcgacgccgccggcgacagcttcgtcgactgccccgtcctccccagcggcaggccctgcggcaaccggatcgagttcccggctttctaagctaactcactcttcacgtcagttgctgcaatatactgctagtccttttgcttgcattctatgcaagaggataatggaatgttcattccccattcttcaaagttttttttttgcaaataaaaggaggcgatcggtgttccatatttattatgttgatcataacatgacattcagagaacaattcataagttcaaaaaaaacaaaaaaaaggcccctagggcc

SEQ ID NO: 16625 - DNA, 1002 bp, Zea mays
gcccggccgggtcgggatctcccacctcgatccctgcactgcaagcaacaaagttctactctgtccatctagctcccaagaaaccaatccgtaccagcgctatccggccggccatggcggcggcgcgccggctctccctgcccctcgtcctgctggtcgtcctggccgtcgccgggcgcgcggcggcgcaggactacgacttcttctacctcgtgctgcagtggccgggggcctactgcgacaccaagcagagctgctgctaccccaagtccggcaagccggcggcggacttcgggatccacggcctctggcccaaccgcgacgacggcacgtacccgcagaactgcagccccgacaacgccttcaacccgtcgaaggtgagcgacctgctgagcagcctccgcgccaagtggccgacgctggcgtgcccgtccaacgacgggctgcgcttctggggccacgagtgggagaagcacggcacctgcgcagccgacgtcttcgacgagcacggctacttccaggccgcgctgcgcctccgcgaccagctgggagtcctcggcgcgctcacctccgccggcgtcaagcccgacggcggctactacacgctgagccagatcaagggcgccatccgccagggcaccggcttcgagccctacgtggagtgcaaccgcgacgaggccggcaacagccagctctaccagctctacttctgcgtcgacgccgccggcgacagcttcgtcgactgccccgtcctccccagcggcaggccctgcggcaaccggatcgagttcccggctttctaagctaactcactcttcacgtcagttgctgcaatatactgctagtccttttgcttgcattctatgcaagaggataatggaatgttcattccccttcttctttttttttgcaaataaaaggagggcgatcggtgttccatatttattatgttgatcataacatgacattcagagaacaaaaaaaaaaccaaaaacaaaaccc

SEQ ID NO: 16626 - DNA, 2387 bp, Zea mays
gcacgagaccattacctagaacatcctaatcgaaaagattcggttcggttcgttccaatcggggttttgctacttccgctgccaccggtgtgctccgagctgctcaagctgcgcgccggatacctggctgctcgatctgattcggtctccaacaccagccccctccgcggccgccgctccccgctgaccccggcgccatttcgacccgcgcggccgatccttggatggttccgatcaatcgggaccaagagacccaaggcttcatcacctcacccggcccccggcggcggtcgatccatggccggggagaaagcgccgcgcgcgttccccatcgaggagcttccaggccacctcatcggggaggtcctgacctcgggcgggctcgcggccgccgacctcgccaggctcgaggccacctgccgcgcgctcaggccgctcgccgaatacgccgcgtccaagctctgcgcggcacgggcggctttcgcggctatggggcccgccgcgcgtggggagctgctagagaggtgcgggggaagctggaagaatgtgctcaggttcctgcagtccgtcgagcagtcgtcaggcacggtcgagaccacatcgggcagcatgcaagtagccacaggaagatatcacacacttttggtccatgactcttctgtctattcttgtgggtccagcttgtgtggtgtgctaggtcatggcccagatactacacagtgtgcggcattcagtcgggtttccttcccatcactttcttgtgttataaacatctctgcttcacacaaccatgctgcttttgttatggagtctggggaggttttcacctgtggtgataactcatcattatgctgtggtcatggcgaagtggggagaactatatttcgaccaatgcaagtagaagcgcttaaagggattccctgcaagcaggttgctactggtctaagttttactgtgattcttactagggatggactagtatatacttgtggaagtaatacacatggccaacttggtcatggtgacaccatagacagggccactccaaagcttattgaattgtttgaaggctccactccggtggtgcagattgcagccggtgcaagctacacgtttgctgtaacagatgacggaacagttcattcctttgggtcttgtactaatttctgccttggacatggggatcagcatgatgaacttcttccacgtgcaatccaatcatttaagtggagaaacattcatgtagtccgtgtttctgctggagatgagcatgccgtggctcttgatgcactaggatatgtctggtgcagtggcgagaggtatctcactgagtcaccagtcgtgggtttttcgaagcagtctctccacatttgcgggtttatacatggggcaaaggatactgtggagccttaggccatggtgatgagaatgataaaactagcccagaattgatcagcagcttgaagggccaagttgctgtgcaggtatgtgcaaggaagagaaagacatttgttctcacggacaagggctcagtcgttgcatttggttggatgggcttcgggagcttagggtttcccgaccgaggaccgttggacaaagtaatgaggccccgcgtccttgagagcctgcaggatcactacgtctcacaaataagcacgggactgtaccacactgttgcagtgacaagtaagggcattgtgttcgggtttggggacaatgagagagcccaacttgggcaggagtacattcgtgggtgcttaaaacctactgagataatgttccaaaagagcatggaagacataccgattgcggcgcctagtggttgacttgaatgccatcattttggacactgttgcctacatgtgttgtatttatatcggaattcttgtcggcaagtgtattttatacttcgtgctttgtgagtaatctgggtgaacgggggaaagacggaagtggttggaattggaggacagtgttgtgtagccaaagaagcatatagtttagtaacgtgtaatgtatcgaataattcaacccaccatttttcttctgtacagaatttattggtgtgtttgtattttttttgtctctctcttgtccccttcatgttttcttggttctgtgctaacaactgttgagtaaatagcatttgctccccaaaaaaaaaaaaaaaaagtgcctaatcttgctagtttctatcaccttcaacaatgtcaattcgtcatcactgttttcaattatgcatataattacatgtgcacctcttagctgaaaaaatggtgccatactattggaaattgcttgccttggcagccgaaagatgttttattggtgatgcttgcaaggcattggacaacttcgatccagaatttgttggaaggcattggaca

SEQ ID NO: 16627 - DNA, 3310 bp, Zea mays
tagttgtttgctgctcccacctagctaaaacaaagccaacaacttactagaatgactaataattagttctagaggtttggaatagggccttaattaaattgagcctttggcttattcaatatttttaaaaaactcgactgtgggggtaagacactcccagaccattgtattaagaaaacctttttcacacaggtagagaaaacccctgaaaccccaacccatacacaacggcaccgtagtccatgtgagaatgactggggccgggtcctagacctatgctttgacgcgggacagacgggatgatttttttaactctagcctaaaatcgaggagtgctaatcagaccacctaaccaacatagctagaggcttatattgtttcaagactgactacaagtttactagtattcgagctcactgttaattgtcatattatatgttttcagaaagaaataataataccaattcaaaaaatgtaattctcttgtatttggagacaggtttccctgatggtggatggcattgaaaccgctattttttaagtttccaaattgttttcttatacgtgtgaacctcctgtatgtttccagatgcaagtagccacaggaagatatcacacacttttggtccatgactcttctgtctattcttgtggatccagcttgtgtggtgtgttaggtcatggcccagatactacacaatgtgcagcattcagtcgggtttccttcccatcactttcccgtgttataaacatctctgcttcacacaaccatgctgcttttgttacggagtctggggaggtaattgatgatctccttaattgaagccagttatgcctattactgtattactacatttccttgccttggtgttctgaaggattttgtctaaataggttttcacctgtggtgataattcatcattatgctgtggtcatggcgaagtggggagaactatatttcgaccaatgcaagtagaagcgcttaaagggattccctgcaagcaggtgggatcaaagatctttctcatccttttatgttttgtgtctctaatgatactcctgtacttattcataagtctgatctacttaaaattttctaaattgaataagtcccaccattctcttatatttttttcctgtgaaattgtaatttagttctgaagatttctattgatttctagaatattgcatttgcacatgtgtatttcatctccatttcactatttcttgttgaaatcatgttctgcagtcaatcagtatgatttgcatgttgaagattttatcaataaatgcctcacattgtgatgatttctttatatatgtcagtactaaattttttgacttgatccatgttaatgatcccttccctgcttaaccgtgtgcatatgcacatatcttttggaactatcttacatctcaggtcctgagggcaaaccacctaattctcttttgtttttctttttggggcaagtgattcttatcttttgatcgttgctggtacttcagtttcatactttctattacatattaaatcagctttctattgaacaataaacacactcattcaccattttatatgtatctatatgttattgggataagctttttgaggcttaattgttttctacacttatctatattccattttctatactgtttattcactaggctgcctagattttgttctgagccattaagatctttcatctttcctctgtaattaagtattcgtgatctgatgctatcttattaacttttcacaggttgctactggtctaagttttactgtgattcttacaagggatggacaagtatatacttgtggaagcaatacacatggccaacttggtcacggtgacaccatagacagggccactccaaagcttatagaattgtttgaaggccccactcaggtggtgcagattgcagccggcgcaagctacacttttgctgtaacagatgatgggactgttcattcgtttgggtcttgcactaatttctgccttggacatggggatcagcatgacgaacttcttcctcgtgcaatccaatcatttaagaggaggaacattcatgtagtccgtgtttctgctggagatgagcatgctgtggctcttgatgcactaggacacgtaagtgtatattgacctgttcgcattcccatatatatcgttaatgattgctctctaggcataggtataaagtctgaatctgaactttacaggtttatacttggggcagaggatactgtggagccttaggtcatggtgatgagaacgataaaactagcccagaattgatcggcagcttgaagggccaagttgctgtgcaggtccgttgctcatattggcaaggaagatattttgcaagccccttgcaatagttaaataaaagtggcattgcaaattatttgttttagatgtttaaatcaattcttctatacagcaatatgacatacaaacttcttggtctaattaaagtgctcttgatattcacacacatgttacttatcagttccatgcctgaaaccttttcttaatttttataggtatgtgcaaggaagaggaagacgtttgtcctcacggacgagggctcagttgttgcgtttggatggatgggttttgggagtctagggtttcttgaccgaggaacatcagacaaagtaatgaggccccgcgttcttgagagcctgcaggatcactacgtctcccaaataagcaccggactgtatcacactgtcgcagtgacaaataagggcattgtattcgggttcggggacaacgagcgagcacaacttgggcaggagtacattcgtgggtgcttaaaacctaccgagataatgttccaaaagagtatcgaagacataccaattgcggcgcctagtggttgacctcaaggccaagaggccaagaccaccattttggacactgttgcctgcatatatgttgtacttatattgaaattcttctcggtaagtgtattttatactttgtgatttgtgatgaacgggggaggacggaagagcaaagttggaggacagtgttgtgttgtgtagccaaagaagcatgtagtttagtaacgtgtgatgtaccgaataattcaacccaccatttttattctgtataaaatttattggtgtgtttgtattctttttcttgttcctcccacttttgctatctcggaatttattgtattactgcttaatgccctgtttgtttcagattataatctcacaagattatataatctagcgcaaataatttaatagttaaacaaacacatagattatgagttcagatttatataatct

SEQ ID NO: 16628 - DNA, 1365 bp, Zea mays
  misc_feature (1268)..(1272): n is a, c, g, or t
atgcaagtagccacaggaagatatcacacacttttggtccatgactcttctgtctattcttgtggatccagcttgtgtggtgtgttaggtcatggcccagatactacacaatgtgcagcattcagtcgggtttccttcccatcactttcccgtgttataaacatctctgcttcacacaaccatgctgcttttgttacggagtctggggaggttttcacctgtggtgataattcatcattatgctgtggtcatggcgaagtggggagaactatatttcgaccaatgcaagtagaagcgcttaaagggattccctgcaagcaggttgctactggtctaagttttactgtgattcttacaagggatggacaagtatatacttgtggaagcaatacacatggccaacttggtcacggtgacaccatagacagggccactccaaagcttatagaattgtttgaaggccccactcaggtggtgcagattgcagccggcgcaagctacacttttgctgtaacagatgatgggactgttcattcgtttgggtcttgcactaatttctgccttggacatggggatcagcatgacgaacttcttcctcgtgcaatccaatcatttaagaggaggaacattcatgtagtccgtgtttctgctggagatgagcatgctgtggctcttgatgcactaggacacgtttatacttggggcagaggatactgtggagccttaggtcatggtgatgagaacgataaaactagcccagaattgatcggcagcttgaagggccaagttgctgtgcaggtatgtgcaaggaagaggaagacgtttgtcctcacggacgagggctcagttgttgcgtttggatggatgggttttgggagtctaggatttcttgaccgaggaacatcagacaaagtaatgaggccccgcgttcttgagagcctgcaggatcactacgtctcccaaataagcaccggactgtatcacactgtcgcagtgacaaataagggcattgtattcgggttcggggacaacgagcgagcacaacttgggcaggagtacattcgtgggtgcttaaaacctaccgagataatgttccaaaagagtatcgaagacataccaattgcggcgcctagtggttgacctcaaggccaagaggccaagaccaccattttggacactgttgcctgcatatatgttgtacttatatcggaattcttgtcggcaagtgtattttatacttcgtgctttgtgagtaatctgggtgaacnnnnnaaagacggaagtggttggaattggaggacagtgttgtgtagccaaagaagcatatagtttagtaacgtgtaatgtatcgaataattcaaccca

SEQ ID NO: 16629 - DNA, 900 bp, Zea mays
atgggacttttcattcgtttgggtcttgcactaatttctgccttggacatggggatcagcgccgcccgcttcggcctcgcgcacgccattcatttaagaggaggaacattcatgtagtccgtgtttctgctggagatgagcatgctgtggctcttgatgcactaggacacgtttatacttggggcagaggatactgtggaggccttaggtcatggtgatgagaacgataaaactagcccagaattgatcggcagcttgaagggccaagttgctgtgcaggtatgtgcaaggaagaggaagacgtttgtcctcacggacgagggctcagttgttgcgtttggatggatgggttttgggagtctaggatttcttgaccgaggaacatcagacaaagtaatgaggccccgcgttcttgagagcctgcaggatcactacgtctcccaaataagcaccggactgtatcacactgtcgcagtgacaaataagggcattgtattcgggttcggggacaacgagcgagcacaacttgggcaggagtacattcgtgggtgcttaaaacctaccgagataatgttccaaaagagtatcgaagacataccaattgcggcgcctagtggttgacctcaaggccaagaggccaagaccaccattttggacactgttgcctgcatatatgttgtacttatattgaaattcttctcggtaagtgtattttatactttgtgatttgtgatgaacgggggaggacggaagagcaaagttggaggacagtgtcgtgttgtgtagccaaagaagcatgtagtttagtaacgtgtgatgtaccgaataattcaacccaccatttttattctgtataaaatttattggtgtgtttgtattcaaaaaaaaaaaaaagcaccc

SEQ ID NO: 16630 - DNA, 1232 bp, Zea mays
cattcctcgccgccgggccggccgggatccgttcttcagccggcgcctcccacgtctccagtccgacactccgactcactccccctcccccgccccaacccgtcgcaatggccgccgtctccgcagccccgaggccctcgatgcctccccgactcgccctccgtgcccacctcttctcctccgcctctccgctcccaatgcgcgcgctccccttactccgcagccgcttccgctccttgaccacggcctacgctgtcaagcaggacacggccctctggacccctgcacccgtctccgccatcagtgctgccaccgacgacggctccgtctccctcatcgccgtcgacctatctgacgccacggacctcgtggactcgtacacgaacccgggccaatacctcctgatccgcgtacccggcgaggagctcaagccggcgtacatggtcatctcctcgccgcctaaagcggggccccggttcgaattcctcgtcaaaagcgtgccgggagctaccgcggggcggctctgcgccctccgagacggggatgttgtggagctcggcgccgtcacggggaaggggttccccctcgacaggataaatccgcccgacgtcgcgcagaccgtgctcatcttcgcggcggggacggggatcagtgcgattcgatcacttatcgagttcggtttcgctgccaaagaaagagctgatgtgaggctttattatggtgatacaagtctgaaatctatgtcataccaggaaaggcttagtaactgggagtcaactggaattaaaataataccagtcttatcacaaccagatgacagctggaaaggtgaacgaggatatgttcaggatgctttcttcagaaacaagaacatagtaaatccatcttctacaggagccatactttgtggaccgaatgaaatgcaggaggaactcaccttatcccttgtagcagatggtgtctcacgagacaaaatcttaacgaactactgaaagcgatctccggtctctgatgtattttatgaccagttaggcctcaacgtgtaaactttattgcttaggcctggctgtgatgttccagtgatatatgaataaactactgaacttgagacgaggatgtaatgttcagtgatatattatatgaataaactactgaatttgaggcgaggacaaaaaaaaaaaaaaaaaacggcccgcctcatataaatggccgcagtaacatgcttctttatc

SEQ ID NO: 16631 - DNA, 965 bp, Zea mays
gctcacgtccgtgcactccaacaccgacctccgcaagctcttcatcgagaccaccagcaagtccatcatcgtcatcgaggacatcgactgctccctcgacctcaccggcgcgcgcgagaagaagaaggcggcggaggaggacggcgacaaggacaagaaggacggcggcggccccagcaagcccggcgagaagaaggacaccagcagcaaggtgacgctgtcgggcctgctcaacttcatcgacgggctgtggtcggcgtgcggcggcgagcggatcatcgtgttcaccaccaaccacgtcaagaagctggacccggcgctcatccgcagagggcgcatggacaaacacatcgagatgtcctactgcggcttcgaggcgttcaagttcctggccaagacgtacctcgacgtggactcgcaccctctgttcgacgccgtcggcgagctactccgggaggtggacatgacgccggccgacgtcgccgagaacctcacgcccaagagcctcgacgacgggccggactcgtgcctcgcggacttggtgaaggcgctggaagaggccaagaaggctagcggagccggagaggatgaagaggaccagcaacatgagccatgaggaggaaacagctctagattattcagttgattattactgccagtttgtcgttagtcggtaactctgctgatttgtctgctgtgctacagtagtgcagaggctaatgataaaagttacccctagaataaattaattagctaggggtttgtgtttgtctaaatttatcttatcctagagaagagaagccccgttcttttttttctataaataagtctagataagacagtttttttccataaaagctgttagttcccctcgccacatgagagaatcggtaaacctcaaaatactaactcttttaaactttttatgatggattgaattcaaactaataaaaaaaaaaagaacg

SEQ ID NO: 16632 - DNA, 1602 bp, Zea mays
aggtttctacaatcctgatgacaaacagaacaacaactctgaatctcaaaaagatggcagcacagcacagtcgggatttgtttgggatgaaaaatctggttactactatgattctgcatctggattctattatgatggaactactggcctttactatgacagcaactctggagtttggtattcatatgatcaacagactcaacaatatgtcccttgtaatgaccagagcaacactaaggcagccggggaggcggccagcgaaaacacgaaaacctcagatagtaatagtggcaaaaaggttgtgatctctgcgcctgctgccacaattaaacaaagtgagaaaacttcacttcctgacgctgttcaagctgctgcaaatgctgcactggctgcagaaaagagagaaaaggagaaggcaaaagagattaaattggcctcaaaaaatagtctcatagctaataagaagatgagcaatgtcctagctatgtggaagcaaaggaatcaagaagggcaggccgcacgaattgtccttgatgacaaagaaccagcaaattctgatgataaatttagtcattcacgtagtggaactggattctctttgaaaagcaagccaaattctgaccttgaaaatgctatgggcaattctcttggccaaggaatgacatcgactcaaacattggattctgttgtaaagcctagacctgtcagtaacagcttagggactacagttatgggtgtcataagaggttctgctagaggagtgatcaagtcagatactacgtttcacgcattatctgatgctggtagcactgattcccgcaccactataaccacaagagcaagtgggttaatgacaagttctgaggcacttataactcctgcacccttcaaaactgatgtgtctgccttagtctctaatactccatcgggagtttctgggagtggtaaacgtcggttttctgaggcaccgggacaatcccagtacagggatcgagctgcagaaagacgaaatctgtatggatcatctcatggcactgatactgttggattggattcaatgagatagggtcgatgccgtttcctcctggtgtgggtgaacgttccagtggtgaaattggcaacagcgaaaactatgaagttattaccgctgatagagcaatcgatgaaagcaatgtgggcaaccgcattctacgcaacatggggtggcaggagggactgggtctcggaaaggatgccagcggtatcaaggaaccagtcctggcaaaatccgtcgacgccagggctggactgggaagtcagcagcggaagcctgatccatcccttgaagcccaagccggggacagctacaaaaccatcatccagaagaaggccatggcaagattcaaggagatgtcttagctacactgttttatctattttattgctgcattttgtagtccgtttttaacagcatgcatttttttgtttgctcgtgtgttttttaaataaactgagccgctgaattgtgatttatcaaaaaaaaaaaaaaaatacatagttcgagaccgaaaaaaaaaaaaaaaaaaaaaaaaaaaaaaagtactctgcgttgttaccactgct

SEQ ID NO: 16633 - DNA, 2582 bp, Zea mays
  misc_feature (2024)..(2024): n is a, c, g, or t
  misc_feature (2582)..(2582): n is a, c, g, or t
cggccgcgtgggtgcaggtccaactcatgttttagttgttcgtggcttggatgaaaagctgatgaggaaatgcttcggtacgaatttgctaagcacgcaccaataaaggacatccgccttgttcgggataagtttactcatgtgtctagaggttttgccttcgttcatttccattcggtggaagatgctacgaaagctctggaagctacaaacgggattacacttgagaaaaacggtcaggttttgcgtgtagcatatgctaaaagtacacatggacctgcatcagggggttctcagtcaaacagccttgctgcagctgccattgaggctgcatcatttgctcagcagtatgatgccataggttgggctccaaaagagtacaatcctgatgacaaacagaacaacaactctgaatctcaaaaagatggcagcacagcacagtcgggatttgtttgggatgaaaaatctggttactactatgattctgcatctggattctattatgatggaactactggcctttactatgacagcaactctggagtttggtattcatatgatcaacagactcaacaatatgtcccttgtaatgaccagagcaacactaaggcagccggggaggcggccagcgaaaacacgaaaacctcagatagtaatagtggcaaaaaggttgtgatctctgcgcctgctgccacaattaaacaaagtgagaaaacttcacttcctgacgctgttcaagctgctgcaaatgctgcactggctgcagaaaagagagaaaaggagaaggcaaaagagattaaattggcctcaaaaaatagtctcatagctaataagaagaagatgagcaatgtcctagctatgtggaagcaaaggaatcaagaagggcaggccgcacgaattgtccttgatgacaaagaaccagcaaattctgatgataaatttagtcattcacgtagtggaactggattctctttgaaaagcaagccaaattctgaccttgaaaatgctatgggcaattctcttggccaaggaatgacatcgactcaaacattggattctgttgtaaagcctagacctgtcagtaacagcttagggactacagttatgggtgtcataagaggttctgctagaggagtgatcaagtcagatactacgtttcacgcattatctgatgctggtagcactgattcccgcaccactataaccacaagagcaagtgggttaatgacaagttctgaggcacttataactcctgcacccttcaaaactgatgtgtctgccttagtctctaatactccatcgggagtttctgggagtggtaaacgtcggttttctgaggcaccgggacaatcccagtacagggatcgagctgcagaaagacgaaatctgtatggatcatctcatggcactgatactgttggattggattcaactggtgactatccgtcccgaaagggttcaagtgagatagggtcgatgccgtttcctcctggtgtgggtgaacgttccagtggtgaaattggcaacagcgaaaactatgaagttattaccgctgatagagcaatcgatgaaagcaatgtgggcaaccgcattctacgcaacatggggtggcaggagggactgggtctcggaaaggatgccagcggtatcaaggaaccagtcctggcaaaatccgtcgacgccagggctggactgggaagtcagcagcggaagcctgatccatcccttgaagcccaagccggggacagctacaaaaccatcatccagaagaaggccatggcaagattcaaggagatgtcttagctacactgttttatctattttattgctgcattttgtagtccgtttttaacagcatgcatttttttgtttgctcgtgtgttttttaaataaactgagccgctgaattgtgatttattatcctgaaaggggcactacatagttcgagaccaaaaaaaaaaaaaaaaaaactccagggggggccccgttccccccccccccaaggggaagacagagaggaaatnattggcccttctttttacaccgccgggactggaaaaaccctggcggtccccagctgggggggcctgcccccactccccccttttccccaactgggttataacccaacacgtccccccccggtccccccttcccaacagtggcccacccccacaatggcaatggggtcaattcgcccgcgggctctccatttgggacaataccccccttctttcgtaggctacgacctcccccctccccttctaacccatggtgcgaatatccccctccaccccttctccaccttatacagaaccctcccctcgggcggcccccccctctcctccctcttccttctcttaccctccctctctctacgcttcttgctcccaccctatctgttctgtcaaatacccttcgatctcgccccccacccaccccctcataatccccccccacaccaaaccgtgttattcgtcctctccgctttgctagtcttcaacccccccactcccggcccgcctcacatctcctctcgcaatcggttcatcccccgccatccctccatcccgtcatcacan

SEQ ID NO: 16634 - DNA, 3384 bp, Zea mays
catcggtaccctccgggccggccggggaccagcctcgccgccgcgcgccaaaaaccctaacccctcctcgcctccgcccctgccgcgtgacggccccagagatggggcgagacaagagccggcgtctatacggcagccgccatttccggcagcggctggtgctggcgacgctcacctctaccgctgtcaccatcgaggacatccgctcaggggacgcttcgccggggctccgcccttacgaggtctccctcctccgcctcctcgacaagatctcagaccatcacaccattgacctcaacgagacaggaacgaagctgaggtaccggccgggggtgattatagggggaaagggccttgagcacgactgcggggtgcaccggggtattggctactttcttgagccactcatactgcttggtctattttcgagggcccctatatcgattcggcttaaaggaatcactaatgatacaaaggatccttctgtggatactttccggacaacaaccttgcatatgctcaagcactttggtgttcctctggatggtttcgatctaaatattgacagccgtggatctcctcctcttggtggtggtgaggtgtttctccgggttcgcaatataaatagcacattgacggcagcaaattgggtagatgaaggtatggtgaagaggataaggggtgtttcgttctccaccagagtatctccacagttggaaaaccgcatcatttatgctgcacgtggaatcttcaatcgtttcattcctgatgttcatatacacacggatcatagatctggttctgctggtgggaggtcaccaggctatggtgtatcgttagttgctgagaccactacgggatgcctgctctctgtagatgtcactgtgagttatcctagtgttgatgaaataaatgaagaatctgagaagcctgagctgacttctccggaggatcttggtgttcaagctgcatcaatgctactagaagaggtggctcaaggaggtgttgttgattctacacatcagggcctcctatttattctgtgtgctttatgcccaccggatgtatcaaaggttcgtgtgggacagttgactccatatggtatagagacacttcgaaacatcagagattttcttgacgtcaagttcatcatcaagcctgatcccaattcaaacaccgttactttaaaatgtgttggcgcgggagtgaagaatcttgctcggaagatttcataagcaacatgaccattaatctgatgaaggatccatgccacatcaagagactactatgagaccctatttgtaactgcaaacaacagtgtaggagtttcccttagctgttactgctgaaattctattcgaggtccatgatgtcttagacatcaccgatgtacatcagtattagaatggattgttctgatcatgatgccctgtattgtcgacacatttttgcatcacattgcttcactccaactatgccatgacatgctgatacatagaaatgaagaaaaggtgacaaacgtccagactaaaaaaaaaaaaaaaaatgtgcattttgtttgatcaaattgtcctgtgggctttggaatccacttctggcattttgtttgaccatgctgtcctgtggacacatgaattggagttgctcaaggcacgctggtggcggtgagcagtcaggtatcaccgtaccagtagcaattacaggccgcgcttgtggcactctagtatcatggggttatcggtagttgttacaacagcgtaaggaaccgttcgtttgtccacaaatggtatcaggatttgtttcagcttatcaaaacttatactaccttagttctcgaatattgtcgttcactagtttatttttaaactaaatcgtgacaaataaaaaagaaattcagctaggttttgttctgagcctccaatctgtaaaaaccgaacattatctcggttctcgaatatttatcgttcactagtttatttttaaactaaatcgtgacaaataaaaaagaaatttagctagattttgtttatttttaaattaaatcgtgacaaataaaaaagaaattcagctaggttttgttctgagcctctaatccgtaaaaaccgaacaggacgaaaaatccagatcagacacaggacccggccacgggacagggatgcagcggatgctaagccgtggggttgtcggcagtggcggatcctagcttatggctaccaagaactcactgtaatatccgatataaacttcactaacattactataagattattgaaacagttagataaccaaaaatatgcaacctgtgaagatctagagcacttctgataaagcatagatcagtacatagatcactgattttactgacagacagacattgaactcggaagcattttgtgaaggcaacaactctaaattgtacatagatcactgacagaataaccactaattaaacccagccttattcatgatacaggttccatgcaaaatcaaacccagaactccagatactactaagtttgtcataaccactagactataaaccctttggcagtagtatgtaacgtaaatggtttatatggggtaatggataccaatatttttgtttgattgagctctttctagtattaataggtactactattcaatccaattataactagtaaccattaccaccggtaaaagatcctattaccattcccttaacaaggcctgaaccaaacaggagactcctattattttgacatcaacacgcatggattagcatgagcctctacaaggccctaattaaaccgtgactagcacaactatttcctagactcgcgcttattaattccacgtcagtatcaacgtccaagccgcagtcgctactgcatgcaatgaatattccagtcagtaccccggcctcggccttatttgtgacgtgatgtacacattccaaaagacttggccaaatttgaggcagagttcattgctgaatttgtgacgccgtgctcttgattggcctgacaactcagagccggccactcatccattcgtttcttccaggtccgccactccattttcaccacatatgcgtaggcagataagctccgttgtctcttttccaatcttttcgctttcgcgtggttctccgatcctcagctccatgcattcagagatacgcatccatggacgctggtggattactcttctcgacacgattccgtcgtctgtttggattgaatttgaaccatgagttgtacaccacgacgaataggctactacttactacaagtagtagtaccaccttgcgtgggagcttgttgtatcgcattcattattgttattcactgccatctgcatgcttaagggatattaagtttctagaaactaatttttagtacc

SEQ ID NO: 16635 - DNA, 3561 bp, Zea mays
ttgctactgctcaaacataacaatgccactttacttgcttgattgaaggttgtatgttgttataatcccaatctatctatgagcgaagaatcgtcaacttacctgaagattgaatggtgttaatcctgatctgtttatgatgaaaacttacctttttcttttctggttttattgtggccgcaatatgaggcagcatggttgtctctgcagaggacaccattgtcggttgtaaatattggtgcctcccatcctggtgaagcttctcacttcaccaaatgaagatgtccgtaaacaagcatgttagaaaacaaattatcattatttgaattgcgcacacatttcatgttattagtgtaaatttgtgagatattggggttgatgatatatatgttgttcgttttcatgtaatctttgtgcactaacatttattgaataatttggatgacgtcgtaacacatgagcacataactagagaaggtaccaaccaaaagtatgtgcatgaacagagatcaaacatttcaaagtttcttcataatctaaaaatacataaatgtgtgtttgatttaccagaacatgtaaagtatcatattcaacatttttaatccagggttaagatatcctgggttcacatatcctactttcatgacattgtgcaattacatctaatatatttgccttctttcgtctaggtactggtttcatcatatacatgatctttcttaaacaaaaaggaataattctctaacctcacataatggtgtacaatgatgaaaatggatttgggatagatgcggtcatagggttagcgacatgagctccgtgagcccgcccatcgtggacgggatctggccatgcacgtcgtccgcgccgtcaatgaagacgatgtttacacgctggcccgacgtcgttgcaccaaaagtggtcccacgcgcagtagttgggtagcacatgcttcatgttcagcagcgcgtgcagctcgcgaggtgagcaggaccacgtcgtgttgcggacgctgcaatgagcaggaagacaacgaggaagatggtggtggtggacgccattgcgctcgtgtgctaggacctaggaagatagccgtgcatatcatagtgatgtttatcgttaacttttaaacatcgtggcaaaacacggacacttacctagtccctagataaaagcccagtccgacaattgaagtgtctccattctctaatgaggaatttgtatttttgacaccttaagtaagtgattttgcacaattgacactctaaaattaatttcgtaaatttgatacccacatcattgtcactttgatttatttgtcattttatcttttaatagttttcttttcttttttctattttctaaaatataaaaggactaatatatcctttcttgtttataaatttgccgcagatgtgctctttcacttattaaaagagtaccacattctcaatttgccgcagcggtggctttattagtacgttaaatacgagaaatggtatattatatttattccttccatatctcagaaaatgggaaaataaaaaaactattaaaaagtgcgtgtcagatttacgaatttaatctttagaaattagaatgtcaattgtgcaaagccagttatttagggtgtcaaaaatacaaatttctcctcccgaacaccctactcgttctcccccatcggcgccgctacgaccagcgtttgagccactcgccgccgcgcacgatcctccacgccttgctccagtcctcgtcggcacgcctccttcccaaccctaaccctagcactagcagtcagtcgagcggcggcaagtcaagggtctgtcgagcgggccggcggcgaagaagtgtctagcgaggcgagtcaggtgcagggggacccacccgcagcggtggcgtgaagcgcgtttgactggatcgaccaggttggcggctaaacagaggaggttgcttgtttgttttctccgtccggctgcggttttcctttgactggatcgatcagatttgccggcggcggcagcggtcccccggcaaaggcgtggggatccctgccgggatggaggtgccgtggctgctgctggtgcacgggtcagtgacggcgctggtggtggtgtcgttcctctgcgggcaatggcccatcttcgagggcaccttcatccagagcatcaaccacttcctcacctttggggcctaccactacctcctgcggtttgtgcagtctgtgtgcggcactggggctagggatctcgtcctcggtgtcgagggatactgctgcgaccgacccaacccgatattgcaggtattttatgttgccataattggagtgacatattttataatagtgcagacatctttccagtatattcctgggtattatgtgagtggattgcacagatatctgagtgttgtggctgtttctgttggtgctatactcttcgtgcttactagcttttctgatcctgggactgttactgctgaaaatgtttctcaatacgtatcttcctacccatatgacaacattatttttgtggagaaagaatgttcaacttgcaagattactaggccagccagggcaaagcactgtagaatatgtgacaagtgtgttgctcgattcgatcaccattgtggatggatgaataattgcattggggagaaaaatattcggtattttgtggcctttttagtttggcatttccttatatgtctgtacggggctttaatccttggcttcattcttgctggtgaaataaaagagcggaaaattatatacattctgacagtttattatggcatcgataattcattctcgggcttgtttccacatgttgcacagtggttgcttgctgtgcataacactcagatactcttgagtgtatttttggctatattagcactgctccttggtggcttttgtgcttaccatgcacatctttgtttgacaaatacaacaaccaacgagacattcaaatggcaagactacatcatgtggatgaaaaaggaaaatgaagcaaaggcggacgctgccacgctcagatccagcataggctcggccaatagtgatgcacagaaagctcctccaagcaaatggaggacgttcttcatgagatcccgcacaccaagcatggaaccagttgtgagaaacaacatatatgacagaggcatgattacaaacctgtgcgaggtggtcgtccctttatcagaacggaaggcattttcccgcatgaaatcagattgatgtcttttgttgcagttgctttgtcaccaaactgttgttgtatatcagtgtagaatttgcgacacatttttttggtcataccatagaggcatagggaaaaatattcagggtaatcgtgttcagtacctacgtcctatttattataggtgaaaggttttgaagttgcatttgcctttgcctttgcaatacgccgatgtcaatattctgtttttagaacatgattatgaaaatgtacgaaatatgaaactcatactatatgccttcgagtaattatctggccttaaaataaatttctagaagattgagttacaaaaaaaaaaaaaaaa

SEQ ID NO: 16636 - DNA, 4004 bp, Zea mays
cggtccggccatcccggtcaattcggcacgaggcgctagacctcaaagactcgatcgcaccgcatcttctctctctgctcctcgttcgcttcgtcgccggcgaccccgccgccagcttccccttccgctggccgccctttgcctcgcccctgaggcgtcggtttccactgcataggagtggggcggcgatccgactggacctagggttgcgagaccccatagggtgaccctaggagcatccgcctccacgtgggtgaggcggaggagggaggatgtcgtcgctcagccgggagctggtcttcctcattctgcagttcctcgatgaggagaaattcaaagagaccgtccacaagcttgagcaggagtccggattctatttcaacatgaagtactttgaggacgaggtcgtcaatgggaattgggatgaggtggagcgctaccttggtggattcacaaaggtcgacgataaccgctactccatgaagatattctttgagatccgcaaacagaagtatctcgaggctcttgataagcatgatcggtcaaaggctgttgaaatcttggtcaaggaccttaaggtatttgcatcctttaatgaggagttgtttaaggagatcacacagcttctgaccttggagaactttagggaaaatgagcagctttctaagtatggcgatacaaaatctgcaagagcaataatgtttgttgagctgaagaagctgattgaagctaaccccttgttccgtgataagctacaatttcctagcctgaagaattctaggttgcggacacttattaaccagagcttaaactggcagcaccagctttgcaaaaatcccaggcctaatcctgacatcaagactctatttgttgatcattcatgtggacaaccaaatggtgcacgtgctccatcaccagcaaacaatccattactcggatctatgcccaaacctggaggtttccctccattgggtgcccatggaccttttcaaccttcaccaacacctgttccacctctggctgggtggatgtcaaaccctccagcagtaacacatcctgctgtgtctggtggtgccattggatttggcactcctacaaatcctgccgctttgttgaagcatcctagaacacccacaactgctaatcctggtatggattatccatcaggagattctgatcacatctccaagagaactagaccagttggcatgtctgaggaggtgaatcttccggtgaatatgctgcctgtgacttatccgcagagccataattaccaacaagatgatttccataaaactgttgcacggaccttgagccaaggatcaacaccgatgagcatggatttccatccacttcaacaaactcttcttcttgttggtaccaatgttggcgacattggattgtgggatgttggtaccaaagacagactcgttgtaaggaacttcaaagtctgggacctcagtaaatgtacaatgattctccaggcatcactggttaagcagcctccggtgtcagttaatcgcataatatggagtcctgatggaaccttgtttggtgttgcttattcaaggcatattgtacaaatttattcctataatggtggcgacgatattagacaacacttggagattgatgcacatattggtggtgtaaatgacattgcatttgctcatccaaataagcagttatgtataattacatgtggagatgataagacaattaaggtatgggaggccaccagtggagctaagcaatttacatttgaaggacatgaagctcctgtttattcagtttgtccacattacaaggaaaatattcagttcatcttctcgactgctttagatgggaagatcaaggcatggctatatgataatatgggatctagagttgactatgatgcaccaggtcattggtgcactacaatggcatatagcgcagatggttcaaggttattttcatgtgggaccagcaaggatggtgaatcacatctagtagaatggaatgaaagtgaaggagcagtgaagagaacatatcagggatttcgtaagcgatccatgggtgtcgtgcaattcgataccacacggaacaggtttttggccgctggggatgaattcatgattaagatatgggacatggacagcacgggtcttctaactaccattgatgcagatggtggcttaattgcaagtccacggatacgcttcaacaaggaaggaactcttttggctgtctctaccgttgacaatggcatcaagatcttagcaaatgctgatggacttcggttgctgcgcacgctggaaaatcgttcttttgatgcttctcgtaatgcatctgaggctgtaacaaagcctctaataaatcccttgactgctgcggcaaatgcagctgcagcaagcagttcaggagctggtgctccgtcagctgtaactgcaatgaatggggataccagaagtttggttgatgtaaaacctagaatagctgatgagtcactggacaagtcaaaggcgtggaagcttatggagataactgagtcaactcagtgcagatcaattaaactggcagacaacatgagaacgagcaagatctcgagattgatttacacaaattctggtcttgctatcttggctttaacttcaagtgctgttcatctactctggaaatggccacgcagtgatcggaattctggaaaggcaagcgcgagtgtgtctcccacactatggcaaccaccaagtggcattttgatgactaatgacacgactgacaacaatcctgaagaagctgttcactgctttgctttgtcgaagaatgattcatatgtcatgtccgcttctggaggaaaaatctctctgttcaacatgatgactttcaagacaatgacaacatttatgcctgcaccgccggcagcaacttttcttgcatttcacccccaagataacaacataattgcaattggaatggatgactcaaccatccaaatctataatgtccgaattgatgaggtcaaaagcaagctcaggggtcactctaagagaatcacgggtcttgccttttcaaatgtgctaaatgtcttagtctcttccggagctgatgctcagttatgtgtttggaacacggatggatgggaaaagcaaaagaacagatttttgcagataccgtcaggtcgccaatctaatatcttggacactcgtgttcagttccaccaagatcaaatgcactttcttgttgtgcatgaaacccagattgccatctatgaaactacaaaactagaaccagtgaagcagtggcctgttcgagagaattcacctccaatcacacatgctgcattctcgtgtgacagtcaactgatctatgcaagctttatggatgccactgttggcatatttaatgcatcgagtttgagacttcaatgtcggattcttccagcttcgtatctccccccaaatatcagtccgagtgttcatcctgttgtggttgcggcacacccttcggaagcgagtcagtttgctctagggctgactgatggtggtgtttttgtgttggaacctttggaatcagatagaaaatggggaaatcctccaccggtagaaaatgggtctgctagcaacttgtccgcaccgcctcctaatggagcttcaagttctgatcaacctgaaagatgattgagaagatggaactggtagatttttcgtggcatgagtctaaccaagatgggcttcaaaaggtggtgcaactaaccttggcagatcggttccaagggactcggacaatgggctcaataaaaacaagctcaacagcagtttatccgttgcttatatatatttctattgactgtatcgagtgaagaggatagttctagtatttcattttgctttgtttactgtgctgtgaaaaggagttcttatcagtagataagctgtagacaactatcagtttggctcctacattttatgacttagtgaaagtatcttgtttcatttgcctattggccccgatcgagggggggc

SEQ ID NO: 16637 - DNA, 3775 bp, Zea mays
  misc_feature (48)..(48): n is a, c, g, or t
tttgctgctcctcataaaaatccagttgtaaagcgccaagatcagatnaaggaggcggtggcgacgctgaaatatttgcattaatttatcctattcagctccttgtgcctggatacgagagcccagtgtgcaggggacgccaacaaggttactgtcatgtacatacatattgattaacgagcatgacctgaacctctttgctgaatgtgattttgagactgaaagttactgcccgtatgatggtatatgtgggatttgcttgtcagtattttccttttgaggttgcgggggctgctatctcagggtattttgtgatgctcgagctcgagtggagtgcctttctaacctatggtttatttgctttcctatcggtcgtttaaggagatcacaacttttgacattggagaactttaggaaaaatgagcagctttctaagtatggtgtgcaagagcaataatgcttgttgagccgaagaagcttattgaagctaaccccttgttgcgtgataagctacaatttcccagcccgaagaattctaggtgggtttggattgtggaaatgaattgctataaggatattgacatgaaacaaatagcaagtgactgatgtaagatattgacgtactctcaattgtgtatttaggtattaaaaagtagctatctcaaatatctgtgaactcaagcgactgtccagtttgatagctattactgattcttttgatgtgttgtttgtttgatagctagattaaaataacaaaatttttgtatggctaggttcacaaatggattacgaaatcttttgtcataacaatataacacacatttgtacattagttattatagtattatatgtttccgttgcaacgcacgggcactcacctagttatagcataagaggttattctatccatggactcttttcaacgacaagtgacctaaaggcccaaacaacaacgaccataattatatattcaccactagcaagctacacaataatgaagtgtcgtccctctatatctatttgtttcatgttgttgccctactagtcaatgactagttagccatcaatgttatgtgtgtttgtattaaattatgagttctcgcttaatattttcgctcccgttcgtttccgtacagccgtttatcttgctcccgtctttgttaccgactattccggattcagttctgttttcggtgaaaaaaaatacggaaccggaaacatgagaggcatttttctatccattccagttcgttttcatccacacttgcattcagtatgtagagatttttttctggtttagttccagagtttggtgggaccgagccgctcaactctgagttcattgttgtttgaattaagtctatgtagaatagaataaatctaaagaagaaaaattatgctcaaatgcggcttcccaaaatctttcgagctgatctccagtgtgaagcagctctatctcaactagctccaaaaccgaacattacgattagttaataatagtgacgtgctctggttagcgccagtcaagtcaaaccagcggccgcagcattaagctccatttgtgtctttcaaaatgaggcagactttgctggttgttccattacagtctacaacaacaacaaccaagtcattctcgtgaccaaaaattgcttcacctgctcccgtatgcatgatactcgggagattttccgggcagaagaggaaatcctgacaagtagtgcgttccttgctcacaggtttgtgaatgtctcgaatttcattacctttcactgtgtttccaagatctctccgctgagtattttttggatctacaggttctagattgacattctgtggttttagtttactctccttttctaccaccgtcttaaactctcgtttcatctctgcttatatcttcttaaatttgcttcccgttgcaactagcctctaaactgcaggacatgaattactgttgtttcagattgataaggatactttcctgttcatcctgaagcaagttccgcacctactttaattcaagttatacatggtcacctcatgggagatctgcatacctttgctattttagattgtatgacctaaattttgtggagctcatcaaattcaccgtttccttctttccttcttcctcgcgaagctcactggtcacgcttgcttcctcctccgcgcgctccccatcgaccgcgcttgctcgtcctccgcctgccctggccctggccacgcaaccctagccatggcgagccctggtcctggccatagccgcgtggccgccgaatcggcgaggtcgcgctcgcccggtgaggctgcgggagctccaggccgcctgcgcccgcactggcctcgtcctcgtgttcgtgttttttttcccacgcaaattcgtcatatgaggaggaaaggatgaaagggggcaaattaatccatttcaaccaagttgtccttcaggtggagatgctatgtaatttaaacgggttttacggtggatcttaaatccactcatggagccaaatctagattcactttgcgtctgtttagttgcttgtatatgagagtcaggcctgtatggttggatacaaaataagtcattttgatgttattaacctgcattcacccatacgctcaaaattatggtatcttatggcagcctgctctcacgaacgtgcagccatcccatcagactgtttaagcgtgaatctgtctcaaacaacacgtgtatgcgagcaacattccctttcacaatagttctgcaaagtgggggtatgtcagcttttaagaaaaaaaatactactggaaagtggaaactgacatgctctcacatgattgattgttttcttactgtttatctcgttgatcgatgcatgacacagagatctactagtaattaatcattaacgttagatctgaatccctacttgaccacttccaccggcctagctttgacatatgaaattggtcatcactacccagcaaggtgtatatactgtccatgtataccattttttcacctgaagatatttcttgcacctgaaaactactgcaaatgcttttctcgctctttagctgtgtttaattagctaggattttttttatttcctatcactcaaattattacaaaagctactacttgtttctattatatgggtctattgttatgtcttccatgattacttacttacccatccttgctcttgtttcaaggccctcgttgtgtcatgtaactgcaaatggctcgccaaactagcgttacagaagctgacctggagttcatgctaattgatgaaaatgcaaagccgaagcccctgccttattcacttctcgaaaagatcacaaatggtttctccggggcacatattattgggtatggtggatctgcaggcgtgcatgaggtaatcagagtatgaacattcacaactgtaaccatcataattatatttgatgttaagactgcacgatttcatttcactaatcttttcaagaataatgccacatcacataaatggctatagggtgataaagtgaaacaaggcccataacggatttcactgtttcgtagtcttagcatatcacttaaatgctgcatggtgttatgaaacagaatttcttcattcgagtttctgaacgttttcaatgtgtgagaataaaaaatggcacaattgagtttcactcagttttcaatgcatagaaaaatggtgtgtgctacgtttcatatagatgacactcatctcctttctttctctccttacaatttctatgacatgccagtatgccacagttt

SEQ ID NO: 16638 - DNA, 1219 bp, Zea mays
caactctggttcgatagtgatttcatcttcctctaccaggcggctccgtggtccgtgctgatcaactgcatcaaggatcgtcgccggcggcgcgctggcagcagttcgcacggcgagatcggattgatcgagatatgtcaggcctggacctgcgctagacctcgaagcctcgatcgcaccgcatcttctctctctgctgctggtccgctccgtcgccgccgaccccgccgccagcttccccttccacctaaaaggacgacctctggccgcccttgtcccgccccgacgcctcggtttccactgcataggcgtggtgcggcgatccgtccgggcctagggttgcgagagacactatagggtacgaccctaggagcatccgcctccacgtgggtgaggcggaagagggaggatgacatcgctcagccgtgagctggtcttcctcatcctgcagttcctcgatgaggaaaaattcaaagagacagtccacaagctcgagcaggagtccggattctatttcaacataaagtactttgaggacgaagtcctcaatgggaattgggatgaggtggagcgctaccttggtggattcaccaaggtcgacgataaccgctactccatgaagatattctttgagatccggaagcagaagtatctggaggctcttgataagcatgatcggtcaaaggctgttgaaatcttggtcaaggaccttaaggtctttgcatccttcaatgaggagttgttcaaggagatcacacagcttctaaccttggagaattttagggaaaatgagcagctctcgaagtatggtgatacaaaatctgcaagacaaataatgcttgctgagctgaagaagctgattgaagctaatcccttgttccgtgacaaactacaatttcccagcctgaagacttctaggttgcggacacttattaaccagaggtagccccatgtaaaagaattatccctgtgctctttactttcacccattacagaattttgtttctttctgtaagcttccacttatgcaagtgacgatagagccttatcaactgaaatgtttcaaaaaaaaaaaaaaaaatacagtggaaggtggaactagtatgtgattcatatacatgtatactgccgcaggttgccatttatttaatacaacagtacatgtgtacataataaaaaaaaaaagaaaaaaaaaaacacgagggggggccgggtaccc

SEQ ID NO: 16639 - DNA, 2817 bp, Zea mays
gcaaaaatttattattgaaaatacattaagggaaaaccctttatttctgttaaaaaagacatagtaattctcatttttggaaaaaagtgttggacgagagatgtgttttataagcactgtaggatgattgttggcaatggtaggaaaatcagtttcagtttctggaaaaacacttggactggtgattctcctttggctgccaggttcccttgtttatttgatctgacgcatgataaatatatttcagtcaataaagtcttgtcttcaaattttttggccctctcctttaggagaaggatcatggacagtttaaacttgatgtatgatgaactgattgactgttgcagcagtcaacaagtgactggccaggaagacaagatagtttggacccttggtaaaaatggtttttctgtaaactccctttataaaagaaaaatatgccatctggcatatgtgccttatcagtttttgtggaaaaccaaattaccttataaaattaaggtatttctttggttggttgtgagaaacaaaattctcacaaaagataatctgaaaaaaagaaactggcatggattaagtgattgctgcttctgtggtcacaatgaatcgattgagcacttattttttttgactgtcttgttgctagatatgtgtggagggtaatttaggttgctttatgtttggacttcattccaaaaaatattaaggaactttccggcatttggatgaaaggtcctaagaataagatcactaatatgttcttgtttgggtgcggtgatgttttatgggctatttggagaaccagaaatgattggtgctttggtgataaatctttgtttgatcactctaacgtcatattttttgctgcttctagctagattcctaggctattcgacagaaagagaaggaaaaaatggtggtacaaggaagcaagctcatcagaaggacgacaagtgaagttttgtgacgtgcctatggttgaagacctagaaatcgtcttattactgggtagtgggttccaaagcttttggctatatttgcttgtcttgcatctacctgtaggttgttaatgttgaacttctgtgtgtttgcgttgcctattgcatttgatgtaataagcaaagcttatggatgttatcagggcttgtgtctcgctacggtagatctcttttctatcaatttagctaggtattatagaggttttttagtgttgtgcttgtgctagtcaaagtaggcctggctgcttttagtagcgttccttgtaatgtacttgtttctatttcttaatgaaatagggagctctgctccgtggaaaataaaaactaattatcatgtaaatttgtggaccttacgcgcccagtaaatttgtggaccttacgcgcccagggaaacttgcacgaaattgtacattcatgaaactaacctgtcaagccttgactcctgtgcatggcacactgaggtctccttttgtatatacgctgtgggtacctcgaggccgcgggggagtgcactgctcaccggtcaccacaagcagcgaagaatcgcccgacccaaaaccttattgccttgctggctgcaatggtcaccagccctctccggctactccccgtgctcttgtcgctctgtataatctccatcatccacctgtgtcctggcgtcgtctccacttcgcccctctccttcgacgtgcagttcataccgtggggctacgacccacaggaagtcggcttccatcagatcatcgccccaagaaacctcagtagcagaatccatgcgagccgtccgtacacggcccaccagaagagtcaagtgctccctcgcaagaagcggaagaagttcgtgcctgacaggtgcgactgctcaaagcagatcgacggggtgatgtacatgcgcccggcgccgctccgggacgaggccaccggcgacgtcgcaagcttcaagatgaccttgtgttacagaatcaaccctcgtcaagcagatgatggtaccgaattcaaccacggtggccgcaacattggtctgttcctgttcctcgtaccttacccctggaattccaatgatgagaggatagaggttgggctcgacagcaagtgcacagaggcgaagatgaagcagtacagcagcatcggcggtgacgcagtagtgtgtgcccatgtccactacgacagcgccaaggagctgctgatcaccaacgtcctcgtggacgactattcctgcacctgcggaaggaaactcaaccggagcagcatgcccagcgaggcggccgtcggttttgcctcgaccaacgccggcgacccgattgagctgcgaaacattattacctgggcgttccattccaagctggagtccaaggatcccccgctgatgacgacgaagcctgctcaagtggaaaccccaaccggcggtgaggagagctcctggccgatagacagggggcagcagcgattccgtgtggatccttggactaggcacgctgaattgaatctacagtaccagcggaactggcaacggaattggcagctcacatgtagtctcagcatctctgtaggctatggaaacacaaatggtgacatggattagaattcaagctaccaattctacctgcaggctagggggtaataatatgaaacctaatgaaaaatcgaagtaatatgaaaaagaaaacttagatgcaggtggtttttttccgattttctgggtaatatcggcggccgaaatggctattattatattacttgtgctattgtatatttatatttggaattcaggctcctgcctccccatcctttcactaaaaaaaaaaaaaaaaaagcggcc

SEQ ID NO: 16640 - DNA, 2946 bp, Zea mays
cattgggacctcgagccggccgggaaaaataaaaaaaaaactggtaatcctggtatggattatccatccggagattctgaccacatttccaagagaactagaccggttggcatgtctgaggagatgaatcttccggtgaacatgctgcctgtgacttatccacagagccataattaccaacaagatgatttccacaaagctgttgcacggaccttgagccaaggatcagcacctatgagcatggatttccatccacttcaacaaactcttcttcttgttggtaccaatgttggcgacattggattgtgggatgttggtaccaaagagagactcgttgtaagaaacttcaaagtctgggaccttggtaaatgtacaatgaccctacaggcagcactggttaaggacccagctgtgtcagttaatcgcataatatggagtcctgatggaaccttgtttggtgttgcttattcaaggcatattgtacagatttattcctataacggtggcgatgatattagacaacacttggagattgatgcacatgttggtggtgtaaatgacatagcatttgctcatccaaataagcagctatgtataattacatgtggagatgataagacaattaaggtatgggaggccactagtggagctaagcaatttacctttgaaggacatgaagctcctgtttattctgtgtgtccacattacaaggaaaatattcagttcatcttctcaactgctttagatgggaagatcaaggcatggctatatgataatttgggatctagagttgactatgatgcaccaggtcattggtgcactacaatggcatatagtgcagatggttcaaggttattttcatgtgggactagcaaggatggtgaatcacatctagtagaatggaatgaaagtgaaggagcagtgaagagaacatatcagggattccgtaagcgatccatgggtgttgtgcaattcgataccacccggaacaggtttttggccgcgggggacgaattcatgattaagatatgggacatggacagcacgggtcttctgactaccattgatgctgatggtggcttaactgcaagtccacggatacgcttcaacaaggagggaactctattggctgtctccactgctgacaatggtatcaagatcttagcaaatgctgatggacttcggttgctgcgcacactggaaaatcgttcttttgatgcttctcgtaatgcatctgaggctgtaacaaagcctctaataaatcccttgactgctgcggcaaatgcagctgcagcaagcagttcaggagctggtgctccgtcagctataactgcaatgaatggtgatagcagaagtttggttgatgtaaaacctagaatagctgatgagtcacttgacaagtcaaaggtatggaagcttatggagataactgagtcaagtcagtgcagatcaatcaaactggcggataacatgagaacaagcaagatttcgagattgatttacacaaactctggtcttgctatcttggctttaacttcaagcgctgttcatctactctggaaatggccacgcagtgatcggaattctggaaaggcaaccgcaagtgtatctcccactctatggcaaccaccaagtggcatcttgatgactaatgacacgactgacaataatcctgaagaagctgttcactgctttgctttgtcgaagaatgattcatatgtcatgtctgcttctggaggaaaaatctctctgttcaacatgatgactttcaagacaatgacaacgtttatgcctgcaccgccggcagcaacttttcttgcatttcatccccaagataacaacataattgcaattggaatggatgactcaaccatccaaatctataatgtccgaattgatgaggtcaaaagcaagctcagaggtcactctaagagaatcacaggtcttgccttttcaaatgtgctaaatgttttagtctcgtcaggagctgatgcccagttatgtgtttggaacacggatggatgggagaagcaaaagaacagatttttgcagataccatcaggtcgccaatccaatatcttggacactcgtgttcagttccaccaagatcaaatgcactttcttgttgtgcatgaaacccagattgccatctatgaaactacaaaactagaaccagtgaagcagtggcctgttcgagagaattcacctccaatcacacatgccacattctcgtgtgatagtcaactgatctatgcaagctttatggatgccactgttggcatatttaatgggtcgagtttgagacttcaatgtcggattcttccagcttcgtatcttcctccaaatatcagtccgagcgttcatcctgttgtggttgcggcacacccttcggaagcaagccagtttgctctagggctgactgatggtggtgtttttgtgttggaacctttggaatcggagagaaaatggggaaatcctccaccagtagagaatgggtctgctagcaacttgtccacaccgcctcctaatggagcttcaagttctgaccaaccagaaagatgattaagaagttggaactggtagatttttcgtggcacgagtctaaccaagaagacagggcttcaaagggtggtgcgactaaccttggcagataggttccaagggagccggacaatgcgctcaataaaaataagttcaacagaagtttgtccgttgcttgtataaatatttgtattgactatcgagtgaggagtcctagtatttcatttttgctttgtttgcggtgctgtgaaaaggatcagtagataagctgtagtacaacaactatcagactggctgtacttacctatatttatgactattagttaatgtatgttgtttcatttgcctttttggctccgttcaaaaaaaaaaaaaatcataaagtgatgtttctgcccggtaccc

SEQ ID NO: 16641 - DNA, 586 bp, Zea mays
ccttggcaggaattcgcgagcacggtgtcctgcataaagatactctcgccgcaggaggtgcagcagatgggcaagcagggcctggagctcctgagctcggcccccgcggcgcggaggctaggtagcagctgcgacggctacgttagcaggcaggagtcgaggagcctaagcaccgggatcgcgtccgtgggttcggtcgagttctgaaacagaaggcaggagctcgttacgcgccccgagcttagtttagggctggcctgtgacggacccgctagctcggctcgcgcttccgatgttttttgcagtccatggcgtcgaggtggaagcagcaccagacccagcattagctctccttccaggttatgtactaccatctaataattctgtccagtcgtatatgacacccaactcccaagtagaagaaactaccagcagccgctgtcggtacacatgctgaaacttcgctcttgtatggagaaacactaatccttgtgaatgtagccagctaggctctgtaatgatccatgagttaatagcccttttgttgcctagcacacggcaagcacaaaaaaaaaaaaaaaaaaaa

SEQ ID NO: 16642 - DNA, 792 bp, Zea mays
accgtgccgccgccggcctctccaccgttcattctcctatggcatctactcacgcaagcagtcctattcctgattccttgctcggcttgcgtggcccatggattcgatgtcatatcatgtgttgtttgctcacccgcctggtcgcagttcgtgtcggatggcgtgttcttcgcggagctgaatgagatgctcgcggaggacggctactccggcgtcgaggtccgcgtcacccccatgtgcatcgagatcatcatccgtgccacccgcgcccagaacatactcgcgagaagggccggaggatcagagagctggcttctgtgattcagaagcgctttaacttatcagagggtggcgttgagctctacgcagagaagctgaacaaccgcgggctctgcgacattgcccaggccgagtcgctccgctacaagcttctcggtgaactcgccgtgagaagggcatgttatggtgttctcttatttgtcatcgagagtggtactaagggctgcgagatcagtttcaattggaacatgccaagctgaagcgatactcacctgcaaggagcgtcttctctgtgtactgcgtcgaagctttacctttttatgtaaattacgctgtaaatgtacagttcctctggacactgaatttctaagggctttttttatctttctgacgcaccattcactgatagctttatcgttgcatagtattttcttgaaattatatgccattctaacgaacaataatattgtagtatcattctttactaaaaaaaaaaaaaaaaaacggcacgag

SEQ ID NO: 16643 - DNA, 1877 bp, Zea mays
tacagttgcaagcagtggtaatcaatgtattatttctgcttctcactttagttttgtttgtttttatcttgctgctctgtattatcctgttattcacttgacttgccttgtagttacagtttatactttctgctagtgtgttatttagactgatgtttcctttggcaaaaattcatgagctgttaattgtttgcctactatggtccggcgggatagtgtgtatcagcttcacgcaattttgatgcgtcttttgctgaaagtgtttcctgctatatcaatctgaggaaaatgggccagtggggttaagcatatctgctttctccaacattcattttcctctcatgtactcagaaacatatttggtttttttatatgctatcgtcagctgctttgtgggttagttttttttgtaatatatcatttccatagaatttggcagtattcttctatttgtctgctgtaaatttatagatgtcaggacatgtactctacattcatgttcttctcaactggactgtcataagttttcttcacttctgcacaactagttgctaagcaggatagtgtgtatcggctttatgctaacttctatgcattttgcgctgaaagtgtttcctgctatatagattgaagaaagtgagcagttgggttagacttgtatcctgttttctccaacaatcattttcctctcatgttacataatacatatattctttaccagtttttgaattgcgggcttagtatttacatgctttaactgctttgtactgtatgaatcaaggagtatgtaaattggtctattgcatgtgccatagtttgaattccatgtgcaggacttgtctagacaggcatacacagattgtgttacttgccacctgaacattcctgctatatcagtttaagaaaaatgggcagttgagttaggccggatattttactgtggttttctcaacaatcatttttctcatattgtatctccacaaacaactccttggttaaaacttttgtttgccttgagaaaagctttaggtttaggcctatattcttgttttaatgatggattgatgtttcatgtgcttccatgattgcttggaattgtactgttaaagcatttgttggtgcaggatttttgtatcggcagcatgctgataattgtgcaatgttaccgagcggtcctgcaaaatcgatttcagggaggatggccttctccgcgcttagtgttgtcaccgaatgcattaagctgtcccctctatatgactttggtgaattctgtgtatttgattttggggaagaactttgttggttgtttgcgtttgtgttttttgtaaggattgcaaacagcctaggcgagttgctactgtgtttgtttgggactggtaattccatcactacattacctctttaggtgctccataagggctcctttgggagcaaggatacccggggttttaggcccttcaatctcctctgctatcattgctcccaaacaaaaaaataggaaaggaatgtattagtgtaatgcaatctctgtaaacagtcatgatgacttttaaataactctcactgtgcatgagctttcccctgatatgttttcataaaaaaatctgtggctggggattggactggtaactatacttcccctggagcagaaattgtcgagttcttacctgttgtctatcgtaactggagcttcatctgaaaaagcaaacgctgctggagcgcgcctctctataccatcgttgcagccgttttgtgtaaaacaatttacgttgcaaatgtacgctgcttttgtaaactcatcatttttatagaactttgggccagctggtggttaaatctgtatgtttggatacgcagattcttagattgtagattct

SEQ ID NO: 16644 - DNA, 2663 bp, Zea mays
  misc_feature (456)..(456): n is a, c, g, or t
  misc_feature (2644)..(2656): n is a, c, g, or t
  misc_feature (2661)..(2663): n is a, c, g, or t
gaaaaaatctttagagcttgttcgattattttcaatcgatatggattggagaggattgatacggattgagagatattttaatttattagaaattaaaaccctatcaatccatatggattgggtaaaaccgaacaatgtcttggtggtcttgtgatccgtccgcgcaagcccactcagccactaggcaccgcacaaaccctaaccttctatcgcggtacactatatatttgcactcgcacttcatcttgatcgatcctcctaccgtgccgccgccggcctctccaccgttcattctcctatggcatctactcacgcaagcagtcctattcctgattccttgctcggcttgcgtggcccatggattcgatgtcatatcatgtgttgtttgctcacccgcctggtcgcagttcgtgtcggatggcgtgttcttcgcggagctgaatgagatgctcgcgnaggacggctactccggcgtcgaggtccgcgtcacccccatgtgcatcgagatcatcatccgtgccacccgcgcccagaacatactcggtattggcgcttgtacaacccccattccattacagaggtgattactttggttttctagtgttttggacttttggttgctgaaactgtttttcttcttcatattccttaagcgagaagggccggaggatcagagagctggcttctgtgattcagaagcgctttaacttatcagagggtggcgttgagctctacgcagagaagctgaacaaccgcgggctctgcgacattgcccaggccgagtcgctccgctacaagcttctcggtgaactcgccgtgagaaggttatgctcttgaccgtgcatctttactgttgtagtcactctcacagcaggctcggctttttgctgtgccagaccctgtgttctaactctaaggtgacgaaattgatcaccccctccattgcattttatagttagtgggagggacttattactcttccattgctcaagtgttggagggttatgtacttctgaactaggtaaattttggagatagttattttagttgtgttttgtgcatgtcatctataaagcaaataggttaccgtgtaccaactttgtgtcggaagatgactatatcacctgtgccaactggtagtgtacctctgagaagctttggtcataggcttctgagatatttatggttggccacattacttgtctgtttgtttgtttttgtatgttttgagcttgttttattattgattattactgattactgatatgtgaatctttaattgctaaaatattcttgttagtatgcttggcacggcaccttttgtttacctctagtatttaatctttactaaattggtttgtttgattttcagggcatgttatggtgttctcttatttgtcatcgagagtggtactaagggctgcgaggtgtgagttccacaaataaaaaccattccagtttttgtttctatctcgctgcaccatgttatcctgacaatttttgctagtgtgctatttaaactgatggaacaattacagaacactttcctttgtcgaaattcatgagtgaattgttaacctagtatggtcctgcaggatagtgtgcatcagctttgccctgttttgatgcgtcttttgctgaaagtgtttcctgctatatcaatccgagttaaatgggcagttgggttaagcatatctgctttctccgacaatcattttcctcacatgtactcaggaagttatttttttgcgttctatatgctgctgtcatctgttttgttggttagctttgtcagatatatttgtttcaacggcaagttagtgtaggctagagttgaaacccaacaaaaaccatatgtcaaggttaaagcgataggctaaatctttggtatatttcatcctttcaaatctcttactgctttatgtcaacttcgaccttcctctatctctctttttattgctattgtgacttgaaagatgttagaacaggtattctacatttatgttcttctcatccggattgccatatgttttcttcagttctgcacaactagttgctctgcaggatagtgtgtatcggctttgtgctaacttatatgcattttgtgccgtaagtgtttcctgctatatagactgaaggaaagtgggcagttgggttagacttgtatcctgtcttttccaacaatcattttcctctcatgtgacataatacatttgttcttggaaactagtttttgaattgctgtcttagcatttacatgtttagctgctttattatactgtatgcatccaggggtatggaatatggtctgttgcatgtgctttttcctggtatgcaaagcatgtagtttgaattccatgggttgtgttatatgtttcgctatctaagtcagcttcatctgaaaatgataagcagatcagtttcaattggaacatgccaagctgaagcgatactcacctgcaaggagcgtcttctctgtgtactgcgtcgaagctttacctttttatgtaaattacgctgtaaatgtacagttcctctggacactgaatttctaagggcttttttttttaaaaaaaaaaaaaaactcgaggggggggcccggtacccaatccgccttataggccacccgctttttatgtccttnnnnnnnnnnnnnttttnnn

SEQ ID NO: 16645 - DNA, 2072 bp, Zea mays
gcacgagtgtgtttgaagattggggtgatgtgaagaatcagaaaatagtagaagaggcacgagaccattacctagaacatcctaatcgaaaagtttcaaatgtcagtgaaagcaggaaggataatgttttagaagctgagctccatgtagatgataatctggtccaagaagatgaatccgttgttgccaaggagggcaagaagccagcagttgccacagatgctgttcaagtagattgggtgaagacagacgaagctaaccctcaaaagtccaagttgcatgaggaaatggaagttctagacgaacttcttggaaaagaaaacatggagaacagcggtatttcgagcactgatgagaattatgctgaaaaaactggagatgatatcttgtttgaggatggcgttctgattgagaatgggttagccactgcttatgaacatgatttgctttggggttggaaggccctgcagcagctgctgatgagcctgggtttcaaaatggatacaacatgaaaaaggcataatctattgccatatatctaatgttcgtatgtcgcaattcggatgcaatggtgttgctttccaggataatttgttttgacccctgaggagactgccttgtggatgttcacggaaaaggctttgcactctagaaagctgctggcattgtggtattgtatgtatataatatgttcgttttccaggcgtgctgtatcttagcaggaatgagaacctgttattataaataatcaaccatctgttttactaaaaaaaaaaaaaaaaaaaaaaacgtcctcgccgccgtgaagatgttatggtctgcagacgctgcatgggaactgtatatacgtgtggtgagaaaaatgtctttgacaaatgtggacaatatgatagtaggttctatttctccttggaatgtagttgtctcagttgttccgtgtattagcacagctcttaggttaggttggtcttatttgactagttagagaccgagcccaaaaccatgactttgatatcactgttaaagatctttaactttagctcataaccctagccattagaaaccgtaaaacagagagtctagcttcggagttttgggaggtcaccatgtgaaggtcggagtatagtgttgatggcgacaacggctctgatagattagaagcggcgacaatcctttcacaaaacagtcaagtattattattctatagcctagtggttggaggtgctttagtagcaacttcagatcctaagtttaactctcaagatcatatataggttggataaaaaattcccaatcctgtcgctaaggtttagggatgttttggccaatgaggtgagttcttctatctcttaagaaataccttgggaggccaacacctggttaatcgagttttttatatactacatatgcgatttgagctcttacaagaaggtgcgggtttttttatatactgcgtatgcttgagatttaagctcttataatgtgattggaaggtagattttttatatatacagttggttactcatttttgactccttcaggatataaaaaataagacaacacagtcaaattaagtttcatcttcattctttgaatcaatttccttcgagggaaattgattaaaggatgaagatgtagaaaactaacagaagataaatgaaggacgttaagggtaaatcatatacaactcaagaatgaagcatataattcaaccctattagacatttctttcttctactcttattatttaacaaaggatcacaaatgtaccttcggctattattgagaattacaatacgaaggtaagaagaatacaacttcgtaggtagagtgagacagctattctcattagttattttctgcaggcatccggccccaatttccaacatgttctgttagccacagggattttccagttcctgtggtgggatttggggcctagtataagcttacgagtttcatgctaacttgttgattgaaatatggctttccaacaagatagcaaaaaaattcaacttcaattggggtcttggtttcttgctagatccaggatgtgcatagatcaagtctgc

SEQ ID NO: 16646 - DNA, 770 bp, Zea mays
actcctaagggcgattggggccctcggggcccgccgggccccccccccacccctccccttcccctgctcctcgaccacctcaacgagcttctgctccgacgacgacgacgtgccgccacatccacatggcggacgacgccgtcgccggcggagcggccgttcgctgcgcagggccggcgccggcctcgctgtcttctagcaggaagcagcagcagcagcccgacgacgccggctgcggcagcagcgacgaccactaccagcacgacgtgatcatgctgaggcggacgaggagcgggcgggcgttcccgccgccgatctccgtgatcggcaagggcgggcggccgtggctctgcctgcgggcgcaccgcgagggtggacgcctcgtgctgcggcagatgcgcctgccgtcgcaggagctgctgcagccctgcaaggaggacggcaggttcaagctcctcatgcacccggaggcccgcgcgcggccgtgcgggggcggcacactgcaggaacggcaagggaatgatagctagcgctcttaattgatcagctgatcagatgatctgccgccacgcacacgtcgtcttgtatgggctggctgctacaatgcaaccggtagatctccctgcttagtttcttgagatcgagggctccagttcttgctttgcattctgcaaccgttgtccaaatgtccacaatctttgccttccgtcaaattttaatacatggtcggaacattgaggcaaaaaaaaaaaaaaaaaaaaaaaaaaaaa

SEQ ID NO: 16647 - DNA, 761 bp, Zea mays
ctgcgccactacttatccttctccgcgccccgcctctgccgtctgcccccacccctccccttcccctgttcctcgaccacctcaacgagcttctgctccgacgacgacgacgcgccgccacagccacatggcggacgacgccgtcgccgccggagcggccgtttgctgcgcagggccggcctcgctgtcttctagcaggaagcagcagcagcagcccgacgacgccggctgcggcagcagcagcagcgacgaccactaccagcacgacgtgatcatgctgaggcggacgaggagcgggcgggcattcccgccgccgatctccgtgatcggcaagggcgggcggccgtggctctgcctgcgggcgcaccgcgagggtggacgcctcgtgctgcggcagatgcgcctgccgtcgcaggagctgctgcagccctgcaaggaggacggcaggttcaagctcctcatgcacccggaggcccgcgcgcggccgtgcgggggcggcacactgcaggaacggcaagggaatgatagctagcgctcttaattgatcagctgatcagatgatctgccgccacgcacacgtcgtcttgtatgggctggctgctacaatgcaaccggtagatctccctgcttagtttcttgagatcgagggctccagttcttgctttgcatcctgcaaccgttgtccacaatctttgccttccgtcaaattttaatacatggtcggaacattgaggcaaaaaaaaaaaaaaaaggggccgccc

SEQ ID NO: 16648 - DNA, 2059 bp, Zea mays
agcgtggcaagcattacccttctattcttggtgttagggagcatgtcttcacgggaagtgtttcctccctggcctcatttatgtctaatcaggagacaagttttgtgacattaggacagcgtgttcttgctaacccgctgaaagtgagaatgcactatggtcatccagatgtttttgatagaatttttcatataacaaggggtggaattagtaaggcctctcgcagcatcaatatcagtgaggatatatatgcaggattcaactcaactctgcgtcaaggatgcataactcatcatgaatatattcaggttggcaaaggtagggatgttggacttaatcagattgcactatttgaaggaaaagttgctggtggaaatggtgaacaagttcttagccgagacatatatagactcggacaactttttgactttttcaggatgttatctttctacgtgacaactgttggattctacttctgtactatgctaaccgtgctgaccgtgtacatatttctctatgggaaaatgtatctggccttatctggtgttggagaatcaattcaaaatagagcggatatactgcagaacgcagccttgaatgctgctctgaacactcaatttcttttccagattggtgtatttactgctgttcccatgattcttggtttcatccttgaatcaggtgttttaacggcttttgttcagtttattacaatgcagttccaaatgtgctctgtatttttcactttctcacttggaacaagaacccactactttggccgtgcaatattacatggaggtgcaaagtatagagcaaccggtagaggttttgtggtacgacatatcaagtttgctgagaactaccgtatttattctcgaagccattttgtgaaagggatggaggttgcacttttgttggtgatcttcctagcgtatgggtttaacaatggtggagcagttggctatattttactctctataagcagttggattatggcattgtcttggctttttgctccctatttatttaacccatctggatttgaatggcagaagattgttgaggatttcagagactggacaaattggctgttttatcgaggtggtattggtgttaaaggagaagaaagctgggaagcttggtgggaagaagaactgcaacatatttacagcattcgagggaggatactggaaaccatattaagcctgaggtttttcattttccaattcggagttgtttaccacatgaatgctagcggaggaagtacagctttattggtgtattggatttcttgggctgtgcttggtggccttttcatcctcctcttggtctttggtttaaaccccaaggccatggtacatttccaattgttcctgcgtttggtcaaaagtgtagcgttattgatggttttggctgctctggtcctggcaattttgtttacgaaactcagtgtgagagatgtttttgcttccattctagcatttgtgccaactgggtggggaatcatttcgattgccatggcatggaaacctgtcgtgaagaaattgggtttgtggaaaactgttcgtgccctagctcgcctctatgatgctggaatggggatggtcattttcatacccatagccatttgctcgtggtttccattcatatccactttccagacgcgacttctgttcaaccaggcgttcagcagaggtttggagatatctctgatccttgctggcaacaatccaaatgctgggatctgatggtggcagttccggccttgcttcattaatctgtggacctttcgtacttgaattaatcctcacttctcagttaacagtagcgatgtacatatctgatatctctatgttcaccggagttgtttgccgtgggtataaatatcaacggctatatttctagagttcaccggcttgtacctgtatttttgaacgggtgaactttgtatggcccttcttttgacattgacatatgtgctgattacgtggaaaaattgcttttttaggtcgcttcgaaaaaaaaagaaaaaaaagaaaaaaaaaaaaaaaggggcggc

SEQ ID NO: 16649 - DNA, 2512 bp, Zea mays
gttgagtatgtggtgaacttgaaatttggtgaagaaccaaattatgcgaagtgcatctctctttttgatggcattgttggcccaaatccagacataagaccgataaacactgatggtgcccaaaagctaatatatcaggttggccagaagagaggccggttaatagtggatgaaaatgatgatgagcaacctaagaaaaagatcagaatggggatgccggcaactcagtggattagtgtctacaatgcccgtcgacccatgaaacagaggtaccactacaatgtagccgataatagattgctgcagcatattcaaaaggggaacgaagatggcttgtttattagttcagttgcctccagctcaaacctgtgggctttaattatggatgctggcactggctttacatctcaagtatacgaactttctaattactttcttcacaaggaatggataatggaacagtgggagagaaatttctatatcactgcactggctggggcgaataatggaagctctttggtgattatgtcaagaggaacacaatatgcccagcagtcctacaaagtaagtgatacatttcctttcaaatggataaacaaaaaatggaaggagggcttctatgtcactgctatggcaacagctggaagccgatgggcagttgtcatgtcccgcaatgctggtttcacttctcaggtagtggagcttgatttcttatatccaagtgagggcatccacatgcgttgggacaatggctatcgcattacggcaacggctgccacatgggaccaggcggcctttatcttgagcattccaaggagaaagcctactgatgaaacacaggagaccctgagaacatctgcgtttcctagccagcatgtgaaggacaaatggtccaagaacctgtacctagcttccatctgctatggaagatcggtgtcctgaaacccattttctcgatttggtttggttgccgagaggtatattgatatcaaagacaggtggttttatgatatcagatggagtgttttgaagctcaaaactctgctaacctactgcaactaacaaaaggtaacctatatatgagaaaaaaagaaagaaaagtctactgtgtttcgctaatcgcttccattgggcaaagaacattgtggtctgtttttgtgttgtcgggctgtgtataaattatccaaagtattaggttatgttgtaaatgtagaagtgtacctgctgaaccgttgccatgtatataaagctgtttttttacaaggttgtttcattgtttgcccccgtctcaaaaaaaaaaaacgttttgagagcgtaaggtgttcccacgcaatcgctatcgcacatccgatcgtgttactgagatgagatgtggtataggctgtttaattattatgtggtggatcgttgctcgttcatgtctactggtttgaatcttttgttcggtatcagatttcattggaatgtcatcgggactggaggagacatgctgacacaaatgaacgacgacagggtcggcagaatcgatatcagctggtgtttcgaaattacaaagatggaatttttagttttttcttcatcagttctaagttacagatcattagctatgtcgtaattcattttgatacatcattcagaaggatacaaaattgcttctatgtatatcgttgtgcagttgtgctccaacaagcggccattcccccatattgctgacagctgcacgagttgcggtgaatcaatatcgaatcgcagagtaagaactatttgaagattaataccttagcggggacggacaagctcccccaagcttaacatttcaaggcgttgcctttctttttcagatttgaacaaatataaactcgatacgtatgcttagtcaaacacgacaaaaaaaatcattcaaaccagttagactatctcaagcagcctctctatcctacttcttatttcaaatttcagtttataaatagtcgacactgcaaaattcatatgccggctctgctaagcacaaccttagagcacacaaaatgtcacgctcaatataacaaaagtatttgagcaagatacaattttaaatcatctttctgtagtagcaattggaagcaaatgtctatttacatcataagtatttggttctaaaataaaaaagcatcgttcatattcgctagccgtggtacatgtataataaaaacactgttacacaacttttcttgtcacaaagatcagtaggataattagcatgtgacagataaatcaaaacaaggctctaatataacatcatatttggacaattccgatatattatgtgagctcttaccaaagattcttactatcacattgtcctctttattgtgtatatgctgcaaactattatttctaacttgaggcaaagcaccataacctatttgtaaaaacttagatttcaatgaaggtattgtatcatgaaacaacccatttttcgcctaaaacactgattcttccttctctttgtccttaagagttctcctttgaa

SEQ ID NO: 16650 - DNA, 1900 bp, Zea mays
  misc_feature (1895)..(1896): n is a, c, g, or t
  misc_feature (1898)..(1899): n is a, c, g, or t
atgaagaaaaattatttttgttttaataccttaaaaattagacaatataccactttattatgtatttatgaaaactataaaatatttgtcattttatctttttgagagtatcgttttggaatagccgacaaacccggtctcatagttcgaccgctgattttcgttttgttctgttcataaaatacgaaaacaaaaataatgtagatgttttctcatcattttcgacagtgcatcgactttaacctctggactggacacgtatctcaagtttcacctcacaggacagagggacagacacacgccccgaagggccagaacaaacgttccatagcccccagcattgtcacatgactcgcattcgcatggacccacccagccacgccccatgcccacgcgcgccccacgtgtgagactgagacgccagatccatccaacggttcgtgtcacaccacgccaaggccgcacgcaccgcggacgggtccacacgccagagactgaagctggcaggcataaactgtggggactggggagctcgttctctccgccggcccgctcactctccctggtctctcgtctcctccactccaagagaacaggcgccggcgaaaggcgggagcagcgcgctgcccattcaccgccccctgatttcttgggagttgcggatcggtctccggggcagcgtggaacggctgggcccctcggatcgccggagatgctgccctacgcgacggcggcggaggcggaggcggcgcttggccggcccatgacgcccgccgaggcgctgtggttccggtacaccgcgggggtgtccgactaccacctctactgctgcaacatcctcttcctcttcgtcgtcttcacggtggccccgcttcccatcgcgctcctcgagctccgggccccggccgcggtctcgccgtacaaactgcagccgcgggtgcggctctccagggccgagttcgtccggtgctacaaggacgtcctccgcatcttcttcctcgtcatcggcccgctccagctcgtctcctacccggcggtcaagtttgtgggaattcacacgaagttgcctttgccgtcccttgcggagttggcagcacagctactggtgtacttccttgttgaggactacctcaattactggatccacaggtttctccacggggagtgggggtaccagaatatccaccgtgttcaccatgagttcactgcgccaataggattcgcagctccatatgcacactgggctgaggtgctgatactcggcatcccctccttcgtcgggccagccattgttccaggccacatgatcacattctggctctggattatactccgtcaggtggaggctatcgagacacatagcggctttgatttcccattcaccccgacaaagtatattccattctatggaggagcagaataccatgactatcatcattatgtaggaggccagagccaaagcaattttgcttctgttttcacttactgtgattacttatatggcactgacaaaggttacagattccacaaaacatacctagcaaagctgaaggatctggggcataatgatggccagaaaggagacggcagcggacccagctatgtgaaactggattagattgcaagatatagtgcatcttgagtgtttctatggtcatcgacttcactgtggcatttcgaaatgggatattgctgagttgggctggtcacgtgtgttctcatttctgtagcaggcatacagctttcagctctgccttcttctttcttttttttttctagcgtttatgaaattctatggaacttgtacgctgacgaataacaacgcaactctcacgaataacaacgccaattcttaaaaaaaaaaaaaaaaacacaaaacaaaaggagcggggagnngnng

SEQ ID NO: 16651 - DNA, 1556 bp, Zea mays
attggtacctcgagccggccatgacgcccgccgaggtgctgtggttccgggacaccgcgggggtgtccgactaccacctctactgatgaacatcctcttcctcttcatcatcttcacggcgaccccgcttcccatcgagctcctcgagctccgagcccaggacgcgggctcgccgcacaaactgcaaccgcgaaagcggatctccatggaccgagttacgacaggtgctacaaagacgtccatccgtatcttcttccatcaacatcgacccgctccagctcgtctctcgtacccggcggtaaagtttgaggaaatctcacacaaagttggctttgcacgtcccttgcggagttggaagtacagatactggagtacttccttgctgaggactacctcaattactggatccacaggtttctccacgtggagtggggataccagaatatccaacgagtgcaccatgaggtcactgcaccaataggattcgcagctccatatgcacactgggctgaggtgctgatactcggtagtcccctccttcgacaggccagccattgctccagggcacatgatcacattctggctctggattatactccgtcaggtggaggctatcgagacacatagcggctttgatttcccattcaccccgacaaagtatattccattctatggaggagcagaataccatgactatcatcattatgtaggaggccagagccaaagcaattttgcttctgttttcacttactgtgattacttatatggcactgacaaaggttacagattccacaaaacatacctagcaaagctgaaggatctggggcataatgatggccagaaaggagacggcagcggacccagctatgtgaaactggattagattgcaagatatagtgcatcttgagtgtttctatggtcatcgacttcactgtggcatttcgaaatgggatattgctgagttgggctggtcacgtgtgttctcatttctgtagcaggcatacagctttcagctctgccttcttttttcttttttttctagcgtttatgaaattctatggaacttgtacgctgacgaataacaacgcaactctcacgaataacaacgccaattcttaaagttcatcgagttcgctccgtgcttttattaatttggaccagttgctgtatagttttctagcgtaccatattgttttgggtaccatattgttttatgtttaaaactaggtactcaacctagttttcaacaaacttctactgccccacgacaggtcaaaaggttcaaattaaagaaactttcattcaacttttcagaaaatcgaaatatataactacacgggtgcactgaatatgttttgcaataggcaatagcaagcaaaaggaaaatataagcaatttaccgtagcatcggtattcacgtatacacactctcccttctaatactctatctgtcccaaaatatgagtaatttgactttgtaacattttcatcgcacggtttcaccagtctactactccgcagctgtgcttcgccagtctactactccgcagggggat

SEQ ID NO: 16652 - DNA, 1618 bp, Zea mays
ccggccgggcgccgcgcagcgctgtgatggcacaccacccgacgacaatgacgacaaagtcgatggattccccaaatgtgagaagtggatacgcaatgacattgttgacaccaaggagtccaagacgacttcatggttgaagagattcatcgggcgtgcgaagaagcctgcaatgacatggccattcccctttgtagaggagaggctatttgttctgactatacaagctggagttgaaggtttccacatttacgttggtggtcgacatgtgacatcttttccttatcggccggggttcactcttgaagatgcaacagggttatttgtcaagggtgatgtagatatacattcagtttatgccactgcacttccttcgtcgcatcctagtttttctcttcaacaagtccttgagatgtcagaaaagtggaggtctcggccactaccaaaaggccccgtttcccttttcattggaatactgtctgcatcaaatcatttcgctgagcgcatggctgtgaggaaaacatggatgcaggctccagaaattaagtcttttgaagccgtggctcgattctttgttgcactgaattcaaggaaagaggtcaatgtaatgttgaagaaagaagcagaatacttcggagacattgtcattttgccatttatagaccgctatgagctggttgttcttaagacaattgctatctgtgagtatggggtccagaacttgactgctgcaaacatcatgaaatgtgacgatgatacatttgtgagagtagatgtagttctgagacgcatcaagttgaacaatggtgacaaaccattatatatggggaaccttaacctcctgcacagaccattgaggactggaaaatgggcagttacagacgaggagtggcctgaggatatctacccgccatatgcaaacggaccaggctatgtgatttctggtgacatagcaaaattcatcgtgtcacagcatgccaatcagagtttaagactgtttaagatggaagatgtaagcatgggcctatgggtcgagaagttcaattcaacaaatcctgtccaatattcccacagctggaagttctgccagtacggttgcctggagaactactacacggcccactatcagtcacccaggcagatgctgtgcttgtgggataagttggttcgtggtcaggcatcctgctgtaactacagatagcagagtgaagctaaggattgctggacgctgtcctctcttcatcataccccagccaggtttaggtcggttggctggtattttctttttcgacacaatcgtagtgtagtaggtgttgttgctcctccgtcgctggctcaaatatgagctaaatgcatgggtgtgcggtaggagattgaagatttaggaagccccaaccagttggttattgttttttacacgatctgtattggtccaattgtggcgttggcgtccttgttcttgtaattgatccaattttgatgtagtaggccagattagagggaatattccagatcagatgtacgtctccgttcttttcttatagtaataactagacacaatttgccctaaaaaaaaaaaaaaaaaaaaagcggccaaaaaaaaaaaaaaaaagcggcc

SEQ ID NO: 16653 - DNA, 596 bp, Zea mays
tgcccacacggtgagtataggtcataggaagttgtcttgcatgattctggggacgataaactgcctgtttctgatgatggcgcgggcacacttggtcgtcgagttgcatctgttgaagtgagtggggagctgaacgtttctgtcaaggcatggcaaggtggtgaagtctttacgcacagagagaggggtttcaaacctaaagaggcaggttggagttatggcactcttgacgttggcttctgccaaatggatgtatctgtggcctggtcgcttctttcgtcgtacggtgtgtagtgtgcgggcgtgaaaaggaagctttgtaagactgtctgcagcggttccctctaaatttcttcccctatatcactttgtaagactgtctgcagcggttccctctaaatttctgccaaatggatgcagtggttgttgcttcgattctctagcatgtaatgataagttcacattgggatatgcttgctgttttgctgtaatgataagttcacattgggatatgcttggtggtcgtttttttatttatttttcttgatcctctagcatgtaatagagtatcctccaagtagagtttttttttcctt

SEQ ID NO: 16654 - DNA, 1516 bp, Zea mays
cgaccgactctcggcaacggatatctcggctctcgcatcgatgaagaacgtagcaaaatgcgatacctggtgtgaattgcagaatcccgcgaaccatcgagttggcgttcgcaggccgcgcccgctccctcctataaggccgagaacaggcagagcaccgggatctagggtttcgcacccaacacccggagtgagcggcggcgagggatcggatcgtcggcggcgatggaggacgaggtgcagagggcagcggtgagcagttggaacgagcttgactatgaggcggaagcgcgtttggtggcggaggcgagggcgtcgtgggataggaaggcaaggggggaggaggaggatgaagaagaacatgatcctgagatgaccttggactactacgcctaccaggctaaaaagtttcgcaacacctggaacatcctctatttcggccacttcggtcgcttcgaggacaccacaaggatccctcctatgcgctttacagagaagccgcctgactccccggcgtacccgcgcactacactgcaggtcttttcgatcaaagttgcagggatagaggggggtttacagtggccactccatgtgtttgggaaggttgccctacgcgacgcagttgatcacaatcgcaatatggtcttcgatcgcactagagacaactgccaaatccttacaaaagaggttccaaatttgaaactgacaggtcctagccgtgctgttctgctggtggatcctgtgactattgaggctgacctgaaagttaaaggccgtactgaatctgaggataaacacttgagctttctagcagtgccattcttgatcacgatcccgctcgagtcatgcctgcgtacaagagatttcaccagcaagcttagcacgctgaggtttggtctcgcaattgttgttctctcagtggaggctacaattagtgtgcgagttcgtggtgggtcatggcctgatggtctccgtgcccagtttgctgcccacacggtgagtataggtcgtgaggaagttgtcttgcttgattctggggacgataaactgcctgtttctgatgatggcactatcacacttggtcgtcgagttgcatctgttgaagtgagtggggagctgaacgtttctgtcaaggcatggcaaggtggtgaagtctttacgcacagagagaggggtttcaaacctaaagaggcaggttggagttatggcactcttgacgttggcttctgccaaatggatgtatctgtggcctggtcgcttctttcgtcgtacggtgaaaatgaagctttgtaagagtcggtgttagccgtggtcgttgcttcgattctctagcatgtaatgataagttcacattgggatatgcttgctgttttgctgtaatgataagttcacattgggatatgcttgctgttttgctttttatttatttttctccaaaaaaaaaaaaaaaactagcatgtaatagagtttttttttccttgatctccctgcataaagcccaagttgctcattgctt

SEQ ID NO: 16655 - DNA, 1237 bp, Zea mays
cattgggtacctcgaggccggccgggagacctatccactccctcatgcagcatcgcggctaacttcccagccactgcttgcaccatcccgattcccccccacccgccgcgcaacaaggcgcaacccagaccccggcccctccagctcggaaaacccccccgacgagccaccgccacgcgacgccccctcactcactcactccgccgccctgcccgccgcgcgaggccggtcctggaacacggcgcgccgcgctcgtacccatgccgtaacgcccgaacccgccaacctcgccgcagccgcctcgccgcgcacacatgcacttcccctcgccgcgcgcgctcgccatggccgcgccggcggtcgcccgccctcgcctcgcccccgtggctcaccccgcctcgacctcttgcctgctggccctctgggaccggaggcgcgggcacggccgcgcggttgcggcggtgagggcgcgcgagcaaggcgcggcgccgcccgacccggcggccttcctgcgccggccggaggtagcgacggtgacgtcgacggaggaggagagggaggccgatgcggggtcctcgtttgatggccccggggaggacgaggcgcccgaggaggaaggggtccgggggaggaggaaggcgccggagagggagtgggtggattgggaggaccttatcctcgaggacaccgtgccgctcgttggcttcgtacggatgatcctccactccggcaagtatgaaagtggcgatcggctgtgtcctgaacatgagaaggcgattctggaacgtttgcttccataccatccacaatataatgagaaaattgggtgtggtattgactacatcacggtagggttacatccagaattcgaaaactcaaggtgtttattcatagttaggaaggatggcgagcagatcgatttttcgttctggaagtgcgtcaaaggtctcattcggcaaaagtaccccatgtacgcggacagtttcattctcaggcatttccgcaggagacaagactactgaagtagttgctcgtacggctgtttcagtgttatatttttctgtgtaattgattttgtcctgtccctttcatatcatgcgattctagcatttgttacgtggagtttttcattaagcatattattccatgcaacataaatagatataggtttgtcgcttgcagatgaaattgtagcgcaccatttagttaccacatttctaattgtgagtcgttcttt

SEQ ID NO: 16656 - DNA, 1263 bp, Zea mays
ccgtccgggaacgccgcaccgaacaaataaaaatatataattaatttagtgcacacggagtggggaaacgaaaaggaaagctctctcattgccaaattgcccccgactcaagccccccgcgccgccggcgttggtggaatcgatcgacccggcctcgccggacaatccaccagcgttggtttcacctcaggtttttgtgcatggaagatgacaatgaggtcactggagagtcacctgtggctgatgaatgggatatgttgtccctgacttcatcaatatatgctagcccattattccgaagaggatttgatccaattaatttgcctggatatgggaatgtgattaatattcaggaaggcacacaaactggattagtcatgtcagatggcttcgtgttccctccaagtgagcatgaaaatttgccaatagaaccagagcatgaggatttgccaatagaaccagggcatgatgaatcaaatacaaacagcgttgaaaaggaaagtagttgtgctggaaataacgatgatgactggtgtcatgtttcacctgaagaaatcgatgacgtaagtaatgaaaatctagctgacaacagtgacttgcctactgccagtgaagctacggtaccagattcccagcctacagaaataaatgctaagcgagagaaagatcataggacatgcaaggctgatcatacttgtgaaagatggtggaaaaagaaaaccacgtatctatttcatcatataaaaggagtgactacactctgctcagttgtggcagctggtgctgttgttggttttgttgtaatgggtcagaggtggcagcaggaccattggcaccttcatcaatttaagttcagtgtcagcggtgagagcatgaatcgagtcattggagcattcagtcgtttgaaggatgggcttcctgggagtgagcaactaagatctatgctgccgactcgcgtactcccacaacagccgctgagcgcttgagtacatgcaccaaattttggtgggctgcttctagtgtcaatttttgttgcttatatgatcttgagaaagttcattctttttcttgtgctacttgattttatgttactgtaaattagtggtcgagacttctcacggtgctgttctttaaaacatagcaaccgtgaagggacatggtggaaacacagagggcactataacaatatgtatccatatcacctgttttactttctatctcaagtcgacctcgagggccttaaaaaaaaaaaaaaaaaaaaaa

SEQ ID NO: 16657 - DNA, 1628 bp, Zea mays
gcacgagaaacaatctacggttgccaggtctgcgacgtcagtgccgacgaactcatggctcgcgagaggcccgtaaaaacatgatagccagatctgcgacgtcacggctgtcgccagtgatcgccattcgccaccctctccgttccattccaatccgttcagcggtcagcggaacatgatacggtctgcgcccttccaagcaatcacatcttcttccccgttataaatcgctcactcgctatcgtcggctacctgtatcctggcgacacccaacagcctgcttgccgcgcttgcattgaggggagttcggggagcggccggtgcggaaggaatcgacacagagttcagttcacatggctgctgaatcagagaacggcaactgcaaagcttgggcagcgagagatccttctggagttctctcaccacacagttttaaccgcagagcagtgcaaagcggcgatgtttcgctgaagatcatatactgtggagtctgttatgcagacgttgcttggacgcggaataagctcaatgattcaaaatatcctttggttcctgggcatgagatagctggagttgtaactcaggttggtgcagatgtcaaaggctttaaagtgggtgaccatgtaggtgttggaacatatgtgaactcttgccgtgattgtgagaactgcaatatctctctagacaaccattgcccaaaagcagtttatactttcaatggcattgatacagatggaactgtcacaaaggggggttactccactcacattgtagtccatgaaaggtattgcttcaaaatacccgatggctaccctttggcgaaggcagcacctcttctgtgtgctggaataaccgtgtatactccaatgatgcgacacaacatgaaccaacctggaaagtcacttggggtcattggtcttggtggtctgggtcacatggctgtgaaatttggtaaagcatttggtcttaaggtcacagttttcagtacaagtgaatcaaagagagatgaagccatcaacctccttggagcagataattttgttatatcatcagacacacagcaaatggagtccctgaagaactccctgcacttcataattgacactgcttccggtgaccatccatttgatccgtatttctctctccttaaggttggtggtgtgatgacattggtaggttttccaagtgagatcaaaatgcatcctgcaagccttatacttggtgcgcggaccttgtctggcagtgttgttggaggtataaaagacatccaagaaatggttaacttctgtgcagccaacaatatctatccggagattgagatcattaagatagattatatcaacgaggctctcgcgaggcttgttaatcgagatgtgaaataccgctttgtaatcgacatcgagaactccttcaagtagcgtgctagtgcacatgctctcgtctttctgttagtgttcaacagttcaagagctattacaaatgtgagtcatgccaaataaacttgatgtaaacaaccataattgaacagcaaggggaaacaggtatattgtgataatgaagtcgctctatgaatattcaactgcaaaaaaaaaagacaaaaaaaaacaactagtctgtcggcggggtct

SEQ ID NO: 16658 - DNA, 1533 bp, Zea mays
gtcagtgccgacgaactcatggctcgcgagaggccccgtaaacatgatagcccgttcggcgcctcgacgccggccgccagtgatcgccattcgccaccctctccgttccattccaatccgttcagcggtcagcggaacatgatacggtctacgcccttccaagcaatcacatcttcttccccattataaatcgctcactcgctgtcgtcggctacctgtatcccggcgacacccaacactaccctgcttgccgcgcttgcattgaggggggagcggccggtgcggaaggaatcgacacagagttcagttcacatggccgctgaatcagagaacggcaactgcaaagcctgggcagcgagagatccttctggagttctctcaccacacagttttaaccgcagagcagtgcaaagcggcgatgtttcgttgaagatcatatactgtggagtctgttatgcagacgttgcttggacacggaataagctcaatgattcaaaatatcctttggttcctgggcatgagatagctggagttgtaactcaggttggtgcagatgtcaaaggctttaaagtgggtgaccatgtaggtgttggaacatatgtgaactcttgccgtgattgtgagaactgcaatatctctctagacaaccattgcccaaaagcagtttatactttcaatggcattgatacagatggaactgtcacaaaggggggttactccactcacattgtagtccatgaaaggtattgcttcaaaatacccgatggctaccctttggcgaaggcagcacctcttctgtgtgctggaataaccgtgtatactccaatgatgcgacacaacatgaaccaacctggaaagtcacttggggtcattgggtcttggtggtctgggtcacatggctgtgaaatttggtaaagcatttggtcttaaggtcacagttttcagtacaagtgaatcaaagagagatgaagccatcaacctccttggagcagataattttgttatatcatcagacacacagcaaatggagtccctgaagaactccctgcacttcataattgacactgcttccggtgaccatccatttgatccgtatttctctctccttaaggttggtggtgtgatgacattggtaggttttccaagtgagatcaaaatgcatcctgcaagccttatacttggtgcgcggaccttgtctggcagtgttgttggaggtataaaagacatccaagaaatggttaacttctgtgcagccaacaatatctatccggagattgagatcattaagatagattatatcaacgaggctctcgcgaggcttgttaatcgagatgtgaaataccgctttgtaatcgacatcgagaactccttcaagtagcgtgctagcgcacatgctctcgtctttctgttagtgttctagagctattacaaatgtgagtcataccaaataaacttgatgtaaacagccataattgaacagcaagggggaaacaggtatattgtgacaatgaagttgctctatgaatagccgcc

SEQ ID NO: 16659 - DNA, 1568 bp, Zea mays
acatagagactcggtgatgcacagatcttgtagcaaggggttgaagaagccccccccctccacctgcagtgaccattcgcccaagcacatccatgactagaatgaagagcatcggtgagagggggtcaccctgtcgtagtccttgacgatgaacaatatgtttgcccggaaacccatttaccatcacttgagtggaagaggttgcaagcagcccacatagaatatccctccaaatctgtccaaatcccatcctttgtaatacctctatgagaaaaggccaggagacagaatcaaaggcttttgtgatgtccaatttcagaagcaaatgggcctgtcttcgtcgatggaggaaccttgcagtttgctgaactaacatgtagttatcctgaataaaacgaccttttataaaagcactttgaatgggtgaaatcatctcatttaaccttccagctaggcgattagctagcagcttggtgatcaattttgcgaagctatgtaccaggctaattggtctgaagtcttttacttgatcagccccctccttctttgggatcaatgtgatgtatgctgtgttcagcctattgaactgcgcaaatctcctgctccaaactgctgaaactgctgccattatatccactttaattatagaccagcaggccttataaaatcctcctgtgaaaccatcaggacccggagccttatctgaaggcagcaatttaactgtttcccacacttctttctccaagaaaggcaagtctagagcagccaaatcaaaggtcggaactcccacagcttcaagattgacagagcaatctctgtcaatgctgacacccagcagattggaaaaagaattgatccattagaatggccttctcattatgtccagtgaaaacctggttgtcagcaaccaatcttgccacaaaattttttcttttccggtgacgggcatgcatatgaaacaatttcgtattagcatcaccttctttgagccaagaaactctagatcttagacgggcgatggtgcgctttaatgaggcaagtccaagggagtgcttcttcaatttatttttgagccaaatttcacttagcgataaggaccgagcatcttgtgcaatctccaacctatgcagcacctcacgagcaagggcaagttgggagttcacgtgtcccactctactatcgctccagctttgcaatctttttgctgtcgccttaagtttcatgtctagagcttggaaaggacactccaaggcagggactgagttccatgcatcctgaacagcctcctggaatccatctagctttggccagaaagattcaaaatggaatcttcgctttcctgacctgttatcccgaagaccaagcagtaaagggcagtggtcagacacttcagaagctgaactctgcaggaaaacattagggaacaagtcctcccaatcagtagaacacatgactctatctagcttcaccaaggtaggtatgttttgttggttggaccatgtgtatttgcgtccatgaagggggatctccttaagagataaatcatcaatggtccttctaaagcaacc

SEQ ID NO: 16660 - DNA, 993 bp, Zea mays
  misc_feature (1)..(1): n is a, c, g, or t
nttggcctgggccaagtctggtgttattttattaaggaatcacagccccatcttagcttttgcccggggtgagaagcaaagagcttgcggccctcaaattttccacctctttctggatatcaacctattggagagccgtgatatccacatacattttcctgctggtgctgtgccaaaggatggcccttctgcaggtgtgacattggtaacggcactagtgtcgctttttagtaacagaaaagtgagagcagatactgctatgactggcgagatgactctaaggggccttgtattgccagttggtggtgttaaagacaaggtacttgcggcacatcgttatggaatcaagagagtaattttacctgaaaggaacttgaaggacttatcagaggttccattaccaattctctccgacatggagattctgcttgtgaagcgcatcgaggaagtactcgaccatgctttcgaaggcggatgcccacttagatcacgctccaagttgtagcacccaactcgcgtttggtatggatgtttgcttgagaggatcatcgtcacagtaccacgaatggtcaacagtgtgagattccctgctggtcttgccacgcccttttcggtttggcttcgcgtctggaatgtgtatacaggattactggtcagaattctgagaataacgagaagattctctgctgggatagtgggattccctgcatatttatgtgaaaccagctgtcggtctttatgcacagatgcaacagcaacacaaatctggtaggaacactggtgggtttctgtcgataatttgagtgtatatgtaatattatgtaatctattccagggaaacatagttaaaccgaggttgtgaaagccaaagagattgagaaaatatcatacgtactttagggttgggtgacttcgccgaaacgcccggggttgccgccggtgcctattcacacttcttcaataaacaaccgaaaatgcaaacatttgctcgtt

SEQ ID NO: 16661 - DNA, 705 bp, Zea mays
attgtgttgggctctaaggggcattgtattgccagttggtggtgttaaggacaaggtacttgcggcacatcgttatggaatcaagagagtaattttacctgaaaggaacctgaaggacttatcagaggttccatcaccgattctctctggcatggagattctgcttgtgaaacacatcgaggacgtactcgaccatgctttcgaaggcggatgtccacttaaatcacgctccaagttatagcatccaactcgcctttgctatggatatttgcttcggaggatcatcgtcaacagtaccacgaatggtcaacagtcagaataagagcctagctctcttgccagcacaggtcttgacacgcccattttggttaggcttcgcatctgaatgtgtatactggtcagaattcggagagcagtcagaagatctgctcgttcacctgctgggactcattgcatagtttctcgacaccagctgttgatgtttatgcacagatgcaacagaaatcagggaggaattacgctggttggtttctctgtcgtgggtgtacatatgtatgtatgcatgtaatctaatccagggaaatatagctacaacaaggttgtcaaaactaaagacatcgaggaacatcacacgtccgttgggcttgggtgactttattataaagggatgttcggattccccaaaaaaaaaaaaaaaggccccta

SEQ ID NO: 16662 - DNA, 3842 bp, Zea mays
gaattcggcacgaggttttttaactctctaaattttctttttttaaaaaaaaatattgttctttggcgtacgctggtgcgcctctcctccccgcctcggcatcgacgcgatttgcgtgcccgacatgtcggactcgccggtggagctgccgagccggctcgccgtactgcccttccgcaacaaggtgctgctccccggtgccatcgtgcggattcgctgcaccaaccccagtagtgtgaagctggtggagcaagaactctggcagaaggaagagaaaggcctgatcggggtacttcctgtgcgggactcggaggcaacagctgttggctctttgctgtctcctggtgtgggcagtgattcaggtgaaggaggcagtaaggttggcggttctgcagtagagtcatcaaagcaggacacaaaaaatgggaaggagcccattcactggcacagcaagggagttgctgccagagctttacacctttccagaggggtggagaagccaagtggaagggttacatacattgttgttcttgaaggtctttgtaggttcagcgttcaggaactaagtgcaagaggaccataccatgtcgcccgtgtttcacgccttgacatgacaaagactgaattggagcaggcagagcaagacccagatcttatcgctctttctaggcagtttaaagctactgccatggaactaatttctgttctagaacagaagcagaagacggttggtagaacaaaggtgcttcttgatacagttcctgtttacaggctagctgatatttttgttgctagctttgagataagttttgaggagcagctttcgatgctggattcagttcacttgaaagttagactctcaaaggcaactgaacttgtagacagacacctgcagtccattcttgtagctgagaaaataacacaaaaggttgaggggcagctatcaaagtcgcaaaaagaatttctactgcgccagcagatgagggccataaaagaagaacttggtgataacgatgatgacgaagatgatgttgctgctctggaaagaaagatgcagaatgcaggaatgcctgctaatatttggaagcatgctcaaagggaaatgaggcgcctacgaaagatgcaacctcagcaacctggttatagtagctctcgagcctacttggaacttcttgctgaccttccttggcaaaaggtcagtgaagaaagggagcttgaccttagagttgcgaaagagagccttgaccaggatcattatggactaacaaaagttaagcaaaggattattgagtatttggctgttcgtaagcttaaacctgatgccaggggtccagtgctgtgttttgttggaccacctggtgttgggaagacatctttggcctcctccatagcaaaggccctgaacagaaaattcataagaatctctcttggtggtgtaaaggatgaagctgatattaggggccaccgaaggacatacattggaagcatgccagggagacttattgatggactaaagagggtatctgtgagcaatccagtgatgcttctagatgaaattgacaagactggttctgatgtacgtggtgatcctgcatcagcactactagaagttcttgaccctgagcagaacaaagcattcaacgatcactatttgaatgtgccgttcgacctgtcaaaagtcatatttgttgcaactgccaataggatgcaacctataccccctcctctgttagacaggatggaaatcattgagctgccaggctacacacccgaagagaagttaaaaatagccatgaaacatctcataccaagggtattggagcagcatggcttgagtacgacaaatcttcagattcctgaggctatggtcaaactggtcatcgagaggtacacgagagaagctggtgtgcgcaatcttgagcggaacctagctgcattggctcgtgcagctgctgttaaggtcgcagagcaagttaaaactcttagacttggcaaggaaatacaaccaattactacaacccttcttgattcaaggcttgctgatggcggtgaagttgaaatggaagttattcctatggagcatgatatatcaaacacttatgaaaatccatctcctatgattgttgatgaggctatgctagaaaaagtacttgggcctcctagatttgatgacagagaagctgcagatcgtgtagcaagcccaggagtctcagttggccttgtctggacttcggttggtggggaagttcagtttgtggaggctacagccatggtgggtaagggtgacttgcatttgactgggcagcttggtgatgttattaaggagtcagcgcagctagctttgacatgggtgagagcaagagctgctgacctcaatttgtcacctacttctgatatcaacttattggagagccgtgatatccacatacattttcctgctggtgctgtgccaaaggatggcccttctgcaggtgtgacattggtaacggcactggtgtcgctttttagtaacagaaaagtcagagcagatactgctatgactggcgagatgactctaaggggccttgtattgccagttggtggtgttaaggacaaggtacttgcggcacatcgttatggaatcaagagagtaattttacctgaaaggaacttgaaggacttatcagaggttccattaccaattctctccgacatggagattctgcttgtgaagcgcatcgaggaagtactcgaccatgctttcgaaggccgatgcccacttagatcacgctccaagttgtagcacccaagtcgcgtttggtatggatgtttgcttgagaggatcatcgtcacagtaccacgaatggtcaacagtgtgagagtaagagcctagctctcttgccagcacaggtcttggcacgcccttttcggtttggcttcgcgtctggaatgtgtatacaggattactggtcagaattctgagaataacgagaagattctctgctgggatagtgggattccctgcatatttatgtgaaaccagctgtcggtatttatgcacagatgcaacagcaacacaaatctggtaggaacactggtgggtttctgtcgataatttgagtgtatatgtaatattatgtaatctattccagggaaacatagttaaaccgaggttgtgaaagccaaagagattgagaaatatcatacgtactttagggttgggtgacttgttacaaaatgtgcatattcacatttcttcaataaacaaccgaaaatgcaaacatttgctcgttaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggccccccccccgtgcccccggacccggccccccccccccccgggggggaaaccccccttgtttgggcccggggcccccccccccccaaaaaagtgaaggggttttccccccccccccctttggggggagggaaaccccccccggaaagggaaaaaaagggggggtttttggccccgggggccccggggcggcccccccccggggggggccccggggcccacccccccaaaaatgggggggtttaacccccggtccccggcccggcgggaaccggggcccccccggcggggaagcccccttggggcccaaaaacaacccccggggggtttaaacccagggcctcggaaaaaccccccaaaaaaggggccaaaaggggagggggccccccaaggggggggggggggggttattttggggccaaagaaaggggggggaaaaaacccccccccgg

SEQ ID NO: 16663 - DNA, 3287 bp, Zea mays
tgcagatcgtgtagcaagcccaggagtatcagttggccttgtctggacttcggttggtggggaagttcagtttgtggaggctacagccatggtgggcaagggtgacttgcatttgactgggcagcttggtgatgttattaacccgcccgcccggttagctttgacatgggtatggatcttcttgtcccgtcatttatccgcatttgaaagtaaacaggattgcttggaattgtagattgattgatcaaggtacagggaatagatgtatatatagtccggagatcttgggtttatagaagtatatccaaacaagatctcctcgttattccctatccataaagtcctatacctatccataataaatacaggagagagctggctggctataggaaacacaacatcattgaaatcgtttgacaaaacttatctgtgttgacaaattcatgcttctattctatgtttatttaaactctggtggatagaggttgcaagttgccaacttgccactgtgttggtttatattttgcgggcgacccaaaacttgctaaaataaactagcatagtaacatggcattgccacctgttagcacctctgtgttgttaaccattgcttacccacttgcatccctgttgttgtaaccttggaattttaactgtattttctttgcaaaatactatttatattaaatatcacaaggttaattgattagttttgcatgttgggacatctcaaatcgaataattcattgttattttgtaactacaatacgaccttgattttttacaggtgagagcaagagctgctgacctcaatttgtcacctgcttctgatatcaacttattggagagccgtgatattcacatacattttccagctggtgctgtgccaaaggatggcccttctgcaggcgtgacattggtaacggcactggtgtcactttttagtaacagaaaagtcagagcagatactgctatgactggagagatgactctaaggggcattgtattgccagttggtggtgttaaggacaaggtacatgaccggttccttttttttatttaccttttcacttagaaaatgtggaaggtccaatcatttttgtgttggtgcccttctgtttatttgactccacaattctgtggaattcaggtacttgcggcacatcgttatggaatcaagagagtaattttacctgaaaggaacctgaaggacttatcagaggttccatcaccgattctctctggcatggaggtatgttgttgcgttgttgtttgcatgttgcttgggcagctgtttggtactcctacttcggtgtagtttgatctttgacgatattccgagccttagagctactaatactaaagctagattcatgcactttaggggcatgttcgaaaactagttatgggtgaaatccggccttttggtgcttatttaagatattttgctggcatggagattctgcttgtgaaacacatcgaggacgtactcgaccatgctttcgaaggcggatgtccacttaaatcacgctccaagttatagcatccaactcgcctttgctatggatatttgcttcggaggatcatcgtcaacagtaccacgaatggtcaacagtcagaataagagcctagctctcttgccagcacaggtcttgacacgcccatttttgttaggcttcgcatctgaatgtgtatactggtcagaattcggagagcagtcagaagatctgctcgttcacctgctgggactcattgcatagtttctcgacaccagctgttgatgtttatgcacagatgcaacagaaatcagggaggaattacgctggttggtttctctgtcgtgggtgtatatatgtatgtatgcatgtaatctaatccagggaaatatagctacaacaaggttgtcaaaactaaagacatcgagaaacatcacacgtcctttgggcttgggtgactttattataaatgtatgtacatataacccaaaatgcgcacgtgcgtggtcctgcattctgtctaactctgacggatcgatccgtcttgtcatgcgcaaatatggatgcagtattttgccgcaaagttacaaacgaactagatgaccaattagaggtacgttagcagcagttacaaatcagtatttggcacagctaaaacctacaaacggcagttgcgaatagcgttaccatcggttacaaaactgatgtgtaaggttgcaaaactgttgtgaaggctatggttgtgcaaaacattactttgtaccgtaggttgtactgtttatagagttgagtttaaaataggatcgctacaaacatgttacatgtaaaatgttacaattgcaatactgacctattatagtagatggaaccttaacaaaacattggtcatatgctacaatattgcagttccaaaacatcaagcatgctacaatattgcaaacaaatgttggtcatgctaacaatatattaattgaactacttgcattcagtttcaacttatactaccatccgagattcaacttatatatactagcatccgctttatagttttaactcttgcgtgtatgggttgtaaaattgcagcctcacaaattgcaagtatcacatagaaagttacaaaatcaaacaaagtcaaataacaatctcatatttacatgaattgcaactctaaggcctccattggaacaaaagaaaagtgaaggaattttgaaggaatgaaatcatataggaagttttcctatgttaccctttggaacaaaagatagagttcatacaaatcctatgaaattcctatggaattgtcagtgtttatgacccgaatgcacacctttaggttccccacgtgattcttttgagcaggacgacgtcgttgattgcgattcgatggtacgtgcgggagcacgtcagattgcacatgggtttatacaggttcggaccgctagaatgtgtaacacactacttcctgttgagtatgtatatcgaactttcattggtgtatacagattacaaatgagacgagggtggtggtgggtgaatctcctgccgatctagtagtgtgtggtcgctacaagagtgctaatgagctttgaggtggtgctaggatgcagcaaatgagatatggtatgagatgttttcgcaggggtaccccctcagccttatataggtgaccagagggttatccctttacaagttgtgatcactatctaattctacatgaattctctgttaacgtggcatgcattcctgcttatccggagttcggtcgcttcctccgccgagttaacgccgagg

SEQ ID NO: 16664 - DNA, 2591 bp, Zea mays
tgtttgttaatggcgagccttttatcgttttttcctgcctattttccttttattttctgttggtgttttgtgtctatcttagtctagctagttcctattcttcgtcgagttgtcttacagctttgttctattttctttcttgtgttcaaatgatgcatacttgctggtcatttgtgcaggctatggtcaaactggtcatcgagaggtacacgagagaagctggtgtgcgcaatcttgagcggaacctagctgcattggctcgtgcagctgctgttaaggtcgcagagcaagttaaaactcttagacttggcaaggaaatacaaccaattactacaacccttcttgattcaaggcttgctgatggcggtgaagttgaaatggaagttattcctatggagcatgatatatcaaacacttatgaaaatccatctcctatgattgttgatgaggctatgctagaaaaagtacttggggtatgctatcatgtttagacacaatttcatggacagctgcagagttctatcattctcttcactgtatctaaactggaacttgatgtttgtggtacagcctcctagatttgatgacagagaagctgcagatcgtgtagcaagcccaggagtctcagttggccttgtctggacttcggttggtggggaagttcagtttgtggaggctacagccatggtgggtaagggtgacttgcatttgactgggcagcttggtgatgttattaaggagtcagcgcagctagctttgacatgggtatggatcttcttgtcctgtcatttatctgcatttgaagtaaacaaaattactttgaattgttgattgattgatcaaggtacaggggtacatgtatatagtccggaggaaatcttgggttcatagaaacataaccaaacaagatctccctattcctatccataaactcctatacctgcccgtaataaatacaggagagagccggcgggctataggaattacacagcccaggctcagtccagctatatacatgcatacacaagtacatatacatgtatcatcattggaattgtttgataaacctaatttatatttgacgacttcatgcttttatgtttatttaaactctgatggatagagtttattttggggttgacccaaaatttgctaaaataaactaaaatggcattgccacctgttagcacctctgttgttaccacttgcatccctattgttgaagctttgaaattttagctgtattttctttgcaaattactatttacaattaaatatcacaagcttaattgattagttttgcatgtcgggacatcttaaatcgaataagttgttgttttgttactacaatgcgaccttgatttttacaggtgagagcaagagctgcggacctcaatttgtcacctacttctgatatcaacttattggagagccgtgatatccacatacattttcctgctggtgctgtgccaaaggatggcccttctgcaggtgtgacattggtaacggcactagtgtcgctttttagtaacagaaaagtgagagcagatactgctatgactggcgagatgactctaaggggccttgtattgccagttggtggtgttaaagacaaggttcatgatcattgccttaccccgttctcttttttttatccttctactttgaaaatgtggaaggtttaatcatttttgagccgctacccttctgctttgtgtaattccacaatcctttggaatttaggtacttgcggcacatcgttatggaatcaagagagtaattttacctgaaaggaacttgaaggacttatcagaggttccattaccaattctctccgacatggaggtatgttgttgcattgttgtttgcatgttgcttgggcagctttttggtactaaggtgttgtttgatcttcgacggtttctgagccttggagctactaaaactaaagctagattttcctgcagtttaggggcatccacaaactagattcaaacataaaacctcttgatatgtaattttggaagtagttggtgaaaccggccttttaattcagtgcttatcaaatatttttctgctgtcagattctgcttgtgaagcgcatcgaggaagtactcgaccatgctttcgaaggccgatgcccacttagatcacgctccaagttgtagcacccaagtcgcgtttggtatggatgtttgcttgagaggatcatcgtcacagtaccacgaatggtcaacagtgtgagagtaagagcctagctctcttgccagcacaggtcttggcacgcccttttcggtttggcttcgcgtctggaatgtgtatacaggattactggtcagaattctgagaataacgagaagattctctgctgggatagtgggattccctgcatatttatgtgaaaccagctgtcggtatttatgcacagatgcaacagcaacacaaatctggtaggaacactggtgggtttctgtcgataatttgagtgtatatgtaatattatgtaatctattccagggaaacatagttaaaccgaggttgtgaaagccaaagagattgagaaatatcatacgtactttagggttggggac

SEQ ID NO: 16665 - DNA, 872 bp, Zea mays
aaaagctggcgtcagtctgacagctcagctcctcccgacctccctatatctctctgctccccctcgaggcccggcccggcataacacaaacaatctctctcccctcactccctctctgcagcgcgcagctttcaaagcgttgggagagatggcagaggagacgcaaccagaggccgccgcagccgccgccgcgcccgccgcggccgaggtagtcgtgaccgaagctgcgccggcggaggcggaggtgcctgcggcggcggaagctgaagccgaggccaaggatgagaagaaaggtgacgaggcggagctcaccgccgatgacgcgggggtggggaccggctcgttcaaggaggaaagcaacctggtggaagacctgcccgacccggagaagaaggcgctcgacgagttcaagcagctgatcgctgccgccctcgccgccggtgagttcaacctgcctcccccgccgccgccgccgaaggccaaggagacgaaggtggaggaagccaaggccgaggagcccgccaaagaagagcccgcggccgaggcggaggctacggcggaggagcccaaggcccaggtggctgcggatgccccggttgaggaggtcaagacggaggtgccgccggccgaggaggccaaggctgagacactggctgaggaagccaagccttccgagcccgagccgcaggagaagaccgtcgtggtcactgaggaggagactgccaccaagacggtggaagcaatcgaggaaaccgtcgtgtccgcccccgccgccatcccggaggaagcagcggcgcccggaaggcggtggtcgaggctcaggcgaccgcgcctggaacccgtgctgattgggggcgtgcccctggtcggcg

SEQ ID NO: 16666 - DNA, 937 bp, Zea mays
tgggaccctcgaggccggccgggtataatcccatgtttgcccgatgtgctcagatttgttctgcttgttctacaacaagggaatcatatgcttgtaattaacacccaaaagagataaaagtggaggcaactgatcatttaagtgtttgtgacttgaatactcaccgaattcagcatccatatgatattgcattacttcatgcagaaacagtatcttgtcattccttacttgataattagtagagaagttctcttcgattgtatgctagtcaatgggcatatttcccttatccgaaatatgaatgacaaaatgccacttagtggacagtgcaaagggcggaagtggaaagggattcaactggcagaagttccagatgccatctgtcaaaagcaagaatggatggctattagctggagggcttcatgcagataatgtttgtgaagccttttctgctctgaaaccagatggtgttgatgttagcagcggcatatgtggtcgagatggtatccgaaaagatgcagacaggattaattccttcataagtaatgtgaaatccctaaatttcctatcgtaaggtcatttgcttgtcgagagcttagtttttttttcatttgctcacgtgtggaatccctgaattgctgcaacctgaaggcaagctgtcaaaattgctcttggggctgagggcaaaagagtgattgaatttttgaagtgtgaacatatgtatccggtttattgtggagtgtggcaaactcgttactgcaacctgatggcaagatgttcaaattgcgcttgagaatagggattacatttttgaatgtgagtattgtgtttgtttctagtgcaataagtgtgttttgtatgcatgtccagttcaaatgcaaaaataaaaacacattgtaccgtagccaaaattgctgcagtaaaagctggagaattt

SEQ ID NO: 16667 - DNA, 2304 bp, Zea mays
ctgctctggttttggttctcttccagccagccaccgtagagcgcgcagcaaagctggcgtcagtcagtctgacagctcagctcctcccgacctccctatatctctgctcccccaaaccctaccccctgccataacacaacaatctctctcccctcactccctctctgcagcgcgcagctttcaaagcgttgggagagatggcagaggagacgcaaccagaggccgcagccgccgccgcgcccgccgcggccgaggtagtcgtgaccgaagctgcgccggcggaggcggaggtgcctgcggcggcggaagctgaagccgaggccaaggatgagaagaaaggtgacgaggcggagctcaccgccgatgacgcgggggtggggaccggctcgttcaaggaggaaagcaacctggtggaagacctgcccgacccggagaagaaggcgctcgacgagttcaagcagctgatcgctgctgccctcgccgccggtgagttcaacctgcctcccccgccgccgccgccgaaggccaaggaaacaaaggtggaggaagccaaggccgaggagcccgccaaagaagagcccgcggccgaggcggaggaagccaaggcccaggtggctgcggatgccccggttgaggaggtcaagacggaggtgccgccggccgaggaggccaaggctgagacactggctgaggaagccaagccttccgagcccgagccgcaggagaagaccgtcgtggtcactgaggaggagactgccaccaagacggtggaagcaatcgaggaaaccgtcgtgtccgcccccgccgccatcccggaggaagcagcggcgccggaggcggtggtcgaggctcaggcgaccgcgcctgaacccgtgctgatttggggcgtgccgctggtcggcgacgacgagcgcacggacacggttctgctcaagttcctgcgtgcgcgggagttcaaggtgaaggatgccatggcgatgctcaagtccgcggtgctgtggcgcaagcgcttcggcatcacctcgctcctcgacgccgacctcggcctgacggagctggagaacgtggtgttctaccgcggcacggaccgcgaaggccaccccgtgtgctacaacgtctacggcgagttccaggacaaggatctctacgagaaggccttcggcgacgatgagaagagggagcgcttcctcaagtggcgcatccagctgctggagcgcggcattctgtcgaagctggacttctcgcccagcggcatctgctccatggttcaggttaccgacctcaagaactcgccgcccatgctcggcaagcaccgcgccgtcacccgccaggctgtcacgctgctccaggacaactaccccgagttcattgccaagaaggtgttcatcaatgtgccgtggtggtatctagccgccaacaagatgatgagcccgttcctcacacagcgcaccaagagcaagttcgtctttgctagcccagccaaatcagcagcgactctattcagatacatcgcaccggaacaagttcctgtccaatttggaggcctcttcaaggaggatgatcctgagttcaccacctctgacactgtctccgagctcactatcaaaccatcctcaaaagaaaccgttgagatccctgtcaccgagaactccacaattgtatgggaactccgggtgctgagttgggaagtgagctatggcgccgagttcacccccgacgcggagggtgggtacaccgtcattgtacagaagacaaggaaggtgcctgctaacgaggaaccgatcatgaagggaagcttcaaggcaggcgagcctggaaaacttgtgctaactgtgaacaaccctgcatccaagaagaagactctactttacagatcgaaggtgaagagcgccagcgagtgagtgtgaggtcacgccgctagctgcctgggccctacagttaaaacgatctacagcatgatagaagagagaaggaaccttttggtttggttcgttaatttactgggatttgctgggttttttattttttgggttcgcattctacattttgtttggttgaaaccaaagtgagcttgtttttgtgacagtagatgggagaagtataatggcattgtgtgatggatggttgttgatgagggcagggaggacgaaaatgaggggaaggaaaggctggagaatgtctgttcctctgtagatgtgtgttctgtacattgcatctcttggattctcattgatatgttaaaatttaggagtacttggtcaaaaaaaaaaaaaaaaaaaaaaaaaaactcgagagtacttctag

SEQ ID NO: 16668 - DNA, 1455 bp, Zea mays
cattgggtacctcgaggccggccgggggcaaagtgtggcaactgaggtagcgtgccgcgcgtccgcgacgacgagcgcacggacacggttctgctcaagttcctgcgtgcgcgggagttcaaggtgaaggaggccatggcgatgctcaagtccgcggtgctgtggcgcaagcgcttcggcatcacctcgctcctcgacgccgacctcggcctgccggagctggagaacgtggtgttctaccgcggcgccgaccgcgagggccaccccgtgtgctacaacgtctacggcgagttccaggacaaggatctctacgagaaggccttcggcgacgatgagaagagggagcgcttcctcaagtggcgcatccagctgctggagcgtggcatcctgtcgaagctggacttctcgcccaacggcatctgctccatggttcaggttaccgacctcaagaactccccgcccatgctcggcaagcaccgcgccgtcacccgccaggctgtcacgctgctccaggacaactaccccgagttcattgccaagaaggtgtttatcaatgtgccgtggtggtatctcgctgccaacaagatgatgagcccgttcttcacgcagcgcaccaagagcaagttcgtttttgctagcccagccaagtcagcagagactctattcagatacatcgcaccggaacaagttccggtccaatttggaggccttttcaaggaggatgaccctgagttcaccaccttggacactgtcactgagctcactatcaaaccatcgtcgaaagaaaccattgagatccccgtcaccgagaactccgcgattgtatgggaactccgggtgctcggttgggaggtgagctacggcgccgagttcacccctgacaccgagggtgggtacactgtcattatacagaaaacaaggaaggtgcccgctaacgaggaaccgatcatgaagggaagcttcaaggtaggcgagcccggcaagcttgtgctaactgtgaacaaccctgcatccaagaagaagaagctcctttacagatcaaaggtcaagagcatcagcgagtgagtgagtgagtgaggttgctgctagctgcctgggtcctagagttaaatgatgtaccacagttcatctcagcatgatagaagagaggagaagccttttggtttggttcgttaatttattgggttttgctggcttttggttcacattctatattttgtttggttaaaaccaaagcgagcttggttttgtgacagtagatggggaagtataatgacattctgatggatggttgttgaggagggcagggaagacgaaaggctggggaatgtctgctcctctgtagatgtgtctgtacattgcatctcttggattctcattgatatgtttaggttttaggagtactttgtcacatcattatgcaatccatgttactctctgcatgttcctctttct

SEQ ID NO: 16669 - DNA, 1019 bp, Zea mays
gtgccgtggtggtatctagccgccaacaagatgatgagcccgttcctcacacagcgcaccaagagcaagttcgtctttgctagcccagccaaatcagcagcgactctattcagatacatcgcaccggaacaagttcctgtccaatttggaggcctcttcaaggaggatgatcctgagttcaccacctctgacactgtctccgagctcactatcaaaccatcctcaaaagaaaccgttgagatccctgtcaccgagaactccacaattgtatgggaactccgggtgctgagttgggaagtgagctatggcgccgagttcacccccgacgcggagggtgggtacaccgtcattgtacagaagacaaggaaggtgcctgctaacgaggaaccgatcatgaagggaagcttcaaggcaggcgagcctggcaaacttgtgctaactgtgaacaaccctgcatccaagaagaagacgctcctttacagatcgaaggtgaagagcaccagcgagtgagtgtgaggtcacgccgctagctgcctgggccctacagttaaaacgatctacagcatgatagaagagagaaggaaccttttggtttggttcgttaatttactgggttttttttttgggttcgcattctacattttgtttggttgaaaccaaagtgagcttgtttttgtgacagtagatgggagaagtataatggcattgtgtgatggatggttgttgatgagggcagggaggacgaaaatgtgggggaatgaaaggttggagaatgtctgttcctctgtagatgtgttctgtacattgcatctcttggattctcattgatatgttaaaatttaggagtacttggtcacatcattattcaatccatgttactctgcatgttcctcttttctcttcgtgtccttttcccttgttaatggaacactgtctgctgccgctcccaccatttatatatatatgctcatttgcagcaacaaggggatgtactcagaagtgacaaataatggccgtgt

SEQ ID NO: 16670 - DNA, 1013 bp, Zea mays
ttctgctcccccgaacctcgatcccgggcataacacaatcaatctctctcccctcactccctctctgcagcgcgcagctttcaaagcgttgggagagatggcagaggagacgcaaccagaggccgcagccgccgccgcgcccgccgcggccgaggtagtcgtgaccgaagctgcgccggcggaggcggaggtgcctgtggcggcggaagctgaagccgaggccaaggatgagaagaaaggtgacgaggcggagctcaccgccgatgacgcgggggtggggaccggctcgttcaaggaggaaagcaacctggtggaagacctgcccgacccggagaagaaggcgctcgacgagttcaagcagctgatcgctgccgccctcgccgccggtgagttcaacctgcctcccccgccgccgccgccgaaggccaaggagacgaaggtggaggaagccaaggccgaggagcccgccaaagaagagcccgcggccgaggcggaggctacggcggaggagcccaaggcccaggtggctgcggatgccccggttgaggaggtcaagacggaggtgccgccggccgaggaggccaaggctgagacactggctgaggaagccaagccttccgagcccgagccgcaggagaagaccgtcgtggtcactgaggaggagactgccaccaagacggtggaagcaatcgaggaaaccgtcgtgtccgcccccgccgccatcccggaggaagcagcggcgccagaaggcggtggtcgaggctcaggcgaccgcgcctgaacccgtgctgatttggggcgtgccgctggtcggcgacgacgagcgcacggacacggttctgctcaagttcctgcgtgcgcgggagttcaaggtgaaggatgccatggcgatgctcaagtccgcggtgctgtggcgcaagcgcttcggcatcacctcgctcctcgacgccgaccttggcctgacggagctggagaacgtggtgttctaccgcggcacggacccgcgaggccac

SEQ ID NO: 16671 - DNA, 1199 bp, Zea mays
ttgggtacctcgaggccggccgggtgtctctcgctcgctctctctctctctctccctctcgtagtcgtgcggccaccgggtgactgccggcgccgccctaagccaggtgccgtcttcgttgggtccctcggttgcgacgagcacccaccagtaatgctgttggcaagctcaacaagacgctatgagcaatttcctttagcacgaaacaatggacttccaagattttcaagagtaaaaatgtcatgcttgggaacaaaccaaagtaaccatcattctgataccgtcagatcttcatcccctagttgtggagataccagaaagatccaccctgtagtcaaaatgtgtggcatcacatcagctagagatgcagaaatggctgtaaaagcaggagctgagcttataggcatgatactatggcccaactctaaacgctctgtctcgttattggaggcaaaagaaatatcaagagttgcgcaatcttatggcgctgaatcagttggtgtctttgtggatgataatgaagagacaattctacgggtgtctgattcatgtgaccttaactttgtccagcttcatggtgatgaatctcgtgcattggttcatactctttcaaagaataatcgtatcgtttatgtactaaatgctgatgacgatggaaaactaatcaacattcctgatattgaatacgaacttgattggtacttagtggacagtgcaaagggcggaagtggaaagggattcaactggcagaagttccagatgccatctgtcaaaagcaagaatggatggctattagctggagggcttcatgcagataatgtttgtgaagccttttctgctctgaaaccagatggtgttgatgttagcagcggcatatgtggtcgagatggtatccgaaaagatgcagacaggattaattccttcataagtaatgtgaaatccctaaatttcctatcgtaaggtcatttgcttgtcgagagcttagtttttttttcatttgctcacgtgtggaatccctgaattgctgcaacctgaaggcaagctgtcaaaattgctcttggggctgagggcaaaagagtgattgaatttttgaagtgtgaacatatgtatccggtttattgtggagtgtggcaaactcgttactgcaacctgaaggcaagatgttccttttccgcttggccctagcgattacatttttg

SEQ ID NO: 16672 - DNA, 1185 bp, Zea mays
gccggccggttcggaccagccggccagtccccgttctccccagttcccagcccgaaccaccggcgacgcacgctccgcttcgctatggcgctctcgctcgcgcgcagccccaaccccgccgcggcgctccccgccccgcgtgttccccactttgcccttcctctcctcacgctccgctgccctcgccgccagaaccaggcacgcctccgcgtcgcagcatcctcgcccccggaggcgcaggctgcccccgtggcggaggatgagcagggggagaagcggcggaagctatacgttgccaacctgccctggtcgttcccggcgccggagatcgagaagctcttcgcgcagcacggcactgtcaaggacgtcgaggtcatcaaggggaaggatggaagaaacagggggttcgcgttcgtgacgatgtcgacagcggaggaggcggccgccgccgctgataagcttaactcccatgatgtaatggggcggacaatcaaagtggagttttcaaagagcttcagaagaccagctccgcctcctcctccaggcactattatagagaggcacaagctttacgtgtccaatctcccatggaaagcaagggctcccaatgttaaagaattctttgcaaactttaacccgctttctgctaacgttatattcgacaatggaaaagcagctgggtacggtttcgtttcctttgggacaaaagaagaagcagaggctgctctcactgagcttgatggaaaggaacttctgggaaggcctgtacgcttgaattggcgggaaagtggtgatgataaggttgaagttgcaaaggctgacagtgaagttgaagctgtaaatattgaaggagcatgcgttgatgatgccagcacggatggaggtgaagataaacaggaatagtaaaaaaaatattatagtggcctacggcaagaaagtttcatctgccagtctgccttcttggtatgcacacagatgtggagccttgttgtacagttacaggtttttttttcctacactacctggtgggtgagtgcatgatcattgtgcctataagtgcacttactactcatggttggtatttgaactaatttgtttctgtggaaaatttaattccgcgacatcatcggaattcttctaattgaatgtacacttttggccaaaaaaaaaaaaaaaaaagcggcc

SEQ ID NO: 16673 - DNA, 1113 bp, Zea mays
attccagtcagtccaggtttccccagcccctccgcttctccaatgtctaccgccgtccacgctgcagccatggcggaggacgccgccgccgatctgcgccggaggatgaaggacaagcgagccgccatcgagcgccggatcaccgactcccgggaccgcgccgccgccgcctcctccgccttcagcgccgccctcctcgaggcgcgctccatcgccaaccagaccgtctccaaccgagcaaaactcagcgaacaaaaacaacacctccggaaattagaatcagatctaacacagcccccccccccccaagcaagcagaaggtcaaaacacaagttcatgactgagtcgatttcaaacaccactgcaacaaatgaacatcttagacacttggctatggaccgtaggtctacaagagatgaatgcatgaatgccatatcaaatcaactaaaagatattgaatcccttgaagctgaaagtgacgcaaatggagataagagcctagagacggctcttatgtggtatgataagtttcttggttttcaagttgttggaggagaaggggtgaaatttgtgttcaacaaaattgatgtgcaaaatcctgacaagaagtattctttttgcataaaacttgctggagaaagatacatcttagtctggtgtgttccatctgtggacgatgctgaagaattggtgaaggatcttaactgcagcaatgatctgtacaaatttgtgagggccatgagagagatgttccaggctgctacaatcagtggaaatctgttgccaagctccttttgccctgacgtatcatccataacatcttcatcgttctcagcgttatcactggattccagaagtgaaaaatagcattaatcagagtcataccatgacacttgacttagcaatgggctgcggatatctgtacagtacaagttgaagcacttctgaagccctcttctgttacacacgctagcagtgttgtataatgcttgtctgctgcttgcatttctgactccaaacttgtcttctattacctatcattcttaataatcatggtaatgtttgagccttttaaaaaaaaaaaaaaaaaaaaataactaaaaaaaaaaaaaa

SEQ ID NO: 16674 - DNA, 1295 bp, Zea mays
catctcgggcgctactgatggaatatggatgggcaggcgaaagagcccggccggcagaagaagcgcggtttgctgacgtctccatcccatcatgtattatcctcagcctaccgtctccttggcggcggcggttgccctcctccgcccctcactccgccgccactctcaaagggcgtcatcccttctccgctcctccacgccgcctccatgggttagtgcgaggaggaggacggccgtctccgacgacttcttcaccgtcgagttggacgctactggagtggaaccggaaccggattccatcgacgacgggctcccctctccatgggagggagctgtcgtctaccgccgcgacgctgccgtccagcacctcgagtacgccagcacgctggagcgcctcggcctaggggacctctcctcccccgactcccgcgcgcgcgccgctgacctgggcctggctggagggaccctggacagcactggcgcgcagcctcggacccccgtgctcgtctccgtcgacgtgaccaggcgccgcggccgcctgcgcctggacggcatcgtgcgcaccgtcatcaccctcggctgcttcaggtgatctgtctatagttgatgaatgccacccaaattcctgtcatgtgatcagcaattttttaaggctgtctttcaggtgtgctgagccagctcctcaaggtatatttgccaatttctccctgctgttgacagaagacccagtagaggaggaaccagacctcggcacgatttttcaagaggacgacgacaaaggtggtgcttcgctagcctgcgccatggatggagatcaagatatcgactgggatgaccggctgcatttcccagcagctgacaaggaaatcgatatatccaagcacatccgggacatgattcatctggagatcaccttggatgcagtgtgcaaccccaactgcaagggtctatgccttacctgcggcgcaaacctcaacaccaccagcagctgcacatgcaagcccaggaacgtccaaggactttctcctctcaaaggggttttcaagtgatgatgcggataccaaagtttgtacaaccagcccaacttcatgtcatgctgtgagcctgtgacttctagattcatataatcgcaaatatgcattgaaacttcacatttatagattcacatccgcagatggcaaaataccaaatcgacttcatatatcttatgttcttcattgtaacaaaccaccaaagatgaaaaatcttaacaaccattttttaaatattatcactcatcgggcggcggctcgcca

SEQ ID NO: 16675 - DNA, 1037 bp, Zea mays
gcggtttgctgacgtctccatcccatcatgtattatcctcagcctaccgtctccttggcggcggcggttgccctcctccgcccctcactccgccgccactctcaaagggcgtcatcccttctccgctcctccacgccgcctccatgggttagtgcgaggaggaggacggccgtctccgacgacttcttcaccgtcgagttggacgctactggagtggaaccggaaccggattccatcgacgacgggctcccctctccatgggagggagctgtcgtctaccgccgcgacgctgccgtccagcacctcgagtacgccagcacgctggagcgcctcggcctaggggacctctcctcccccgactcccgcgcgcgcgccgctgacctgggcctggctggagggaccctggacagcactggcgcgcagcctcggacccccgtgctcgtctccgtcgacgtgaccaggcgccgcggccgcctgcgcctggacggcatcgtgcgcaccgtcatcaccctcggctgcttcaggtgtgctgagccagctcctcaaggtatatttgccaatttctccctgctgttgacagaagacccagtagaggaggaaccagacctcggcacgatttttcaagaggacgacgacaaaggtggtgcttcgctagcctgcgccatggatggagatcaagatatcgactgggatgaccggctgcatttcccagcagctgacaaggaaatcgatatatccaagcacatccgggacatgattcatctggagatcaccttggatgcagtgtgcaaccccaactgcaagggtctatgccttacctgcggcgcaaacctcaacaccaccagcagctgcacatgcaagcccaggaacgtccaaggactttctcctctcaaaggggttttcaagtgatgatgcggataccaaagtttgtacaaccagcccaacttcatgtcatgctgtgagcctgtgacttctagattcatataatcgcaaatatgcattgaaactccacatttatagattcacatccgcagagg

SEQ ID NO: 16676 - DNA, 982 bp, Zea mays
  misc_feature (19)..(19): n is a, c, g, or t
ctcgaggccggccgggccngggcttcaaaacccatagtacggataggcccagcatccagttacagtccggagtctggttagtactccgcatgttcgttctttttacgccgacggaaatcaacctgcgccgctgccttctccgttctcgccgtcgcctccgcctccgctgccgccgcgcaggtcagggtcatgtcgatcttcgagtacaacgggagcgccgtggtggcgatggtggggaagaactgcttcgcgatcgccagcgaccgccgcctcggcgtgcagctgcagacgatcgccaccgacttccgacgggtgttcaaggtccacgacaagctctacatcgggctctcggggctcgccaccgacgcccagacgctgtatcagcggctggtgttcaggcacaagttgtaccagctgagggaggagagggacatgaagcccgaagcctttgccagccttgtttcagccctcctctatgagaaaaggtttggaccatacttctgccaaccagttattgctggcctaggagacaacgatgagccgtttatatgtaccatggactgcattggtgccaaggaactagcaaaagattttgtggtctccggtactgcttcagagtcactttatggtgcttgtgagtccatgtataagccaaacatggaacccgaagaacttttcgagacaatctcgcaagcattgcaagcatctgttgatcgcgactgcctcagcggctggggaggttatgttcttgttgtcacacccactgaagtgcaggagagagtgctgaagggaaggatggactgatgagtgctgccatgtagttattctaggagagattgtttcttcattcgccctgacatactcgcccctgtcctacggcgtacataattcagagaacctgtgcaccacgtttacttctcattctgaatgaacattgattcagtagttgccttcgcctttaattccaaaaaaaaaaaaaaaa

SEQ ID NO: 16677 - DNA, 2058 bp, Zea mays
agccgatccgtagacgcagcagcacacgcggttagccgccctcaagctcgctcgacgctcgttcccctgccccgcgtccgccccgcgtcccgaaaattcccccttttttcctacttcccgtcccacggctcctacgccccgcgggcccaaaaaccctagccggctaatccaatcctgcttcccgcccatggcctccgcggacgctgccaagcccgcgtccccgcccgccgcggatccgcccgtcgacgaccccatggacgccgaccccgcgccccccgcgggggaggaggagcaggccacgccgcagaagcagcagccggagaagaagcggggcggccggaggaagaagggcgaggcggcggagaagacgccgccgtcgtccaagaagtcggcgggccccacggtggagcgcccgtccagggagaggaagacggtcgagaggtacgcggagcttgcgccgcgcgccacacccgccaaaaagtcccccgctattctccagggttctggaacgaagctcaaggacatacccaatgtttcatttaaactatcaaagagaaaggtggatgagaatctccagagcctccatactgtattgtatgggagaaaatcaaataaccattttctgaagagaaacatatctcaattttctgggtttgtttggacagataatcaagaaaaacagaggaacagaataaaagaaaagcttgagaaatttaacaaggagaagttgctagatttttgtgaaatactggacgttattgtaaaagtaactatgaagaaggaagaagtttctgccaagctcttggaatttttggagtctccttgtgttactcgggatgttgttctcactgataaaaagaaggggaagaaacggggaagaaaatctaaagtaggtcgtgaggcaactgctgaaggtgcttctgcagagaagaaaaggaaaagagcccataaacaagcagctgaagatggtaaagagaatgatggtgaggatgatgatcccgctggttctgaggatgcatcaacaggagaggaagctgatggggactctgaggcaaatgatcatgctttgagtgatgatgaacatgatgagcctgctgcaaagaaaaagtcttcagatgttaaacaaaagaaagaaacaggttctgatgcaaaggaaaaggatgcaccaggaaaaaaaggttctacgaaacgtgcatcaaagccttctcaaaacagtaaaaatgagcctgaggtagagataaaaaaggttggcaagagagaaaagagttcaaaagaaactgacgtgtcaccagattcaaataagtcaaacaagaagatttctaaatccaaaaagggtgatggaaaagaaacccaaaataataaagctgccaggtcatccaataagagtaaaggtaaagtcaaaggtgggtcagtggctgggactgccccaaccactgaacagcttcatgctgttgttagtggcattttgaaggaagttgacttcaacacagcaactttggctgatattctcaggcaattagggacccattttgaaatggacctcatggacagaaaagcagaagtgaagcgcattatagaagatgtaattaatagtatgtctgatgatgaaggtgaggaaggctcagaagatgaagctgaagacgatggtaaggcggataatttaaagagtgaacccgatggaggtgaagagaagtgattctgtggactggatgtggattgaacatcgaagggtcatttttcatggcagtctcctgtttggaggtttggctctgtacaattcgggcaccgcaagaacgagccggtgacctgggtactgcttacatgattgttaaccatttcaacagccatacgcatctagctgagcttgacttggtagtgaatgtagtctagtcgcttgtcatgtaatagctttgcgattgatagtttgctagcttaggtagctagcctgactgtaatatgcagaataattcttgtcttgtttccgtccattttatccatgtaaaactatgagttctgaatctaaaaaaaaaaaaaaaaaaaaaaaaaaaaaaaaaaaaa

SEQ ID NO: 16678 - DNA, 1986 bp, Zea mays
aattcggccccccgccccctacgcgcgcgagcctaaaaccctagctccgtgccccgatcctccttcccgcccatggcctccgccgacgccgccaagcccgcgtccccgcccgccgcggatccgcccgccggcgacgccatggatgccgaccccgcgccccccgccggggaggaggccacgccgcagaagcagcagccggagaagaagcggcccggccggaggaagaagggcgaggcggcggccgcggcagacaagaagacgccgccgtccaagaagtcggcgggccccgcgctcgagcgcccgtccagggagaggaagacggtcgagaggtactcggagctcgcgccgcgcgccacgcccgccaagaagtcccccgctattctccagggctccggaacgaagctcaaggacatacccaatgtttcattcaaactatcaaagagaaaggctgatgagagtctacagagccttcatactgtattgtatgggagaaaatcaaataaccattttttgaagagaaacatatctcaattttccgggtttgtttggacagacaatcaagaaaagcacaggaccaaaataaaggaaaagcttgagaaatttaacaaggagaagttgctagatttttgtgaaattctggacgttattgtaaaagtaactacaaagaaggaagaagtttctgccaagctcttggaatttttagagtctccttgtgttaccagggatgttattctcactgataaaaagaaggggaagaaacgcggaaggaaatctaaagtaagtcgtgaggtaacttctgaaggtgcttctgcagagaagaaaaggaaaagagttcagaaacaagcagctgaagatggtaaagagaatgatgatggggatgatgctgatcttgctggttctgaggatgcatcaacaggagacgaagctgatgtgggctctgactctgaggcaaatgatcatgctgtgagtgatgctgaacctgatgagcctccagcaaagaaaaagtctacagatgtaaaacaggttaaagaaactggtactgatgcaaaggaaaaggatgcaccaggaaaaaagggttctatgaaacctgcaaaacgtgcatcaaagccttctcaaaacagtaaaaatgagcctgaggtagagataaaaaaggttggcaagagagcaaagagctcaaaagaaactgatgcgccaccagattcaaataagccaaacaagaaggtttctaaatccaagaaggataatggaaaagaagcccaaaacaacaaagctgccaggaataagaataaaggaaaaggcaagggtggcccaggtgctgggactgccccaaccaatgaacagcttcatgctgttgttagcagcattctgaaggaagttgacttcaacacagcaactttggctgatattctcagacaattagggacccatttcgaaatggacctcatggacagaaaagcagaagtgaaacgcatcatagaagatgtaataaatagcatgtctgatgatgaaggtgaagaaggctcggaagatgaagcagaagacaacggcaaggtggagaagtcaaagagtgatcccgatggaggagaagagaagtgattctgtggaccggatgtgccagtggtggtttggattgaacctggaaggactattttccggccaattctcccgtgtttggaggtttttggctctgtacaattgggggcaccgcgagaacgagccggtgacctgggtactggttacaaagattgttaaccatttcacagccatacacacctagttgtgcttgacttggtagtggatgtagtctctagtgtatggtcatgtacgatagtttggttgcgtaggtagctagcgtgactgtaatatgcagaacaattctgggcttgtttcatctatttatccatgtaaacctctgtatccgagttctgaatcgttcctgctccttgcatttgttgtttacctaaccatcgcaatgttagcgcagtg

SEQ ID NO: 16679 - DNA, 5246 bp, Zea mays
ctgcagacaattgctctcatgcagctgtctcctcccatcccttctgccacaccacctctggaatcacaacccaacaaatcattttgccatcttgacattgcacatgttttctgacatccacggtgtttaattggatggctacgacctatataacgttagggctctgcctcgtgcttaagaacaccttggtgaatgcataatgatgtttccttaagcatttttttggtactgaggacattacttctgtctcttttcttgaactgtttcatgacagacgtctatgtatactctttgagctcttcttttttagtaatctagtttcttactgtctaggcaataagtcaacatacatgggcaatatgtatagtggttaaatttttttttgtattatcattttttactgattaatggaatcttggtgtctgcttgtctcattgaacagaaaaggaaaagagttcagaaacaagcagctgaagatggtaaagagaatgatgatggggatgatgctgatcttgctggttctgaggatgcatcaacaggagacgaagctgatgtgggctctgactctgaggcaaatgatcatgctgtgagtgatgctgaacctgatgagcctccagcaaagaaaaagtctacagatgtaaaacaggttaaagaaactggtactgatgcaaaggaaaaggatgcaccaggaaaaaagggttctatgaaacctgcaaaacgtgcatcaaagccttctcaaaacagtaaaaatgagcctgaggtagagataaaaaaggttggcaagagagcaaagagctcaaaagaaactgatgcgccaccagattcaaataagccaaacaagaaggtttctaaatccaagaaggataatggaaaagaagcccaaaacaacaaagctgccaggaataagaataaaggtacaagttttgtaatgcttaccacatgctgtgtgtattgattggtattgttttggtattctttccttttgattgttgccatcctagtgcagctttgagtttatttgtgctcgttaatttaagagttaagactgcaagtttttttttcttctgtccaaaaatcattttcagttaaaaggcctgtgatttgtgatgtgatgccatatacatgcgttactctgcttgactgccatagctctaataagctattttctgtttatgctccctaggaaaaggcaagggtggcccaggtgctgggactgccccaaccaatgaacagcttcatgctgttgttagcagcattttgaaggaagttgacttcaacacagtaagcagtttgtgttttgaacatggtctatagttttatgtgtttttttgtattctgactggttattttttgtgtaggcaactttggctgatattctcagacaattaggtacatttttatgctgcttgaatttcattggtgtagatatatgaagaaactgttgatacatcggctgtaaccttagttttctagcagtagcagatgagtgtactgacatgcttggttcgtttaaacccagggacccatttcgaaatggacctcatggacagaaaagcagaagtgaaacgcatcatagaagatgtaataaatagcatgtctgatgatgaaggtgaagaaggctcggaagatgaagcagaagacaacggcaaggtggagaagtcaaagagtgatcccgatggaggagaagagaagtgattctgtggaccggatgtgccagtggtggtttggattgaacctggaaggactattttccggccaattctcccgtgtttggaggtttttggctctgtacaattgggggcaccgcgagaacgagccggtgacctgggtactggttacaaagattgttaaccatttcacagccatacacacctagttgtgcttgacttggtagtggatgtagtctctagtgtatggtcatgtacgatagtttggttgcgtaggtagctagcgtgactgtaatatgcagaacaattctgggcttgtttcatctatttatccatgtaaacctctgtatccgagttctgaatcgttcctgctccttgcatttgttgtttacctagccatcgcaatgttagcgcagtgattctctgctatgtgggcatttttgttgggtccttgtctgtgtgatcttaagcgtttcaagtggtcgtactctctctcatgtgctcagacgctgtgtgtgcaccgctggtggataggtctgtagatgaaacgcttccgatgaaaatgatcacagctgcagtcgccgtcttctctgcctgcttgtgcttgccatttccactagcaaccttcctgaaacccaagatcatctagaatacggttccgattctcacctgctcggagaagaactacgagcgtgcatttgcatgctggctgcatcccttggctcactccatccaaatgtcccaaccaccttactcgcgcgcacgcacaagagacctctcttcctcttcttataagccttctccctcgatccgctcccctccgagttctttcttacacgcgcgctgcgtcgtccaggtccagatccagtcccggttgtgctccgctgctggtctgactccagcaatggtaatgtccgttcatcaagtttttttttgctagtcgtgttctcgccgtttctgacatggacgacggatatgcacgcagagtgtgttcgagatgcggatcaagcagcagggggagccgtcgctggtgacgccggcggaggagacacccggcggcctctactacctctccaacctggaccagaacatcgccgtcatcgtgcagaccgtgtactgcttcagggcggcagacggcggcgccggcggcggagtcagcgcctgcgacgtgctgagggagtcgctggcgaaggtgctcgttcactactacccgctcgccgggcggctggcgacctcgggcgacgggaagctggtcgtggactgcacgggcgagggcgccgtgttcgtggaggccgacgcggactgcgccatggcggacatcggcgacgtcaccgagcccgacccctccgtgctcggcaggctcgtgtacagcgtccccggcgccaagaacatactcgagatgccgctgcttgcagcccaggtacgtacgatttgctgctcgtgcatcgatctcctggatcgatggagttagttattagataataacgacgggcgatggatccatggacttgcaaggtgaccaagttcaagtgcggcggcttcgtgctggggctggccatcaaccactgcatgttcgacggcgtcggcgccatgcagttcgtcaactcgtggggcgagacggcgcgcggcctcccgctgtcgctgccgccggccctagaccgcgccgtcctccgcgcgcgcgacccgccgcaggtcgacttcccgcaccacgagttcgcgcagatcaccgacgacgacgaggacgagtacgaggactccccgctcctgcaccggtcgttccagttcacgcccgcgtccatcgcgcgcgtcaaggcggcggcggcggcggcggcgctggagggccgcgcgtgcaccacgttcgaggcgctggccgggttcgtgtggagcgcgcgcacgcgggcgctggggatgcgggcgtctcgcccgagcaagctgctgttcgcggtggacgggcggccgaggttctcgccgccgctccccgaggggtacttcggcaacgccatcgtgctgaccagcgcggcgtgccccgcgggggagctggcgcgctcgctgccgcgcgctgtgcggctggtgcgcggcgccgcgggggccgtgacggacgcctacatgcggtccgcggtggactacttcgaggcgacgcgcgcgcggccgtcgctggcgtcgacgctgctcatcacggcgtggtcgcggctgccgttccgcgcggccgacttcgggtggggcccgcccgcggcgtgcggccccgcggcgctccccgagaaggaggtggcgctcttcctgccgtgcggggaggaggggggcggcggcggcggcgtccgcgtcctgctggggctgccgcccgcggccatggccgagttccagcggctcgtggacgaggtgaccgcggcttgaagtggaggacccaatgtttgcttgcttgtatacggaagtgctacctgagtacctgttatctgtgtttcttcttttctgatttgaaaatttgtttgtgttgagttgatggcacctgtatgtcgtagtgaactcgtcgttgtacctgaatggatgttaaaaaaagcgttaggaggagtttggttcaaaaaaaaaaaaaaaatgcggcacgcggaaactaaaactccattttaattttcttatttgacaatttagagattcaaaatgaaataaaatagatgaactaaaaattattccttaaaaatcaaacactgcttagttaacaacatatgatgccattgttgtgagttccagaactagttatctttaatatcttactatattacagtattactaataagatattccatgtcagttttcactagagatgttaggctatctccaaccattcctcctcccaaatctccgcattcgtacattctattcgtatttaaatacctctccttcaattattcttccccctatttctcctcttattcaaccattctccctatctagctccctcattatcctttaattgagctatttaacttttgtacctcagtttttgtagttttaaaaaatactaccatatatcatatatgtagtaccataatatacattgttatcggctaattaaactcaacaatattaattttccactaaatacaatcaattaggttagagctccccctcggcgaggggagagatgttggacggcgagggggcgtcggaacccaccccataaccgatagttggagcgcgagagggagtcgttgaagagaaccttagggaaaaaatgtttcatactttactttttaagcactctgtcatattaaaattctaaagttagaagaagcattaagatttataacacaaaattaatatcattggataggccataactatattctcatactacgtttgaattggtatcacacatctgtacagttttctctctctattgattcaaccaaccacaaaaaggtttcacttaagacaactcgagaaagtaccagccgatggataagactcctgttgaaggctaaatgagccttgcggacggtccggccctgaggccggacggtccgcggtccggacggtccgcggtggcggcgcagacggtccgcgcgcgcgcagagtcagttaggg

SEQ ID NO: 16680 - DNA, 4518 bp, Zea mays
  misc_feature (979)..(979): n is a, c, g, or t
ctgtactagcctaatgcctgtaatgaaccaacacataatgctttagttagttgccaattttatttcttatagtttcaattgtggttatctcatgtatattctgtactagtccaatcctgacactcttgttagctttgttatactttttgaatgacctgatctttttttatgtaactgtgcttggattatgtaggctttgtttgttgttggtcatgtttgccctgactgtgtgatattcatcaggaaaaacagaggaacagaataaaggaaaagcttgagaaatttaacaaggagaagttgctagatttttgtgaaatactggacgttattgtaaaagtaactatgaagaaggttagttggccgagttaatctttgtttattgatgagcagtgagttctttattaatggttcgtgttttactcaatttcaggaagaagtttctgccaagctcttggaatttttggagtctccttgtgttactcgggatgttgttctcactgataaaaaggttcatcttttgatacacccatgatttttttcttggcctggggccacttaaagcattgtgatttgttggttgtcctttggcagcactgcattcttagcagcacatgacttatttgctctgagcttggcaccatgaactgaagtgtctgtcctgttctctgccattgcagaaggggaagaaacggggaagaaaatctaaagtaggtcgtgagacaactgctgaaggtgcttctacagagaaggtaataatatctagtgttgggtgaagctaaaacttttcctttttagtgccctgtccaatccaaaggaaccatttatctttaacgcattcatttgtgttttgaagccagatgctttgattctaaataataatacaatctgtctccgtagtccattttgctttcatttttctgcaaaaatgtaccatggaaagttagtcatgcatttctgggagaaaatgtagagtatttangtatggggtattaagtagctatttcaaatggctacttgagaagtcataaatagctgattgaattggctttaacggtatcaagaattagctgtttgattaaacagatataactgattgagctgattgagttagctatttgcataagcatatagatgactgagttggctatttatgtatcaagattcaataaatagttgtctatttaggtaataaatagatttcaaaatgctattttgggcaattatatattgctgactgattgggtcgtttgtgtcaaatatctgtttaaagtggctatttcagtaaccatctggccatttggattggctgtatatatttccaagtactataaatatctaatattttgttgtggtaccatgggttatcaatgtatttcaaggttctaaaaggcactaggggcttagtgagcttcaagtcacatattgcctagagctgaacatagattgaatgccatttcagcaggtgtagctgcatacatttgcaagaaagaaagaaagagcaatgtcttgaaagctcactgaggtctgggaggaacacatgaagttgactagcccatctaagcacaataacacccattaatgtcctatgcccctacctactgctgccaattcacagctgtgctctccccccatcacggaacacacatctgttccccctctgctcaccccatgtccactcagacaactccctctgtttctgaccccatgctgaaattgagcagatgttgagttatatcaagtgacaaatgtatccatatatggaagcacaatcgaagaaaccatcttgctatcctaaacttgtcccctctcttgttttcttctacatccatgggttctgacagttccacctatggcctatatagtgtgtaagggatttgtgttgcccaacaatctactatgtatactccatgctctcctttcttagtactgtagttatttcttagactatggccagcaaattgtgtatatggctgtgcaaaacattgttttgcactgtagactgcattatttatagtgtagggggatgttgatgagtaaaatgctagagatagcctgtctagatagggaaataaatgaacatacatcagcaatgtctatagtagttaaatgcattacttttgttgaacattccttttttactgattaattgaatcctaccgcctgcttgtcttattgaacagaaaaggaaaagagcccataaacaagcagctgaagatggtaaagagaatgatggtgaggatgatgatcccactggttctgaggatgcatcaacaggagaggaagctgatggggactctgaggcaaatgatcatgctttgagtgatgatgaacatgatgagcctgcctcaaagaaaaagtcttcagatgttaaacaaaagaaagaaacaggttctgatgcaaaggaaaaggatgcaccagggaaaaaaggttctacgaaacgtgcatcaaagccttctcaaaacagtaaaaatgagcctgaggtagagataaaaaaggttggcaagagagaaaagagttcaaaagaaactgacgtgtcaccagattcaaataagtcaaacaagaagatttctaaatccaaaaagggtgatggaaaagaaacccaaaataataaagctgccaggtcatccaataagagtaaaggtacaagctcgttgatgtttaccacatgcagtgtctattgattggtctatgcacataccaatctgattctttctgattattgccatccaagtgtgcctttgagtttttttcttttacccaaaaaaccggtttcagttaaaaggcttgtgcgaaagggtctgtagccgagttcattaggtggtctgattagcattccttaggttcttagtttgaatcccagtgggagcgaattttggaccgaggttaaaaaaagtcacttgctagtttccttggtcgtgcacacatgagatggactgacctaatagggggctcaaaacatgactgccatagccctaataaaccattttctgtctatgctctgcaggtaaagtcaaaggtgggtcagtggctgggactgccccaaccactgaacagcttcatgctgttgttagggcattttgaaggaagttgacttcaacacagtaagcaattgattacgttttgaacatggcacatagttttataagctttgtattctaactcgttattttttatgtaggcaactttggctgatattctcaggcaattaggtacctatttatgttgcttaaatttcattggagtagatatgtgaagaaatataccatctctaaccttagttttctaacagatgagtgtactgacatgtttgattcttttaaaccagggacccattttgaaatggacctcatggacagaaaagcagaagtgaagcgcattatagaagatgtaattaatagtatgtctgatgatgaaggtgaggaaggctcagaagatgaagctgaagacgatggtaaggcggataatttaaagagtgaacccgatggaggtgaagagaagtgattctgtggactggatgtggattgaacatcgaagggtcatttttcatggcagtctcctgtttggaggtttggctctgtacaattcgggcaccgcaagaacgagccggtgacctgggtactgcttacatgattgttaaccatttcaacagccatacgcatctagctgagcttgacttggtagtgaatgtagtctagtcgcttgtcatgtaatagctttgcgattgatagtttgctagcttaggtagctagcctgactgtaatatgcagaataattcttgtcttgtttccgtccattttatccatgtaaaactatgagttctgaatctttctgaaccttgcttttcttgttctccttgtcatcttaatgtctgatcatttttgttgaattttttggttgaagcttcttaggtctatagtggttcagacgcttcagtttgtcataggttttgccagcggctgtcgctgcatctttttacggtttagtacatagtagcttggctcatactccctcttcttaaaatatagttctttgtatctttgtcctctgttcatattcattcaagtgataatgattataggcatatatgtaagctataattatatgttacttattgaatgtatgattagtctaaaataaagttgttttatctcttaatttttatgtttatatttaaatggatgataatgaatctagacatgtaatatacatgtatcaagaattgtatgaacctaattatctaaaacgactactatacggtcaaaagtgtagtgtaagagaatatgactgaggctgagcattaaattttaattaagttgattaaaattttattagttaataagtataagtaaataacatctcaattcaataagagatcataaatagaattatcatatctagtttaattaattccataatttactcatgtaaaaggttcgagccgtttttaaccgtaaggatgtgtggttttttggtgtgtgttactttcaacatagcaccttctcacttccattatacttc

SEQ ID NO: 16681 - DNA, 1584 bp, Zea mays
  misc_feature (835)..(835): n is a, c, g, or t
tccgagttctttcttacacgcgtgctgcgtcgtccaggtccagatccagtcccggttgtgctccgctgctggtctgactccagcaatgggtgtgttcgagatgcggatcaagcagcagggggagccgtcgctggtgacgccggcggaggagacgcccagcggcctctactacctctccaacctggaccagaacatcgccgtcatcgtgcagaccgtgtactgcttcagggcggcagacggcggcgccggcgacggagtcagcgcctgcgacgtgctgagggagtcgctggcgaaggtgctcgttcattactacccgctcgccgggcggctggcgacctcgggcgacgggaagctggtcgtggactgcacgggcgagggcgccgtgtttgtggaggccgacgcggactgcgccatggcggacatcggcgacgtcaccgagcccgacccctccgtgctcggcaggctcgtgtacagcgtccccggcgccaagaacatactcgagatgccgctgcttgcagcccaggtgaccaagttcaagtgcggcggcttcgtgctggggctggccatcaaccactgcatgttccgacggcgtcggcgccatgcagttcgtcaactcgtggggcgagacggcgcgcggcctcccgctgtcgctgccgccggccctagaccgcgccgtcctccgcgcgcgcgacccgccgcaggtcgacttcccgcaccacgagttcgcgcagatcaccgacgacgacgaggacgagtacgaggactccccgctcctgcaccggtcgttccagttcacgcccgcgtccatcgcgcgcgtcaaggcggcggcggcggnggcggcgctggagggccgcgcgtgcaccacgttcgaggcgctggccgggttcgtgtggagcgcgcgcacgcgggcgctggggatgcgggcgtctcgcccgagcaagctgctgttcgcggtggacgggcggccgaggttctcgccgccgctccccgaggggtacttcggcaacgccatcgtgctgaccagcgcggcgtgccccgcgggggagctggcgcgctcgctgccgcgcgctgtgcggctggtgcgcggcgccgcgggggccgtgacggacgcctacatgcggtgccgcggtggactacttcgaggcgacgcgcgcgcggccgtcgctggcgtcgacgctgctcatcacggcgtggtcgcggctgccgttccgcgcggccgacttcgggtggggcccgcccgcggcgtgcggccccgcggcgctccccgagaaggaggtggcgctcttcctgccgtgcggggaggaggggggcggcggcggcggcgtccgcgtcctgctggggctgccgcccgcggccatggccgagttccagcggctcgtggacgaggtgaccgcggcttgaagtggaggacccaatgtttgcttgcttgtatacggaagtgctacctgagtacctgttatctgtgtttcttcttttctgatttgaaaatttgtttgtgttgagttgatggcacctgtatgtcgtagtgaactcgtcgttgtacctgaatggatgttaaaaaaagcgttaggaggagtttggttc

SEQ ID NO: 16682 - DNA, 2639 bp, Zea mays
tgggacctcgacccatctctctctctctctgtctcccaccacctatctcccctccccatgtgggcggcctcgagctctgcttaggtctcacagctgtgctctcgttggttgggtgatccgccccttgtcggctcctttcaactcgagagctccgggacagcgagatctgcgctgtcgccgccttacctttcttgcgagctcgcgtgcaggcaggcactgagcagtgagctccccccgtcttcctcagcctcgtttcccctctcgttgctggatctggctcgcaagatccaatctttcgtgccccctttctccaaagatcctcgcttgggtggttcttcctggagattgctgggaggatgcagcacgaccagaagaagaaggcaccttcagagatggattttttcacagagtatggcgaaggcagcaggtacaagatagaagaggtcataggcaaaggcagctacggcgtggtttgctctgccgtggacactcatactggcgaaaaggtcgctataaagaagataaacgacatcttcgagcatgtgtctgatgcgacgcggatactccgggagatcaagctgcttaggctcctgcggcatccggatattgtggaaataaagcatatcttgctccctccgtcgaggagggagttcagggatatatatgttgtctttgaactcatggagtctgatctgcaccaagttataaaggctaacgatgacttgaccccagagcattaccagtttttcttgtatcaattgcttcgaggattgaaatacatacatacagcaaatgtatttcatcgagatctcaaaccaaaaaatattctggcaaatgctgattgtaagctcaaaatatgtgactttggcttagcaagagtagctttcaatgatactccaaccgccatcttttggacggattatgttgcaactaggtggtaccgagcaccagagttgtgtggatctttcttctccaagtatacaccggcgatagatatatggagtattggctgtatatttgcagaattgttaactggaaaacctcttttcccggggaaaaatgtggtacatcaacttgatataattacagatctccttggaacaccttctccccacgcgtccgcgtggattcgtaatgaaaaggccaggcgctacttgagcagtatgaggcgaaaaaagcctataccgtttacgcaaaagttcccaaatgcagatccacttgcactatgtttgttagagcgaatgctcgcttttgagccaaaagacaggccaagtgctgaagaggctcttgctgatccttatttcaagaatatagccagtgtggatagagagccttctgcacaggctgtcacaaagcttgaatttgaattcgagaggcggagagttacaaaggaagacataagggagcttatatatagggaaattcttgagtatcatccaaagatgctgagggagtttcttgagggaactgagtcaagtggtttcatgtacccaagtgcagtagatcattttaaaaagcagtttgcataccttgaagaacattatgccaagggatctacaggaactccacctgagaggcaacataattcattgccgcggccgtctgttgtctattccgacaaccgatcacaaaccacagccaacatcaccgaggatctttccaagtgtatgctcagagaaaatacacagaagacacatccatattctgcttctgttgcaagtaaatttccaccacatgttcctcaaggtgatgttgcaaggcctggtaaagcagttggttcggtgatgcagtacagcccatgtccagcgcctgctgccgagcgatatgagcaacgaagaatcgctaggcacccagcagttgccccaaacaatatcccttctggaagctcataccccagaagaagccagacctgcaagagtgagacaggtgatgccgaaagccatatggatgcgaaccaagctcggcagccaaagccatatgcagcgaacaaactacctgctaccgttgatagtcgtggtggtcactggtaggatttctgcggtgcaccagaaagccattccaaaccgtttcttaacacgttatcagtatcgattacttctgctgagtgctacattattctgacaaatccagaaatgtagttctgtacagatttgtgttctttttccggatacctgaataccgaaagactgtacaactgtagtttctgattcccactccttgtcgctattcaatcactaaaggatctgtccctggtggagaagaaccggcagattcaatgcaatgttcttgactgacgttgtcatggattttgttcttcaacctggtagctctgaagacgaattgaatagctgctagtttctgctaatcatctacagtcaggtgcagagtgttctgggagctagttctgaacatcactgtcacgctgtaatctgcacgttcctgagctcctaacttctaagcatgccactaccgtatccctttgtaatttaatcagctgtaccatccagtactctgtttacatttgtagaaacgctctgcaaagaagctattatgtgggagtttctttgctattattataaatgttctgttgttataaaaaaaaaaaaaaaaaatattataaacgtcatgtcgttataagc

SEQ ID NO: 16683 - DNA, 2301 bp, Zea mays
ggtggtctccctcacttgactcctcagctaccacccccaccgccccacccccgtctcccccctcctgtgggcggcctcgagctctgcttaaatcacagctgtgttcgtttgtggggtgatccgcccccctgtcggattctttcacctccgagctctgggacaggggagatctgtggtgtcgcagcctcgcctttcttgtacgcgcgcgtgtgggcactcagcagcaccttcagaaatggacttttttacagagtatggcgaggggagcaggtacaagatagaagaggtcatagggaaaggcagttacggtgtggtttgctctgccttggacactcatactggtgaaaaggtcgccataaagaagataaatgacatctttgagcatgtgtctgatgcgacaaggatacttagggaaatcaagttgcttagactcctgcggcatccggatatcgtggaaataaagcatattctacttcctccatcaaggagggaattcagggatatttacgtcgtgtttgaacttatggagtctgatttgcaccaagttataaaggctaatgatgacttaaccccagagcattatcagttcttcttgtatcagttgcttcgaggtttgaaatacatacacacagcaaatgtattccatcgagatctcaaaccaaaaaatattctggcaaatgctgattgtaagctcaaaatatgtgattttggcctagcaagagtagctttcagtgatactccaaccgcgatcttttggacagattatgttgcaactaggtggtaccgagcaccggagctgtgtggatcctttttctcaaagtatacaccagcgatagatatatggagtattggttgtatatttgcagaactattaactggaaaaccgcttttcccgggaaaaaatgtggtacatcaacttgatataattacagatctcatgggaacaccttctccagaagcaatatcgaggattcgtaatgagaaggccaggcgctatttgagtaatatgaggcggaaaaagcccataccttttatgcagaagttcccaaatgcagatccacttgcattaggtttgttagagcgaatgctagcttttgagccaaaagacaggccaagtgctgaagaggctcttgctcatccttattttaagaatagccaatgtggatagagagccttctgcacaagctgtcacaaagctcgaatttgagttcgagagacggagagtcactaaagatgacataagggaacttatatatagagaaattctcgagtatcatccaaagatgttgaaagaatttattgagggaactgagtcaagtggtttcatgtacccaagtgcagtagataattttaaaaagcagtttgcataccttgaggaacattatgccaagggatctacgggaactccacctgagaggcaacataactcattgccacggccttctgttgtctattcagacaaccaatcacaaagcacggccaatataacagaggatctttccaagtgtataatcagagaaaatgcacagaagtcacagcaatataatgcttcagttgcaaataaatttccatcccatgttcctcaaggtgctgctgcaaggcctggtaaagcagttggttcggtgctgcagtacaacctctctcaagcatctgctgctgagcaatatgagcagcgaagggctgctaggcacccagcagttgccccaaacaacatcccttctggaagctcataccccagaagaaatcagacctgcaagagcgagacaggcgacactgagaggatggacgtgaaccaagctgggcagccgaagtcctatgcagcaaacaaactacctgcaactgttgatggtcgcggcggccattggtagatctccgcgttgtgtaacacgttatcagcatctgttacttatgctaagcgctacattattctgacaaattcagaaatgtagttctgtacagatccgtattctttccccggattcctaagtactgtagaacggtgctcgaaatcgctgggtttccacctcctgtcgctattcattcactgaaagatctgctggctggtggagatttgtcagactgaagtatactggaagctcactggcaacagcgggaactcaagcaagcagagttcttgactgacgttgtcatttgttcttcagcttggtaatactggtagttcttgtgaatcatctacacgtcaggtgcagaattctgttgagctagctaggaggtgcaagcatgttgtacgcttctgaatatcaaagtcattgatcctttactaaaaaaaaaaaaaaaaaa

SEQ ID NO: 16684 - DNA, 1951 bp, Zea mays
gtatctgtttcctgactgtaaacttgtgtattataacaggccttctgttgtctattcagacaaccaatcacaaagcacggccaatataacagaggatctttccaagtgtataatcagagaaaatgcacagaagacacagcaatataatgcttcagttgcaaaataaatttccaccccatgttcctcaaggtaaccccctgtgattccgaagaggtcattgcggtttacctgtataaactgatttgttgttaccgtacctcaatctactaaatagtactccctccgttctaaaatagtattcgtcttagctcttgatttttatgtctatattcaactagatgttgatgaatgtagacacggatatatagaatacatacacaaaatattgtatgaatccattaaaaagtcaaaacgaattttattttgggactgagggagtaatacaaatacttttgttggattcagtgacaagatgcatccgtataatagtatttcagcgaaacaaaccattttttggagaatgtagttaactgacgtgctgttgctgacaacattattctaaaaacactgatttgttatatggatggttgcggataacattattgtcaaaatggtttgtttggctgaaattttatttcacggatgcatgttccactgaaataaactgatatattatgcatcctgtatgaactgatgtgttgttgctgataacatgttaagtggaacaattttgcaactctgaacaggcagtttccgttagctgttataaactgatgtgttgttactgtacctcagcctaattatcttctgtttttcttcattaacgttctgttattttggagaacggatacctggcatatatactagacttgctttatgcatgctgattgctgacaggtgccgctgcaaggcctggtaaagcagttgcgttcggtgctgcagtacaacctctctcaagcatctgctgctgagcaatatgagcagcgaagggctgctaggcacccagcagttgccccaaacaacatcccttctggaagctcataccccagaagaaatcagacctgcaagagcgagacaggcgacactgagaggatggacgtgaaccaagctgggcagccgaagccctatgcagcaaacaaactacctgcaactgttgatggtcgcggcggccattggtagatctccacgttgtgtaacacgttatcagcatctgttacttatgctaagcgctacattattctgacaaattcagaaatgtagttctgtacagatccgtattctttccccggattcctaagtactgtagaacggtgctcgaaatcgctgggtttccacctcctgtcgctattcattcactgaaagatctgctggctggtggagatttgtcagactgaagtatactggaagctcactggcaacagcgggaactcaagcaagcagagttcttgactgacgttgtcatttgttcttcagcctggtaggtctaacgagctgaatactggtagttcctgtgaatcatctacacgtcaggtgcagaattctgttgagctagctaggaggtgcaagcatgttgtacgcttctgaatatcaaagtcattgatgtaatctacaagtttgagttctatcttctgattatgtggctactgtattttgtaatttagttaactatactactaagcacttcgtttacgtttataataacaccatggagacgctattggggaagtatatattgttacgccagcttggcaccggaacatgcatctgatcgatggctcagaaaaacagcaaaaccgaagccaagctcccgcagaatccggccaccggagcgttgactcagcacatcgtcagcacgggagggacatactggttccaacgccggtagacatcggtgacgtgtgagccgacggtactgatccgacttcaatgcagggcgactagtcgataggca

SEQ ID NO: 16685 - DNA, 1881 bp, Zea mays
gtcgacctgcaggttcatgaattggataatcatttttttgcatattattgactgctctgttgacgtcaagcatgagataaatggttttgcttgttttgtattgagtaatagattgcttattttgttttgtggaatgatgttgattggttaaccaataaaacactaaataaatttgagactaaattttcattgatctgaatagagttgttctcttatgttttcagtgcagtagataattttaaaaagcagtttgcataccttgaggaacattatgccaagggatctacgggaactccacctgagaggcaacataactcgttaccacggttagatatcactcttgtttctgtcctcaactgacaacagtttgacccacgatagagtatctgtttcctgactgtaaacttgtgtattatgataggccgtctgttgtctattccgacaaccgatcacaaaccacagccaacatcaccgaggatctttccaagtgtatgctcagagaaaatacacagaagacacatccatattctgcttctgttgcaagtaaatttccaccacatgttcctcaaggtaaacacctgcaaccccaaagatgtcattgcgcttagttgtatagaccgatgtgttattactgtatatttgaggtgctgtttggttgagcagttttggcccgtgatcggttcacagaggtaccggatacggtgtatgctgtttggttagattggcctgcaaaggatcatgacgcgatcagatacaatactaggccacacttacttattaccgctcaccacccgacgctatctgctcccgcatcgctcgtattcatctataaaaatgaaaagggaagcactactggagccaaccaaacaaatagtgtatcctgttcccttgtaaccattaccaccggtaaaaaatcccattaccattctcgtaaccaaaacagcactaggtccagtcaagcagcaagttttggattacttatctctttttcttcgataatgttgtattattttggagaactgatatctaccgtacacaataaatctttgaatcatcattattggttctgcataattttaactgctaatcctagacttattttatgcatcacttcatctgacaggtgatgttgcaaggcctggtaaagcagttggttcggtgatgcagtacagcccatgtccagcgcctgctgccgagcgatatgagcaacgaagaatcgctaggcacccagcagttgccccaaacaatatcccttctggaagctcataccccagaagaagccagacctgcaagagtgagacaggtgatgccgaaagccatatggatgcgaaccaagctcggcagccaaagccatatgcagccaacaaactacctgctaccgttgatagtcgtggtggtcactggtaggatttctgcggtgcaccagaaagccattccaaaccgtttcttaacatgttatcagtatcgattacttctgctgagtgctacattattctgacaaatccagaaatgtagttctgtacagatttgtgttctttttccggatacctgaataccgaaagactgtacaactgtagtttctgattcccactccttgtcgctattcaatcactaaaggatctgtccctggtggagaagaaccggcagattcaatgcaatgttcttgactgacgttgtcatggattttgttcttcaacctggtagctctgaagacgaattgaatagctgctagtttctgctaatcatctacagtcaggtgcagagtgttctgggagctagttctgaacatcactgtcacgctgtaatctgcacgttcctgagctcctaacttctaagcatgccactaccgtatccctttgtaatttaatcaggggtaccgag

SEQ ID NO: 16686 - DNA, 722 bp, Zea mays
ttgggtccctcgaggccggccgggccgggaccagcactcgcactcgccgagccaagcaatacacagtagtgagcaatcgtaggcagcgcagcaggatacatagcagttagcaccacagcgagcagctgcccgtacgcacgtacgcttgatggcgatggcgatggcgagcttcgtcgctcagctcaaggacatgttcctcggcctcgtcgaccgcgtcaccggctgccgcggctgtggcggagacaagcaggacgtgccggaggcaaccaagatagcaagcctccagcccgttgagatcaggtcgagagaccccgttgtgggcggaggatccgtggctggggccaattgattgctaatactgccagacaagctgcacgagattgcaaccgcttgctgtggtgttccagcaaattccaagttttttttatttgttctttttcgtcaaaggagttgctcgttccaaaaaaaacgcataatgcttgtgcagtgttattgattgatttctcctctgtgattgtaattgaacccggtatttttttactttttttctttttcgtttgtttctttaattttggcgttaccacattgtgattccgagtgtacgtacatgctgtatcttgccatcttcaagtaaataaacagtaatggtttgactaaaaaaaaaaaaaaaaaaggcccctagggcccccctgctgaagctggtgaagctgggcggcctcatc

SEQ ID NO: 16687 - DNA, 1214 bp, Zea mays
cagacgcgtggcgggcgcccctcgaggcccgcccgggcaggcaagcagatcgtcctgactcctgatggcacaggcacaccaccctcttctcctactaattcttttgctcttcctctcctccactgccattccttcctccaagagaacccagccgaagttctcggccgtcttctacttcggcgactcggttctcgacaccggcaacaacaaccatctccccacggtagctgtggcgaaccatgctccttacggaagggacttcccagggaagaaaccgacggggaggttttccgacggccggcttatcccagacctcctcaacgagaggctgcagctcaaagagttctcgccgccgtttctggacgcaaggctgccgaacagcgacgtcgcgacgggggtgaacttcgcttcggctgggtcaggattcgacgaccagacgtcgcggctgtccaacactctgccgatgtcgaaacaggtggacctcttcgaggactacctgctccggctcagaggcatcgttggggacaaggaggcttccaggatcgttgccagatctctgatctttatcagctcggggaccaacgatttctcacactactaccgttcgccaaagaagaggaagatggagattggtgactaccaggatattgttctccagatggtacaggtttatgtcaaggaactgtatgaccttggggggcgacagttctgtttggcaggccttccgccgtttggctgcacacctatccaaatcacgttgagcggagaccctgacagggcatgtgtggatgagcaaaactgggatgctcatgtctacaactctaaacttcaaagactgcttgcgaagttgcaaggctcactccatgggagcagaattgtgtacgtggacgcatacagagctctcgtggagatcctggagaacccggccaaatatggatttacagagacatcacgaggatgttgtgggactgggctcagagaggtcgctctgttttgcaatgcattcactcctatctgcaaaaatgtgtcatcctatgtattttacgatgctgtgcacccaacagagagggtttacatgttagtaaacgattacatagtcaacgatgttattccacagttttaattaatcaaatacccagataaggttttctcgtaaaaaaaaaaaaaaaaactaattgttttgccttcatacttaagtccaggatacaagagct

SEQ ID NO: 16688 - DNA, 3432 bp, Zea mays
agcaggattatcaatttaatattttcatatacttcaattgaagacctattatgcatccgtagccagtaatacctgttaattcctggattctcagtttgctgttccaaactgaccaagagagcccgataagtgctgcagaaaatttattttggagtacacagtcacgttctgttctgattgcattctaaatttcttatatctacacgattttcttttgttctatgcttccatccattatttatgtttctggaacaggtatacaagcgtttgaagttgacccttgagttagtaaaaaaggagatggagattagtaagctacaggtaatcatattcttatcatccggtcctgcgaacgggtctctagctgagttttttaggtggctctagtaacactcttctggtcctgggttcgattctatatgggagagaattttaggttgggggttaaaaaaatccccgcaacctgtcccacaccaaagcacaagtctaaggtccggctctggttgtggtcgtgttcacatgggctacagtgccaagttcgggggtttcctggacttgtgaaaggtcttctcaacgcagttccccctaggtcgagttttcttaatgtccggtcttagccatcatgttttgtccaatctttttgacgattaatgtgcttctgtttcagcaatccatagcaaaagcaattgaagaaaagattagtggagatcagcgacgttatttattgaacgagcaacttaaggcaatcaagaaggtacttcattatttctgctgctcatacaggttacctatgttccttacattgcagacttagtgccggaggctcccacatgagtggggtttggggaaaggataaaccgaggcaatcccccccccccccccacacacacacaaatacggagaggctgcttcaaacccgtgacctggtgacttagtgagacaggcagaccgctctcaccactgcactaggcctggccttctagtcaaattacttacattgggatagtcaagttactatactgttgtaggatctgttcgtgctgttgtctttaatgaaaagcctgatggccaacaataatccctgactctgtctatgtcatgtattcaggagttgggtttggagactgatgacaaaacagcattgtctggtgtgttcttgaactatgatactcaatgagctttgtatatgcttttaccaaatagctgcacaatgaacataggagatttcaagttgacttattgttcatttgttgcagcaaaatttagagaacgtatagaatcaaagaaggacagatgtcctcctcatgttttacaagtcattgaagaagagcttaccaagcttcagcttttagaagccagctctagtgagttcagtgtaactcgtaattatttggactggctgacagtgttgccatggggaaattatagggttgtattctttgatgtccaccgtgctcagaaaattctcgatgaagaccattatggtttgagtgacgtgaaagagaggatactggaattcatagcagttgggaagttaagagggacttcacaaggcaagatcatatgtctttctgggccaccaggagttgggaaaactagtattggtcgttcaattgcacgtgcactgaaccgccagttctacaggttttctgttggaggtttggctgatgtggctgaaatcaagggccatcggcgcacgtatgttggtgcgatgccagggaagatggtgcagtgtcttaaatcagttggaacagcaaatcctctagtattgatagatgagattgacaagcttgggaagggtcattctggggatccagctagtgcattgttggaactccttgatcctgagcagaatgttaatttcttagatcacttccttgatgttcctattgacctatccaaggttctattcgtttgcacagcaaatgtaatagagacgatacctaatccgttattggataggatggagatcattgctatagctgggtatataactgatgagaagatgcatattgctcgggactatctagagaagaatacaagacaagcctgtggcattaagcctgaacaggttgaagttacagatgctgcccttcttgctcttattgaaaattattgtcgagaagctggagtgaggaaccttcaaaagcatattgagaaaatttaccgtaagattgctctccagcttgttcgccaaggggtatcgaatgagccagaccaggagtctctcggtgtcactgtaaatgaggaatctaatagtggtgatagcatcacagcaaaagatgagattgtgaaggatcctgctgtagaagatgcttcagtcgccaacaatgttacaaatcctgcctctgaggaagctaatgaagtaaatttgacaactgaagcaccaaaagaagacagcacatctaagggcaacaagaaaacagatggagtagcagaagatgcagcagacaaggcaactgagaaggttgtggtagattcatcaaaccttggtgattttgttgggaaacctgtgttccaggctgagcgtatatatgagcagactcctgttggagtggtcatgggtttagcttggactgctatgggtggttctactttgtacatcgaaacaacaaaagtggaggaaagggaagggaaaggtgaccttgtgctgacaggacagcttggagatgtaatgaaagagagtgctcagattgcgcacacagttggcagaactgtattactggagaaagagccagataatcatttttttgcaaactcgaaggtgcacttgcatgttccagcagggtccaccccaaaggatggccctagtgctggatgcaccatgataacgtctatgctgtcgttagctatgggaaagcctgtcaagaaggacctcgcaatgacgggtgaagtaacattaactggaagaatcctcccaattggcggggtgaaagagaagacgattgcggcaaggagaagtgcgataaagacgctcatatttccggcagcgaataaaagggactttgacgagcttgcttctaatgtgaaggaaggactggaagttcattttgttgacacatacagtgaaatatatgatttggctttccagagtgacgccgggactgagatgatttagctttacattacaggattgagattttttccccttctctagatctggttacaggctaaataccaaagaagtttgtcagcagaggcagaccattgtaaccaagatgagtggagttaattgatatttacgagaaagaaaaataatatttctttttttggccccaatataacatcattgaatctaagagatttatttggctaggctgtaaaaaaaaaaaaaaaaaggtggtggtattggccttttatattgttgggacttgggagtgtgggaaaaacagtactggtgcaccatctgttatttattttaagtgttttccg

SEQ ID NO: 16689 - DNA, 3411 bp, Zea mays
tccgccgacttggagaaaccctagaatcaagcgcggaaccgccctcatccaccatgctgcgtgcggctgtggcggcggcggaggagctcaggtctccgctgctcagggtcattgggacgctgagggacggccgcggctcggtgctgctgggtaggagggtgcgtttctgctccaactcttccgcgagcgacaccgaggcggcggtggcagaggcggaggcgaaggccgaggatgcgtccgctgcggagggtgaggcggacagcaaggcgtcttccgccatcgtgccgaccagcaccaatatcgatgattgcctctcggttatagcgttacctcttccacatcggccactctttcctggattctacatgccgatcaatgtgaaggaccaaaagctgctgcaagccctaatagaaaatcgcaaaagatcagctccgtatgctggtgcctttcttgtgaaagatgaagaaggtactgaccctaacatcgtgactggttcagattcagcgaaaagcattgatgatctcaaagggaaagacttgctgaagcgtcttcatgaagttgggacgcttgctcagattacaagcattcaaggggatcatgtagttctacttggtcaccgacgtttacggataactgagatggtcgaagaggatccacttacagttaaagttgaccatctaaaggaaaagccctacaacaaggacgatgatgttatgaaagctacatcattcgaagttatatcaactttaagggaagttctaaggacaagttccctttggaaggatcatgtgcaaacctacacacagcacattggtgactttaactaccaacggttagcagactttggtgctgctatctctggtgccaacaagttgctttgccaggaagttcttgaggaattggatgtatacaagcgtttgaagttgacccttgagttagtacgttgctgtcgggagattagtaagctacagcaatccatagcaaaagcaattgaagaaaagattagtggagatcagcgacgttatttattgaacgagcaacttaaggcaatcaaaaaggagctgggtttggagactgatgataaaacagcattgtctgcaaaatttagagaacgtatagaatcaaagaaggacaaatgtcctcctcatgttttacaagtcattgaagaagagcttaccaagcttcagcttttagaagccagctctagtgagttcagtgtaactcgtaattatttggactggctgacagtgttgccatggggaaattatagtgatgaaaacttcgatgtccaccatgctcagaaaattctcgatgaagaccattatggtttgagtgatgtgaaagagaggatactggaattcatagcagttgggaagttaagagggacttcacaaggcaagatcatatgtctttctgggccaccgggagttgggaaaaccagtattggtcgttcaattgcacgtgcactgaaccgtcagttctacaggttttctgttggaggtttggctgatgtggctgaaatcaagggccatcgacgcacatatgttggtgcaatgccagggaagatggtgcagtgtcttaaatcagttggtacagcaaatcctctagtgttgatagatgagattgacaagcttgggaagggtcattctggggatccagctagtgcattgttggaactccttgaccctgagcagaatgttaatttcttagatcactaccttgatgttcctattgacctatccaaggttctatttgtttgcacagcaaacgtaatagagatgataccaaatccattactggataggatggagatcattgctatagctgggtatataactgatgagaagatgcatattgctcgggactatctagagaagaatacaagacaggcttgtggcattaagcctgagcaggttgaagttacagatactgctcttcttgctctcattgaaaactactgtcgagaagctggagtgaggaaccttcaaaagcagattgagaaaatttaccgtaagatagctctgcagcttgttcgccaaggagtatcgaatgagccagaccatgagtctgtcagtgcctctgtaactgaggaatctggtaatggtgataacaccacaacaaaagatgagattttgaaggatcctgctgtagaagatgcttcagtcaccaacaatgttacaaatcctgcctccgaggaagctaatgaagaaaatttgacaagtgaagcagcaaaagaagacagcacatctaagggcaacaagggcactgatggagcagcggacaaggcaattgagaaggttgtggtcgattcatcaaaccttggtgattttgttgggaaacctgtgttccaggctgagcgtatatatgagcatactccagttggagtggtcatgggtttagcttggactgctatgggtggttctactttgtacatcgaaacaaaaaaagtggaggaaagggaagggaaaggtgcacttgtgcttacaggacagcttggagatgtcatgaaagagagtgctcagattgcgcacacagttggcagagctgtattactggagaaagagccagataaccatttttttgcaaactcgaaggtgcacttgcatgttcctgcagggtccacccctaaggatggccctagtgctggatgcaccatgataacatctatgctgtccttagctatgggaaagcctgtcaagaaggacctcgcaatgacgggtgaagtaacactaaccggaagaatcctcccaatcggcggggtaaaagagaaaacaattgcggcaaggagaagtgcgataaagacactcatatttccggcagcgaataaaagggatttcgatgagcttgcttctaatgtgaaggaaggcctcgaagttcattttgttgacacatacagtgaaatatatgatttagctttccagagtgacgccgggacagaaacaagctgagatgatttagctttatgggattgagattttttccccctagacccacgacagaaacaagtccgtcaagaggcaggcaaaccagaccattgtaaccaagatgggtggagttaattgatattcacgagaaaaatgaaatcctttttttttgcccccaatataacatcattgaatttaagagatttttggctaggttgtacgtactagtgtggttgcccatctaggtggtatagcctatattattagtaggaataagaaaagcagcatggatgcaccatctgttatttatatttattgatttaagagtgttctctaaaagcagcaggtatgccccagttgttattcattaaatttgtttcagtgagtgttagttacctttggatactgtactgtgcgtcatcaatttataggatgttttgattttttttggatacacaaaaaaaaaaaaaaaaaaaaaaaactcgag

SEQ ID NO: 16690 - DNA, 1047 bp, Zea mays
  misc_feature (184)..(184): n is a, c, g, or t
tttttcacacacacacacacacacaaggggggggggggagcggaattaagccagctcgtggcgcaatccgaacacgctctgccagtgcctgggaaggataagcgcgtcgtgtttagtttactgttgtgtgcccaagtgatccagtccacaggctcaggctctactgctctaggaggagggtgantgaggagctctgcagccagtgacccctgtcggcggcggtagcttaaagcggcccgccaggcgccggccggtcggactcctctgcaataaagccatcgggggagtgactgactgagtcagtgagtgggtgtgaggagagctttgaggggaggggagctagctagctactgcctactggaggagggcttcctccgacgccggacatgggggaggtgaagcacctgtgcctggccaagttcaaggagggcgtcgtggtggacgacgtgctcaagggcatgaccgacctcgccgccgggatggacacggtcaagtctttcgagtggggccaggacgtgctgaaccaggagatgctgacgcagggcttcacgcacgtcttctcgctcaccttcgcctccgccgccgacctcgccgcctacatggcccacgacagccacaccgcgttcgccgccaccttcatggccgccatcgacaaggtgctcgtcgtcgacttccccgtcgtcgtcgccaagcctccgccgtcggcatgacccgcttgccgctctcgcatccgccggccactgtacgcctccccttttcaggtctcgcagcagatccacgtgtgcctgcggcggtgcggccgccgtgctggtagtagtactagtactgtctattgcctattgcctgttatgtatgttctatctaccacgtacctacctactactattgtttggttatcttcggaataaattttcggtcacttttatggtagcatatatctagcggctagctgcttgcgatacaccctttccgatgtttatgatggattgtcagattcctaatcgacttttagttttcttgttaagaaaaaaaaaaaaaaaggcccta

SEQ ID NO: 16691 - DNA, 2171 bp, Zea mays
tggagtacccctaattacgatacccgacacttatagagtagtaaatattaatgcaccattttttttggcaatcccaactggcccttggacgtgcacagattctgggcatacagaaaaggttgaaagaacggggaagaaaaatctgtacatagcatcaagaacctacacaagaaatgttccagcaaactgggaatagatcaaaggtaggtgaaacaactacatttgcctaaagcaatcctgattcctgagttcctgaccactgacccttcctctctctactgcaagccgtggaatgcccatcgagaggaaccgaatccattctcgcctccaaactcctaaatttctttctcggatccacctcatgtttcacgattgatccgtccgagttctctgctgcacgtctgcacccactcatcaatcccgtcgattcatgctccgaacgaattgttggagctgtccatggacttgaggtccttgtacggcaccggcaccagttcctgctccatcccagctcgtccctgcttcctcctctcccgaatctggtacccgatgcaagctccggccgcggccaggccgaccaagaccagcgacagcgccgccgtggctgcggcgacgcccggcgacagcgacacgcccggccgtgcaggcggcttcctgaccttgaagtagcccaccttccggtcgtcggcctcgtacaccagcgtctccacggggaagtcgatgaggtagcagtagccgctcgcgccgctgtgcacagcggcccagcagctgcagttgccggcgcacgccgcctcgcactcctccgccgtcctgttcgtctcgaacggcagctcctccttgtacgccacggacacccgcttccgccgcaccacgtggaaccccagacccagttgattgccggcgcaaaggtcggcggtctcctctgcgtggcacgatggggcggcggtgctcgtgctgttgtcgaggcactggcactcggccttccgggggacgcacaggccgtacgcgccgcacggcgtcggcaggtcgcaccgctccgcgatggccctgtagtccgacgcccacgccttggagccgccggcccagtagtacgcgcggaggttgccgtcgtcgtccagcgtcatccgccggaacgcggcggtgaggttctgcgcgaacgtgtcgaacgagagcacgtccaccctctgtccgccgccctcgaggtacaggccgaagaacccgcgggcgtcgaggctgccgtacaccggcggctccgtggcgttctccggctgcgccatcagggccgtgtgcctccagtacgccggcgccgtctgcccgccgtagaactccatgtgcagcgccatgtacgccttgccgagccgcagcgcgaaccggcggttcgcggagacgagcggcggcgaggaagccgtgaagttctgccccaggacgagcgtgtcggacgggtggcggaagctctcccactccggcagggtcttctcgtaccgccgcacgacgaggttggaggagttgagcagcacgacgacgtcgccgacggcgccgagcgtctgccacagcacgccgccgtcgtagccggtgagctccaggccgccgtcgaacgtgaacgtggccgggcgcgaccagtccccgaggcgggccggcgtggcccgccagacggggaaggaggacgggaggtggaccacggcgaggtcgagcgaccccgcgccgacgcggaggaagccgagcgcgaaggcgccgctgggcgcgtacagcacgggctggaacggcgccggcgcgcccgccgcgtgcgccgcggtgaagccgttcaagagctgcgtcgtgggctcctctccctcggtggcgccgtcgaccaggcccaggagcaccgccgacgcgacacagagcacgccgatggcggcggcggcggtgatcgccggatcacctcggcacttcattgcggcgcagacaaaggccttgatggaggtcaaatgtctggagatcaagggagtattgcccccggcatagtgtattactaggattagccgattagtagtacattattggcataggcattttggggaaggtcaactgtgtgcacgcagattttgcaatataaaaggattcagatgcatagatgaacataaaaaaaaaaaaaaaaaaaagcggaatcagctcctttgccgtgtgttctaaac

SEQ ID NO: 16692 - DNA, 647 bp, Zea mays
ggaccctcgcgcccggccgatcggactcctctgcaaataaagccatcgggggagtgactgagtgagtgagtgagtgggtgtgaggagagctttgaggggaggggagctagctagctactggaggagggcttcctccggcgccggacatgggggaggtgaagcacctgtgcctggccaagttcaaggacggcgtcgtggtggacgacgtgctcaagggcatgaccgacctcgccgccgggatggacacggtcaagtctttcgagtggggccaggacgtgctgaaccaggagatgctgacgcagggcttcacgcacgtcttctcgctcaccttcgcctccgccgccgacctcgccgcctacatggcccacgacagccacaccgccttcgccgccaccttcatggccgccatcgacaaggtgctcgtcgtcgacttccccgtcgtcgtcgccaagcctccgccgtcggcatgacccgcttgccgctctcgcatccgccggccactgtacgcctccccttttcaggtctcgcagcagatccacgtgtgcctgcggccgtgcggccgccgtgctggtagtagtactagtactgtctattgcctattgcctgttatgtatgttctatctaccacgtacctacctactactatt

SEQ ID NO: 16693 - DNA, 936 bp, Zea mays
ccacgcgtccggcgcgtcgtgtttagtttactgttgtgtgcccaagtgatccagtccacaggctccctctctccggctcaggctccaggacgagtgatgagctctgcagccagtgacccctgtcggcggcggtagcttaaattggccaccatgtcgccacgatccatcggactcctctgcaaataaagccatcgggggagtgagtaagtgagtgggtgtgaggagagctttgaggggaggggagctagctagctactggaggagggcttcctccggcgccggacatgggggaggtgaagcacctgtgcctggccaagttcaaggacggcgtcgtggtggacgacgtgctcaagggcatgaccgacctcgccgccgggatggacacggtcaagtctttcgagtggggccaggacgtgctgaaccaggagatgctgacgcagggcttcacgcacgtcttctcgctcaccttcgcctccgccgccgacctcgccgcctacatggcccacgacagccacaccgccttcgccgccaccttcatggccgccatcgacaaggtgctcgtcgtcgacttccccgtcgtcgtcgccaagcctccgccgccggcatgacccgctggccgctctcgcatccgccggccactgtacgcctccccttctcaggtcgcgcagcagatccacgtgtgcctgcggcggcggtgctggtagtagtactagtactgtctattgcctgttatttatgttctatctatctatctatctatctatctacgtcacgtacgtacctactattattgtttggttatcttcggaataaattttcggtcacttttatggtaaaaaaaaaaaaaaaaaaagctggttgcaatcccccctttccgatgtttatgatggattgtcagattcctaaaaaaaaaaaaaaaaaaaaaaaaaaaaaaaa

SEQ ID NO: 16694 - DNA, 1516 bp, Zea mays
tgaatccaatgcgacgacgacgacgacgccgcccagtcggtctctgatgaacctgagattacctacctgatcttgctactgccagggcgcgcgatcaacattccatttgacactggtaactgttggcggtggtgcacagtgctgactgacggacctgcctgtcatccagggtcagggtacatggagatgaggatcttggatggatgggggagaggggcctgcatctgcatcagagccagagggaggcgggcgaggggggaagcaagcaaagcatgcggtgctgggctgccctgcccacgcagcgtcgtacgctcgtgtcggtcgccggcccagtcgaatggaatgaatgatgactctctcacccgtcccagatctagccgcgtcagcgcgcacggaaccgctcctttctttttcttttttttttcacctccctcccttgctctcccgtgcgtgcactgacacacacacacacacacacacaagttggttggtgagcggaattaagccagctcgtgacgcaatccgaacacgctctgccagtgcctgggaaggataagcgcgtcgtgtttagtttactgttgtgtgcccaagtgatccagtccacaggctcaggctctactgctctaggaggaggaggagtgatgagctctgcagccagtgacccctgtcggcggcggtagcttaaattggccaccatgtcgccacgatccatcggactcctctgcaaataaagccatcgggggagtgactgactgagtcagtgagtgggtgtgaggagagctttgaggggaggggagctagctagctactgcctactggaggagggcttcctccgacgccggacatgggggaggtgaagcacctgtgcctggccaagttcaaggagggcgtcgtggtggacgacgtgctcaagggcatgaccgacctcgccgccgggatggacacggtcaagtctttcgagtggggccaggacgtgctgaaccaggagatgctgacgcagggcttcacgcacgtcttctcgctcaccttcgcctccgccgccgacctcgccgcctacatggcccacgacagccacaccgcgttcgccgccaccttcatggccgccatcgacaaggtgctcgtcgtcgacttccccgtcgtcgtcgccaagcctccgccgtcggcatgacccgcttgccgctctcgcatccgccggccactgtacgcctccccttctcaggtcgcgcagcagatccacgtgtgcctgcggccgcggtgctggtagtagtactagtactgtctattgcctattgcctgttatgtatgttctatctatctatgtccacgtacctacctactattattgtttggttatcttcggaataaattttcggtcacttttatggtagcatatatctagcggctaaatgctgcttgcaatacaccctttccgatgtttatgatggattgtcagattcctaatcgacttttagttttcttgttactggctcctggttaaacaaaaaaaaaaaaaaaa

SEQ ID NO: 16695 - DNA, 6212 bp, Zea mays
gggaaaccataaagcacggccccgttaggagctagtattttggtaccgtaaaggttgccattaaggattttattgcgttttcagtaccatattacttgtcgtcctcgaatttttggtggcttgtccttgaggatttgggtgcctacataaaagaaaatggtgcgaccgtttagtaccagtgccttgcctgttatgctctgctggtgctggatattgacaaccgaatcatttcggtgcctacatagagaaaatggttcgattgttcagtacactgtcttgcctgttatgctctgctagtgctgggtatcgacgattgaatgaatcatcacgtcgatgtgggatgtgtagctggtctccctggagacgatagggacgaatgctgaggcgttgttatcgagtagcctagcctcatctgtgcttgacgaacggggaacagggggactgggttaccacaagtcctctgtctgaatgcgaagcggtcactatgtatgtgtcctcttgatcgagctcgaaacgttcagacgaaacatgagcctgaaaagatcctgtcatggcgagtagatgtttgatgtttcatccccatagctcgcacgaatttgacttgtcttatttgtacctttggctccttacctttagctacactgaaaattcacatggacaacagaccatgggatggtgaactgtttcgctggccctggaacttaactgaaccacctctctgttggtaaactggcaggtgcgtcatctgtctggcggaatacgaagagggagacgggctccgcgtgctgcctccctgcagccacaccttccacacgggctgtatcagcctgtggctggcgcagaactcgacgtgcccggtctgtagagtctcgctgctcgtgcctgatactagtactacccctgaaagcgaacactctgcaccccatcctcctcctcctcctcatcatcatcatcatctgtccagcatagtgataataagcccaccaagctcccccgaaccgtcgagatcggacccgtgccgatgcctgttcgccagcggtggtgggcactcgtcaagggcggcagaggctcctcctcctcctcctcctcccagacacgagcccgaccaggtcgtatctggtccaccaccggcagcagatggggctagcggctacagctcgccgttgcctgaagttattcaccccgctcctgctcctgaaaccaacgggcagacagtacggaagcaggcgggcagcagatctactaccccgctaggcccctgcaaatagcggccgctcactctgtgtgggtgggtggggtgaacaggtggtgcgtggtaaaagcgaagtagagagaaacaagcgacttgaagaggcctgggttcgttcgtgtacatacgatcgagaaatcgtttcaggtcattcattcatccattcattcatccatgggcacatactgtggtattacggagtattacggtgtacgtgtagtgtgccgcaggagagacgacgcgacggcagcagtgcgttttccatatgcgacgggacgggagcattcgaggagatgatggcaatggcatggttttgtgtactgtacggtaacatttgtcgctgggaattaataataaaaaacccgtggctggctgatgcagcaaaaaaaaaaaaaaaagccagccaccccggcgacctcgtcggcgcccccggccccagcgtgatcagtcgccaccttgtcagcttgtatccctctgctgtaggctgtagtaccatgtggtctgaatccaatgcgacgacgacgacgacgccgcccagtcggtctctgatgaacctgagattacctacctgatcttgctactgccagggcgcgcgatcaacattccatttgacactggtaactgttggcggtggtgcacagtgctgactgacggacctgcctgtcatccagggtcagggtacatggagatgaggatcttggatggatgggggagaggggcctgcatctgcatcagagccagagggagccgggcgaggaggggggaacaagcaaagcatgcggtgctgggctgccctgcccacgcagcgtcgtacgctcgtgtcggtcgccggcccagtcgaatggaatgaatgatgactctctcacccgtcccagatctagccgcgtcagcgcgcacggaaccgctccctttttttttcccccacacctccctcccttgctctcccgtgcgtgcactgacacacacaagttggttggtgagcggaattaagccagctcgtgacgcaatccaatccgaacacgctcttttgcctgggaaggataagcgcgtcgtgtttagtttacagtggtctcgtttggaagttcttcactctctatagactcgatagctgattctctactaatgtaatttcaagtgattctctagtaaagtgattctctagtaaaagtaaatttaattgataaaaaccgtttgataaataagatgtgaagtgcttgaacagttagtggggagtaggttgagacttgagagcggtggaaagctgatttttttggctctcactttctagtataaaatagaaactagattaactctactttcatcatagagtaatttagatttttaccggtttgactctggaggagtaattctgggagcggagctgtgagctctgcaaaacggctcctgtgtgcccaaatgatccagtccacagactcaggctcaggctctaggacgagtgatgagctctgcagcccgtcacccctgtcggcggcggtagcttaaattggccaccatgtcgccacgatccatcggactcctctgcaaataaagccatcgggggagtgagtaagtgagtgggtgtgaggagagctttgaggggaggggagctagctagctactggaggagggcttcctccggcgccggacatgggggaggtgaagcacctgtgcctggccaagttcaaggacggcgtcgtggtggacgacgtgctcaagggcatgaccgacctcgccgccgggatggacacggtcaagtctttcgagtggtacacactacacacccacccgtttcttctccactcttgaccttccatcatccttccttccttcattgcttcccttctgtgaaagcaaaatccgccgaacaaacgcgtgcgtgcgtgcaggggccaggacgtgctgaaccaggagatgctgacgcagggcttcacgcacgtcttctcgctcaccttcgcctccgccgccgacctcgccgcctacatggcccacgacagccacaccgccttcgccgccaccttcatggccgccatcgacaaggtgctcgtcgtcgacttccccgtcgtcgtcgccaagcctccgccgccggcatgacccgctggccgctctcgcatccgccggccactgtacgcctccccttctcaggtcgcgcagcagatccacgtgtgcctgcggcggcggtgctggtagtagtactagtactgtctattgcctgttatttatgttctatctatctatctatctatctatctacgtcacgtacgtacctactattattgtttggttatcttcggaataaattttcggtcacttttatggtagcgtatatctagcggctagctgcttgcaatacaccctttccgatgtttatgatggattgtcagattcctaatcgacttttagttttcttgttactggctcctggttaaacaacagcagatttctcagagcattgaggattcagaacataaaccctgatatatctcggggttgaaatgagccgagctcatataacaggacaagctcggtttggattggtcgctcctttaatgagtttgaaaagttgactcgcttacgactcgttagccggcttctcgagccaacgatatttgaaattataatataaaattttaaaaatattttaaataccatattttgaaattagtaaaataaatatattactaatataatatagttatagatttattataggtagaaacttcaaaaaactataaaataattgtggtactaacattatatgttaattatgattttatataacaaattattgttgagtcgattcacaagcgagttgtgagtcgagtcgagttaactcgctcttttcaactcgggcttgttctgagtatcgagcgagccaagcgaagctgctacgagcttgatctttttttctcgacctattctctagttagatgatggtgggcatctgcccgccctgctgcgaggttaaaaatattgcgatttgcgacggagacaggtgggtggagtggttttgtagctctcctaaataaaataaattattttactcttttaaaaacctgttttaggttttctagaaataattttcactgacgattttattacgccgattaccttagagcatctccaagagactagctgaatagttcattaagttaaattttgattaatcagcagcaaaataattctccaacagactagctatctgactcgtcaacctatccgactcttcaaattggctcccttgctagttaaatttggctagccacctaactagccaaactaaatagatagtctattggagtgaaatgttatatataaagtgtaatctgtatgaagagataaatagagagttaaatagagtgccaaaaataaaaaatctcttggagatgctcttagttatccgtctgaaaaaataatgatttctactaatccctaatagtgacagttatgaaaaacgatagtgtaaatagttttacagtcgccactatagagtttctgtatagcagtctactagtgtgtagaactgaaacgagtgcagaatcacttgtttttttttggtcatacggaccattttcacgtacggtagaaaataacagcacggcgggacgccacacgcctgccagtgcgcggacgaggagtccattccttgctcgcggtgacgttggctgaaatttgtggtgctgggccgcgtgctgcgtgcttcactactttccatcccatgccatccacaacgacgtatagaaaaaaaatttcaagaaataaaaggcaaaataaaatttaaaagtaattctcgttatgggcctagaatatgcagttaaaatggtctagaacaaaattgaagaaagtaattctcgttatggaaccgttgcctggaatgattcatggaacgattcaagacagattgtttgcaaatttacataacactctgtttggatgttggaattggaggatatggaattaaattgggtttgattccaaatcagctatgagattgaaatgagatacaattacaattctaatgtttcgatcaaatagatgtttggattcttggatagaacatcatctaaatcaaatctattttgcatttatatagaactctcagaattgcgccaccgtaagaagctatttttcatccaatagatcaatatgcaacggaagtttagtctgtcatcgattctttcggtgctttacttttaggctagttcgagagccacaaaattggagaaaattagagagactaaaataatctcctcattcaattttcaataaggatgagattttggcttctccaattctccagatttttggactcccgaactgaggatctgaggtacctggatggctggattcattttcgtctccagactctgcaattcatcaaggagaggaggcctgggcctatgatcaatctcacgttgtgcgactagcaaatgactcatccaactccactccagtgcgcttgaccttcaacttcaaccaacactctcatggttgggttcatgctttgaacgaattgttagagctggccatggacttgaggtccctgtacggccccggaaccagctcctgctccatccccgctcgtttcctcttcctcctctcccacgtcctgtagccccagtacgctccggccgcagccaggcctgccaggaccagcgacagcgccaccgtcgcggcggtaacgcccggcgacatgcctcgccgcgccgagttcgctgtcgccgccttcctgatcttgaagtagcccagcatccggtcgtcggcctggtacaccagcgtctccacagggaagtcgatgaggtagcagtagccgctcgcgccgttgtacagcgcgccccggcaggtgcagttgcccgcacacgccagctcgcacccgtccgccgtcgtgttcgtccggaacggcagctcctccttgtacgccacggacacccgcgtccgccgcaccacgtcgaaacccagctgccgc

SEQ ID NO: 16696 - DNA, 622 bp, Zea mays
attccttgatgcatcagtcgatgggggagggagctttggaacgtgcaatacattcttcattccttgtttcggcggacatggctcatgctctgcacccgaactatgccgaaaagcatgaagagtgccacagaccagaactacagaagggacttgtcatcaagcacaatgctaaccaacgttatgccacaagtgctgttacagctttcctcttcaaagaaatagcaaggattcataatcttcccgttcaggaatttgttgtgaggaatgatatgggatgtggctccactattggacccatacttgcttctggtgttggcatacggactgtagactgtggtatccctcagctttcgatgcacagtgtacgagaaatgtgtggtaaagaagatgtggacacaacatacagacacttcaaagcttttttcgagatgttttctgatatcgataggaagttaaatgtagatttttaagtccaaatccttatctttttttcaggtttgaataattagtggaaactaaaactatgattgtcaagcatagtatcaatctatcaaactcatattctgaatttttttagttgataaagaggacgacgaattagcaaaaaaaaaaaaaaaaaagc

SEQ ID NO: 16697 - DNA, 483 bp, Zea mays
  misc_feature (450)..(451): n is a, c, g, or t
gacgacactgcacacctctcaccagtccccacacggccacaccacactccagctgtccccatcgcgcgcacactctctcggtctctccctcccagtcccagcgtttgcggtccagtccagagagctcgagcagccatggcggctcccctgttcctcctcctcctgctgctggctatgttcacaggctcaggtgagcgagctctccggatctgcatgctgctccctgcggcgcttaacgtttgtgtgagaagatgagcagacgcggcgttctgcgtgtgcaagacgggcgtgcccgaccaggcgatgcaggcggcgatcgactacgcctgcgccaagggggccgactgcgcctccgcctccaagggcgcgccctgctacggcaacggcaacaaggtggccgtctgctcctacatctgcaacagctactaccagagccgcagcgccacgggnncacctgcgacttcaacggcgtcgcacgctcac

SEQ ID NO: 16698 - DNA, 1587 bp, Zea mays
aaagagaacagacggagatgactcaccgagtcaccggcctgggctttaccctcacaggccacagcgacgccagatagcgaaatcgagccgttggcgtccggacacgggcgggctcttctcccaaagggccaacggtgcgcccactccggtcagtcactgcacggccgcgcgacggtgttcgttcgcagtcgctgcaaagaaaatcgggggaaatcaagcgccgcttcagcgtgcggtcgctgtttcgtccataaaaggagggaggaccccccgggccgcccggcgacactgcacagcactcccccagttcagtccccacaccgagctgtgcccatcgcgcacacacacacacacacacacactctctctcccaccgttcacggtccagtccagagagctcaagagctcctgcagccatggcggttcccctgcttctcctcctcctgctgtccgtgttcacagcctcagatgcggcgttctgcgtgtgcaagccgggcatgtccgaccagatgatgcagtcggccatcgactacgcctgcagcaagggggccgactgcgcctccaccaccaagggcgcgccgtgctacggcaacggcaacaaggtggccgtctgctcctacatctgcaacagctactaccagagccgcagcggcatgggcgccacctgcgacttcaacggcgtcgccaccctcaccggcaccgaccccagctccgggacctgcaagttcgcctccgggcccagcagcgtaggcaccggcggcggcgctggtatgggcaccggcggagcaggcgctggcgtcggcggtggcacgggcgccggcgccggcactggagcaggcacgggcgcgggcatgggtgccggcgctggaaccggagcaggcacgggcatgggcgccgggacggggaccagcaccggagctggcgccggcgccgggatcacgacccccggggccctgagcccgccgttcggcggcacgggcgcctacggcccggcaggagcaggcagcaccgactacaacgacgctgcggcgccgcgcgtctccaggctgcacgtggtggccgccctcggcctcggcctcgccgccgccgccgcacctctcctccgctaggaggtgtaagtgggagggagggggcgggcacgacacgcgcagtggatcccgctgtctggcgtgcgtgcgtgcctgcgcctgcgctgggttttgatcgatcagccgtcgtcagcgtagcgtggcgtggtttagtagcagcacggggtttactgttattcaactgaccctcttgtccttccccgtgctagtggtggtggctgccatgtgccatgtggtttggtgctctgtactagtggggtagtagagatcctagggattcttttggtagttccggacatacgtgtcgtcgacgtgttcttcagtcgtttttttctctctatgttttgttccttgtgcctccgttgtgttaggctgtgtttttactagaactatgctagtgtctggtggcggccgctttccatgaaaaaaaaaaaaaaaatgtaccttgccacgtttggatccttgatgcagtcgggatcacatgcccagcatgatgctg

SEQ ID NO: 16699 - DNA, 1298 bp, Zea mays
acgacgcaacactggcaggggccgaggaggaggaagatcaggacaattattcgtttaccaccaccacttgcgggccccccgcgaccggcgggcccgccggacgacactgcacacctctcaccagtccccacacggccacaccacacccagctgtccccatcgcgcgcacactctctcggtctctccctcccagtcccagcgtttgcggtccagtccagagagctcgagcagccatggcggctcccctgttcctcctcctcctgctgctggctatgttcacaggctcagacgcggcgttctgcgtgtgcaagacgggcgtgcccgaccaggcgatgcaggcggcgatcgactacgcctgcgccaagggggccgactgcgcctccgcctccaagggcgcgccctgctacggcaacggcaacaaggtggccgtctgctcctacatctgcaacagctactaccagagccgcagcgccacgggcgccacctgcgacttcaacggcgtcgccacgctcaccggcaccgaccccagctccggcacctgcaagttcgcctccggccccagcagcgcaggcaccggcggtggcatgggcgctggcgcgggtaccggcggtggcatgggcgctggcgctggcaccggcgccgggacaggcgttggcaccggagcaggcacgggcatgggcaccgggacggggaccagcaccggcaccggcgccggcgcaggggtcgcgacccccgggagcgccctgagcccaccgttcggcggcactggcgcgtacggcccgtcaggggcaggcagcacggactacaacgacgccgtcgccccgcgcgccgccgggctgcacgtggtggctgccctcgctctcgccgtcgccgtcgccgcacctctccaccgctaggggcggtgccatggcaactgggagctggcgggcacgacactcgcagacgggatcccgcctcggcggcccgccagcgcgggctctggtcgatgtccggcgttagtgcgtgcgcgtacctgatgaagtgatgatgggttttgatcgaccagccgtcagcgtagtgcggtcacggggtttacagtgttattcgaactgacctctctgcttcctcgtgctagtagtggtggctgccatgtgtgtgtgctgctggtagagaactagggattctttttttttcttctgtcgcttccttgcttatatgtcccgtcgtgttaggctgtgtttactatgcagtgtttggtggtggccgctttccatgagaatatttggtgtgcgcgctcgggggccccggcccgtttggcc

SEQ ID NO: 16700 - DNA, 1375 bp, Zea mays
aacggtgcgcccactccggtcagtcactgcacggccacgcgacggtgttcgttcgcagtcgcggcaaagaaaatcggggaaaatcaagcgccgcttcagcgtgcggtcgctgtttcgtccataaaaggagggaggacggcgcggaggccttgacgacactgcagaccactccccagttcagtccccacaccgagctctgcccatcgcgcgcacacacacactctctctcccaccgttcacggtccagtccagagagctcaagagctcctgcagccatggcggttcccctgcttctcctcctcctgctgtccgtgttcacagcctcagatgcggcgttctgcgtgtgcaagccgggcatgtccgaccagatgatgcagtcggccatcgactacgcctgcagcaagggggccgactgcgcctccaccaccaagggcgcgccgtgctacggcaacggcaacaaggtggccgtctgctcctacatctgcaacagctactaccagagccgcagcggcatgggcgccacctgcgacttcaacggcgtcgccaccctcaccggcaccgaccccagctccgggacctgcaagttcgcctccggccccagcagcgtaggcaccggcggcggcgctggtatgggcaccggcggagcaggcgctggcgtcggcggtggcacgggcgccggcgctggcacgggcgcgggcatgggtgccggcgctggaaccggagcaggcacgggcatgggcgccgggacggggaccagcaccggagctggcgctggcaccggcaccggcgccgggatcacgacccccggggccctgagcccgccgttcggcggcacgggcgcctacggcccgtcaggagcaggcagcactgactacaacgacgctgcggcgcggcgcgtctccaggctgcacgtggtggccgccctcgtcttcggcctcgccgccgccgccgcacctctcctccgctaggaggtgtaagtgggagggaggggggcgggcacgacacgcgcagtggatcccgctgtctggcgtgcgtgcgtgcctgcgctgggttttgatcgatcagccgtcgtcagcgtagtagcagcacggggtttactgttattcaactgaccctcttgtccttccccgtgctagtggtggtggtggctgccatgtgccatgtggtttggtgctctgtactagtggtagtagagatcctagggattcttttggtagttccggacatacgtgtcgacgtgttcttcagtcgtttttctttctttctgttttgttccttatgcctccgttgttgtgttaggctgtgtttttactagaactatgctagtgtctggtggcggccgctttccacgcaaaaaaaaaaaaaaaaaaaaaaa

SEQ ID NO: 16701 - DNA, 1426 bp, Zea mays
  misc_feature (1400)..(1403): n is a, c, g, or t
  misc_feature (1409)..(1409): n is a, c, g, or t
  misc_feature (1418)..(1420): n is a, c, g, or t
gcacgagaccattacctagaacatcctaatcgaaaaggatctgcatgctgctccctgcggcgcttaacgtttgtgtgagaagatgaggtttctgtctagctctcttctgcctgcctgcctttctttgtatcccccttgtcagcttcgaaacttctctgctcatgagctatggccagtcctgctgccactgtagatttttttaagtgcggaggaaatctcttccccccccccctccctccctggttattgtgcatacatagctatcctgctgaacgaagcacaaataaatacaaaccaagaaacgccagtgctttctcgatcacgtactggcacgagctagcgagcagactcactcgaacacacactgaccaaccgctcctctctccttccgttccgtcattccgtgtgcagcagacgcggcgttctgcgtgtgcaagacgggcgtgcccgaccaggcgatgcaggcggcgatcgactacgcctgcgccaagggggccgactgcgcctccgcctccaagggcgcgccctgctacggcaacggcaacaaggtggccgtctgctcctacatctgcaacagctactaccagagccgcagcgccacgggcgccacctgcgacttcaacggcgtcgccacgctcaccggcaccgaccccagctccggcacctgcaagttcgcctccggccccagcagcgcaggcaccggcggtggcatgggcgctggcgcgggtaccggcggtggcatgggcgctggcgctggcaccggcgccgggacaggcgttggcaccggagcaggcacgggcatgggcaccgggacggggaccagcaccggcaccggcgccggcgcaggggtcgcgacccccgggagcgccctgagcccaccgttcggcggcactggcgcgtacggcccgtcaggggcaggcagcacggactacaacgacgccgtcgccccgcgcgccgccgggctgcacgtggtggctgccctcgctctcgccgtcgccgtcgccgcacctctccaccgctaggggcggtgccatggcaactgggagctggcgggcacgacactcgcagacgggatcccgcctcggcggcccgccagcgcgggctctggtcgatgtccggcgttagtgcgtgcgcgtacctgatgaagtgatgatgggttttgatcgaccagccgtcagcgtagtgcggtcacggggtttacagtgttattcgaactgacctctctgcttcctcgtgctagtagtggtggctgccatgtgtgtgtgctgctggtagagaactagggattctttttttttcttctgtcgcttccttgcttatatgtcccgtcgtgttaggctatgtttactatgcagtgtttggtggtggccgctttccatgaaaaaaaaaaaaaaaaaaannnnaaaaangaaaaaaannnaaaaaa

SEQ ID NO: 16702 - DNA, 724 bp, Zea mays
  misc_feature (714)..(714): n is a, c, g, or t
taagccaacgtggtggcatcatcaaggtccatatggtcctcaactctacatcaccagggaggattgcagatcacggctctagtatttctgagcctttgcttaaagataccataccggccacagcaaatggacacggcgttgactgcagccagcagcaacaggtggttgcctctgaagaaacggtcgttgtactggttaacaataacgaccatttcaccagtttgaagcccgctgagtcaggcgtcacatcacaagaaggttcagacagcaacgcggcatcatcggaaactccacaacggccgcccccgccggcagacgaagccccgaaccagaacggcaccggaaaggataagcagaaagaaccggtctcagcgggctgctcgtcgtcgcgccagctcttccctcctgggaggatcatccacatggttgcgctgccgccgcagcagccggacccaaactccgacgacggcacgagcagcggtgagatcgttggcatatacgagacgccgaggggtttgtacgggaagatacggctcgcgcccgacatgattaaagaacattacatgcctagctatatacgtacgatggaatcgttgttggaacagctccagaaggacgacgatgatggcagtgtatgtacatgtaccgcaccaagtgacctgtgaattcttgtggagaactcgggcagtgattattccaattctttcttaaccnaaaaaaaaaa

SEQ ID NO: 16703 - DNA, 1196 bp, Zea mays
ccggccgggggaatgtacccgcccgcgagacgggaccagtgagtcagtgaccaccacgcgctcgtggctaccggcttcgctcccagatcccgccgcgcgcgcgagccccgaggactgaccatggaggagcccacggagtccaggccagctggcgcggaggatctcgcgaacggcgcgaaagacccggaggggcctccgccggaggttgaggaggaggaagtggaggagccgccacgatcggcgacggcgaagcaggaggaggcgaaggaggtactagggtcggaggggtctcgcccgttcaccatgcgggagctgctcggcgaactcagggaggacggcgagacggcggtcggcggcagcaccgcgagatctgcgttcggcgacgggaacggggtcggatccgctgatgccgagggctcgtcctacagccaagatagcgcacagttttcatcacaccatgatgtagcgatggacttgataaatagtgtaactggagttgacgaggaaggacgttctcgccaaaggattctttcttttgctgctaaaagatacgtaaatgcaattgaaagtaatcctgacgaccctgatgcatattataattgggctctagtcctccaggagagcgcagacaatgtggatcccaattcgagttcctctaaagatgcattgctggaggaggcttgcaaaaagtatgctgaagctacccgacttagtccaactctttatgatgcatattataactgggctattgctattgctgatcgggctaaaatgcgaggtcggacaaaagaagccgaagaactctggaagcaggcaatactgaattatgagaaggctgtccagcttaattggaatagcccacaggctctcaataactggggtcttgggctacaggagctgagtgcaattgttcctgcccgggataaacacaccatcataaaaacagctatcagtaagttccgtgctgcaattcagctgcaatttgatttccatcgggcaatatacaacctcggaactgtcttgtatggtttagctgaggataccatgagatctgggaagccagatgtctccccaaatgagctttacagtcagtctgctatctatgttgcagctgctcatgctctggagccaaattactccgtctaccgtagtgccttgcgactagtccgctcaatgttgcctctgccatatctcaa

SEQ ID NO: 16704 - DNA, 2481 bp, Zea mays
ttccccctccccttccgctgacgcgacgccacctcggcggctcggcccgcggcgcgctggtttccgtccgttcattgcggtgcggagagccggagacagaccacgcggccgtgcgggcgctcgcggctcccggctccgctcccagatcccgccgcgcgggcaagcttcgaggagtgaccatgcaggagcccacggagaccaggccagctggtgcggaggatctcgcgaacggcgcgcgagacggggagggacctccgccgcaggttgaggaggaggaagtggaggaggagccgccgcgatcggcgacggcaaagcaggaggaggcgacggcggcgctggggtcggaggggtcccgcccgttcactatgcgggagctcctcggcgagctcaaagaggatggcgagacggctgctggcggcagcagcgcgagatctgcgttcggcgatgggaacagggtcggatctgatgatgccgagggctcgttctacagccaagatagcacacaacagttttcatcccaccatgatgtagcgatggacttgataaatagtgtaactggagttgatgaggaagggcattctcgccaaaggattctttcttttgctgccaaaaggtatgtaaatgcaattgaaagaaatcctaatgaccctgatgcatattataattgggctctagtcctccaggagagtgcagacaatgtggatcccaattctagctcctctaaagatgcattgcttgaggaggcttgcaaaaagtatgctgaagctacccggctttgtccaactctttatgatgcatattataactgggctattgcgattgctgatcgggctaaaatgcgaggtcggacaaaagaagccgaagaactctggaaacaggcaatactgaattatgagaaggcagtccagcttaattggaatagcccacaggctctcaataactggggtcttgggctacaggagctgagtgcaattgttcctgcacgggataaacagaccatcataaaaaccgctatcagtaagttccgtgctgcaattcagctgcaatttgatttccatcgggcaatatacaaccttggaactgttttgtatggtttagctgaggataccgtgagatctgggaagccagatgtctctcctaatgagctttatggtcagtctgctatctatgttgctgctgctcatgctctaaagccaaattactcggtctatcggagtgctttgcgattagtccgctcaatggtataattaatttattctgtttctgatgaactgtgttagtttattctgtttgatattattattacttaatagttcatgtagctgggatatgatagctgcttttcagttcagttatccatgtgtgttgaactctttagcaacccatattcttgaggaaaataactgacaaccctcatggtattcaaacttttttttctctctgaacggtactgtgtgctggtcttttagcacatttttctgttctttagatgttctcttgtctaattcttgattatgacagtgttcctctgttcttattgcatcttataccatgcagttacctctgccatatctcaaagttgggtatttgacggctcctccagctaacaattccattgcaccacacaaagattgggagagatcacagttcattttgaatcatgagggactccagcaggttgatgcttctgaccagcctccatcacaatccccagggcatttggacaggggcagaaagcctgtcagaataaacattgcagatattgtttcagtgtcagcatgtgctgatttaaccttaccaagtggcgctggcctctgtatagaaactatttctggtcctacattcttggttgccgatagttgggaggctctcgaaagttggctagacgccatacgccttgtctacactatttttgcaagagggaagagcgacgtacttgccggtattattactggttaaatgtcttgctgcaaatgcaaaactgccaccgaagagccgcaaagttttggagattcagcggcagccttatcggttgaatgccctctttggtttgtgttattatttttcccgtctgtgatgtcagtcttcctagatttagccatttagggtattaggtatatcatatatattcatttgtaactactttccactgattggctataggtccgttttccttttgtaaaagtggccgtgtgactgtattgtgcattcacagcagatgtatcggacattcttaagtttgtgattttgtttctctgtaacaatgtatcaaggcacgatggtctatgcttaaatttactgcttgggacggcgctgctgtgctgggctgcagggccttcaacatgtatcaagccaaggatccggagaggttacaagatatactctccattccaaaatatggtagtccctccgtgactttttttcccccaattggaccaggtcgtcttattaaataaatattattagtttcccctgtgacaa

SEQ ID NO: 16705 - DNA, 1949 bp, Zea mays
gacgcccacctcggcggctcggcccgcgctggtttccgtccgttcattgcggtgcggagagccggagacagaccaccgggccgtgcgggcgctcgcggctccgctcccagatcccgccgcgcgggcaagcttcgaggagtgaccatgcaggagcccacggagaccaggccagctggtgcggaggatctcgcgaacggcgcgcgagacggggagggacctccgccgcaggttgaggaggaggaagtggaggaggagccgccgcgatcggcgacggcaaagcaggaggaggcgacggcggcgctggggtcggaggggtcccgcccgttcactatgcgggagctcctcggcgagctcaaagaggatggcgagacggctgctggcggcagcagcgcgagatctgcgttcggcgatgggaacagggtcggatccgatgatgccgagggctcgttctacagccaagatagcacacaacagttttcatcccaccatgatgtggcgatggacttgataaatagtgtaactggagttgatgaggaagggcattctcgccaaaggattctttcttttgctgccaaaaggtatgtaaatgcaattgaaagaaatcctaatgaccctgatgcatattataattgggctctagtcctccaggagagtgcagacaatgtggatcccaattctagctcctctaaagatgcattgcttgaggaggcttgcaaaaagtatgctgaagctacccggctttgtccaactctttatgatgcatattataactgggctattgcgattgctgatcgggctaaaatgcgaggtcggacaaaagaagccgaagaactctggaaacaggcaatactgaattatgagaaggcagtccagcttaattggaatagcccacaggctctcaataactggggtcttgggctacaggagctgagtgcaattgttcctgcacgggataaacagaccatcataaaaaccgctatcagtaagttccgtgctgcaattcagctgcaatttgatttccatcgggcaatatacaaccttggaactgttttgtatggtttagctgaggataccgtgagatctgggaagccagatgtctctcctaatgagctttatagtcagtctgctatctatgttgctgctgctcatgctctaaagccaaattactcggtctatcggagtgctttgcgattagtccgctcaatgttacctctgccatatctcaaagttgggtatttgacggctcctccagctaacaattccattgcaccacacaaagattgggagagatcacagttcattttgaatcatgagggactccagcaggttgatgcttctgaccagcctccatcacaatccccagggcatttggacaggggcagaaagcctgtcagaataaacattgcagatattgtttcagtgtcagcatgtgctgatttaaccttaccaagtggcgctggcctctgtatagaaactatttctggtcctacattcttggttgccgatagttgggaggctctcgaaagttggctagacgccatacgccttgtctacactatttttgcaagagggaagagcgacgtacttgccggtattattactggttaaatgtctttctgcaaatgcaaaactgccaccgaagagccgcaaagttttggagattcagcggcagccttatccgttgaatgccctctttggtttgtgttattatttttcccgtctgtgatgtcagtcttcctagatttagccatttagggtatatcatatatattcatttgtaactactttccactgattggcgataggtccgttttccttttgtaaaagtggccgtgtgactgtattgtgcattcacagcagatgtatcggacattcttaagtttgtgattttgtttctctgtaacaatgtatcaaggcacgatggtctatgcttaactttactgcttggg

SEQ ID NO: 16706 - DNA, 2118 bp, Zea mays
gagctaacctagcttctttagaaatatcatactccctctatcttaatttagtattcgttgtagcacttattttgtttatatctatattcaaattgatgatgagaaatctagatacatatacgaaacacatacattaattatcgtatgaatcattaaaaggcaaaaacaaattttaatttgggactgagggagtaacatatatcttggcagtgtatttattaggtattatatggacgttagtgtaaatatctatgagcttagtaaactgtagagaagcttgcctcggaacattttggaacgaatgagtatcccagaattccatgctcgtctattaacgaacaacagaatgcaaatatatcttaacattagcagctgtgtggaaatgaacgttgcattacggagcgagcaacatttagtatttagtcgcaatatacattctcgacacacattttggtcgaaaggtcaagcagtaatggacgctttatcgatcaacaaaatccacatcaagtttggcagcgtaaatcggatccagtgcattatttgcgtatagcactcctatttaggatttagcagacgagcgtatacatgccatgccagcaagacaaagctacgactcgctatccgtttttccttgccaaactcgtggaagctcggcgagaaaactgtagcacgcaaatgttgaattcttcacactaccacagctatatatagacagccggccggcccggcagcgaagcagttggagggggtaattcggagcagctagtagacactagacagacagaaatggcttccgttctccaccacctcttcccgctcgtcgtcgtcctcctcctcgcggccgctgccgacgcggccaccttcaccgtgaccaacaactgcccgtacaccgtgtgggcggccgccgtgccgggcggcgggcagcagctggacaacgggcagacgtggagcatcgacgtgccggcgggcacgacgggcgggcgcgtgtgggcgcgcacgggctgctccttcgacggcagcggcaacgggcagtgccagacgggcgactgcggcggcgtgctgcagtgcgcgcagtacgggcaggcgcccaacacgctggccgagttcgggctcaacaagttcgacggcctcgacttcttcgacatctccctggtggacggcttcaacgtgcccatggacttcctgcccgccggcgacgcctccgggtgccccaagggcgggccgcgctgcgacgccgacgtcacgtcgcagtgccccgccgcgctgcaggcccccggcggctgcgacaacccctgcaccgtgttcaagacggaccagtactgctgcaccggctcggcggcgaacaactgcgggcctaccgactactccaagttcttcaaggggctctgcccggacgcctacagctatcccaaggacgacgccaccagcacctacacttgccccggcggcaccaactacaacgtcgtcttctgcccatgagctccatcgagctgctcaaacatacgtacctatatagttgatccaggagacacgtacgtgagaaacaaataaactaaactagcacacaaatgatgaaatgaataagttattatgaataacttgtgcaagaacacattacattattgttcttctagcttcaaggttgggaattgaattctgtgaaataatgatatgagatacgttgtgtaccataaaaaaaaaaaaaaaaaaggcggccgccctttgttttttgtggtgcacaaaaggtggggtatagataagattatagatggatggtgacacaacacagcagggcacatggctagcctgctagcgtgcggcacccacacaacacaacacaacacactgctcgccagaagcgccccagggggccaggggaggacacgacgccgccatcaggcatcatcatcatctcagactcggagcatgccatggcacgcaactgactgactgactgactcgaaacacacacagcgacgccgctatactttattaagctttataattagctagcttcctccggccggcctgcagggtggagcacctagctcacttgccgcagttgcaggggtcgcactggcagttgccgccgcacttgcacccgccgttctcagctcc

SEQ ID NO: 16707 - DNA, 1302 bp, Zea mays
gcacgagcggacttccccctcattgcccgtcgccactcccatggcgttcggccccgcgggcccggcccgtctctccctttccaagggccgccgcatccactccgccccccgcctcgcagtgcctccccaccgccctccgcgcccggcaggcgacgtcccgttccagatccaggattcaaacaaaccagtacattaccaccatggttcttgattcattatcatcacctcacaggaggtcccaaaacacattcttcgtgtcatctgcaaaaaagcctcagtcatctcgtgacgacagttggtctgcactggttgagcgacaccggtttctcctgacgacactccttgttcttgccttcctgtgcactgtctatctgtactttgcagtaaccttgggggcatcagatgcttgcactggattgacaggagcagagaggattgagtgccaggcaagatcagtgctgcaacatggaaagttgaaattccgatgactttggagactcattgatgaagaccaaattattgagttttatatgcactcgggtcacatgacaaattcttgataccatgtatctgtatatggtggggtggctgatgttattggaccacaaaatttgctgtactggtagaggcaaatctaatagttagggttgagcttgtggaaacgggtatactggggtaggcccatattgttcttttaccttggtgtgcgaaaaacatcatggcgtctgtaattcttccaggagatattggtattgtctcccttgagacatactcacagttaatttgaaaccatgctaccttgagtaccgttaatccaaaaacggtttccatttcccaggaaggaaattttgtgtgttgtctccgcaaagagaatccctggaatgaactggagctcaaaaaagtagcttcttttaattcatttcatgcacataattgttgtcagtgttcatgcacataattgttgtcagtgtttagacaaggctatacctttggcagccgtcaagatgcgttaagcgcctgacagccattaagatgcgttcagcgcctcaagaaggattatcgtcatcaaaacacgttcaaagatcctggtatcgagtccggcgtctgcttcgggcgtctcttggctctggcctttgggcaacgtgcctagatttataggattagttagtcctccctatgtcctaatatattatttgttttagctcattattattattatgtctatattcaaatgacaatgaatatgaatatatatatatatatatatatatatatatatatatatatatatatatatatata

SEQ ID NO: 16708 - DNA, 947 bp, Zea mays
acggatttccccctcctcgaccgtcgtcaatatcgcacggttcaccggccacgctctctcgctttccaaggaccgccgggtccgctccgtcccccgtctggcagtggcctcctcgccgccctcggcgccgcctggccacgccttatccagatccaggattcaaagaaaccattacttcaccaccatggttcttgattcattgtcatctccgcacaggaggtcccaaaacatattcttcgtgtcatcatcaaaaaagcctcagtcatctcgtgatgacagttggtctgcactggttgagcggcaccggttcctcctgacaacacttcttgtgcttgccttcctatgcagtatctatctgtactttgcagtgaccttgggggcatcagatgcgtgcagtggtttgacaggaggggcacagaagatcgagtgccaggcaagatcagtgctgcaacatggaaagttgaaattccgctgacttcggagtctcattgatgaagaccaaattattgagtttatttgcactctggtcacaggtcttattcttcataccatgaatctgtatattattggtggtggctggtttgtattcatgctgatgttattgggccacaacatttattgtactggtagagataaatctaatagtgatagcgttgagtttgtggaaagtggaaactggtataagggtaggtctatattgttcttttaacaatcatggtgcctataattcgtccaggagaccttggtattgtctcccgtgtgacatgtgacacagtcagattgatactgtgctacctgagcaccctttgatctttaagtactgattaatttcgttagtgttcatcttaatttattaacaatcagctgttcactgagaaatttgtcaattttagcggccccgtgctccagctacgacaacctggaacatgattgtttgtagttgtgtt

SEQ ID NO: 16709 - DNA, 1312 bp, Zea mays
attccctccttttttttaattccccgcgccacgttccaattccaactctgcaccgagccctgcccacattgcaattcgactgttccacggctcgcttcgattacgcgatacgcggtcatttacgagcggggagtagcgcagcgcagcggccggcgcgcgtcagaagtgcccatggacgccgcggcggtgctgaagcggaagggcgaggaggcgcccgaggcgtggctgcttggcggggtcgtggtccccgccaccaagatccgccgactcgatgcggaggtgccgccgcctgtcgggtccggcgcgggcgtgctgtcagagccgcaacgtgctttagggttggaggaggcgcggatgagcggccacgtgggggcgccggccatggacgcaacgccgttgttgaagaggaagggggaggaggcgccgcagccgtggctcgatgtcgacggggtccctatacccgccacgaagatccgccgactcgacgccgatgtgccacccgtcggatccgggatgggcgtgccgcttgctgagcccggcgtgagcgtggcgccgcagcctttcgtggcgggggacttgcggatgagcggtgatgttgcgccgccggccgcggcgattgccgtagctgctccggcggtgaacgaggagcgggcgatcgtggtgtaccagcctgccgaggccgaacgcaacctcctggacggtccactccgcccgggggcttctctccgcgtcagccccgactggatccatgggctcaagaacaccatgctgcaagaggcgagcaaccacagagctctgttcgaggagatggcggccagggacgggaacctcaacctggccatggtcccgtgggcgcctcccaaggtcgatgtccatgccgcctccagctccacagcggcggcggtggaaatggtggacgctgatcaggacggcgacggcgcatccatggaggtcgagcacgacgttgagggccagaccacgccaccagctggcggtgcgctgcaggtggaggcgttcaaccaccattaccagcagcagcaccagtggccagcgcagcactgcgttgcgtcgccgcagctacagctcccggccgcgagctaccaggcaagccctgtcacgtggtcgtggtgatggcgcgaactagagcagaggactgcagggggagacatagacacatagttgtcgtagactagtagtagtgattagtattaatctcctccctgctcagtttgctatttgcttttctggatgttggggttggggttgctgttgtgaaaaaacgcgagcttctgagcgaaaaaaaaaaaaaaaa

SEQ ID NO: 16710 - DNA, 1246 bp, Zea mays
gctggcgaggtacttgtgaagaaaaactgctaaatgtgcagcttctagtttgttttacttttagatgcatttctagaatgcttcatatgaattttttatttgtgcatccatttaaggtgggtttatgacctgtatattaacctctttctatttattaattgtttttcacttgaaattgctgtaagttaaattttgtccgagctgtacttgcccacattttatttatttcgagctctattcttctttcattaaaaagacacagaaatgtattgcaatcagctacagttataatgtagtatggaacttgatcttgcaggctggtttggtgacagctagaaaatcattcaagatacacgcactttcaaagataatgatactgcacttgaagaggttcagttatggaaatcatgagagcactaaagtctataagccactccactttccatccgtactggttcttagtcgtgatctgctgagctcaccatcacaagaggtgatccgctgatttgtggtcccaaactcctgattgtttgacatttagtattaagcatgaattgagtttgtacagcgaccatgtggctttggcacatgggaatgacactacagtctgtttgccactccacttaaaccatccgtactggttcttagtcgtgatctgctgagctcaccatcacaagagggtagaaaatacgagcttgttgcaaccatcactcatcatgggagggacccttacagggggcactacaccgctcacgcaaagcatggcaacgggcaatggcttcgtttcgacgacgacgccgttgtgcccgttggcgagaaggatgtcttgcatgaccaagcatatgtcctcttctacaaacgagtctgaaagcacgacgtagttgaatagttagttgctctttcgtattgccgctgcttaaacaggcagatatcatcatctaactatggtcctgttaatgtagccgctgagtaacagcagagtattatgtggagtgcaccctggtgccgcctgtgtttattagtatattatttgactggtcgtatagcgagagggggattcgtcgtcagcccattttgaggttctgtaaaatttcaactgcgcatcattgtaatgaccagcgaagtaatgatgggatgttatgctaatcatggtcgcccctgtcgcaaacagctgctgaaataggttgtgattggttgaatgtggcatgctgtggttctgaattggttttgttaggaagaagacaag

SEQ ID NO: 16711 - DNA, 2448 bp, Zea mays
ataccagcaacccaagcaactccccacgttctctgtccttccaagacccaggctttcagttccagccccacctcgcctcgcttctcccctccccttcccaaaccctacaccccgggccttcgccgtccccgactcaccgccgggcgccggccacccccatagcgcagcgccggcgccgaactgaactcttccgtgcggtcggccgcgcgtacggccacccccctcggcgccgcccgccgcctttgatgtctcccacctgcgacctcggcttcctttggccccggtcgcagaagagcccccaagaggtctcccgagcggccgcttccggagcccagcgattggcctccccacggcagccgaaatgagcggcggcgagaagatgttgctgtttgggtcctttacggaggacgagactaagttgtttcagggtcagcctctcaaaagtccaaataaaagcgtcaacaaagaatgtgaacggacggagatccagtttggcaccctgaacttttcagtgctgagtttagagaaggtatctacttcaagtgttgttcttcctgcaaaatcagcaaacagcgagaccagtgccatcgcaaaggagaatacatgcagtaatgaaaagaaagctgcaggatcaagccttccaaatggcagatccattctggctaatggatgcccccctgttaatgttcctgccaacaatggtttatttgagaatgtgaagaagacagaggctgttgtcccaccagttgtgcctgtaaaaagcatcagcattccaacaccacaaatgacattggaggtgcataacaatggcaccgaaccgactcaaagcagaaagttagacaaggaaagggaaattactgaaaatggtagcccaattgtcgatacgcccattgctgcagctccagcagaagaggcagtcacaaacctaaataagaaaacctcacagaacatgcccttgattccacaaggcttgaggaacacaggaaatatctgctttctgaatgcaactttacaggcattgctttcatgctcgccttttgtccaccttttacaggatctgaggaaccgtagtatacctaagtttggctacccaactctgcgtgcatttgttgagttgatctctcaattcgatgtgcttgacgagtcagttaacaagaaaaatgagaaggctattactgttgctgcaaagccacttaatcctgccatgtttgatgatgttctcagaaactttacaccagatgtgccggctggaataactgctcggccaaggcaggaagatgctcaagagtttttaagttttgccatggatagagtgcatgatgaactgctgaagcttaatggtaatggtttgaattcaaaggagggtatggttgtttcttctgctgatgatgcttgggagacagttggaagaaagaacaaatctgcaatagttagaacacatagttttgttccctctgagctaagtgctatttttggagggcagctacagagcgttgtgaaagctgcaggtaacaaagcatcagctactgttcaacccttcctactgctccatcttgatatattcccagatgctgttcagacacttaatgatgcacttcgtctgttctctacccccgaatctttggaaggatacagaacaactgctggaaaggctggtttggtgacagctagaaagtcattcaagatacacgccctttcaaaaataatgatcctgcacttgaagaggttcagttatggaaatcatgggagcactaaaatctataagccactccgcttcacatctgaactggttcttagtcgtgatctgctgagctcaccatcacaagagggtagaaaatatgagcttgttgcaaccatcactcatcatgggagggacccttacagaggtcactacactgctcacgcaaagcatgccgacgggcaatggcttcgctttgacgatgacgctgttgtgcccgttggcgagaacgatgtcttgcatgaccaagcatatgttctcttctacaaacaagtctgaaagcactacgtagttgattagttgctctttcgtatcgcagttgcttaaacagccagatataccgtctaactatcgtcctattaatgtagtcaccgagtaacagcagcagagtattatgtgaagcaccctggtgctgcccgtgtttattatcatatgcttggtcatgatgtggcgagagcggggatttgtcttcagctcattttgaggttctgtaaagattcaactgtcatcattgcaatgagcagcgaagtaatcatggtcagccctgtcgctggcagctgcctaaaaaaaaaaaaaaaaaacgagagggggggcccggtacccatttcgccctataggaggcgtattaccttcccccgggccgtcggtttacaacgtcggggcctgggaaaacccttggggttacccacttaatcccgcttggagaaatt

SEQ ID NO: 16712 - DNA, 4091 bp, Zea mays
  misc_feature (3116)..(3116): n is a, c, g, or t
cctaaaaaaaaggccaactaattatacccagattaattaaaaatctagctaatctacctttacgggcttgtcaattataccatagctggactgatggagtacatcattattgcccccgcgcactctgcccccccccctcccgccagcaccccctctgctccttcacttcaccacaatggcaaccactacccctgctgtcacggaaccggacaatgctgacgcatctcctccatctccgacgtctccaccgtccaagaagctcatgtacgagctcgccgcccggaacatctactacgccaagcctactgcagcgccgaggtcgctcgcgcagcttttgaagccgtgcggcgcggccccgacgccgccggactacatcctccgcgatgtatccctcacggctcgggccggggagatcctggccgtcgtcggcccgagcggcgccgggaagtccacgctgctcgacatcctcgccgcgcgcacagcgccgacgcacgggaggctcctgctcaactccgcgccgctgcggccgtcgtcattccgcaggctgtcgtcgcacgtgccccaggcagatgtcgcgctcaccctgctcaccgtctccgagaccttcgcgttcgcagcgtcgctgctgcacccggagtcggagtccgctgtctcggccgcggtcaccgcgctcctcgcggacctcaggcttgcccacgtcgcgcacacgcgggtctcccccgcgcggctgtccggcggcgagcgggcggcgcgtgtccatcggcctcgccctcctgcgcaaccccggcggtgctcctcctcgacgagccgacgtccggcctagactcctcctcggcgcacgtggtcgtcagttgcctccgcgccgtcgcggccgcccggggcacaacgggtggtgttttccatccaccagccaagcgcgcgcctcctctccgctgtggactgcctgctcctcctctcccgtggcaccgtcctccaccacggctccctcgcatccctcgacgctgccctcctctcacacggcctggtcgtccccgcgcagctcaacccactcgagttcgcccttgaggtcctcgaccagctccctcaccccaccccctctacccctgaacccaaggcgacgacgcaagaaactgaactcgtcgtcgggccaccacaagatggtggccacggcgacgccgtctactggtccgccgtcgtcgtggctgcacgagttgatggtactgtacaagagggcgtggaaggtggtgtacaggagcaagcagctgcttctcaccaacttcctagaggccgtgctcgtgggcacgctgctgggcacgatctacatccacgctggctacggcgaggccggggcgcacaagcggctgggtctgttcgccttcacgctgaccttcctgctgacttcgacgaccgagacgctgccgacgttcgtgacggagcggcccatcgttctggcggagacggcggccggactgtaccggctgtcgtctcacgcggcggcgggcacgctggtgttcctgccgtaccttcttgctgtggcgctgctctactccgtgtgcgtctacttccttgtggggctctgctcgtcagccggcgccttcgcgtcgttcgtgctggtggtgtgggcggtggtgctgacggcgaactcgttcgtgctgttcgtgagctcgttcgcgccggactacatcgcgggcatgtccctcgtatccgtgtcgctggccgggttcttcctcttctccggctacttcctgtcgcgggggagcatgccgtcgtactgggtgttcatgcactacgtgtcgccctacaagtacgcgctggacgcgctgctggcgaacgagtacacgtgcgcggggaaccggtgcttcggtgtgggcggcggcagcgagtgctcgcagacggggctcgacgtgctggtggagaagggctgacggcggaggagcggtggaccggcgtccaggttctgttcggcttcttccttctctacgggtgctctactgggggtgctcagccggcgagcgtccagggcgaagagatgatgagatcagaatcagatcagatgaggtgagcagccggcgaacatcggatgctctcgcctccatgtactacgtacgcatgcaaacaagcttagccagcagaggtatgtcaaaaaaaaaatgccaacttggagaggaggaagatgaagaggcaagagcgatattaactggaattagtaattacgctgtcatatactgtactgatgtaaattgtgaagataaaattcctttataagtgtggcgatatggtcgagatgcatggatgggtgaataatgtgtagacttatatcaaatatataagttttgtgcttcttgttaattgactcgggtctggggaatcatatatatatgtgactgcatgaaaattgtatctatatgttggtgggagttgttaaagataagttttgtctttttgttagttttgtctgatcttagttacccctacttcgaatctgtctggcagcatgttcgtctgtgtatttttttttgttacgaagaaaataaatgggccaagttaatgttcagctcatctgatcgcatgtgtataaaaccaagcaagcaacaagaagaagaaaaaaaatgtacaccttgtaaaatgtcaataataaaagggcatgctttttattagccggcagaagtaccaagcactgcactgctgggctttgtttgacacagcttattttcagcttctttacaaatttaagccgaaattttaccaaacagacagcttctacgtcagcttatgcatccccggccagccgtgagaggatcacgcgcgatcagtttctgatcaatggggcgggcgagctagcatggatcggatagcatgcttattatagactcaccatgctgccgagtgtgatgtgacggcacgaaacattgtgtgctagcctagctagcagcatatataaagatggcgatggaaagttggggacttggagttggaagagctctccacagccagtcgtacacgatggcacaactggaaatacgctaaaaggcagcaaggtgatcgtatcatgtggatatatagcagtagcagagaacgatgatgcccggaggcggtttcgtcggttactttcacgngtccttggttgctgctgctgcctcttgtcgcacctcttctgtttctctctctctctctctcctatttgatcgtcgagtgtgtctcgtgaccccccccccctttgtcctctgggacagttaggcactcgccgtcgtgtaggggagcggtgagagatagagagagagatggggggaggcaagagcaagacgacgctcgtgacgcaggaacatgcgttcagggccacacattccaccgagtaaataaagcacagtagtttcacttcacgcgcgcctacggggggaaaaataaatcagtgtgcaggattgctggagtgcagccacgcaagggtgtagactccacgccagcggcgcagcgacgctgagtcgctgagaacgggaaggtctcggagatggtgaggcggtgagcagggtgagcacagcatctgcctgcctgcgtggcgccgagagcctgcggaatgatgggccaccactatgccatggctcaaaaacagtagcctaaaacatgatccagcacaaaaaaaaaattatagatctagctagcacgattcgaagtcgagtctagaccggaccttaaattccaatccgttcggccttggcacatcacgcacacatggaccggacttcggccggcacggccaatggaacacatattgtttaatctcattaatttagtaagctgtagactttatattgttgtgatattttgtactttatatgaccaaacgatgccatcattatttaatatctttaattcagtaagctttaaattttgtatggttataatatccgggttttatgtggttaaaatattaattttattaatttagtaagctatagactttatattgttgtgttattttgactttatatggtcaagtgatgctaccattgtttaatatctttaatttagtaagctatgaactttatgtggttataatatttggatttttatttggttaaaatatatgatcggca

SEQ ID NO: 16713 - DNA, 2300 bp, Zea mays
  misc_feature (845)..(851): n is a, c, g, or t
  misc_feature (1057)..(1057): n is a, c, g, or t
  misc_feature (1216)..(1216): n is a, c, g, or t
gccggccgggctgggaaagaaggtttcgtggtgtagtgtcaactcattccatgcggataccatagctggactgatggagtacatcattattgcccccgcgcgctctaccccttccccttcctccagcaccacctctgctccttcacttcaccacaatggcaaccactacccctgctgtcacggaaccggacaatgctgacgcatctcctccatctccgacgtctccaccgtccaagaagctcatgtacgagctcgccgcccggaacatctactacgccaagcctactgcagcgccgaggtcgctcgcgcagcttttgaagccgtgcggcgcggccccgacgccgccggactacatcctccgcgatgtatccctcacggctcgggccggggagatcctggccgtcgtcggcccgagcggcgccgggaagtccacgctgctcgacatcctcgccgcgcgcacagcgccgacgcacgggaggctcctgctcaattccgcgccgctgcggccgtcgtcattccgcaggctgtcgtcgcacgtgccccaggcagatgtcgcgctcaccctgctcaccgtctccgagaccttcgcgttcgcagcgtcgctgctgcacccggagtcggagtccgctgtctcggccgcggtcaccgcgctcctcgcggacctcaggcttgcccacgtcgcgcacacgcgggtctcccccgcgcggctgtccggcggcgagcggcggcgcgtgtccatcggcctcgccctcctgcgcaaccccgcggtgctcctcctcgacgagccgacgtccggcctagactcctcctcggcgcacgtggtcgtcagttgcctccgcgccgtnnnnnnngcccggggcacaacgggtggtgttttccatccaccagccaagcgcgcgcctcctctccgctgtggactgcctgctcctcctctcccgtggcaccgtcctccaccacggctccctcgcatccctcgacgctgccctcctctcacacggcctggtcgtccccgcgcagctcaacccactcgagttcgcccttgaggtcctcgaccagntccctcaccccaccccctctacccctgaacccaaggcgacgacgcaagaaactgaactcgtcgtcgggccaccacaagatggtggccacggcgacgccgtctactggtccgccgtcgtcgtggctgcacgagttgatggtactgtacaagagggcgtgnaaggtggtgtacaggagcaagcagctgcttctcaccaacttcctagaggccgtgctcgtgggcacgctgctgggcacgatctacatccacgctggctacggcgaggccggggcgcacaagcggctgggtctgttcgccttcacgctgaccttcctgctgacttcgacgaccgagacgctgccgacgttcgtgacggagcggcccatcgttctggcggagacggcggccggactgtaccggctgtcgtctcacgcggcggcgggcacgctggtgttcctgccgtaccttcttgctgtggcgctgctctactccgtgtgcgtctacttccttgtggggctctgctcgtcagcgggcgccttcgcgtcgttcgtgctggtggtgtgggcggtggtgctgacggcgaacttgttcgtgctgttcgtgagctcgttcgcgccggactacatcgcgggcatgtccctcgtatccgtgtcgctggccgggttcttcctcttctccggctacttcctgtcgcgggggagcatgccgtcgtactgggtgttcatgcactacgtgtcgccctacaagtacgcgctggacgcgctgctggcgaacgagtacacgtgcgcggggaaccggtgcttcggtgtgggcggcggcagcgagtgctcgcagacggggctcgacgtgctggtggagaaggggctgacggcggaggagcggtggaccggcgtccaggttctgttcggcttcttccttctctaccgggtgctctactgggtggtgctcagccggcgagcgtccagggcgaagagatgatgagatcagaatcagatgaggtgaggtgagcagccggcgaacatcggatgctctcgcctccatgtactacgtacgcatgcaaacaagcttagccagctagcagaggtatgtcaaaaaaaaaaaaacaaatgccaacttggagaggaggaagatgaagaggcgagcgatattaactggaattagtaattacgctgtcatatactgtactgatgtaaattgtgaagataaaattcctttctaaaaaaaaaaaaaaaaaaaaaaaaaaaaaataaaaaaaaaaaaaaaa

SEQ ID NO: 16714 - DNA, 944 bp, Zea mays
  misc_feature (14)..(14): n is a, c, g, or t
ggaggagatattgngaatgggaaaaagggaatggaagcatgatgaagaggaggagctgccttcaccttcttcctccttgggctacctgatgctgtgtaggatctgccacgaggaagagggacggagggcgtgcgaccatggagtccccttgtggatgttccggctctctcaagtacgctcacaggcgatgtgtgcagagatggtgtgatgagaaggggaccgccatctgtgagatttgccttcagaatttcgagccagggtacacaatgcctccaaagaaaactccggtggttgaaacggcggtcacgatcagtgaacacgaggacatgcaatctttggaatctcgggagggcttgagtgggggtgcaggctacaccaggtgctcctacaccgcagatcaatgcgccacatggtgccggtcgctggcgatcacgttcaccattatgctgctggcatggcatctggttgcagtggtgacggttgaagcagcagctcactgcgcgttcagtctcctggcaatgtacttgcttcgcgctgctggtatcctgctgccgctgtgcgttgtcatgcgactgattcgcatcgtccagagtggtcaggagcagcagtatgggctgcagctgctggagcaccaaagaagaaatgtatcaactatatgaattatatgcgtgtccaggaggaggaccagcgagtaattaatattcattaagccaatgaatctcaatgcaagcttgcacaaatgtgcattaagtattaccgtggaaactttcaaacagaacatcatctgtaaacatttagtatacatacagttggtgcagggaaaaacagccccattttattcctgctttttctgaacgttcattatgctattagggaatgttcaaacagatcattattgcatatcccaatgaaaatattggcggccaaccagtcacgtactcttc

SEQ ID NO: 16715 - DNA, 2095 bp, Zea mays
gcacgagaccattacctagaacatcctaatcgaaaaaaaatcacttcaggtaagggcgaagaagagcattccctctcccggtctccccatctcccgaaccgcgtgagccaaaccctcccagctcgcgcgccctcgatggatgcctccgccgccacccccgcccccgggccttccttctctggcgccgagtcctccgcggccgccgcccagccgccggcggaggctccgcagttgcgcgtccacggcgccggcagcggcagcggcgtcgcgcgagcctgccgccaccacgcgtacagccgcaagcagaagtcgctcggccttctctgctccaacttcgtggcgctgtacgaccgggaggacgtggaggtgattgggctggacgacgcggccaagcgtctcggcgtcgagcgacgccggatctacgacatagtcaacgttctcgagagcgtcgggattcttgtgcggagggccaagaatcggtatacatggctcggattcgggggagtccctgctgcgctgaaagaactcaaggagagggcgctaaggaagatgtccggatcaccggtgttactgtcaatggaggactcgtctactgccaacttatcagatgatgaggatgatgaaaaattgggcgatgctgatgaagatgctgagagcgagaagctcagccaacctgttgacaatacgtctgataagcctgacgcacccagctgccgccttagatctgatcatcggaaggagaagtcccccgacagcaacgctcagaattttgtcaagctcttcctcaacatggaggttgggacaatctcacttgacgaagctgcaaggcttctccttggagagggacatgcagacagcaacatgagaaccaaagttcgtcgattgtatgacattgccaatgtgctgtcttctttgaacctcattgagaagacgcagcaagcagacacaagaaaacctgcattccggtggctaggccaggcaaagcgaaagcaagataacaatgtcatggtttctgtacctccatcgatgaaggcaatgcccaataagagagcatttggtactgatcttacaaacattgacaataagcgaggcaagttagactcagcagcggagaacaaagtcaagctcatgcagggtgctggtaacatagtgaagacttttgagaggcagctggtgcaagggaaaaggagtgactttgtttatgggcccttccaccctgctggtgcaaagaaacacgaaactgatgatcaaactgttaagcagcaggagaggaagaacattcaggactgggaaaaccttgctgtgtccttccgtccacaatatcagaatcaagcactgaatgatctttttggtcattatgtggaagcatggaaatcatggtacgtggatcttacccaggaaacggcatcatgaagcagaatgttggcaggtcagttgtaacttgtaagccgtttccagtagttagatcaactgagttgttgatgcttgcttagggaaccaccctgtacaagatggaataaaaacacgaaggcaattttgtctttcgactgtatttactcgaatgctagaagtgaggccattttttcataaggaaaaaggcagggaaaatggggaatcgatcgagttgtcaccttgttgctagtggactattctggagtcaatcgagttgtcaccaaaggctaccgtttcctcgtctctggtatctgcttcgttgtatatcatacggctttagttgttgggtacgaggagcacagcaagacaaatgaaggctacaatccgttctgctggttgtttatttttgcattactctaccagttctgaacttttgatgaatttatctggtttagtgtaacgttaagatttaatgatcgtgcgatagatcttttaaaataactatttgagagactaatttgatccactatatctttaggatcagagaaaatatcataagctagtcatcgaccttggttcatctaacaaaaacagaaatcagtaacttttgacatattctggcgcatgggctgggattagcatcatatcgaggagatgcaagacatgcagatgcccaatcaaactcagtcatagttcacacact

SEQ ID NO: 16716 - DNA, 978 bp, Zea mays
ctcggtaccctggtgagctctacagtcgacctgcagtggtcgggctcgaatattgaaacttttattgcctagaatctgattttctgatcttctaaaacttttaaagctggcacctggtattcacataccccagccaatttcattctttcagtcattgttgagatcatatatgtactgcacagacaccatattgaaggtctgctaacatcgttcgactttgttaaaactgatgcattatacaaattttgtaggcaggcaggtcatcacctacaatttccaaatgaattcttattcttcaaattatctgtgatcttcctgtagtttgcctcgtgataatatcttaatgatgggcttattttctatttgtcacgtcaaaataatatattaggttgaagaagaatattggcaaatatgttttataactgaaacatgttgtgagctgcaattggtgaaagataaatagtttatatttttcatacgacccctcttcattttggtaatttatccaatctgaaatgatttcagcagttaattctccctcaatgaaaaatggcgattgatatttctggtgactggattagcggattatttggtttggcagggcttcagaaaggtggatcctgacagatgggaatttgctaatgaggagtttctgagaggtcagaggcacctcctcaaaaacattaggcgtcggaaacctccacactcatctcaaaatcagcaatctcttggctcttacctcgaggtaggacactttggatatgaagaagagattgatcagctgaagagggataaacagctcttgatggctgaggtagtgaagctgaggcaggagcaccaaaatactagatcagatctacaggccatggaagagaaattacaagacaccgagcagaagcagcagcagatgatggcattcatggcacgagtcatgcagaaccctgatttcatgcgtcagctgatctcccagcgggagat

SEQ ID NO: 16717 - DNA, 6374 bp, Zea mays
acgtatgactatggttgatgacccaaccacgaacgccgttgtgtcatggagtgccgccaacaatagctttgtagtttgggatcctcatatctttgggacggtgctgctgccaaggtacttcaagcacaacaacttctccagctttgttcggcagctcaatacttatgttgccgttcttccgtgtttgtttctgcggctgtggaaccatgcacggagggatgatgcggccgtgtgaaagggcttcagaaaggtggatcctgacagatgggaatttgctaatgaggagtttctgagaggtcagaggcacctcctcaaaaacattaggcgtcggaaacctccacactcatctccaaatcaacaatctcttggctcttacctcgaggtaggacactttggatatgaagaagagattgatcagctgaagagggataaacagctcttgatggctgaggtagtgaagctgaggcaggagcaccaaaatactagatcagatctacaggccatggaagagaaattacaagacaccgagcagaagcagcagcagatgatggcattcatggcacgcgtcatgcagaaccctgatttcatgcgtcagctgatctcccagcgggagatgaggaaggagctcgaggatgctatctcgaagaagagaaggcgccgcattgaccagggacatgaagctggtagcatgggcactggttctagcctggagcaagggccacagggagtgtttgaaccgcaggagccggtggaatcactcgccaacggtgtgccatctgatctggagagttcgtctgttgaggcgaagggattggaggttcgacagggtgtttcttcaggtggttctgagcatctgaatggcaggccaagcggagagttaaatgatgatttctgggaggaccttctgcacgaggggggacttggtgcagatgcaggcaatgctgttggtcaggatgatatgaacatggacatggacccagatgttagcctgcctcaactgaaacaacatggacccagacattagccgctcttgtgctatcacaatggctgtgactctgtgagtatctttacagttatgctcgttatacccctgtggtgtacctgtttcgatcgtcttcgaccaaatgtcacgtcgactgcagtctccagttgttaatacagtctgttcagcacgctgatttaagtatttgggtcaagatgttcatataatcctgtggtatccagagatattatagtttgttttcgtaactgtttgcgcagagaccatgctatgttgcctgcaggctatcagtgtatttgttctaacagatcgcaacgctggtacaacgcagtgacctgccagactgggccactatgagattgtagggaaagaccagatagcttgtgtatgtaaaagctgatccatagtagcctatcatgtgcaacgctattgccctttgggatttggcatttcactgtatataacatatcatcgccgtattgccgcatccatcgttgtcttggtttacccatttaagtttgttgtcttcccttttagcttacacatgtaccggctcggtcagtgcccgaggatctatttgcgtgcaaaagtgttcttttttcaatttctgaaatctagaggcttctgtcttcttattctgtttgatgctacctcgccctcgagggaattgtctcatgctagcagtcccttcgaccgaccctacgttcatcatgcaaacttgaatggtttttattcatcaaactttgaagtggtactactgtggtggtgtttggttcatgcctcgttcttagaatctcattattagccaaacagattctggatgttatattggatttgccagaatctcacaatatcaacaaaagttgataatataatttgtattggattttgtgtagtgtgcaacttttcaaaatctatggagaaccaaaaccacctatgcaagaagacataacttacatgtctacattggggccatttccgaaatgggcctcgacagagaatagaatagcctaatcaattcagttggttatttcttatctagaagcaaaagagaaattgctaatgctatttttacccgttttgtctttatcctttccgcgtccgacgagtgcgcggcggccggtgatgactggtcgcgacaggtgtgccgcgggccccgcggtgccgtgccgtgtggatcagtcccgatccttctcccgccttcggccttccccgcgcgcgcgcgcacgcaccagcaccaccgcgatataaagcccgccaccaatccgctcgtggtcgtcgtcatcatcccgattcccgacacgcttgtgttgtcgcgattggcaagctcggcggctcgtggcagcgggaacttacgaggcgaaggagagcgagggcgaccgcgcggatcgcatcgcagctctgggcggaggtggggccttgcgcggagatgctagcggtgttcgatcgggcggtggcgccgagcccggaggggctgcggcagccgggcgccgcggggggcggctgcgcggcgggcctcgcggaccggttcagagaggcgcggcccgacgcggtcaccgtcaaccttggcgggtccggcgccctggcgtactcctcgagcaaccagaaccccctcctccccaggtgagtcgagcttgctttttgtattgtctcagtggagggatgaggatcatcctcccgtcgctgttgggagggtcatgcactacactacatggcagtagtggtgtctgtgcagaatgtgtgctctctgatgtctgagcctcgttttactgattttctctcgcgtgacaaactgacattcctgcgagattataaattacaacttgatagctttttcactatttattgagacatttctacctctatagtatatgatccgcgttctcgcggattcagaaactagtcaacaagcgacaaaccctgcgtccctgccgttgctttagcagtacgccgacactagcaattaccagaaccagacccgtttccttgttaggttactgctgaactggtacagatccgttacaacgagtgttgctatcaactctgctatatcattagcctagcgtgatcagcggtatacgccgtacctcgttctcaaccaaatcgttcatggttgcaggttgtttggcgcggtggacggcgtattctgcatgttccagggaacaattgcgaacgttgctgtgctgaagcagcagtatgggttgagcaaaggcgctaatgaggtcagcatcatcatcgaggcttacaggaccttgagggacaggggcccttatcctgcagatcaggttgtgagggacataagcgggaaatttgcatttgtcctgtatgattgctccactaagtcggtcttcatggctgctgtaagtgaactactcctatgttgtaccaaattgtttttttttggctattctcattattaacatcttatgagcagacattttgtcaataaattagtcagtgactcagtggtgttgtccttttaaaaaggattgtgcatagtggtgttctggttgctctatgtggatgagaactcaaatcatcttgggatgcacatagaatcggcatcatatatagtagacaactaaaggttttgcttaaggtcgaagtggcaatgccattttttcagcagactattggatcatagtggtgctagtgcagaactggcagcataaaatcgaatcaaattcccgctaattgggattatgacacctatctagtgagtagtgatgtcacttttttttcaagtaaaaaaaaatgagaccttcacttctagactagtctagagaccccagcctattctgttcgtgtgatcagcatcatctatgtgacatttatcaatgttttgagtttccaccttcaacaagaacagcaacatcacgatctacctgcatttcaactaaattggctggttcttgacgatgcttctgcctaacattttcaggtcatcgtcctacatttacaaagaacagatgcagctgttcagttattcccgaagacatatatctgatcacaggctactgctacgacgtacaatggtaccactggtattgaccggcaactgataggtagctcagctcgtgttcgtaacctcataacaggacaccgatggaaatgttccgttctactggggcgtggacaccgacgggcgtcttgtggtctctgacgacgccgaactcgtgaagagtgcctgtgggaaatcctgtgccccgttccccaaaggtaaaaaagaaaatatacgaacagaagtgtttctcgtcactcttcactctgctctcgcccgcgcgctagctgacgcctggctggcgtttcgacttggatgtctctcgactgcatcaggcttcttcttcacgacgtccggagggctgaggagctacgagcaccccatgcacgaggtgaagccggtgccgagggtggacagcaagggcgaggtgtgcggcacgacgtacacggtcgacgcaagcgccaggaaggagaccaccatcccaagggtcggcagcgccgccgactggtcttcgcagtactaaaattcgttatctttctctgtgtgtgttgaacgggttcgagcgcaggtagcagggcgtcgcacgggcgtggcccgtgtttgttcgcatggaaaccctagctgtctggtgtttatctgaatgaatagactgttctctatgaatcaacacggatttctctctaagttcacatgatttccgttgctgctttgctgcacgcctgtactgtaacaagaattactgcctttgttatcaggaaataagttcacatgatttcctgtctgcagatgcgctgccagtcgagcatccttgaggaaggatagggataaggcagtaccggctagtagaagaagcaatgaagcatgacacgggcgttactgtgcgcaaatagtgccggaactcgaatcacgcaaccgtgtgccactgccacaggcgttcgctgtgcctgcacattcccccttgatcggcttgggggcctggtagttggcaccaataatctgccgtgtatatatgggctgtctgggctgggctgggctgccactgccgtggacgggatctgttgcgacagggaaagaggccgaccagcagcccattccttttgtatgtatctcaccgtctcttcccggcaggcataggggacgcacgatggcgtcacccacttctcttgctgttgctcccatcccatccgccgacaacgtggcgtcggatcctgagacggacgttccagatctgcgcataacatatgagccccagcccccaggagaggacttccggcgcggctagcaaagagacccaagagaggagagggacggacggacggcgcggcgtgcgcggcttttgcatgcacgcatgcatggcagcgcacgcgggagagccggctgccggcgggccgggaccgggaggggtgcccgtgccgtgcgtcggtgcgtgcacatgcagatgcagaggcagcaggcgcgcgttcccatggccatgcacgatcgatactcctagtatctgataaaaaaaaactagctagctactaggcccgccaaaatatgcctacatgttgctaactacgagtgtggctaccatagttttggtagccttcgatcatttgttaactttgctaccatagttttgctaactacgagtatgttgcaacttggctagccttcggtcatttgttaacctcgtagagcctgtttggtttctcaaaaccatgattttataatactatactttgtaattgtcataacaataccatagttttagtagctcaaaagatactatggttttgagaaacattgtttggatataacattgtaaaccacgatattagacaaaagctaacaatgccactttggatgggaatttctaatactccaaaaacgccatggtatctagaatatcatggttttaaagacatagttttcaagattgcaatcaaacacctcgtgacattaaatactacggtattgccccagaccatggcattgcatagaaactgcaaacggtattgcccaagaccatggcattgcatagaaactgcaaacgtactgcatttccaaacaggccattaggatatagacgatagccatatatttaagctaagttcattgcctctagacaattttcatacacattatttgttgttgttgttgttgttgttgttgttgttgttgtgtctaataagatttattttgagacataagatttaatttaaaacaagcctcgatcaatttcaattagattcaatgagacatgtagctaactactacgagtcttatgatcatacgacgatacaacatgatgcacgtctgttacagaactcgtactatatgttttgctagaactaccagtaccacagaaagtcacgaggactacgcatatca

SEQ ID NO: 16718 - DNA, 3958 bp, Zea mays
  misc_feature (2791)..(2791): n is a, c, g, or t
  misc_feature (2795)..(2795): n is a, c, g, or t
ggtacccccgagttcggccgggatcttcgttctgagctctctccccctcgccccgcccggctacccaccaaatctcgcagtcgcagcaggtccgggtgctcccgaggaatccattcccaatttgcgtttccctcccaccaccgcttcttcccgtatcccttgtcctccctaatttcctctcacaaaaagcgggtgcggcttcctgccactcacctcggtctcagggggcgccgtgcggcgggcgcccgtgctgctggtttcgctccaggggagaaggggcagagggagtagagcaggttaggtccgtttgcgttttcttttgcgggtttgtaggtcaaaagctccgcgagcactttccgctccacctcctcacgctcggaatcaaatcgatgcccccctgatttggttcctggtatcggtgcatgagcttgctccaagagatctcccttttggttcggcgtcaggggttctgtgaggtcacgcggcttcttcctcttggcgctcctcacatgtctgggcgcttcgatctctgcccactgcgcgagtgattctgctgctgcagcagctgttaggtgcgcgcgggccgttatggggtgaaccgaagcgttcctcgctgggctgtgggtttattacgccgcctgtttgcttccccgcaccttgtcctactccttgtgcccatacttctttgcttttgtcacgcctgaaccgtgtcttcttgtagtatctgaggcttggcagttggcaagtacaaaatagcaacttgcttaggtataaacccgtgtctggtgcagagcccaaaggggtcacgaatcgttgatgcatagatctgcttctggctgagataaggctctaagttcgctctgttgatggggctaccatgagccacgggaacgggatgttgaattctgtcaaggtggagaggtggccagcagcggtcgctgcaaatggccagcctaggccgatggatgtgctccacgacggcagctcgccgccgttccttaccaagacgtatgacatggttgatgacccaaccacgaacgctgttgtgtcatggagtgccgccaacaatagctttgttttgggatcctcatatctttggcacggtgctgctgccaaggtacttcaagcacaacaacttctccagctttgttcggcagctcaatacttatggcttcagaaaggtggatcctgacagatgggaatttgctaatgaggagtttctgagaggtcagaggcacctcctcaaaaacattaggcgtcggaaacctccacactcatctccaaatcaacaatctcttggctcttacctcgaggtaggacactttggatatgaagaagagattgatcagctgaagagggataaacagctcttgatggctgaggtagtgaagctgaggcaggagcaccaaaatactagatcagatctacaggccatggaagagaaattacaagacaccgagcagaagcagcagcagatgatggcattcatggcacgagtcatgcagaaccctgatttcatgcgtcagctgatctcccagcgggagatgaggaaggagctcgaggatgctatctcgaagaagagaaggcgccgcatcgaccagggacatgaagctggtagcatgggcactggttctagcctggagcaagggccacagggagtgtttgaaccgcaggagccggtggaatcactcgccaacggtctgccatctgatctggagagttcgtctgttgaggcgaagggattcgaggttcgacagggtgtttcttcaggtggttctgagcatctgaatggcaggccaagcggagagttaaatgatgatttctgggaggaccttctgcatgaggggggactcggtgcagatgcaggcaatgctgttggtcaggatgatatgaacatggacatggacccagatgttagcctgcctcaactgaaacaacatggtcccagacattagccgctcttgtgctatcacaatggctgtgactgtgagtatctttacagttatgctcgttatatccctgtggtgtacctgtttcgatcgtcttcgaccaaatgtcacgtcgactgcagtctccagttgttaatacagtctgttcagcacgctgatttaagtatttgggtcaagatgttcatataatcctgtggtatccagagatattatagtttgttttcgtaactgtttgcgcagagaccatgctatgttgcctgcaggctatcagtgtatttgttctaacagatcgcaacgctggtacaacgcagtgacctgccagactgggccactatgagattgtagggaaagaccagatagcttgtgtatgtaaaagtggtcattctatcattctatgtatggtgatccataatagcctatcatgtgcaacgctattgccctttgggatttggcatttcactgtatataacatatcatcggctcatcgccgtattgccgcatacatcattgtcttggtttacacaaaaaaaaaaaaaaaaaagcccgttggcttacacatgtaccgactcggtcagtgcccgaggatctatttgcgtgcagaagagttctttttttcttcaatttctgaaatctagaggcttctgtcttcttgttctgtttgatgctacttttccctcgagggaattgtcccatgctaatgctatttttacccgttttgtctttatcctttccgcgtccgacgagtgcgcggcggccggtgatgactggtcgcgacaggtgtgccgcgggccccgcggcgccgtgccgtgtggatcagtcccgatccttctcccgccttcggncttncccgcgcgcgcgcgcacgcgcacgcaccagcaccaccgcgatataaagcccgccaccaatccgctcgtggtcgtcgtcatcatcccgattcccgacacgcttgtgttgtcgcgattggcaagctcggcggctcgtggcagcgggaacgtacgaggcgaaggagagcgagggcgaccgcgcggatcgcatcgcagctctgggcggagatgctggcggtgttcgatcgggcggtggcgccgagcccggaggggctgcggcagccgggcgccgcggggggcggcagcgcggcgggcctcgcggaccggttcagagaggcgcggcccgacgcggtcaccgtcaaccttggcgggtccggcgccctggcgttctcctcgagcaaccagaaccccctcctccccaggttgtttggagcggtggacggcgtattctgcatgttccagggaacaattgcgaacgttgccgtgctcaagcagcagtacgggctgagcaaaggcgctaacgaggtcagcatcatcatcgaggcttacaggaccttgagggacaggggcccttatcctgcagatcaggttgtgagggacataagtgggaaatttgcatttgtcctgtatgattgctccactaagtcggtcttcatggctgctgaccccgatggaaatgttccgttctactggggcgtggacaccgacggccgtcttgtggtctctgacgacgccgagctcgtgaagagtgcctgtgggaaatcctgtgccccgttccccaaaggcttcttcttcacgacgtccggagggctgaggagctacgagcaccccatgcacgaggtgaagccggtgccgagggtggacagcaagggcgaggtgtgcggcacgacgtacacggtcgacgcaaccgccaggaaggagaccagcatcccaagggtcggcagcgccgccgattggtcttcgcagtactaaaattcgttatctttctctgtgtgtgttgaacgggttcgagcgcaggtagcaggtgacacgggcgtgggccgtgtttgttcgtatggaaaccgtgtctggtgtttgttcgtatgatttccgttgctgctttgctgcacgcctgtactgtgacaagaattactgcctttgctatcaggaaataaatttgtagagtttagagttgttttaaaaaaa

SEQ ID NO: 16719 - DNA, 2639 bp, Zea mays
gagcatctgaatggcaggccaagcggagagttaaatgatgatttctgggaggaccttctgcacgaggggggactcggtgcagatgcaggcaatgctgttggtcaggacgatatgaacatggacatggacccagatgttagcctgcctcaactgaaacaacatggacccagacattagccgctcttgtgctatcacaatggctgtgactctgtgagtatctttacagttatgctcgttatacccctgtggtgtacctgtttcgatcgtcttcgaccaaatgtcacgtcgactgcagtctccagttgttaatacagtctgttcagcacgctgatttaagtatttgggtcaagatgttcatataatcctgtggtatccagagatattatagtttgttttcgtaactgtttgcgcagagaccatgctatgttgcctgcaggctatcagtgtatttgttctaacagatcgcaacgctggtacaacgcagtgacctgccagactgggccactatgagattgtagggaaagaccagatagcttgtgtatgtaaaagctgatccatagtagcctatcatgtgcaacgctattgccctttgggatttggcatttcactgtatataacatatcatcgccgtattgccgcatccatcgttgtcttggtttacccatttaagtttgttgtcttcccttttagcttacacatgtaccggctcggtcagtgcccgaggatctatttgcgtgcaaaagtgttcttttttcaatttctgaaatctagaggcttctgtcttcttattctgtttgatgctacttttccctcgagggaattgtctcatgctagcagtcccttcgaccgaccctacgttcatcatgcaaacttgaatggtttttattcatcaaactttgaagtggtactactgtggtggtgtttggttcatgcctcgttcttagaatctcattattagccaaacagattctggatgttatattggatttgccagaatctcacaatatcaacaaaagttgataatataatttgtattggattttgtgtagtgtgcaacttttcaaaatctatggagaaccaaaaccacctatgcaagaagacataacttacatgtctacattggggccatttccgaaatgggcctcgacagagaatagaatagcctaatcaattcagttggttatttcttatctagaagcaaaagagaaaatgctaatgctatttttacccgttttgtctttatcctttccgcgtccgacgagtgcgcggcggccggtgatgactggtcgcgacgggggtgccgcgggccccgcggtgccgtgccgtgtggatcagtcccgatccttctcccgccttcggccttccccgcgcgcgcgcgcacgcaccagcaccaccgcgatataaagcccggggggggggcgctcgtggtcgtcgtcatcatcccgattcccgacacgcttgtgttgtcgcgattggcaagctcggcggctcgtggcagcgggaacttacgaggcgaaggagagcgagggcgaccgcgcggatcgcatcgcagctctgggcggaggtggggccttgcgcggagatgctagcggtgttcgatcgggctgtggcgccgagcccggaggggctgcggcagccgggcgccgcggggggcggctgcgcggcgggcctcgcggaccggttcagagaggcgcggcccgacgcggtcaccgtcaaccttggcgggtccggcgccctggcgtactcctcgagcaaccagaaccccctcctccccaggttgtttggcgcggtggacggcgtattctgcatgttccagggaacaattgcgaacgttgctgtgctgaagcagcagtatgggttgagcaaaggcgctaatgaggtcagcatcatcatcgaggcttacaggaccttgagggacaggggcccttatcctgcagatcaggttgtgagggacataagtgggaaatttgcatttgtcctgtatgattgctccactaagtcggtcttcatggctgctatgcagctgttcagttattcccgaagacatatatctgatcacaggctactgctacgacgtacaatggtaccactggtattgaccggcaactgataggtagctcagctcgtgttcgtaacctcataacaggacaccgatggaaatgttccgttctactggggcgtggacaccgacgggcgtcttgtggtctctgacgacgccgaactcgtgaagagtgcctgtgggaaatcctgtgccccgttccccaaaggcttcttcttcacgacgtccggagggctgaggagctacgagcaccccatgcacgaggtgaagccggtgccgagggtggacagcaagggcgaggtgtgcggcacgacgtacacggtcgacgcaagcgccaggaaggagaccaccatcccaagggtcggcagcgccgccgactggtcttcgcagtactaaaattcgttatctttctctgtgtgtgttgaacgggttcgagcgcaggtagcagggcgtcgcacgggcgtggcccgtgtttgttcgcatggaaaccctagctgtctggtgtttatctgaatgaatagactgttctctatgaatcaaaaaaaatttctctctaagttcaaaaaaaaaaaaaaaaaaa

SEQ ID NO: 16720 - DNA, 1706 bp, Zea mays
  misc_feature (1611)..(1611): n is a, c, g, or t
gccggccggatcttcgttctgagctctctctctctctctccctacccaccaaatctcgcagtcgcagcaggtccaggtgctcccgaggaatccattcccaatttgcgttcccactcccaccaccgcttcttcccgtatcccttgtcctccctaatttcctctcacaaaaagcgggtgcggcttcctgccactcacctcggtctcggggggcgcccgtgctgctggtttcgctccaggggagaaggggcagagggagtagagcaggttaggtccgtttgcgttttcttttgcgggtttgtaggtcaaaagctccgcgagcactttccgctccacctcctcacgctcggaatcaaatcgatgcccccctgatttggttcctggtatcggtgcatgagcttgctccaagagatctcccttttggttcggcgtcaggggttctgtgaggtcacgcggcttcttcctcttggcgctcctcacatgtccgggcgctttcgatctctgcccactgcgcgagtgattctgctgctgcagcagctgttaggtgcgcgcgggccgttatggggtgaaccgaagcgttcctcgcagggctgtgggtttattacgccgcctgtttgcttccccgcaccttgtccttgtgcccatacttctttgcttttgtcacgcctgaaccgtgtcttcttgtagtatctgaggcttggcagttggcaagtacaaactagcaacttgcttaggtataaagtataaaccagtgtctggtgcagagcccaaaggggtcacgaatcgttgatgcatagatctgcttctggctgagataaggctctaagttcgctctgttgatggggcgaccatgaaccacgggaacgggatgttgaattctgtcaaggtggagaggtggccagcagcggtcgctgcaaatggccagcctaggccgatggatgtgctccacgacggcagctcgccgccgttccttaccaagacgtatgacatggttgatgacccaaccacgaacgccgttgtgtcatggagtgccgccaacaatagctttgtagtttgggatcctcatatctttgggacggtgctgctgccaaggtacttcaagcacaacaacttctccagctttgttcggcagctcaatacttatgtaagttgttaactctatagatgctttggtttcatgttctatgatgcggttgaggtgtgctgaaatcctactaccttatttgtggagtgaattaccgttaggtactgtttgttttcgtgtttttaaccctgtaagcgattgcaccactgtaggttgccgttcttccgtgtttgtttctgcggctgcggaaccattcacggagggatgatgcggccgtgtgaaaggtcgttactttccatccccaggtcttatccatttacactgctcgcgggttgcagtttctcctctgctcgctcatcgtgtgtggcaaccaaacacgatgatgcggccgtgtgaaaggtcgttactttccatctccaggtcttatccatttacactgctcgcgggttgcagtttctccctctgctcgctcatcgtggtgtggcaaccaaccaaaaaaaaaaaaaaaaataaaacaaaacatcataatnataaaatcacaaataaaaaaaaaataacatacaaacaaaccaaagaacataacatttaaaaattaacacaattataattaataaagggggggggc

SEQ ID NO: 16721 - DNA, 942 bp, Zea mays
  misc_feature (888)..(888): n is a, c, g, or t
cctcgaggccggccgggatcttcgttctgagctctctctctctctctctctctccctacccaccaaatctcgcagccgccggcagctccggggctcccgaggggtccattcccaatttgcgttcccactcccaccaccgcttcttcccgtatcccttgtcctccctaatttcctctcacaaaaagcgggtgcggcgtcctgccactcacctcggtctcggggggcgccgtgcggcgggcgcccgtgctgctggtttcgctccaggggagaaggggcagagggagtagagcaggttaggtccgtttgcgttttcttttgcgggtttgtaggtcaaaagctcggcgagcactttccgctccacctcctcacgctcggaatcaaatcgatgccccccctgatttggttcctggtatcggtgcatgagcttgctccaagagatctcccttttggttcggcgtcaggggttctgtgaggtcacgcggcttcttcctcttggcgctcctcacatgtccgggcgcttcgatctctgcccactgcgcgagtgattctgctgctgcagcagctgttaggtgcgcgcggtccgttatggggtgaaccgaagcgttcctcgcagggctgtgggtttattacgccgcctgtttgcttccccgctccatgtccttgtgcccatgcttctttgcttttgtcacgcctgaaccgtgtcttcttgtagtatctgaggcttggcagttggcaagtacaaactagcaacttgcttaggtataaagtataaaccagtgtctggtgcagagcccaaaggggtcacgaatcgttgatgcatagatctgcttctggctgagataaggctctaagttcgctctgttgatggggctaccatgagccacgggnaacgggatgttgattccgccaagggtggagaagtggccagcagcagtcgctgca

SEQ ID NO: 16722 - DNA, 1983 bp, Zea mays
tacagttgatctcctaactccttgcttccatggtgactcatttcttgataggatgctatccttgttgccacgcaaggaaaatatgccatccaattctgcagcgaaaaatccacaaactcgaagtaagcattctcaaggcaccattaaacgttccccactggatataaaagttccttttgagacagtgtttagcaaggaagaatcaaagattaggagcagtatgttatctgaaggtttcatgtcatttgcgtctggatggaactccgttgatgttgactctgaagttagctggttacctgattacgctgataaagcacatgatcacaaacttagctgtgaacttgacactataagtggctcgttcctacccaattgtgctcgaatgcgctacttagaagcattgctagacagaggatcgaaagatgggttagtactcattaaaaaatggcttattgaagccttgcagcatgggaagctaacatctgcatccaaaggtcggcaaggagccacttctgtttcccacgcgcccgccctcgcgcccgccctcgcccccgaccagttgtcattgttaaaaaacagggcgtgttatccagttagcactagctgctgaaatgactctacgggagcctcaaagttctcgctgggacgcctttacaagtgccgagagaatattaagtgtgacatctgcagagacacctcaaagtcttgccagtgagcttcgtgatttcatcaacactagcactttagttgaatcacacacacaaactacttcaatggagtcttcacagggcctacttagtttccaggacgtactgcttctaacgattatagggtatatcttagctggtgaaaatttccctacatctatggctggtggtccattttcttgggaagatgagcggtctcttaaagatgttatagtggactctatccttgaacgaccatcatctgtgaagttgcgcttccttgatggcctggatagtgaacttgaagctaaagctagatctaaagatggtgagaggaataaaaactctagcgaggtagcacccagtactgatgatgattttgatgatgaatggggtacctgggatgacagtgataatactgatcaccaaaaggaggaagcttatggggacatgcaacttaagttggaagtgcgagatagagttgatcagcttttcaaattctttcacaaattatccagtatgaggttaagaaatcaagcccttggtgaaggtctagcagcattaagtagattcgagactgacggttactcgaggaaatgcttgctttataagttactattagctctcttgtcgaggtacgatgtacctggcctcgagtatcattcatcaactgttggtcgtctattcaaaagtggactaggtagattcgggcttggacaggtgagtttctcagtctttttgtccgtttccatttaattgctcagttctaagttttgttctatttgcagtctaaaccagccttcggtgatcaatctgttcttatcatttttgttcttggaggtattaatactcttgaggtatggtccatttcctttggtttcaattattcatgccaagataattctttattcctcccatagtttggttggtgttgacatggatatttgatctctatgaaactactgtgaacctgttgttagcttttaatcccaatggaaatcctttatgtttgtcgtttgttattccttggagggatggtattttagttacttttttgtataatgtgtttacctttgtacaaaggaagcaagtaggccttttttttttgtaatatccgtttctcagttcagtgtatcgttcagccaaattacttttaactttggactagatatttcttccttttttcgtcatatattttgcaagcgtacagttcagtgtatcgttctctaattgttatatgttggatctgagattatggctaagacacaaaaggttttagttactgcaggcatgcaag

SEQ ID NO: 16723 - DNA, 710 bp, Zea mays
tccagtatgaggttaagaaatcaagcccttggtgaaggtctagcagcattaagtagattcgagactgacggttactcgaggaaatgcttgcgcggtacgcccacgcgtccgctcttgtcgaggtacgatgtacctggcctcgagtatcattcatcaactgttggtcgtctattcaaaagtggactaggtagattcgggcttggacagtctaaaccagccttcggtgatcaatctgttcttatcatttttgttcttggaggtattaatactcttgaggtccgggaagtcatgacagcgatatcggagagcagcagaccagatgtggagcttattctgggtgggacaacccttcttaccccagacgacatgtttgagttgatgttgggatcgtcaagctttgcttaggctcaaccttcactcttgagtcatgtgcgggacttggaaagaaatcggagcatatttttttcttattctccagaatagttacttgtctgatgtagcagaagcattcagactcggaagaggatactaccagaagaaagcagtccattcacagtcaaaatagtttgcaagatgaacccacgagtattgctggaaggtgtaagaaacagtgtgtctagttatcagtggctgactcttgttgtaaaacatgtagcagagatatatcaagcaaaagatgcgtaagaactcaagtaatttgttttgtcact

SEQ ID NO: 16724 - DNA, 2028 bp, Zea mays
tccgccgggcacactcctcaccttgtattctcaaggaaaccctttatccatggctcgaggtatcatactactcctgcttgtcatccccctcgtcgtgagaattgaagggagtgtcatgggggagagatccaactcgttctcacaggactccaataattctagccctgctgaaaacaaactccaaccaggtgaaaagtccttcgcatcggaagcatatgcggtgaactggaacgaaccaccagacctgcaaatgcaagactccttcgagcgacctgagctatatcggaagcaatcagtgcaaggtgaaaagtccttcgcatcggaggcatatccggtgaaatggagcatatcaccatcactaggtcagcaatcacaagagtctttcgagccagaggcatatccgatgaaatggaaagaaccaccaccatcaggccaacaatcgcaagactctttcgagccagaggcatatcgggtgaaatggaacaaatcaccaccaccacaccaacaatcgcaagactccttcgagccagaggcatatcgggtgaaatggaacaaatcaccaccaccactccagcaatcccaagactccttcgagccagaggcatatcgggtgaaatggaacaaatcaccaccaccacaccaacaatcgcaagactccttcgagccggaagcatatcgggtgaaatggaacaaatcaccaccaccactccaacaatcccaagactccttcgagccagaggcatatcgggtgaaatggaacaaatcaccaccaccactccagcaatcccaagactccttcgaaccagaggcatatcgggtgaaatggaacaaatcaccaccaccactccagcaatcccaagactccttcgagccagaggcatatcgagtgaaatggaacaaatcaccaccaccacaccaacaattgcaagactccttcgagccggaggcatatcgggtgaaatggaacaaatcaccaccaccactccaacaatcgcaagactccttcgagccggaggcatattgggtgggatggaagcaacatgcgcaaggagaaacagacgttgctgatgggacgacgccagcacgcggccatggcctgcatgtcgcgaccgggatgcttttcacgaggaagagcttgcttccagggacagccctaccggaaggcaccaggttcagcggccacggcttccccgatccgcagaggttcgcgctacgggcagacgcggacgccatccccttcagctacagccagctcgacgcgatcctaaggatgttccggatccctcgagggtccaagaaggcggagcaagtcgctgacacactccgggcatgcgaggccgagtcctcggacgctcatgcctgcgccacctccgagcaggcggcggcggactttgctgcctcctcgctcggggtcagggctagcgacctggtatcggtcgtcaccgccgtccacggggggaaggacgccactaggtacgtggtggcgcccgacggcgtcacacgcatcggcaaggcggcgggggccgcgaccgcggtgccgtgccacccgatgccgtacccgtacatggtccattactgccaccggccgacggacgtggaggcgctccgcgttgagctgactgggctcggagacgacggcgcgaccatcgcgatcgccatgtgccacgccaacaccatgagctgggacgaccgctacttccagatgttgaacgcgacgcgcggcgaggagatctgccacttcatgccgtggaactatgtgctatggctgccggctgccgaccttctagcgaataactaggatcaccttctaggcgggtgatacaccgtccattctaaaatgtaaaaaataaaaataaaaactatatacatagttttttattatgcacttagatatgcgttataattagatatataataaaaaaataaacgacttataatttataattaccatccacaacagagggcgaaaatctagatcacaatttttaacgagtaaagaaatagtaagtaccctaaaattacacattc

SEQ ID NO: 16725 - DNA, 2085 bp, Zea mays
gccggccgggctgtgcgacacgactctcggcaacggatatctcggctctcgcatcgatgaagaacgtagcaaaatgcgatacctggtgtgaattgcagaatcccgcgaaccatcgagtttttgaacgcaagttgcgcccgaagccttctggcggagggcgcgtaccctcgaggcccgcccgggcacactctttggttgaactcttcgcaccttaccttctattctcaaggaaacctttatccatggcccgaggtatcatactgctcctgcttgtgacccccctcgccatctccatggcactgccatcactatcaacgagaatcgaagggagtgtcataggggagagatccaacttgttctcacagctgcactccgataattctagccctacagaaaacaaactccaaccaggtgaaaagtcctttgcatcggaggcatatgcggtgaactggaacgaaccaccagaccaacaatcgcaagactccctcgagcagctagagccgtatcgagtgatatggaagcaaccagtgcaaggtgaaaagtccttcgtatccgaggcatatccggcgaaatggaacaaaccaccatcaccaagcaagcaatcgcaagactccttcgagccagaggcatatcgggtgaaatggaacaaatcaccaccaccacaccaacaatcgcaagactccttcgagtcggaggcatatcgagtgaaatggaacaaatcaccaccaccacaccagcaatcgcaagactcctttgagccggaggcatatcgggtgaaatggaacaaatcaccaccaccacaccaacaatcgcaagactccttggagcaggaggcatatcgggtgaaatggaacaaatcaccaccaccacaacaacaaacgcaagactctttcgagcaggaggcatatcgggtgaaatggaacaaatcaccaccaccacaccagcaatcgcaagactccttcgagccggaggcatatcgggtgaaatggaacaaatcaccaccaccacaccagcaatcgcaagactcctttgagccgaaggcatattgggtgggatggaagaaacatgcgcaaggagcaacggacgttgctgatgagacaacgccagcacgtggtcatggtctgcatgtcgcgaccgggatgctcttcacgaggaagagcttgcttccagggacagccctaccggaaggtaccaagttctgcggccacggcttcctcgatcccgagaggtttgaactacgagcggatgcggatgccatcccgttcagctacagccagctcgacaccatcctgaggatgtttcggatccctcgggggtccaagaaggcagagcaagtcgccgccacgctccggacatgcgaggctgagtccccagaggctcatgcctgcgccacctccgagcaggcggcggccgacttcgctgcctcctcgctcggggtcagggccagcaagctggtcgcgctcgtcaccaccgtccatggggggaaggacgccactagatacgtggtggcgcccaacggcatcacacgcatcggcaaggcggcaggggccgcggccgtagtgccgtgccacccgatgccgtacccgtacatggtccactactgccaccagccggcggacgtggaggcgctccgtgttgagctgaccgggctcggagacggtggcgtgacaaccgcgatcgccatgtgccacgccaacaccatgaactgggacgatcgctacttccaaatgctgaacgtgacgcgcggcgaggagatctgccacttcatgccgcgcaactatgtgctctggctaccagctgccgagcttctagggaactagtggcaatgccactatgttaggtgtcgttgctttgataaaatgaagtgtatgacaatgacagcatcaacaattgttcgtatgaacatatggttggacatgataactgcgagaaagagaggatatatgttgttgcgccctatgaattgtgatatggtgttgtggtggaggatgcatcaaatgatggggaagctaccttagttgtgcaaactacttttaagaactccatttttccaaaaaaaaaaaaaaaaaaagcggccctcgagct

SEQ ID NO: 16726 - DNA, 826 bp, Zea mays
attgtgtgggttcaaggggaagcccacaggccgccgcaacttctccacacccgaggagatcgctgcctggagggtgcgcgcgagcccgcggacgcggcggcgctccgtggcggcgaagctggagcgcgggctcggcaagggggttcccaccaccaactacgtggtgccgctcgacaaggccaccgggatgacgcgcccgctcgtcgagatcctgcgggacctcaacaagcgcgtccccgacaagatcatcgaccccgacactaccttgatcaactggtaccatgccaacagaatgcttagtttttacgcaccaggttggtgtggagaagttcgtgatgttatctattccgagaatggaactgtaaccgtggtatatcgagtgatacttaaaggaactgatggagaggcatacagagatgccacgggcacagcacagttacatgaggggcgcagggaagatgctgttgcagccgcagaggaagctgcattctgcaaagcctgcgcacggttcggttttggcctgtacctgtaccaccaggatgattctcattacgacgaccacttccattgaggctcagtctgcaaaagagttgatcataagctacaacatgcgttggatatgcccctggaaaaacttcgcatccagaatcaatttttgctctttgtgtagtatcatactcataacacagagaagtgaacctatgtagatactattcgaaaccttctttttattaatattagaattcttattaatattattgtataattattttttaatgtatatgtttggacacaatctattgattgatctttcttctggcagtct

SEQ ID NO: 16727 - DNA, 1657 bp, Zea mays
cccacccggccggccaaagttcccgtggtcgtcccacactcccacccctaccaacgctctgcgccaacgaacgcgtccgcaagtcaaaccaggcccggagccaccagcaaccaaccgagcgcatggaggccgcggcggcgaccgcgctcccgttcgcggcggccgtccccactgcctggagggtgcgcgcgagcccgcggacgcggcggcgctccgtggcggcgaagctggagcgcgggctcggcaagggggttcccaccaccaactacgtggtgccgctcgacaaggccaccgggatgacgcgcccgctcgtcgagatcctgcgggacctcaacaagcgcgtccccgacaagatcatcgaccccgacactaacaccgtcaactggtaccatgccaacagaatgcttagtttttacgcaccaggttggtgtggagaagttcgtgatgttatctattccgagaatggaactgtaaccgtggtatatcgagtgatacttaaaggaactgatggagaggcatacagagatgccacgggcacagcacagttacatgaggggcgcagggaagatgctgttgcagccgcagaggaagctgcattctgcaaagcctgcgcacggttcggttttggcctgtacctgtaccaccaggatgattctcattacgacgaccacttccattgaggctcagtctgcaaaagagttgatcataagctacaacatgcgttggatatgcccctggaaaaacttcgcatccagaatcaatttttgctctttgtgtagtatcatactcataacacagagaagtgaacctatgtagatactattcgaaaccttctttttattaatattagaattcttattaatattattggatgatctgcaatccccaagtagagaaattgtgcacagtcatgatttcaatcgtcacctgactcccttcaaagctgagtgggatccaaaggattacaccgaaacagttgcagtgattggccgttacataagtgagaactacaatggtgttgctctgcatccaattgattttatagatactagttctgggaagcttctggctgaggtgatggaccctgacataataacaatcagcccagtgaacaagctacatccgcaagatgacatcctagctacaggaagctcaaggtctattttcatatggaagccaaaaattgaagatgaacttactgaagaaagagccaagcatgacaatagtagtgatgacgactcaggtggtgattctggcggaaagaacaagaaagcaaagaagactcgcttcactcatgcagtaaagggaaagggcaaatccaaagtctgatgcttggtgtacatagtcggcagcattttgacaagaaagcgtccattaaccagctcctgatgcatctccttttgtaccatcttgccaactccctcaccccccccagctaaggtgctgaagacccgtatgaaacgcatgctgatagaccccatagttgtctcctgcatcaatgctcctaaggagttagccagttaggtttcggactcttttgaatcctgacatgcttatgatcacttgtcatttgtcaacgaggccttttaacggtttaatcctgtatcaacatataaatctcctgtacagttgcctgaatacaaaaaaaaaaaaaaaa

SEQ ID NO: 16728 - DNA, 1972 bp, Zea mays
gttggtaatactgtacaaattttcgtctagttgcgtgctctcgctagggttccgccccgccggcatacccgaccataaaccccgcgccgcccgccagcaaccttcagtctcatttctcacgcgtagctcggacaggcagcttgaagctcgcgaaccagccatggcgaatggggacgcggccgtggaggtcggcgggaacggggagcaggaagccgcggcgcgccaggcgtcgacgttcgcggagctgggtatctgcgcggagctggtggaggcgtgcgacgccatggggtggaaggagcccaccaggatccaggccgaggccatcccccacgcgctccaagggaaggacctgatcgctctggcgcagacggggtccgggaagacgggcgcgttcgcgctgcccatcctgcaggagctgctcagcaaccgccaggctgaacagtctttcttcgcttgcgtgctctcgccaacaagagagctggcgattcagatcgcagagcagtttgaggcgcttggatcagctattggtttgcgttgctcagtgcttgttggaggagtggatcgggtgcagcaagtgttatccatcggaaaacgtccacatattgtagttggaactcctggccgtcttttggaccatttgacagagactaaaggttttagccttaagaaaatcaagtatttggtattggatgaagctgataaattacttaatgtggagtttgagaaatcccttgatgacattctaagcgagatgcctaaagacaggaggactttccttttttcagcgactatgaccaaaaaggtaaataaactgcaacgtgcttgtctcaggaatcctgctaaggttgaagtgtcctccaaatattctacagtagattcacttaaacaagagttctattttgttcctgcagatgacaaggattgctatcttcttcatgttctgaacgagaggctggagagcatgatcatgatctttgtgcgcacctgtgaatctactagactccttgctcttatgttgaggaatcttggtttgaaagctatgtctatcagtggccagatgagtcaggacaagagattaggtgctttgaacagattcaaagcgaaagattgcaatatccttatttgcactgatgtagcaagtcgcggcctcgacattcaaggagttgatatggtcatcaactatgatattccaatgaattctaaggattatgttcatcgggtgggcaggactgcacgtgcagggcgatcaggatacgctgtatctttggtgaaccaatatgaagcccagtggttcgtgctgatcgagcagctccttggcaagaaaattgaccagtgtaaggtggacagagatgaagtccttatacttaaagggcccatatccgatgcaaagagaattgcgctgacgaaattgaaggattccggtggccacaagaagcggagaaatgtgggagatgacgatgaagaggttgaagatcattcttctcattctagaagaccgaaatccttgaagagatcaaacagacgatgaaggctctggagcatgtctggactgcctcgtttcgtgcaagtcctttgtggttcagcgcagatccaccctgtggtggtttggagtgatgctttgcctatttatactagggccagttaagacgttcacttgacaccattccttgggttgaaagcaagtctcccccaattttgtcatcccgacccaaaccatgcttacataaggaatcattttttgctgatggctgccaaaaaaaaaaaaaaaaatccgacccgcatgtgcggttttgcccaaggcacaggcagccgttgctttgtgtcaacacggaagtgctagcttgacgttttaccggccatatccccgtatgtccggtatggctataaagtttttaataatgctataaaaatatcgtctcagtctaaaaaaaaaaaaagaaaaaaaaaactagaggggggggcccggtaccca

SEQ ID NO: 16729 - DNA, 1145 bp, Zea mays
ctctagtgtattgccaggtcaggcgcatcgttgtactgccgaggcgacgaagcgggcagtacgaatccctgcttctctggcagcagtactgtactgcactgcttctctagctggcaagtcaatgttgcgtgcgtgcatatatatatatatatatagatctcctcgcgtccttggacgtgttggcattagtggcaggcagcaggtttggtaacacacgcacaggtaaagcgcgagcggagagatgggggttggttttgatttggagacagggatgagacagagcatgggatggggccatcaacaaagtggagggactagcttgcgaggcagaaagaaggtgccagtgccggtgcctccccggtgaaacgatgatgggagtgttgttgctccctcccctgcactgcctcttccctggctccgatcccccaccgttgcccatccatcatctccctctcgctctcgtttatgctcttgcctgcattctttttcacagtaggcatgcagtactacttttggttctctttgcaatatatatactgcaggtttgctaatcgctaagagcctaagaatcttccgcctggagtggactgtactttcaggaaaaatcgttctaaaatatccggtctgcatcttcggggaggacgattgggcgcgacgatgcctcggtaccccaagaaacaggatcccatcgatcggtgctcaagctcgccagcaaccaaagaaaagatgcctccaagaaaaacaatttccagcttccccgattcaacacatgtggattagcacaaactctcttgtttagctttgatttagatctagttcctctgaattggtcccacctaattcttgacccttcgggcggtgtatagtcggacggaggactctcgttaattattaccaaaacgctgcaagatgatttctcactgaaatccggtgttgggtgcaaacatgatctgatctagtactagtacatttctacttattaccttgtgaaggctgcgtttggtttcctgagattttttaaaatccggtgcagtgttgcacagaatccaaggtagcagcatctcacacactgcagctggaactaagtagattctacatgtgttggagacttgttctcaaatactatgagttaagaacaagacaac

SEQ ID NO: 16730 - DNA, 931 bp, Zea mays
tagcgtggtcgcggccgaggtacgcgggatggcattagtggcaggcagcaggtttggtaacacatgcacaggtaaagcgcgagcggagagatgggggttggttttaatttggagacagggatgaggcagagcatgggatggggctatcaacaaagtggagggactagcttgtgaggcagaaagaaggtgccagtggctccctggagaaacgatgatggcagtgttgttgctccctcccctgcactgcctcttccctggctcctccgatcccccaccgttgcccatccatcatctcccctctcgctctcgtttatgctgttgcctgcattctttttcacagtaggcatgcagtactacttttggttctctttgcaatatatatacctgcaggtttgctaatcaagcctaagaatcttccgcctggagtggactgtactttcaggaaaatcgttctaaaatatccggtctgcatcttcggggaggacgagtgggcggcatcacgtcgcgacgagccgacgatgcctcggtactccaagaaacaggatcccatcgatcggtgctcaagctcgccagcaaccaaagaaaagatgcctccaagaaaaataatttccagctttcccaattcaacacatgtggattagcacaaactctcttgtttagctttgatttagatctagttcctctgaattggtcccacctaattcttgacccttcgggcggtgtatagtcggacggaggactctcgttaattattaccaaaacgctgcaagatgatttctcactgaaatccggtgttgggtgcaaacatgatctgatctagtactagtgcatttctacttattaccttgtgaaggctgcgtttggtttcctgagatttttttaaaatcacgtgttgcacagaatccaaggtagcagcatctcacacactgca

SEQ ID NO: 16731 - DNA, 1435 bp, Zea mays
gcacgagaccattccctgcaacctccgagcccagcgcccgcccccggcaaggcaacaccctcctcagcccgacgccgacgctcgccgtcatcctcgtaaatccacagcgcgcgcctcccgtcctcccaggcctcacccctagcgatgcgccactcccggcgctcgtgatccatggcctcactccccgttcctcacactcttccgcgggtctcgccagcgatagtgggcgccgcgagggggagggccgcggtgcgcgtacgcactgccaccgcggcattgggcggtgggtgcggcggcggcggcggaatggagcagcgccacggggatgccccgcacagcccagtgaaggagaagcctgtaatgtcaaacattgggaaatcgactaatattttatggcacaattgcttgattggacaatctgatagacagaaattgctgggacaaaaaggctgtgtcgtatggataacaggactcagtggttcagggaaaagtactcttgcatgtgcactgagtcgtgagttgcattgcagaggccacctcacgtatgtacttgatggtgacaacctcagacatggcctaaatagagatttaagctttaaggcagaagaccgtgcagaaaatatacgaagagttggtgaagtggcaaagcttttcgctgatgctggtgtcatatgcattgctagcttgatatctccatacaggagagatcgtgatgcatgccgtgctctacttccacattctaactttattgaagtatttattgatttgcccctaaaaatttgtgaagctcgtgatcctaaaggcctatacaagcttgcacgtacaggaaagattaaaggtttcactggaattgatgatccatacgaaccaccaattaatggtgagatagtaattaagatgaaagatggggaatgcccttcacccaaagcaatggccaagcaagttctatgctaccttgaagagaacggatatttgcaagcttagcatatgtattttgagaagattgatctgattcttgtgtgtccattacttgtggacacaataagatctgttgttggtcacatgaataaaaggcatcaacacgtaggaagtaacagaaggtaccgttcattcagaaacggaaatggattcattcgtttcattgttgatgatatttgtttcgcgtgtattttgcctgcatagctgtgattcatctgcatcagcaattcaggatgcattcggttaactcgcgttgaccgttcgcgtcaattcgggtagttgttctgtgcttgctagttgggttctgttggcaatgtatttgttacaagtaaatacggacaatgtgtgtaatttgtgtatcactttttttcctcttggaataaaaaccgaggaacattgtaacttcttccattgaaaaaaaaaaactggctttaaaaaaataataggaaaaaataag

SEQ ID NO: 16732 - DNA, 1453 bp, Zea mays
gatcggccgcccaatccttggctcggggggcataccgcaccgagctcactccccctttcgccttcgtcccagatctcaagcccgccgcagagaacgacaggacccaaaccccaattccacaatgaggccgtcgctgatgagatccacctcccagctcctccgccgccggagctactcctccgcatccgggcagcccgagcggaaggtggccatcctcggggcggcggggggcatcgggcagccgctgtcgctgctcatgaagctcaacccactcgtctcctccctctcgctctacgatatcgccggcaccccaggtgtcgcggccgacgtctcccacatcaactcccccgccctggtgaagggtttcatgggtgatgagcagcttggggaagcgctagagggctcggacgtggtgatcataccggccggcgtcccgaggaagcccggcatgaccagggacgacctattcaatatcaacgctggcatcgttaagaacctcagcaccgccatcgccaagtactgccccaatgcccttgtcaacatgatcagcaaccctgtgaattcaactgtaccgattgctgctgaggttttcaagaaggctgggacatatgatgagaagaagttgtttggcgtgaccacccttgatgttgttcgtgctaagactttctatgctgggaaggctaatttaccagttaccgatgtgaatgtccctgttgttggtggtcatgcgggtatcactatcctgccgttgttctcacaggccacccctgcaaccaacgcattgtctgatgaagacatcaaggctctcaccaagaggacacaggatggtggaactgaagttgtcgaggcaaaggctgggaagggctctgcaaccttgtccatggcgtatgctggtgctgtttttgcagatgcatgcttgaagggtctcaatggagttccggatattgttgagtgctcttttgttcaatcaactgtaacagagcttccattctttgcatctaaggtaaggcttgggaagaatggagttgaggaagtgcttggattaggtgagctgtcggactttgagaaagaagggttggagaagctcaagagcgagctcaagtcttcgattgagaagggtatcaagtttgcaaatgataactagataaggccattttgcagattatagcagcaattgaaacctttagtagcaattgaaacctttagttgcgggatcttctgatttcattctacccttttctgtccctttttgtgagggagtggaaggtattacaataaaaaacctgatgggcaaagcttacaagagggatttattccagcaggcaggcacataacttatgtcaagttttgtactgaaccagtcgtatatgagctttctgctgccttttataatcgacggtgctgtcttgtgtgtgtagggcaagctgcgaccggggggccgtgttcccaactc

SEQ ID NO: 16733 - DNA, 1958 bp, Zea mays
cattgggtacctcgaggccggccgggacatcgcctcagctgtatccgccatctgcttctctcttccactgccccaagccgccaccaatggcgacctgcgttctgctgatgctgcgggaagtctctccgtgggcgctggccagcgtggtggcgtccgtgtcgctgttgtggctggtggtctggacgctggagtgggcctggtggacgccttggcggctcgagcgggccctgcgggtccagggcctcaagggcaccaggtaccgcctcttcaccggcgacctgagggaaaccgcccgggctaaccgggaggctcgcaagaagccgctgccgctcggcagccacgacatcgccccacgcgtgcagcccatgcatcacagcaccatcaaggaatacgggaaactatcgttcacctggttcggcccaacaccaagggtgatgattcctgacccagagttagtcaaagaggtgctgtctaataagtttggccactttggcaaaccaaggagtaaccgcattgggaggttgctagccaacgggcttgtaaatcatgatggtgaaaaatgggcaaagcacaggagaattcttaatcctgcatttcaccatgaaaaaataaaggggatgatgccagtattttctacctgctgtattgaaatgattactagatgggataattcaatgccttctgagggatcttctgagatagatgtctggcctgagttccagaatcttactggagatgttatctcaagaactgcgtttgggagcaactatcaagaagggaggagaattttcgagctgcaaggagaactagctgaacgcctcatccaatctgttcagacaatatttatcccaggctattggttcttgcccaccaaaaacaacagaaggatgagagcgatcgatgtagagatccgcaaaattctccgtgaaataattgggaagagagagaaggatactaaaaacagagaaacaaataacgacgacttgctgggcttattactggagtcaaacacaaggcaatcaaatggaaatgcaagcctgggattgacaacagaagatgtgattgaggaatgcaagttattttactttgcaggtatggagacaacatcagtccttcttacttggacacttattgtgctaagcatgcacccagaatggcaagagagagcaagagaagaggttttgagccactttggaagaaccacaccggattatgatagcttgagccgcctcaagactataaccatgattctacatgaggtccttaggttgtacccaccggcaacctttctaacaagaagaacttataaggaaatggagctcggtggaatcaaatatcctgcaggagttgacctccttctacccgtcatcttcattcaccatgatcctgacatttggggaaaagacgcaagcgagttcaacccagaaaggtttgccaacggcatctccagcgcaaccaggcatcaggctgctttctttccgttcggaggggggcctagaatctgcatcggccagagctttgcgttgctggaagccaagatgacgctatgcaccatcctccaacgcttctcgttcgagctctcgccatcctacacccacgcgccgtacaccgtgataacactgcaccctcaacatggtgctcagataaggctcaaaaagctttctccgtgatgctccttctatgctgctaccggacactactttcgttactgaccgcatatgtagaaacgtatttcttatttagtatgtattttttaggatataaataaaaagatggtgcatattaatgggaaataagttcccttgtatgcattgcgatgtaattttgggaagatttggcaaggaacttaattatacaatatatgtattgtctttaagttataaaaaaaaaaaaaaaaaaaaaaaaaaaaaaaaaaaaaaaaaaaaaaaaaaaaaaaaaaaaaaaaaaaaaaaaaaaaa

SEQ ID NO: 16734 - DNA, 1171 bp, Zea mays
cccactgtctccggaaacaaccgctaccttagtacgtgcgccggtgcgcggcagaggaccgagatccaacgcgccaacgcggagtggtacgtacaggtttccatgtagcgcgcccaatccgatccggtccccgtaccaagttaggcgcggtgaccggcgcaggagagagagggtaactaggcagttcatagaagaagctaccccggcagctaataagcagtggcggcgatcatatcgactgcttcgcccaaggttgctttccagcctttacgccatgaaaccaattcaagttccaacacgcacgcaccaagaagattttacacccgatgatcatcatcacggcctcatgcatgcatccatccacgcattttattacgtcgggtggacgcatcgcgatatacttttcctgcacttatatataaagacagtggtagaggaagaagtctctgtcacagcaacgtaacgtcagaaacttatccttgctcgatcgctcgccactgcatccatgagatcgccggtgctgacccgcctgctcgccgccgcgctcctcgtcgcgtcgtcgtcggcggcgctgtcgcaggccgcgtgggtgcccgtcctggacgtgaacgacctggtgatcaagcaggtggcgcagttcgcggtgctggtgtacggcctggcgcaccacagggacctggcgtacgtgggcgtggtgcgggcgcagacggagcaggccgtcggcggcggcaccaacttccgcctcgtggtggtcgccgcgaggcccgacggcggcgggagcaccgcgcggtacgactgcctggtgtggggcgtgccggggtcgcgctccgacacctggaagctccgaaggttcaggaagatcgtccagggctagctatagctgctcatatggatccttctggccttgcaataagcgtcagtaataaggtagtgtttcaatgatcaattgtaagccgtgtcctcctcctcctcctcggctgcaggagccagccaactataatgtagctctcactctctctcggtattccgtctgtaacacagtttcattgctgcgtatcagcgtatgtgctacctgcgttcgtaggaaaaaaaatatgagtcagtgcctacgaatgctcgtccagttctgcgtatgtactgtgctctgcctgaacccaagcttacgctgcag

SEQ ID NO: 16735 - DNA, 1353 bp, Zea mays
ttttttttttttttttgtgaagggattgacagcgatttcatgatcagcacgtatttaacaagtggcaaaatacaatcttttgctagtttaagctcgagtcttaagctaaaacaagggacacatttctacaaaacgttttaagacattcatatggagtttctgcaaatagaaaatccgtcagcagtgtcagctagggcctggaggtttcaattgttagtagcttcaagttaggacccattgctttccaatctagttctatgttatttccaattgcaaaagccatgccagcaactgcagcgatcaaaactgctgttgtacagttcaggacttgttgcagggaaaagcagccaaaagaaggctattgaaccagccagaaacgctaccaatgccgctccttttgttcgtggtgacgagaaaacaggtaaacccatcatattacagaagacgtgagcagtaattggacataacagattccctgttcggattaacaagaatgttgcataccacccaaaaatgacagtgtagcctaactggacacctacaatcaatagcgctctcataaagttacatccctgctggtgtagttcgaaaaaatggttcaagtgcgctagactgaagaagattggactcagaaatataattgtagacattttgaatcccccacagagcagaagaggtatcatgcatgccctgaaaaccagctcctcagtaaatggtgccactacatagttccgccaaaccataacatccgcaacagcagcttggatccattgtgcaagcctctgtgcgcagcctatctccacctcatcgccaccgccccacgagctcactaggagccacactctagcgacgaatgacccagcatacactagggatgtcaggagaagtggaatagccacggcctgaatcaagtgatccttcctaatgccgaacacagcaaacatatcagcgaagtcgctgaggctccagactcggaggagggacgcagtggcaaggacggaggcggcggatgcgacggcggcacaggcgaagcgacggtggaggaaggtgcggagtgaggttgggggtgggaaccggaggatgaccgtcggggcatagaggacagcgacgtagaatactgccatcgcggcgcacgccgccatcgccgcgacacctgatatcaccggcggcgaggcgagaaggaggcccgccggtgtcgccataatctggtgaagcaggcgtcagtcgagattgctcattggattctagatttcatcgggagtgaagatttgggatcgtaacacagtcggtcgcgtggcttcgcttggcacgaagaacacgctgttttcccggccggcctcgtggtacccaatg

SEQ ID NO: 16736 - DNA, 2462 bp, Zea mays
gcacgagaccattacctagaacatcctaatcgaaaagcaaaaaggagagggagagaccgaatacaggctacagccgcttctgttctgtgaggggaaaaaagagaaagagagggagagagagagagagggggctggccggctgggggagtgccaggccagctgtggggtgtgtgtgtgcctgtgtgggggaactgctggggatggagagcgagatggcggacgcgcccgccgcggcgatcccccccgccgccgaaccgctcgcggcggtggcggaggaaggggaaggtgaagcggaagcggaggcgcccgccgaggcggcggtggggtccaccctcaccatggagcgcgtcgccgccgcgaagaagttcatcgagaaccactaccgttcgcagatgaagaccatccaggagcgcaaggagaggcgctttaaattggagagacagctagcttcttctcaagttcccaaggagcagcaaatcgatttaataaaagatcttgagaggaaggaaactgaatacatgcgacttaaaaggcacaaaatttgtgtggatgactttgagctgctcactattattgggagaggagcttttggagaggttcgattgtgtcgagagaagacctccggcaacatttatgcaatgaaaaaactcaagaagtctgatatggttgtcaggggccaagtggaacatgttagagccgaaagaaacttgttggcggaagttgctagtcactgcattgtgaagctttactattctttccaagacaccgagtatctttacctaattatggagtacctccctggtggtgatatcatgacccttctcatgagagaggataccttgactgaacatgtagcgcgattctacattgctgagacaattcttgctatccaatccatccataaacataactacatccacagagatattaagcctgataatttgcttctagataaaaatggtcacatgaagctgtcagattttgggctgtgcaagccaattgactgctcaaagctctcaacgttgaatgaagatgaacccatgggtgatgacaacatgagggaatcaatggatattgatagttctttgtccaatacagcaaatggtagaagatggagaagtcaacacgaacagcttcagcactggcagatgaacagaagaaaactggcattctcaactgtcgggacaccggattatattgctccagaggttctgctgaagaagggatatggaatggaatgtgattggtggtctctaggcgcgatcatgtatgagatgctagttgggtatccaccattttatgccgatgatccaataactacatgccgaaagattgtgcactggagaaaccatttgaagtttcctgaggatgcaaagttgtcaaatgaagcaagagatctcatttgccggttattatgtgatgttgaccacaggattggcagtgcaggggcagatcaaataaaggcacatccttggttccaaggagtcgcatgggacaaactttatgaaatggaagcagcatttaagcctcaagtaaatgatgaactggatacacagaatttcatgaaatttgaggaactggaaaatcctccagccaaaacaggctctgggccttcaagaaagatgatgctgaactccaaagatctgagctttgtggggtatacatacaaaaactttgatgcagtgaaagcaataaaaatttcagatctgcaaaggaattcatctctaacaaggccttccattggttcgatattcggtccatcaggcatggattctcccatggaaccaaacggaagggacacacacatgcacacagtttcatctggtgacccaatgattccctaaccttcagtgccgtctgtcctcagcaaatttccgaactaaatcagcgtgcaaacgccagggtgatgtggctccagctggacaacatgcttatttttagccaggtctctgctctctttatcgtgggcaagcggtttgtagaaatccaccaaagtttctagttgtaaaatagtatgccacagacttcaacaaaggtcccatgcattattggctcatcagacatgggggcagtttttttttggagaaattgcaccttgcggctggctgcccaggttggcagagcaaattgcggccttctcttgtggcagttcccggtctgcaggaaagggaaatacgacggtgttgttgcagcaggaattctcatggttagtgtcgttgttggtgtttgatatgtatcaggaattttcacatttgaagtagggtttctgttagcagagttgtagctattgacaagcaacatccttttacggagttgctttttttcgttgatgtatggaaaacgagacattgtagaaatcgaagttcgatctagccttgtatgctgcatatctgattcaaagtgtttctcagtatttttgtctaaaaattgcttaaatcaatgtgaaaatagaatttttgtgt

SEQ ID NO: 16737 - DNA, 3186 bp, Zea mays
aacatcatcgccccccttccccgcggccccaccaaatagagaggcccagacaccgaggggaaaaaggagagagagtacacaggtgacagccgctgcaccgagggcacagagggacagctagacagggactgccagcggcgtaggcggtgtgggggatggagcgcgagatggcggacgcgcccgccgcggcgatccccgccgccgagccgctcgcggcggtggcggaggaaggggagggggaggcggccgccgaggcagtggggtccaccctcaccatggagcgcgtcgccgccgcgaagaagttcatcgagagccactaccgctcgcagatgaagaacatccaagagcgcaaggagaggcgctttagattggagagacagctagcttcttctcaagttcccaaggaacaacaaatcaatttaatgaaagatcttgagaggaaggaaactgaatacatgcgacttaaaaggcacaaaatttgtgttgatgattttgagctgctcactattattgggagaggtgcttttggagaggttcgattgtgtcgagagaggacctcaggcaacatttatgcaatgaaaaaactcaagaagtctgatatggttgtcaggggccaagtggaacatgttagagctgaaagaaacttgttggccgaagttgctagtcatcactgcattgtgaagctttactattctttccaagacactgagtatctttaccttattatggagtacctccctggtggtgatatcatgacccttctcatgagagaggatacattgactgaacatgcggcacgattctatgttgctgagactattcttgctatcgaatctatccataaacataactacatccacagagatattaagcctgataatttgcttctagataagaatggtcacatgaagctgtcagattttgggctgtgtaagccaattgattgttcaaagctctcaactttgaatgaagatgaacccatgagtgatgacaacttgagggaatcaatggatattgatagttctttgtctgatacagcaaatggtcgaagatggagaagtcaacacgaacagcttcagcattggcagatgaacaggagaaaactggcattctcaactgttggaacaccggattatattgctccagaggttcttctaaagaagggatatggaatggaatgcgattggtggtctctgggcgcgatcatgtatgagatgctaattgggtatccaccattttatgctgatgatccaataactacatgcagaaagattgtgcactggagaaaccatttgaagtttcctgaggatgcaaagttgtcaaatgaagcaagagatctcattagccgattattatgtgatgttgaccacaggatcggcagtgcaggggcagatcaaataaaggcacatccttggttccgaggagttgcatgggataaactttatgaaatggaagcagcatttaagcctcaagtaaatgatgaactggacacacagaatttcatgaaattcgaggaattggaaaatcctccagccaaaacaggctctggaccttcaaggaagacgatgctgaactccaaagatctgagctttgtggggtatacgtacaaaaacttcgatgcggtgaaagcaataaaaatttcagatctgcaaaggaattcatctctaacaaggccttccattggttcaatattcggtccaccaggcatggattctcccatggaaccaaacgggaggggcacacatatgcacacagtttcatctggtgatccaatgattccctaacctgcagtgctgtttgtcctcggcaaatttctgaactaaatcagcatgcaaacgcctggatgatgtggctccagctggataacctgctcatttttagccaggtttctgctttctcaatcgtgggcaagcggtttgtagaaatccaccagagtttctagttgtaaaaatagtattccacggactttaacaaaggtcccatgtactaagggctcatcatcagacaccgggacagtttttttctggagaaattgcaccttgcggctggctgcccaggttggtagagcaaattgcggccttctcttgtggcagttcccggtccgctaacatttgatcagggaagggaaataagatggtgttgttgcggcaggaattctcatgggggggagttagtgttgttgtttgatatgtatcaggaattttcacatttgtagtagggtttctgttagcatattttagaaacatcctttttgcagagttgctatttctcattgatgtatggaaaacaacatattttggagatcgaagctcgatctaacttttatgctgcatatctgatccagattacatcaaacaatagttaaaaatagttgactcctcggaaagtgagaacgaccaatatttttgaacagagagtagctaatttgataaaaatagctaatagttgaattattagctagactatttggatgtattcagttaattttagcagctaattattagctctaatgtatttaaacatccctagtctctttaagtgatgcattagccgtgaagtaagctgctgcttacaaaatgtggtaggccaagcaggtaaggctaacgatagaggattatgtgccagcggtgtctaggatgatcaacgtcatccgaatcagttctgagattcaggtggaggtttcgttttaacgaaagcaatggagctagagatgtgtggaggattggtcttcttccgtatgtatgaccaacccctaaacaacaatacatgagcgttttagctttgctgcacaaatattaagggcagacatcaacagaccttgcgcccggacaggaccctcaggtgcgtgcagtgcagtgcagacgtgcagtagtcctcctggaagctcgcacagtcaacgtaggaatggaacctggatcatcgtagacactgggctgctctgactctgagagaggagatacttttgttgttaaggaaagccgtagagtatgctttgtccaaatgaaactcagttcgtggcaattggtaggaatatatagaaacgacacagacagtcttcttgctctaatataatggatgtcagcattccgcgtcattgacagatttcagagatgcttgcattgtgtcttcacgaacggggagagcaaacgacgtgagtacaattttttttccctagggtctctgcag

SEQ ID NO: 16738 - DNA, 1845 bp, Zea mays
aatttcaggtttgtctccttaatcctacaggtatgtggtatcattacttaccaagaacaagaagttgggtgtgttggattttgcatgcagtcatttttcaggaaccttaatgttccattgaattaccagtatttacatgttaggtgtcaatggctttctaaatggacataatgttcaaatattacttgtgagagaatgcaactgcgaatgcatgcagatctgcaaaggaattcatctctaactaggccttccattggttcgatattcggttacatacttctgccagtgacgcgttatctttttctgatctgcaaaggaattcatctctaacaaggccttccattggttcaatattcggtccaccaggcatggattctcccacggaaccaaacgggaggggcacacatatgcacacagtttcatctggtgatccaatgattccctaacctgcagtgctgtttgtcctcggcaaatttctgaactaaatcagcatgcaaacgcctggatgatgtggctccagctggataacctgctcatttttagccaggtttctgctttctcaatcgtgggcaagcggtttgtagaaatccaccagagtttctagttgtaaaatagtattccacggactttaacaaaggtcccatgtactaagggctcatcatcagacaccgggacagtttttttctggagaaattgcaccttgcggctggctgcccaggttggtagagcaaattgcggccttctcttgtggcagttcccggtccgctaacatttgatcagggaagggaaataagatggtgttgttgcggcaggaattctcatgggggggagttagtgttgttgtttgatatgtatcaggaattttcacatttgtagtagggtttctgttagcatattttagaaacatcctttttgcagagttgctatttctcattgatgtatggaaaacaacataatttggagatcgaagctcgatctaacttttatgctgcatatctgatctagattacatcaaacaatcccacgcggccccagttgactccgcggaaagtgagaacgaccaatatttttgaacagagagtagctaatttgataaaaatagctaatagttgcactattagctagattatttggacgtattcagttaattttagcagctgattattagctccagtgcatttaaacacccctagtctttaaatgatgcattagccgtgaagtaagctgctgcttacaaaatgtggtaggccaaggagctaataaggctaacgatagaggattatgtggcagcagtgtctaggatgatcaacgtcatccgaatcagttctgagattcaggtggaggtttcgttttaacgaaagcaatggagctagagatgtgtggaggattggtcttcttccgtatttatgaccaacccctaaacaacaatacatgagcgttttaactttgctgcacaaatattaagcgcagacatcaacagaccttgcgctcggccaggaccctcaggtgcgtgcagtgcagtgcagacgtgcagtagtcctcctggaagctcgcacagtcacgtaggagtggaacctggatcatcgtagacactgggctgctctgactctgagagacgagatacttttgttgttaaggaaagccgtagagtatgctttgtcaaaatgaaactcagctcgtggcaattggtaggaatatatagaaacgacacagacagtcttcttgctctaatacaatggatgtcagcattccgcgtcattgacagatttcagagatgcttgtgtcttcacgaacggggtgagcaaacgacgtgagtacaattttttttccctagggcctctgcag

SEQ ID NO: 16739 - DNA, 568 bp, Zea mays
gggtcaccgtgcgcgccccgccggagatcctccggctgctcgtgcccaagggcttcgtcgccgtcgacggcactagcctcactgttgtcagtgtggacgacgagggcggctggtttgacttcatgctcgtcaggtacacgcaggacaacatcgtgctgccgaccaagaaggtcggagacaaggtgaacctggaggcggatatactgggtaagtacgtcgagaagctcctcgctgggagggttgaggccatggcgaaggggtgaagaaaaggcttggattcaatgtctatgccgagctcaggtagggtcttgcgttggagatgtcactgaataaatttgatgcatgggatttttgttatgagttttcggagtgctcatttgcttgctgcagcctgcagctgcaacatggattcttcacggatttccgttattatgttttggagatgttcatttggttgctgcagccagcaaattagaaatgctattctggtgcacttacctctctactgtatgagacctgagctttgtgattggaacaatgtgaatacaaggcttagcaccatggtaac

SEQ ID NO: 16740 - DNA, 1426 bp, Zea mays
cgttgctgaagatatatgctcttatatccccaaacccggatttttgtcgacgccgactccaactcagtagtctatccccaccgcgaaccgccgcaggaatctctgacgatggccccgccggccgctgcggttgccgccgtccgccaccacagcccgcacctgctcctccgccgcgggggcgggggtctcctatcatcgccttcgggccccgccacgctccctttcgcctcgcggggtgcggcctccgcgcccgcgcgcctgcgcctgccgccgccgcagttctctctctcccccgtcccgaagagcctctccgccgcctcctcctcccacgtcattgtacggtccctcttcaccggcattgtcgaggaggtcggccgcgtgcgccgcctcggcccgccgctcgcgccgtctgggggtggcggcggcgaggctcttggccttgacttggaggtcgagaccaaggacctcctcgccggtactcagctcggtgacagtgtggcggtcgacggcgcctgcctcaccgttgcggcgatcgacccggccgcgtccacgctcaccttcggagtggccccggagacgctccgccggacgtccctgggagagcgcgccccaggcgacggcgtcaacctcgagcgcgcactcactccgtcgtcccgcatgggcgggcacttcgtgcagggccacgtcgacgggaccggggagatcgttgcgttccggccggacggggactcgctctgggtcaccgtgcgcgccccgccggagatcctccggctgctcgtgcccaagggcttcgtcgccgttgacggcactagcctcactgttgtcagtgtggacgacgagggcggctggtttgacttcatgctcgtcaggtacacgcaggacaacatcgtgctgccgaccaagaaggtcggagacaaggtgaacctagaggcggatatactgggtaagtacgtcgagaagctcctcgctgggagggttgaggccatggcgaaggttgattcttgatctaccattgctgagctgctggatcaatggtcattctacaggtatttcagcaatgttatgttcatcaataatagcagttcattccattttgttgcaattggcttgttgtttttttatttcagactttcagtgagacagtaataaaacataagtgatcgaggaaatgacttatcatttcttttcatccgttgagataaatgtacaagtatccatactctaatatgcagccaaatttagaagtttgttttgttgccgatgaatattagcaaagggtgaacaagagcagcatagcagcatccagaaactaagtgactaatgttgctgccaaataaatgataaggccctccagaacaatcatatccaaataactgctaggggttcctttactggctggcaatatcacagacgtcgcaggcaaaag

SEQ ID NO: 16741 - DNA, 1250 bp, Zea mays
ccggccttgggtacctcgaggccggccgggacaaaaaactcccccaccggccaccgcccaccgcgaactgccggaggaatctctggcgatggcgccgccagcagctgcggttgccgccgtccaccaccgcagcccgcacctgctcctccgccgcggcggcgggggtctcctcccatctccttcgggtcccgccgcccttcctttctcctcgcggggtgcggcatgcacgcccgcgcgcctgcgtttgccgccgccgcggttctctctctcccccgtcccgaagagcctctccgccgcctcctcctcccacgtccctgtacggtccctcttcaccggcatcgtcgaggaggtcggccgcgtgcgccgtctcggcccgccgctcgcgccgtctgggggcggcggtggcggcgaggctcctggccttgacttggaggtcgagaccaagaacctcctcgctggaacgcagctcggtgacagcgtggcggtcgacggcgcctgcctcaccgtggcggcgatcgacccggccgcgtccacgctcaccttcggcgtggccccggagacgctccgccggacgtccctgggagggcgcgccccgggcgatggtgtcaacctcgagcgcgcgctcacgccgtcgtcccgcatgggcgggcacttcgtgcagggccacgtcgacggaaccggggagatcgctgcgttccggccggacggggactcgctctgggtcaccgtgcgcgccccgccggagatcctccggctgctcgtgcccaagggcttcgtcgccgtcgacggcactagcctcactgttgtcagtgtggacgacgagggcggctggtttgacttcatgctcgtcaggtacacgcaggacaacatcgtgctgccgaccaagaaggtcggagacaaggtgaacctggaggcggatatactggggaagtacgtcgagaagctcctcgctgggagggttgaggccatggcgaaggttgattcttgatctaccattgctgagctgctggattaatcgtcattctataggcatttcagcaatgttatgttcatcaataatagcagttcattccattttgttgcaattggctcgtgactttttttaaaaaaaatcagtgagacagtaataaaacataagttatcgaggaaatgacttatcatttctggccccctgttgagatagatgtacaagtacccatactctattatgcagccacatttacaaaaaaaaaaaaaaaaaaacccgcggc

SEQ ID NO: 16742 - DNA, 1834 bp, Zea mays
gatcttgtcacatttattgatttgcaagcgaagttatatagtttgtcagaatttctatataatcaatcaggtggtggggactgggactccggcaacagttagttgtaccagcactgcaattacttgcaaaggttggttttaatgtatatagtgtttcttctttttcttctcgtaataaatgtatagtacactagacagtagtacagatttaggctgcattcataccacttttcccggttgtttttatgtcaatgatgacatgcttttcgctcttgacacattgtggaaacgccacctactagagtagtagtgagtaaagactaaagagagtcaatagctagaagatttattgcgttcttaacatacaaggtacccatatccaggtgggccgcggccaacagcggaaacagcagcacccgatggcccatcacgtgatcacattcacacacgcgcacatgtcatgtccgccttcatttatttttatatatagataaattatactcctttatttatttatatggagataaactatatttttatacccacttcgatattgcagcatttcacccgaaatgtgctccactcatgtcaaatcagatcccagtgtctttgtccatgcatgcatgatccagtttctttgcttttctttttcttctcaactaaaatgtagttgaagacatctgcccaaatttcttccaaatatccctgtatataagggagacacgagccggccgcgccggacaaaagccattccttcaatcactcaaatccactgtgactccgtgagctctccctgcctgctgccctgcacactccccgcccagccgcaccagctcagctcagcagtcatggctcgcccctgccgcagcagcagcagcgccgctgcccgcctcctcctgctgctcgccgccgtcgcagcggcgctccaggcagcggccgccacgccgccggtggccagcggcttcatccgcaaatcctgccgcgcgacgcagtacccgtcggtgtgcgagcagagcctcgcggcgtacggaggctccccgccgccgcggagcccgcgggagctggcgcgcgccgcgctggcggtgagcgcggaccgcgctcgggcagcgtccgcgtacgtcggccgcctgtgcggctcccggtccggatccggcgacggcagcccccgccgcggcgccggcgccggcgcgaagaaggggtcggcggccgcgggtcccgtgcgcgactgtctggagaatctagcggacagcgtgggccacctccgcgacgcggcgcaggagataggcggcgccgggatggcccgcgccgggacgcgcgcgttcaggtggcacctgagcaacgtgcagacctggtgcagcgccgcgctcacggacgagaacacctgcctggacgggctctcgtcccgcgccgtggacgccgccacgcgcgccgccgtccgcggcagggtcgtcgaggtcgcgcaggtcaccagcaacgcgctcgcactcgtcaacaaggtcgggcctgggtactagtagcccagggcggcctgggtgctactactactactgcctcctccacgacgttggttgtttcagcctcggcagttaactagttctgttattatcaatgtgtgtgtttctttgcatataagtatatgctttgtatctgttgtgtgaggtaatttatatatagttaaggccttaagggtaatttgtatattgtattatgggtggcgagaggtacacgaagacggataatccttcttatgaattgtcaccatgttcactgtaccttgctggctgtggcttaactggtttctacgctattttgtttctatagattggagctgcag

SEQ ID NO: 16743 - DNA, 1178 bp, Zea mays
tttttttgcttttctttttcttctcaactaaaatgtcgttgaagacatctgcccaaatttcttccaaatatccctctatataataagggagacacgagtaggtgtctgattacaaaagccattccttcaatcactcaaatccactgtgactccgtgagctccctgcctgctgccctgcactgctgcacactccccgcccagccgcaccagctcagctcagctcagctcagcagtcatggctcgcccctgccgcagcagcagcgccgctgcccgcctcctgctgctgctcgccgccgtcgcagcggcgctccaggccgcggccgccgcgccgccggtggccagcggcttcatccgcaaatcctgccgcgcgacgcagtacccgtcggtgtgcgagcagagcctcgcggcgtacggaggctccccgccgccgcggagcccgcgtgagctggcgcgcgccgcgctggcggtgagcgcggaccgcgctcgggcagcgtccgcgtacgtgggccgcctgtgcggctcccggtccggatccggcgacggcagcccccgccgcggcgccggcgcgatgaaggggtcggcggccgcgggtcccgtgcgcgactgtctggagaatctagcggacagcgtgggccacctccgcgacgcggcgcaggagataggcggcgccgggatggcccgcgccgggacgcgcgcgttcaggtggcacctcagcaacgtgcagacctggtgcagcgccgcgctcacggacgagaacacctgcctggacgggctctcgtcccgcgccgtggacgccgccacgcgcgccgccgtccgcggcagggtcgtcgaggtcgcgcaggtcaccagcaacgcgctcgcactcgtcaacaaggtcgggcctgggtactagtagcccagggcggcctgggtgctactactactgcctcctccacgacgttggttgtttctgcctcggcggttaactagttctgttattatcaatgtgtgtgtgtttctttgcatataagtatatgctttgtatctgttgtgtgaggtaatttatatatagttaaggccttaagggcaattagcttgtatattgtattatgggtggcgagaagtacacgaagacggataatccttcttatcaaaaaaaaaaaaaaaaaaaaaaaaaaaaaaaaagtcgacgcggccgc

SEQ ID NO: 16744 - DNA, 5246 bp, Zea mays
tagatagtatggacacaccacttcccacaactagagaacaaacataagtactgattggaaacaaagtaaaatactcagatttccaacctatacgaagcaactaggactaaatgtgccaaaccctggtccgattgcatggctcgctactaaggggtctttttgtaccggtttttatctcaaacccagtactaaaaggtcactcttttaaaaaagttgcatgcctgcaggtaaagtttgcaccaattgactggtctaaacatgatatgttctgtagaagaatttgataaacaattagccttgcgagactgcctatatagaaaacacttgaaaggaaataacgagaataacaactaaactctgtagcgagcaaaagaaaaacacgtagcatgcacatcaaaactttatttctgcgagatacataagatcatttgatataaagaaacatgtagcttttatttttttaagaaagaaagaaaggttaaactctaaatactcccttcgtatagaaaaaatgctattccatattaattttttaattttaactaagtttacagacaaactgtttttattatttatgtctttaaatagatttatatgacaatatattttacaattatataaaaaaacaggagtcgtatttgtttagcaaaacaaccaagacacgtagtggcggcactaacgcgttggtacttgcctcggtagggcgtgtcgcgagggcattggcccttcaagtcacgtaacgtgcatacgtgacactggaactaggcaactagcaacagaagtgttctcctactctctatactagcaacagaaacgtagggctggaaagtggacagcatctaggcgtacacctgtcctgtccagacagacaacccaaacgggaaaccataccaaacgtccaaaccctccaactgtaggggcagcggcccgggccgtggcgagaccgcgagagcagggctgcaactgcaacatgaagccagccgagggcgaggccagcacggttggggcccaacgaaccatggtgggcccagcctgtcaacgagtccgctgaggtcacggtaaccggcggcgaagctatatgaggtcgcccgggtcgagatcgatctctcctcccaaatcaaatccccaaaccccgggccactgctccgctcctcctccttgccgccgtgcggttgagcgccgacgagcaagcccgacgccaccctatggctatggaggtccgccgcagggttccgccgccgcacgggagcgccccacggcgccagcaggcgaccggcggcgaggggcagcgggtgcgtgtgcaggcgggggacgcgctgccgctgccgatccggcacacgaacctcatcttctcggcgctgttcgccgcgtcgctggtgtacctgatgcggcggtggcgggagaagatccgctcctccacgccgctccacgtggtctccctcgccgagatcttcgccatctgcggcctcgtggcgtcgctcatctacctcctcagcttcttcgggatcgccttcgtgcagtccgtcgtctccaacagcgacgacgaggaggacttcatcatcgactcccgccacggacaggcgcgggcgccgccgccgcccgcgccggcggccccgtgtgcgctgctggggagccccgccgccgcgccggagaaaatgccggaggaggacgaggagatcgtggccgcggtcgtggcagggaagatcccgtcctacgtgctggagactaggctgggagattgccgccgggccgccgggatcaggcgggaggcgctgcgcaggatcaccgggagggagatggacgggctcccgctcgatgggttcgactacgcgtccatcctcggccagtgctgcgagctgccggtggggttcgtgcagcttcccgtgggcgtcgccggcccgctccttctcgacggccgccggctctacgtaccaatggccaccaccgagggctgcctcgtcgccagcaccaaccgcggatgcaaggcaattgccgagtccggtggggcctccagcgtcgtgctcaaggacgggatgacgcgagccccggccgtccggttcccatctgcacgccgcgccgccgagctcaaggcctttttggaggacccagcgaactttgacaccctggctatggtgtttaacaggtaagaacgctagattctaaatcaacggcacattgtccctttcgctttcgacccatgctccacgcgcgctcttgtgcttgacaacacatctctgtgcagtgcatccatcccgatcaaagcaacagttggcatctgtcaatttttaaacccataaattgcctgtactgttgcccacttttttataacttgaggatttagactgggattatgtgagatgtgaccgacctgttttgggaaatatttgtgcaggtcgagcagatttggaaggctgcagggagtgaagtgtgcgattgcagggaggaacctttacatgaggttcagctgcagcacaggggatgccatggggatgaacatggtctccaaaggtgtacagaacgtgctggactacctccaggctgacttccctgatatggatgtcatcagcatatcaggtttccccatgttataaattcttaaactccgtttgtgaatttgacctgctttgtgatatggatgtcatcagcatatcaggtttccccatgttataaattcttaaactccgtttgtgaatttgacctgctttgctgactgtttctatttgagatcagcatattctaattcaagaaccagataaaaaattctcaccgattacactacgacatagcaatatatgtgaaatacaatatcttacatggaaagaaatatagtttatgattaaaaatattgtttataatcagtctagtacgcttgccttatgttggaaaactatagagaatcttaaatattgatagtacgaaggtaagaaaaaagtttgacttggaacaaacctagatggactcaattttgtgaaaaccatttttctaaccctcatagactgggaacaatctaggcattaggcatgacaccagtagctgatgttgacttcacttgctctcacttatgcagttgtgcctttctgtccggttcctccacctgtaggcaatgaacatttgaatactgtacttatatggataattcacacaaataaaaaataaaccaatgactgcgttctactagagtactagtatatagtgttttgaaatgatacgtcaagtgtcaactcatatcttgcccatagcataagtaatagcagtgagctgattttccaatatcacagttacgaagtggcgtagcacaattaattaatgatatgagagagataggaagaatagaaggtgcagttttttgggtgagattttattagaatccacaaaattgtttcttgccattttgatgccttgtattttcttaactaatatattctgtaacaaaataggtaacttctgttctgacaagaagtcagctgctgtgaactggatcgatggccgtgggaagtcggtggtttgcgaggcggtaatcaaggaagaagttgtgaaaaaggttctcaagacaaacgtacaggctctcgtagaattgaacgtgatcaagaaccttgccggttcagctgttgctggagctcttgggggtttcaatgcccatgcaagtaacattgtggcagccatcttcattgctactggtcaggaccctgcacagaacgtggagagttcccagtgcatcaccatgttggaagctataaatgatggcaaagatctccacatctctgttactatgccatctattgaggtttgaaacatcctatgctaatgatgtttgctcttccacggaattttatggtccttaataatttggtgtccataagttttttaagacctagtgattgattgaaacaattatataccacacccccacttgaaagaattgattaataattgcaataaatatatcacttgttttaatatttgtttggtactctaatggtaacacaatttccttggagctaacatatcccttcattgagtatatacatgtaacctgggaatttgatcatgaagtcattgtacagtttagatgtccagctatgcttttatgatgtttagaataatgtatggggtctatgccatcgtggccttacctatattagttattattcccacttgatctgatttgtatacgaaaaaaatatctagcaaatgttgttttcataatcagcagtcgctggcaatagtagtccatacctgtttaattagtgtttaatcttgtaattttctgtctgctattgttgatatggcatctggaatggcatcggtctatgctgggcacttgcagaagattgtttgttagtgtcatcatcttgtggccaggcattatgctatataactgttgaggtgttgtcctgaccccaaacacaggttggcacagttggtggaggcacgcagctggcctcacaatctgcctgcttggacctgcttggcgtcaaaggtgccaacagggaatctccggggtccaacgcgaggctcttggccacggtggttgcgggtgcggtcctagctggggagctgtcccttatctctgcgcaggccgctggccatctggtcaagagccacatgaaatacaacagatccagcaaggatatgtccaagacccttgcagaggaaacagacaaagccaagaaatgctgaataatatgaagtagttgttctatagccctttgggagaaaaggagcagaaagggtcgtacaggatgattttcttgcggcatgctcaggtggaaaggggggaaaaagaccttcaggcgaaaagagataattcagtcgccttgtcatatttaccaggcggtgagacctgttgtggatcctggagtatgacctatttaatttgttgatgttgttgttatagttcctctaaaaaaaaaaaaaaaatttgcgtcttgttttgcccgtcccatgggcattggagaatctgaccatgggttttgtcccaagcttgcatcacactggggggacctctgctttgcggcggtcccgtctcaggaaaaaaaaatttgcgctggtaactgccgggtgctgtgtcctgtgtatttcagctttgaaatttttatccaatgcttttgagtcgaagagtcagtggactcgatgatgtggttgtaaagaaaaaaaaatgcttttgtgtggaagagtcagtggagtcgattacgtggttgtaaaaaaaaggtgtgcttcagaacaagagtacatcacgttgcctc

SEQ ID NO: 16745 - DNA, 3179 bp, Zea mays
cattgggtacctcgaggccggccgggccgggctcccaatcaaatccccaaaccccgggccactgctccgctcctcctccttgccgccgtgcggttgagcgccgacgagcaagcccgacgccaccctatggctatggaggtccgccgcagggttccgccgccgcacgggagcgccccacggcgccagcaggcgaccggcggcgaggggcagcgggtgcgtgtgcaggcgggggacgcgctgccgctgccgatccggcacacgaacctcatcttctcggcgctgttcgccgcgtcgctggtgtacctgatgcggcggtggcgggagaagatccgctcctccacgccgctccacgtggtctccctcgccgagatcttcgccatctgcggcctcgtggcgtcgctcatctacctcctcagcttcttcgggatcgccttcgtgcagtccgtcgtctccaacagcgacgacgaggaggacttcatcatcgactcccgccacggacaggcgcgggcgccgccgccgcccgcgccggcggccccgtgtgcgctgctggggagccccgccgccgcgccggagaaaatgccggaggaggacgaggagatcgtggccgcggtcgtggcagggaagatcccgtcctacgtgctggagactaggctgggagattgccgccgggccgccgggatcaggcgggaggcgctgcgcaggatcaccgggagggagatggacgggctcccgctcgatgggttcgactacgcgtccatcctcggccagtgctgcgagctgccggtggggttcgtgcagcttcccgtgggcgtcgccggcccgctccttctcgacggccgccggctctacgtaccaatggccaccaccgagggctgcctcgtcgccagcaccaaccgcggatgcaaggcaattgccgagtccggtggggcctccagcgtcgtgctcaaggacgggatgacgcgagccccggccgtccggttcccatctgcacgccgcgccgccgagctcaaggcctttttggaggacccagcgaactttgacaccctggctatggtgtttaacaggtcgagcagatttggaaggctgcagggagtgaagtgtgcgattgcagggaggaacctttacatgaggttcagctgcagcacaggggatgccatggggatgaacatggtctccaaaggtgtacagaacgtgctggactacctccaggctgacttccctgatatggatgtcatcagcatatcaggtaacttctgttctgacaagaagtcagctgctgtgaactggatcgatggccgtgggaagtcggtggtttgcgaggcggtaatcaaggaagaagttgtgaaaaaggttctcaagacaaacgtacaggctctcgtagaattgaacgtgatcaagaaccttgccggttcagctgttgctggagctcttgggggtttcaatgcccatgcaagtaacattgtggcagccatcttcattgctactggtcaggaccctgcacagaacgtggagagttcccagtgcatcaccatgttggaagctataaatgatggcaaagatctccacatctctgttactatgccatctattgaggttggcacagttggtggaggcacgcagctggcctcacaatctgcctgcttggacctgcttggcgtcaaaggtgccaacagggaatctccggggtccaacgcgaggctcttggccacggtggttgcgggtgcggtcctagctggggagctgtcccttatctctgcgcaggccgctggccatctggtcaagagccacatgaaatacaacagatccagcaaggatatgtccaagacccttgcagaggaaacagacaaacccaagaaatgctgaataatatcaagtagttgttctatagccctttgggagaaaaggagcagaaagggtcgtacaggatgactttcttgcggcatgctcaggtggaaaggggggaaaaagaccttcaggcgaaaagagataattcagtcgccttgtcatatttaccaggcggtgagacctgttgtggatcctggagtatgacctatttaatttgttgatgttgttgttatagttcctctaccgtacttgaccccgtttgcatcttgttttgaccgtcccatgggcattggagaatctgaccatgggttttgtcccaagcttgcatcacactggggggacctctgctttgcggcggccccgtctcagaaaaaaaaattgcgctggtaactgccgggtactgtgtatttcagctttgaaacttttatccaatgcttttgagtcgaagagtcagtggactcgatgatgtggttgtaaagaaaaaaaaatgcttttgtgtggaagagtcagtggagtcgatgacgtggttgtaaagaaaaggtgtgcttcagaacaagagtacatcacgttgcctctcaactttccctgtagcgtgttcgtctcaattgcatgttccggttggctgggctgccccgtccacggatcaggtttataatataataatttaatacaaaaatgatactttagcaaaacctgatgccgttcgccatttcctatcggtcgtcaagacttgcccgactttggatccaagggttcgacgtagacattagggtctagacattaggagtaacatcaaggacctcccggtgaaaaagtaaatctagtctcattcactgtgaagaatctaatctgtaattcacgtaaatacaatttgattggaattacttagggggtgtttggttgctcctgctaaagtttagtccgggtcacatcaagcgtttgacttttaaataggagtataaaatatagacccaaccaactagactagatttgtctcgtcttttaatcttcggctgacaaattagttttataatccgactacatttaatatccggaacggaggttcaaacattcgatgggacagagacttaattttagcggggtgtaaccaaacacccccttaatttaccttaggataggaggcggcacgcgggccgcgcgccgacgtgggcgcactgctaggcacgagaacgaacgagaaaaaaaaggaaaaataatgggttgtttttttaaaaaaaatagtgagaatggtagataactttcaccaactttaaactgaagttgataaagcacttgccttttgaggagctccaccaaaacagtaaacacggcac

SEQ ID NO: 16746 - DNA, 1707 bp, Zea mays
caacgaaccatggtaggcccagcctgtcaacgattccgctgagttcaagggtagcggcggcgaagctatatgagagcggccccccccgggcccggccggaaaacccccgtcctcctcgccgctccgccgcgcggttgagcgccgacgagcgagcccaccgctgcctcgtccgccctatggatatggatgtccgccgcagggttccaccgccgcacgggagcgtccctaggcgccagcaggcgaccggggccgagggggagcgggtgcgtgtgcaggcgggtgatgcgctaccgctgccgatccggcacacgaacctcatcttctcggcgctgttcgccgcgtcgctggtgtacctgatgcgtcggtggcgggggaagatccgcgcctccacgccgctccacgtggtctcccccgccgagatcttcgccatctgcggcctcgtcgcgtcgctcatctacctcctcagcttcttcgggatcgccttcgtgcagtccgtcgtctccagcagcgacgacgacgaggacttcatcgtcgactcccgccacgcgcgggcgcgggcgccgccgacgcctgcgcagaccccgtgtgcgctgctggggagccccgccgccgcgacggagaaaatgccggaggaggacgaggagatcgtggccgcggttgtggcagggaagatcccgtcctacgtgctggagtctaggctgggagattgccgccgggccgccgggatcaggagggaggcgctgcgccggatcaccggaagggatatggacgggctcccgctcgacgggttcgactacgcgtccatcctgggccaatgctgcgagctgccggtcgggtacgtgcagcttcccgtgggcgtcgccggaccgctcctgctcgacgggcgccgcctctacgtaccgatggccaccaccgagggctgcctcgtcgccagcacgaaccgcggatgcaaggccattgccgagtccggtggtgcctccagcgtcgttttcagggacgggatgacgcgagccccggtcgtccggttcccgtctgcacgccgcgccgctgagctcaaggccttcttggaggacccagcgaactttgacaccctggccgtggtgtttaacaggtaagaacgctagattccaaatcaacgtcacgttgtccctttcgacccatgctccacgcgctcaacgattaccattaggctagcgcgtctcttgggcttgacgacacgtctatgtgcatccatctccatcaaagcagtagcagttgtcatcagtcactttttttaatccataaattgcctgtacggttgcccactttttgaacttgagggttgatggtgggattatgtgatgaccgacctggtttgggaaatatttgtgcagatcgagcagatttggaaggctgcagggagtgaagtgtgcgattgcaggaaggaacttgtacatgaggttcagctgcagcacaggggatgccatggggatgaacatggtctccaagggtgtgcagaacgtgctggactacctccaggccgacttccctgacatggatgtcatcagcatatcaggtaacttctgttctgacaagaagtcagctgctgtgaactggattgatggccgtgggaagtcggtggtttgtgaggcagtaatcaaggaagaagttgtgaaaaaggttctcaaaacaaatgttcaggctcttgtagaattgaacgtgatcaag

SEQ ID NO: 16747 - DNA, 798 bp, Zea mays
cccccaaatctggattatgaaaaatcagaaatctgctaattgtagattggttctatatatgtcactgaggaccagcagtctcctagctttaagctaattatggggtggcactaaattatgagctggccgatgggaaatacgtagcgaataggccagactgtgaacgtgaggccccaaccctccgccgctcgcctataaacacgcgctcggcacggccgggccggcactcactctcattcgcaatttccctacgagctcgagctcacggctcaccgcagctcaaaagccagcacaggcaaacccccgtcatggcctcctccaagatactgcgcgccgccgtcgtcgtcgtggccgtcgccgtgtcctccttcgccggcgccgccctcgccgccgaggcccccgcgccgagcccggcctccggcgccgcggccgtctcctcgtcgctcttggccgccgccctctgcccggccgtcgcgctcctcctcggcaacctgcgccactgatgacgcctgcctgcctgtccgacgagagccgccgtgtgctgtcgcgtgatgttattgtcctctgtatgtgtgtgtgtgtgttcctgacctgtgcgtgccttgtaccgccaccccgcgcgtggattggaactctatcgatcgttcggagattcagcgcgtttgtttctgtagcagcattggttcagacttcagagtgaacgtcgcccagattttctgatgttttttttagaaacacgaacattaaacataattcgtctgaataaaggctcctaaaaaggcccctagggccgcggcc

SEQ ID NO: 16748 - DNA, 905 bp, Zea mays
ggtaccctcgggccagccagtcacgctgttcgagcagagccccatcccctgatccccgtgccaggccgctcggccctcgacgccgtgagtcaggcaggcaggcgcctctttctgtccctccactcgggtctccacgccgccgccgccgccgccgcctcgaccgccccacgcatccgccgctcctctacccatcctcggcccgcggcccagggagaagaccgcacgggcgggcgagatggaaaaccataatccattacattctcagattgctgaagtgaaaatggacatctcagcatcagcttctgttgcatcagggaacaaattctgcaagggtggtgcctgtgatttctctgattccagtaactcctcgaaagatgccaaggagagatccacgtccatgaggaagcttataatcgcagtgatcctttgcatcatattcatgacggtggaagtggtcgggggcatcaaagcaaacagtcttgccatcttaactgatgcggcgcaccttctttctgatgtggcagcatttgccatatcgttattctctctctgggctgctggatgggaagcaacaccgcagcagtcatatgggttcttccggattgagattcttggtgccttggtctccattcagctcatatggctacttgctggcatactggtatatgaggctattgtaaggctcattaacgagagtggcgatgtgcagggctccctcatgtttgctgtgtcggcgtttggactgtttgtcaacattataatggctgtattgctaggccatgaccacgggcacggccatggacacagccatggacatccacatgaccatggtcatgctgattcaaacgatggccattctcaccatgaagaaccagaaacagggccatgttcttcatcatgagcat

SEQ ID NO: 16749 - DNA, 1866 bp, Zea mays
tgcccagtctcggcaatgatgctcctctgattctccccacccgtggctgcgcccatccgtctacaagtaccacctggccgcgcggttggttccaatttccagacggcagtccactggtttttgcttgcatatcctttgtttaggccagagttgagttgtgttccaacttccaagtcttgggttgcggaatcgccggcctcgctcaatcgatggaaaaccataatccattacattctcagattgctgaagtgaaaatggacatctcagcatcagcttctgttgcatcagggaacaaattctgcaagggtggtgcctgtgatttctctgattccagtaactcctcgaaagatgccaaggagagatccacgtccatgaggaagcttataatcgcagtgatcctttgcatcatattcatgacggtggaagtggtcgggggcatcaaagcaaacagtcttgccatcttaactgatgcggcgcaccttctttctgatgtggcagcatttgccatatcgttattctctctctgggctgctggatgggaagcaacaccgcagcagtcatatgggttcttccggattgagattcttggtgccttggtctccattcagctcatatggctacttgctggcatactggtatatgaggctattgtaaggctcattaacgagagtggcgatgtgcagggctccctcatgtttgctgtgtcggcgtttggactgtttgtcaacattataatggctgtattgctaggccatgaccacgggcacggccatggacacagccatggacatccacatgaccatggtcatggtgattcagacgatggccattctcaccatgaagaaccagaacagggccatgttcatcatcatgagcatagccatggaagttctattactgtcacaacacatcaccaccaccactcaggcactggacaacaccatgacgctgaggagccactgatcaagcacgaggccgactgtgagggcacccaatctgctgctaagaagcctcgacgcaatataaacgtacacagcgcttaccttcatgtgcttggggactccatccagagcatcggggtgatgatcggcggggctatcatctggtacaagcccgagtggaaaatcatcgatctgatctgcaccctcatcttctcggtggtcgtgctgttcaccacgatcaggatgctgcgcaacatcctcgaggtcctgatggaaagcacgccccgtgagatcgacgccaccaggctggagagggggctctgcgagatggaaggcgtggttgccgtccacgagctgcatatctgggccatcacagtggggaaggtgctactggcttgccatgtgacggtcgccagggaagccgacgcagacgagatccttgacaaggtgattgggtacatcaagacggagtacaacatcagccatgtgaccattcaggtcgagcgtgaatagagggggagctgtcttttgggctgtcagggcataaatggcgtcacgccttcactggttatcttactctgtcggttaaaacttttttttggcacctgggaaggcatcaggcagccatcggagtcttgatgtgcttgcaagttcatctgtggttcaagctttgatggtcagtagtgttatctgttactactagtctattaggcgggggtaggcgtcaaccagtgtgtacgggtttgattttcggtcatgctgttaacagcattgcggttcgtcgaactggatatgtagtttagtacgctgtgtcatcacctcttgtgtaagggaacgcttcttttctgtggtatggaagatgtgaacttcgtgattggcctgttaaagaaaaaaaaaaaaaaaattggacgtgttctctcggttg

SEQ ID NO: 16750 - DNA, 894 bp, Zea mays
ccggcccctccacgctgttcgggcgttcgagcagagccccatccccgtgccaggccgctcggccctcgacgccgtgagtcaggcaggcaggcgcctctttctgtccctccacccgggtctccacgccgccgccgccgccgcctcgaccgcccccacgcatccgccgctcctctacccatcctcggcccgcggcccagggagaagaccgcacgggcgggcgagatggaaaaccataatccattacattctcagattgctgaagtgaaaatggacatctcagcatcagcttctgttgcatcagggaacaaattctgcaagggtggtgcctgtgatttctctgattccagtaactcctcgaaagatgccaaggagagatccacgtccatgaggaagcttataatcgcagtgatcctttgcatcatattcatgacggtggaagtggtcgggggcatcaaagcaaacagtcttgccatcttaactgatgcggcgcaccttctttctgatgtggcagcatttgccatatcgttattctctctctgggctgctggatgggaagcaacaccgcagcagtcatatgggttcttccggattgagattcttggtgccttggtctccattcagctcatatggctacttgctggcatactggtatatgaggctattgtaaggctcattaacgagagtggcgatgtgcagggctccctcatgtttgctgtgtcggcgtttggactgtttgtcaacattataatggctgtattgctaggccatgaccacgggcacggccatggacacagccatggacatccacatgaccatggtcatggtgattcagacgatggccattctcaccatgaagaacccagacagggccatggtcatcatcatgagcatagc

SEQ ID NO: 16751 - DNA, 2388 bp, Zea mays
  misc_feature (30)..(30): n is a, c, g, or t
gcgtccgctcagttgttgttgtcgttcagnacaatgaagcccacactgtaaattggttttgatgaagatagctcaagtttacccgcaggcattgtattattggcttcgtacatacttgatggaacgccgtcatgttgctactaaaactgaaataggaagaaacatgttggctcagcagcgcatgctagcaagctatgatggcaaacatgcggccaataacttacctgacggaagtgcaagggcatctaatcatgcaggtagtaacatgacttctgacaaccagtctcatcaagcctcccaatcagttggtgctgcaggttctcatgatggtggtaatgtccaaggacaagatccggaacgatctacccctgaaggtggcacaaataccagccatgatcaaggtcaacagagttctacaggtgctgagggctcacaagttccgcttagacgtaatagcggacatgggtgggtaacttctgcagcaagtgcatttgatgctgcaaaagacataatggaggctcttagaagcaaacatactaatctagccaatgagcttgagcttttactgtcagaaattggatcacggtttgttactctgcctgaggaaagacttctagctgtggttaatgctctgcttcatcgctgctacaaatatccaactgcaaccactggcgaggttccacagtctctcaagaaggaactctctggtgtatgtagagcttgcttctcacaagatgctgttaacaagcatgttgattttgtgaaggagtacaagcaagattttgaacgtgatcttgacccagagagcgctactacttttcctgcaacccttgctgaacttacggagagattgaaacactggaagaacattcttcagagtaatgtagaggatcggttcccagcagtattaaaactggaggaagaaagtaaaacacttcgggattttcatgttgttgatattgaactcccagggcagtacttcacagatcaggaaatcgcaccggaccacactgttaagttggacagagttggacctgacattccaattgtccggaggcatggcagtagctttcgacggttgacactcattggttctgatggttcacagcgccattttattgttcagacatcactgactccgaatgctcggagtgatgaaaggatgctgcagctattccgtgtgctaaataaaatgtttgacaaacacaaagaatctaggcggcggcatctggctatccatactccaataattattcctgtttggtctcaggttcggatggttgaggatgatttaatgcaaggtgtatgaaattaattgtgcacggcataatagagaagctgactcgcctattacaattttcaaagagcagcttaatcaagccgtttcagggcagctctctcctgaagcaattgtggagctacgtctgcaagcatacaatgagattacaaaaaatattgttaatgataatattttctcccaatatatgcacaagattctgccaactggcaactacctgtggaccttcaagaaacaatttgcaatccaagtggctctctcctgcttcatgtcgtatatgctgcagattggcggcagggctcctaacaaaattctatttgctaaaaatactgggaagatcttccagactgacttccatccagcttatgatccaaatgggatgattgagttcaacgagcttgttccatttaggctgacacgcaacttgcaagctttcttctcgaattttggtgttgaaggtctcattgtgtctgccatgtgctctgctgcccagtcagtggtttctcctaaacaaagccagcacatttggcatcatttggctatgtttttccgagatgaactgttatcttggtcgtggaggcggcctctgggcattccatcagtccctgtcgctgctggaatgatcaacccatcagatttccaacagaaggtggtaaacaatgtggagcatgtcatcagtcgtatcaagtcaatatcgccacattgtctggctgaggaggaggagaatgcaaccgagccacctcagtcggtacaaagaggcgtcaccgagctggtggaagcggcattgtcgtccaggaacctgtgcatgatggatccgacgtggcacccatggttctgaaggcatccagcacctctgtagcctgaccaaactgacggcgtgtacagattttcatgtccggcaacgctggttgagactagaaaactcgttgcgttatgtagataaagccagggtgtcatcatgtgttcgctggtgtaatggagcagattagcttggtaattaatgagacattgcatttcttaacttactattaggcaaaaaaaaaaaaacacaacaataaaaaaaaaaaactcgcgggggggccgcggtaccc

SEQ ID NO: 16752 - DNA, 1860 bp, Zea mays
cgggaagctctaaaccccgcgcctccggtcaggtctgcgggaaaccagtcactctactactcgatggaaccagcaacatgggctgtgttcctcggcattgccctctgcgcagcggcagcgctcttcctttcgcgcggccggcgcccggtctacaaccccccgccgggccccaagccatggccgatcatcggcaaccttaacctcatgggcgagctgccccaccgctccatgaacgagctgtccaagcggtacggtccgctcatgcagctccggttcgggtcgttgcctgttctcgtcggcgcgtcggttgagatggcaaagctcttcctcaagaccaacgacgcggcgttctccgaccggccgaggttcgcaatcggcaagtacaccgcgtacgacttctccgaccttctatgggctccttccgggccgtacctgcgccaggcacgcaggatctgcgccaccgagctcttcagcgccacgcggctcgagtccttcgagcacatccgcgacgaggaggtgcgcgtgatgctgcgacagctgcgccaagcggctgggcgcaccgtgcggctcagggactacctgcagatgttggcgctcggcgtgatctcgcgcatagttctgggcaataagtacgtcatggaggaggtggcggacggtgagggggactcagcgccggcgataacgcctgccgagttcagggagatggtggacgagttcttcgcgcttcacggtgcgtttaacattggtgattacatcccttggctagattggctggacctgcagggctacgttgctaggatgaagagaatgaaggcgaggtttggtcgattcctggaacgagtcttggacgtgcacaacgagcggcgactacgcgagggagggaactttgtggcaaaggatatgttggacgtgctgctgcagctggccgatgacactagtcttgaagtccagctcagcagggacaatgttaaggctatcacacaggacctaatcatcgcaggcacggatagtaatgcaaacacgctggagtgggctgtctcggagctcctcaagaaccctaagatcttagccaaggccatggaggagctgaaccatgtcatagggccggaccgactggtgacggaaagcgacctccctcgcctcccctacatcgaggctgtgctcaaggagaccatgcgcgtgcaccctgccgcgccgatgctggcaccccacgtggcccgcgaggacacatccgtggacggatacgacgtgctcgctggcacggtcttgttcatcaacgtgtgggcaatcggccgcgaccctggactgtgggacgcgccggaggagttccggccggagcggttcgtcgagagcaagatcgacgtgaggggccatgacttccagctgctgccgttcggctctggccggcgaatgtgccccgggatcaacctcgcgctaaaggtgatggctttgagtcttgccaatctgctacacggcttcgagtggaggcttccggacggcgtgacggcagaggagctgagcatggatgaggccttcaagctcgcggtaccgcgtaaattcccgctcatggtcgtggccgagcccaggttgccagctcgcctgtatactggcgcttgatgcccgtacgtgtcttcggttgttggcatgcgtggagtatagcacatgattttcagctcttggaactttgttttaataaaacacaaatatatgtgttatgttggttagatgaatgtgaatataaagttgacaacctagataattcgaacccctattggtatataattttactttatttttgcataactgtgtaaactggtggtcatggacgttgaagttaatatttggactgtggattagcct

SEQ ID NO: 16753 - DNA, 1794 bp, Zea mays
  misc_feature (6)..(6): n is a, c, g, or t
acgagnccattacctagaacatcctaatcgaaaaactactcgatggaaccagcaacatgggccgcgttcctcggcattgccctttgcgcagcggcagcgctcttccttttgcgtggccggcgcccggtctacaaccccccgccgggccccaagccatggccgatcatcggcaaccttaacctcatgggcgagctgccccaccgctccatgaacgagctctccaagcggtacggtccgctcatgcagctctggttcgggtcgttgcctgttgtcgtcggcgcgtccgccgagatggcaaagctcttcctcaagaccaacgacgcggcgttctccgaccggccgaggttcgcagtcggcaagtacaccgcgtacgactgctccggccttctgtgggctccttttgagccgtacctgcgccaggcacgcaggatctgcgccaccgagctcttcagcgccacgcggctcgagtccttcgagcacatccgcgacgaggaggtgcgcgtgatgctccgacagctgcgccaagcggctgggcgcaccgtgcggcttagggactacctgcagatgttggcgctcggcgtgatctcgcgcatagttctgggcaagaagtacgtcatggaggaggcggcggacggtgagggggactcagcgccggcgataacgcctgccgagttcagggagatggtggacgagttcttcgcgcttcacggtgcgtttaacattggtgattatatcccttggctagattggctggacctgcagggctacgttgctaggatgaagagaatgaaggcgaggtttggtcgattcctggaacgagtcttggacgtgcacaacgagcggcgactacgcgagggagggaactttgtggcaaaggatatgttggacgtgctgctgcagctggccgatgacactagtcttgaagtccagctcagcagggacaatgttaaggctatcacacaggacctaatcatcgcaggcacggatagtaatgcaaacacgctggagtgggctgtctcggagctcctcaagaaccctaagatcttagccaaggccatggaggagctgaaccatgtcatagggccggaccgactggtgacggaaagcgacctccctcgcctcccctacatcgaggctgtgctcaaggagaccatgcgcgtgcaccctgccgcgccgatgctggcaccccacgtggcccgcgaggacacatccgtggacggatacgacgtgctcgctggcacggtcttgttcatcaacgtgtgggcaatcggccgcgaccctggactgtgggacgcgccggaggagttccggccggagcggttcgtcgagagcaagatcgacgtgaggggccatgacttccagctgctgccgttcggctctggccggcgaatgtgccccgggatcaacctcgcgctaaaggtgatggctttgagtcttgccaatctgctacacggcttcgagtggaggcttccggacggcgtgacggcagaggagctgagcatggatgaggccttcaagctcgcggtaccgcgtaaattcccgctcatggtcgtggccgagcccaggttgccagctcgcctgtatactggcgcttgatgccagtacgtgtcttcggttgttggcatgcgtggagtatagcacatgattttcagctcttggaactttgttttaataaaacacaaatatatgtgttatgttggttagatgaatgtgaatataaagttgacaacctaggtaattcgaacccctattggtatataattttactttatttttgcaaaaaaaaagaaaaaa

SEQ ID NO: 16754 - DNA, 1923 bp, Zea mays
cccgccgccccccgcggtattctccttgctgccaaatgaccctgtacagactacagtgtacaagcctgccactttttaaaactcacaacccccgacctgctcagatcaggtaaaccagtcactctactactcgatggaacaagctacatgggccgcgttcctcggcattgtcctttgcgcagcgctcttccacaggaccttccttgcgcgcggccggcgccgggccaacaaccccccgcccggccccaagccatggccgatcatcggcaacctaaacctcgtgggcgagctcccccaccgctccatgaacgagctctccaagcggtacggtccgctcatgcagctccggttcgggtcgttgcctgttgtcgtcggcgcgtcggttgagatggcaaagctcttcctcaagaccaatgacgcggcgttctccgaccggccgaggttcgcagtcggcaagtacatcgcgtatgacttctccgaccttctatgggctccttccggaccgtgcctgcgccaggcacgcaggatctgcgccaccgagctcttcagcgccacgcggctcgagtcattcgagcacatccgcgacgaggaggtgcgcgtgatgctgcgacagctgcgccaagcggctgggcgcactgtgcggctcagggactacctgcagatgttgacgctcggcgtgatctcgcgcatagttctgggcaagaagtacgtccaggaggaggcggcggacggtgagggggactcagcgtcggcgatgacgcctgccgagttcggggagatggtggacgagttcttggtgcttcacggtgtgtttaacattggtgattacatcccgtggctagattggctggacctgcagggctacgttgctaggatgaagagaatgaaggcgaggtttggtcgattcctggaacgactcctggacgtgcacaacgagcggcggctacgcgagggagggaacttcgtggcaaaggatatgttggacgtgctgctgcagctggccgatgatactagtcttgaagtccagctcaacagggacaatgttaaggctatcacacaggacctaatcattggaggcacggatactagtgcaaaggccctggagtgggctgtctcggagctgctcaagaaccccaaggtcttagccaaggccacagaagagctggaccacgtcatagggccggaccgactggtgacagaaagcgacctccctcgcctcccctacatcgaggctgtgctcaaggagaccctgcgcctgcaccctgccgcgccgatgctggcacccccacgtggcccgcgaggacacatccgtggacggctacgacgtgctcgctggcacggtcgtgttcatcaacgtgtgggcaatcggccgcgaccctgcgctgtgggacgcgccggaggagttccggccggagcggttcttcgagagcaagatcggcgtgaggggccaggacttccagctgctgccgttcggctctggccggcgaatgtgccccgggatcaacctcgcgctaaaggtgatggctttgacccttgccaatctgcttcacggcttcaagtggaggcttccggacggcgtgacggcggaggagctgagcatggaggaggccttccagctcacggtaccgcgtaagttcccgctcgaggccgtggtcgagcccaggttgccagaccgcctgtatacgggcgcttgatcgatgcccgtacctgtgttggacacttggactgttggcatgtgtggagcacagcacgtgattgttcagctcttggaaaattaatgttgtgtctcgtatacaaattaattatggtagtgcatatataatgcacggtttgtgagagtttgatgtttcagatctatacgttgaattaggcctttatgccttgttcggttattcctaatacacatggattgaatgagattag

SEQ ID NO: 16755 - DNA, 667 bp, Zea mays
ctggccgggcggtactgaccggggttcgtttccccggatgcgcaaaaaaaaatcgccagtccgtccgtccagcgtccactcgcccaccgtttccgctccatccccggcccccacttccccgttcgagagacgaaaaccgaccattcattccttcttccatggcgaggagggcgacggtgatggtgctcgcggcggcgctcgcggtcctcctgctggcgtcgtcgtcgtcgaagacggcccccgtggccagcgccgcccgggacgacccctcggcagcggcggcggcggccgtcacttcttctcgtgacctgcagaaggatggatcggcggcggcggcggaagggaaggggaaggagaaggagtgcgagggcgccaacgacgaggacgagtgcatgatgaggcgcacgctggccgcgcacaccgactacatctacacccagcagcaccacggctgatccaatagaatccgtcctaggttacatgcgttgctctcgtacgtgtgttcgtgtccgtccgtgctcgtgtcgtgtactcgtgtgtgtgtgtgtgtgtgtgaaacgccagcgcgtgctgcttctgctgcgtcgttattacctgcgtgtcaaataaattcttttttttgtcccaaaaaaaaaaaaaaaaaaaagcggccccgccccccagcttt

SEQ ID NO: 16756 - DNA, 893 bp, Zea mays
taggctaagattaaacaaaaatagggtaatattttagatgaggtcgatcagctagctggctaagtcagctggaactaattttagttaagattaaacaaaaatagcgtaaattagatgaggtcgatcaactagctggctgatataacaactattaaatccatctaaagttcagacttcagagtgaatgtgattagcttttaatttagctggctaaacagttaggcattgccatcaaactggccctggactaggtcgacgatgctggtcggggtgtgcaggcggcggccgaatcgttgtcgactaacgtgttgcccacaagccgtcgtccacacaagctgcaaatctcactgtccttgtcaaatctctcgtcctcacacgctcgcttggcgtctattagtactaccccatcagtccagagctagatcgtggcaggggaactcacctcccttggcgttgggtcggtagcagactagcagatcgacgttggcgagggcggattcaaccggcaacccggcggccggcgcgacggagtcaagcagtcgacaaacagagtgggggtgggggcggcggcgagcgcaatgctgcagtcggtctatggctggctctctagtctcaactcgatctctagctggcaggatggatgaagatccatggaatcgacggtctatggaaacccatctaaggcccatgggtacaaactatttccacccaatataaaaataaacccacccaacccaattcacggtcaattaaaacccatcatcacccatctaaattaaacccatatctaaaacccacccaaaataaccatttacacccgccccatttgcaggcctaggctggtctgaagttaaatccagagaagtgtgtcttcggagtaaaaataggggaaa

SEQ ID NO: 16757 - DNA, 762 bp, Zea mays
cgccacctcgctgccacgtgcccggccgcgaaatcttccattcctcctctctcctgcgccgtgttccctgtgtctctctcctcgcgagctcttcatcccttcttccagcgcggtttggcgatggcggcagcgcaggcgatctcgaaggggagcgtggtgtctccgtgcggcaatcgagcggcgccgggcctccttgccaggcggaggggtgccgtggcggcgcgggtggcgccgtcagcggcgcggatcgggggcttctggaggaagaacgcgtttcctggcgggaggctaaccctgaggacgaggagatccagggccgcgtcaccggcgcagatgaacatgaaccttgcgcttgggaaatcgatgaggtggtgggagaaggggttgcagcccaacatgcgtgagatcgagtccgcccaagaccttgtcgatgctttgaccaacgccggcgacaggctcgtcgtcgtcgacttcttctctcctggctgcggcggctgccgtgcttttcaccccaagatttgtcaatttgcggagcagaatccagatgtgctgttcttgcaagtgaactacgaggagcacaagtctatgtgccacagccttcatgtccatgtcctacccttgttcagattctacaggggagcacagggacgactctgtagcttcagttgtaccaacacaactattaagaagttcagggatgcacttgcgaagcacaagccagatagatgtagcccttgcccaaccagggggctagaggaatct

SEQ ID NO: 16758 - DNA, 1323 bp, Zea mays
cgtcgcatgcacggcgtccgtaggctgcaatcttccattcctcttcttctctctggcgccgtgatccctcttgtgtctcctggcgagctcttcataccatcttcgagcgcgatttggcgatggcggcggcgcaggtggtcgcgaaggggagcgtggtgtcgccgtgcggcaatcgagcggtgccgggcctcttgggcaggcggagggatgccgtggcggcgcagatgacgccgtcggcggtgcggatcgggggctcctggaggaagaacgcgtttcctggcgtgaggctagccttggggacgaggagatccaggcccgcgtcccggagtttctccgcctcgccggtgcagatgaacatgaaccttgcgattgggaaatcaatgaggtggtgggagaaggggttgcagcccaacatgcgtgagatcgagtccgcccaagaccttgtagattccttaaccaacgccggcgagaggctcgtcgtcgtcgacttcttctcccctggctgcggcggctgccgtgctcttcacccgaagatttgccaatttgcggagcggaaccctgatgtgctgttcttgcaagtgaactacgaggagcacaagtctatgtgctacagccttcgtgtccatgtgctacccttcttcagattctacagaggagcacagggacgactctgcagcttcagctgtacaaacgcaactattaagaagttcaaggatgcacttgcgaagcacaagccagatagatgtacctttggcccaaccagggggctagacgaatcggagttattagccttggcagcaaacaaggaactccagttcacctacaccagggagccagaactgactcccatgggagatacccccggggaggtcattgctcccgagcccgcaaagcttcctgccgctacgaagcctttggtcaagctggggtcggaggaaaggtcattggtctctccaggaagatgagacggtccgatgcttccgttctgtatagttccatggttcttgatgtgtacaggttgtagcttctcatggtagcagagtgcaggctaaggttttttacatgtgaagcctgcccacctgtcgtcccgtagtttggctcggttgtactagcaggtagcaataagtggtgctgtggagctatgtcttagggaaatcgtatggtagttgcatcgatgattggtctgcatgctcttgtttcatttttccttaagcctcaggatatgggcatgggtgcctgtcgcaaaactgaataatcaatcgtgctttatgttgtgctaggcattgtggaaatagaaaaacaaaaagaagccaaaaaaaaaaa

SEQ ID NO: 16759 - DNA, 1663 bp, Zea mays
ttttttttttttttttgaacaaacaggcatggccgcatgggctgcaagcatttctgtgaaaaaatatgttacatttcagatgaaatcaatattgtgagttggtaatgtcacagaaattacataggaaacgctgcacccatgctacaataatgcaggtcccgttatacaaatgggaagtgaagaacagtagtggaagtgtccaacatattggtgttaggcaggggcgcagggccggttcggcttgtgcagcaccgtaggttcatccatccaatccagctgagggtcgaagcattctcttcttccaagttctaaacaagatcaatcgtacgagcatgattgtacacacagctcaaatgtgggtcatcctagttcttcagcgtgctaagtggaagattgtttagccattaagtctctttcccactggaaaaggccagacttctcaacatcatctagggacaacaccgggaactctgacaggcaggcactgaaggcactggaaaataggaccaggaggcttcggcaggcctgctcttcttccagtcgctccatccccgtgcgctgcaaagcagaatccttccatggttgatagtaatgccatctccatgcaggatttgattcagccgggcagcctatctttgagcaaagcatttcaattttccctcggttgttggccaggtgtttgttcacttgcttactggatctgtcaagaagcaacaagcaaagggctgcaataactgatggcaaggaatcactgttctttggcatatggtcttgaaggtgtagtataatgacagctagagtatcattcacactgcaactctttgccgtttcagccctttcatatgcattgtccaagaaagagcaaagagtttcactggtgttccctgcaagatctacactctttccatgaaagatgctagatatctttccaagtattacagaagcggctaacaagcgcaaaatctttgaaagtagagactcatttcttggtggctctttgcaggatatttccaacagcgatctttggttagagtacaaccagaagatgcttgaagttgcccatgaaacaaccattgatattcttgacttatccatttcagataaaattggtataggaccattcatcagaatggcatcgataccaagttccattacaagcttatgctctgtacttcttgagctaccaccaatagtttggcacagattaaatacaccatggagggacaaggtaaaatgtggttggtatatcttccttttcatagacaacctcattgttgatgtaatcacacttagagctgaagtcaacaaatgaacatttcctttcaataatttggcattgttaattagaacagaaaggtatgatgatattgttgagagctgctcaagggcggtttcttggagccaatctgtgatcaatcttgatgatatcgaaccattgactacctccaacgctaactcagttactctagaacaggagctttcagacccgtcagacacttcgctacggactgaaataacagacaataaccacaacagaatgccagactcttttactagatgatgagctagaactggcagcttgacacacttcttcagcaccttacggactaaaacctttgattcaaaatctgaaacgggtgaagaacagaaggcaagagcaagt

SEQ ID NO: 16760 - DNA, 4322 bp, Zea mays
actaaatctaaatgtctcaagcttcaacatgtcattgaagtaagttctctaggaggggaaagaaggaacaaggtttctgaagatgaagtcatttctttgcttccagattatctagatcaccacacccacaatttccattaagtgtcgaccgaaagccttcttatcttcaaacattgtaaagaagtcaacctcaagattccacttaatatccacataatgccaacattctatgctgaaaggacatcgaattagaagatggaaagttgtctcttttagagtcataaagaacacaatgaagatcattagccgcattcaggaagccttttctcttgagcatattctttgagttgattctatctctaaagacaagtcaaacaaaaactttgatctttttgcaaactttgggttgccaaatccacatgaacggaggtgggggttaggggtgacaatgagctctaaattttacactataggattcgaatcagattaagaccgactttatttttattcattttaatctaaaatttatttagggccctaacattttatgaagaagcatttgtatcattatccattaccacccctagggggatcgatggatcccaagctgaggctgtagaacttcgaggagctgaaatccatctacccgagtccctagacgtcatcatttgatctataatctccataaaggtctcatattcttgagcaggggagtatataagttatcttctatggacatgttgctaaggaatgtctgaattgaacactctttgtttttttacgaagaagaagaggcaagggaaagctacctagaattaaaaagaactagatctaagtattgattagagttaagatatttagagtagtttatgactttatttttttaccatactataaaaagaggtatatattagtcctttgtaatattaatgaattgagtgtagtgtatattagttgtcgtagttctaggtagcttagatgatgcccaaaagtcatttataacaaacccatccatcaaagtttttgaaactagaagtatttggaaaatcttagaggccttggatcctaagaaataagatcaccagatcaatggaaatagtctaacacctacgcatggaatgctattgagcacatgattgtcagaccttacaaacaagatcgtctgtccatgagcactacggtttgtaaaaacagaccaaagagatctagatcgtgttggactagtatgatagaggttgttgtatcaaatattgcaactgtagcagctactgttctttttataggagtgttggaccctataaaatggtgaccgtcagaccattgggtcttgatccgatgctttatagagagtgacgagagatgtacgacaaggatgcctgcaccatcatcgaactctccatcggcgactacctccactcgaacgccgatctctacactgtctctttcctaccgcccctcttggatctcttttaggatccacgcccgcatctagtgcctcgagcacgaggatgcccagcgggacgaggtgcttactgcgctcttcgccacaacctcccacagtggcgacgacagagaggagcagttctcagtgcacatgctgccgctgagggcgtggagtggagtgcgaactgtaagcggggaagggcgcgcgtggaaagaggatgagtcatgatggatgataaaaaaaatcagccattggatgtaagagaaaggcggagtttgagtatgatctgatcagtttatttttaatgaattagttttctaggtgcaattgctttgatgtatgtaggatggttcatgtctatggggttatttgttggggtagctttagatttatttgaaatgatggattatatagtggcggtgactattaagaactagtgtaaattgttgtattaaaattcaccatcgaactaggtgagtatccgtgcgttgcaacggaaatatgtaatacaataataccgtatatacaaatgtgtattatactgttataagaaaaggggtcgtaatccatttgtgggcctagccatacataaattttgtcattttaatctacctatttcatcactgtattggaaccatcaataccatgcagacttttatatgtgatagtacaatgaatcacttttgtacaaaaaacactatcaacagttggccaaaagcaaaacaagctcaacacagaaaatctttaaatattgtttgtgctcaacattaaacctaatatctgcacaaataccatctgcgtgtaacaattgaacactaaggcgtccaatctcgctaggcttcaaaacaaggtgtagtgaccatcttcaatgattgggtcaactgcacgtgttgggtcataccttgtttggtgtgttaaggatgaactggtaacaggacgaagctcccaatacatatccaacaaagatttcacgagcctactgttctaaaaatgctctttttgcgatgtgaccttattgctatggttgaaattgtctcgcatgtaacctttaataccccaccatgcaccatcatttccacatagatcatctatctccacaaccttcttccagaacttccgtttgaatgttaatcttgcctcatcactatcttgaaagcagttatgcccaccacctgaaagtctcatcactgtcccatccttctctatgcgatccttttgtttaaataatttctttgtggaaaacagatttgacacacaaactgaagtagtccataagtgtggtgtggccctgcaccctccttgagtttcatgtggccggcatcaaggtttgaataggatcctgatatcaatccatagcgtttagtgttgcggtatagcccataccataaacagtgtatgaatggtcatgtaagagcgccataaacttagagtcactttcgaaggattcaaaaacttcctctgttgctaaggttgcagataatggtacaattacctcagtcatcagttttgcatagcaagcgataacaggtaaacaaccaagtaactcagaagtagactgaaagagaagttattaaggtcataaaatacaaagaaaatccctatttatcctctaaaaaggttttgtcaaatatgatatccaccccacgatgtcagaatcctaaaaatatctcatcaaatatgacaggtatttttcgacttctacactcactcacaagtactcgctggaaaagaggatccatcatgaggattccacctgcaccttgtatattactacacaaatatgggttaagaggttgaaccagtaaatggcatggaaaaagtactgagtttttttcagctattagcatcaaatgatagtgcgcatagttacatactaaaggctaaagaggaaaaaatgaaaatattcccaagaagctcaaagagtgaaacttttttacctggttctataattagtgctacaagacatttagaactatttgatagagaaaattctgatagtttctgttttatataggacgaatacaaatcaatagcaaatgttctgtccatggtcttgcagaaggattcagcttgtgaagaaaagtaaaagaaacctcatggacctcgtcggtcttctcgacaatgtgcgcctcgagcgtcatcctgatcttctcatcaaggctatagttgtgcatgtcgacgtggacgatggggacatccttgttgcaggattcacagtaaaattaaaataagagaaacccgcccggcctcgcgggaccccgtgttagaattcactaacgctggttgaagcggagtatttgacccttgtgacgtctcaatatgagtcaatgcactcataaaggtctccagggcacctctcacaaactctacatcctcacggtcttctttcaaaatattgaggaggataggaaaacccattgctccaaatgacatctatgtcgagcgactttctgtcacgagagattgcaactcagtcattgcatacctccagtcttcatgtatcgtgccattgcttatctggtaaagacatctctcgacattgcttatccgtgtgggcctcctttttaaaaggcgctacttttcttcgccgcttccgcatcttccattcctcttcttctctcttgcgtcgtgatccctcttgtgtctcgcgagctcttcgtaccgtcttggagcacgatttggcgatggcagcggcgaggtggtcgcgaagggtagcgtggtgtcgccgtgcggtaatcgagcggtgccgggcctcctgggcaggcggagggatgtcgtggcggcgcagatgacgccgtcggcggtgcagatcgggggctcctggaggaagaacatgtttcctggcgtgaggggatgggagagctagggttgcttgggg

SEQ ID NO: 16761 - DNA, 646 bp, Zea mays
  misc_feature (643)..(643): n is a, c, g, or t
  misc_feature (645)..(645): n is a, c, g, or t
cccgggatccggccttatcgaacatcatccgagagaaagcaagcaaccgtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggcgccggggccgtcgtccggttgaactgagaagcgtgcgtccagccaagcaaggtggtcaaaaccgagaactaattaagggctcgatcgtgtgtcaggctactactgttcttgccataattatatatagatacgcaaagtgtggccaagcctacccacatgcatgctattgcatgcctccgaatatatattatccgactcgatcctgccaaattgtttcgtcgacttcattatatatattccatccctttaatttaatggagaagtgtgactgctgttcgtgatggttttgtatgcgcaaatgtaatgtaatccatttgtccaacataatccttgtttcccacacaaaanang

SEQ ID NO: 16762 - DNA, 2288 bp, Zea mays
actcttatattctcttttctactactataatatgagagtgtatgtaaaaataagatgaaattatgtataagtgagtgtgtgaatctcggttcttggctccatattcacacacacttaatcaatagaaaaacatatattttgtgttttattaaaacaaaatttatcatatatatatatatatatatatatatatatatatatatatatatatatatatatatatatatatatatatatatatataaattgtagcaatgcacgggcatataactagtataacaagaagctatagttcccgcagtttgttttgctgtgcatctaagctctcccctgctcccgggtgtttgggtccacccgacaccaccaccgtgtgtcagtgcccaactctaacttatcgttggtcgcaaccaaccaccgaaattagtaggccttattttttgggccgactacgaccgtcaaaattctttattttttttggctgtcgttgtcgaaaataattacctttctcggtgatgaaatttcgatggaggcttgacataaaaataatcgtcggaaataagttatttcggacggttttgagctgacaaaagtttatgaattttttatagtaaagttggtgcaataaaatctaaaataattagacaaagctcaatgaataataactgaacatcatgaccataatccacgttggatgcaatttaaataagtactttaattttctgtgataaaatttccgtcgaagataagttattttggatggtttgagctgactaaagtttacgaattttttttatagtaaagttggtataatatagaatctaaaattattagacaaaggtcaatgaataatagttgaacatcatgaccgcaatacacgttggatgcaatttagtgctaagtgcatgttcggttagctgggattaagagctggaactattccaactgatcagtatcaatataaataatatgctaggtggaacagttctcaatgattcttcagaacaaaacgaacaagccatgaatataaattggtcctgtgagacatgttcaatcacggacgcaggagggaaagtcatgcgtacaaggcctattcaaagccggcaacggagggcttgcattgataaccgcctccaccaccaaaattaggactagcaaggccacccactttaatttcccgcaaacgccacaaacggccttgcatggatccatcccactccctcctaagggcgattgggttccgcccggccggccggcatcatccgagagaaagcaagcaaccgtgtgccttttggagacgcgatgtcgtccggcaacaagatcagcgtggccttgctgagcgtggccctagtgggcctgctcctctgccacctcgccaccaccgcctccgcccaccagaaagacatccacgtcctcggcagcgtcgacggctccagcgacggcagcagccccgagtccgaaggccgcgtcgtctacgcggacatgaagctggctgatacggaatccgatgcgccggcgccggcgccggggccgtcgtccggttgaactgagaagcgtgcgtccagccaagcaaggtggtcaaaaccgagaactaattaagggctcgattgtgtgtccggctactactgttcttgccataattatatatagatacgcaaagtgtggccaagcctacccacatgcatgctattgcatgcctccgaatatatatatattatccgactcgatcctgccaaattgtttcgtcgacttcattatatatattccatccctttaatttaatggagaagtgtgactgctgttcgtgatggttttgtatgcgcaaatgtaatgtaatccattcgtccaacataatccttgtttcccaaaaaaaaaaaaaaaaaaattgcggcccccagctccagcagcaggtcacatggttcatgtggactaatatggacgcgccaggcaggctaatgcaaggatcccgatcgagctcctaccgacgatcgatggccgtagcctcgcagactccaaccaaaactaactcatcttggccgattgttttcctcgtcatccaaatgttaattaattaagaaatgaacttctacgagcttgcaatacttaacttctaccatactgatgagcatgaatgcatgattacgtactgtctaagaagataaacaatcaacacgttaaagcatggtataaacaaagaatgcatgtcaaaatgggttgcgtgttgatcgataatatgtaccccgtgtatttaccatctcatccatgtaataagccagacacacctatcacag

SEQ ID NO: 16763 - DNA, 2477 bp, Zea mays
ctgtatcttgcggcacatggcatacagccttgataactagctctgggcagttatacacatttggtgatggcacatttggagtcttaggtcatggaaacagagcatcatgctcatatccaaaggaagtggagtctttgaagggtctgaggacaatttctgtttcgtgtggtgtgtggcatactgctgctgttgttgaggttatcatttcacagtcaaatgcttcatctggaaagttgttcacttggggtgatggagacaaatatcgcctgggccacgcgtccggataggtcttcaaaactgaaaccaacatgcgtcccctcgttgatagattacaacttccataaggctgcatgtggccatactcttacgattgggttgactacctcagggcacatttttactgttggaagccctgtgtatggacagcttggcaatccaaataatgatggaaggtatcctcgcctggtcgaagagcagcttgggggtggcggtgttgtggaggttgcttgtgggtcttatcatgtcgcggttttgacaaatgctggtgaagtttacacatggggtaagggtacaaatggaagattaggccatggtgatattgcggatcgtaaagtgcctacactcgttgaggcattgaaggataggtctgtaaaacgtgttgcttgtggatcaagctttacagcagccatctgtcagcacaaatgggtgtctgggatggagcagtctcagtgctcggcatgcaggcagccatttggtttcactcgaaaaaggcacaactgttacaattgtggtttagtacactgccattcgtgcagttcaaagaaggctctgagagcagcattgtctccaaacccgggtaagccataccgtgtctgtgattcatgttacgtgaagctaagtaaagttttggattctggtgttagttatagcagaaatactatcccccgcttacctggtgatacaaaggccgagagaatagacacaaaggcaaccagagttgcacagtctaatagttcagatatgattaggaatttggatgtgaaggcagccaagcagacgaagaagtctgagtattcgtcgcaagttccagcgacgttgcagctgaaagacatccctttcatcagcgcacctgacctgcagaacctgtctacagtggctaatcaggtacccttatgaccccagatctactttaccatccttgagaatgccatatctgaactactccagctccctgtcctcggaaagctccgagagtcttaaggatgcaaatgaacttctgaagcaagaggttcaaaaactacaagcggaggttaatagtttgagacgggaacgtgaacagcaagatgctgagctgcagaaagcagatgctaaagcccgtgaagcgatgaaccttgccaccgaggaagcatccaaactgaagacggcgaaggatgtcataaattcactaacagcccagctaaaagaaatgtctgaaaggcttcctcctggagcatgtgacgtgaagaacaatggacgcgttatgggcgatttagcgcccgaaatggggagagagaagcagatgcgatatggtgatcggttcagtggattgcctgctcaagtttaccaaacaagcaactacagtgaaacagccatggttcctccacaagggagcagcaggagcgagcacgtcgacggtgtccgagagttcttctcccctgtgcagcagatggccaatggaggagggtctacgactattgggtatcgttacaggtcagatgaccacgaccgaagggagacagacaggttccagataaatctgcagagcttgaatacgagaagctctaattctcccagtaaccaagtcgacgcggagtggatagaacagtatgagccaggagtgtacctgactctagtttctcttcgtgatggaaccaaagagctgaaacgcgtacggttcagccgaaggagatttggtgaacaccaagcagaatcatggtggaaagacaactgtgagaaagtgtacgacaagtacaatgtctgcggaacagatcgtctctcttcggtaacgacagcctagcgtaggccctgcatgcatgacatccaaaaaggagggcaaagccagtgcgcctgtagcatcgttgtgccctctttctttctctccatcatttgaagagcgggaggcatccagcttggttttggaacgtgcgctgcttaatcgacttgtttatctttttctgtcacctgcttggattcccctctctctcgttgtcgttgtatagaggagatgatggaaccaaagcagttgttgctcctttgactgagatatactatatacacgtagctgggcgtaaatcgtaatgcaagccccgttatcgtcgccttgtgatgtatctcttctgtcagtcgtcatgcatactctgtctgtaacacctggtacactctcgtattgatggtacatatttctgacagtcctttttaaaaccatagatcatccatat

SEQ ID NO: 16764 - DNA, 1076 bp, Zea mays
ttgggtacctcgaggccggccgctctctctccgtcccctcttgcttctcccttctttcttgccttcccgaacaaccgccgaataataatacactagcgctagcgatagaggaattttgttggaggtaaagtagccagaccgaccgggggaaaaaacaccgtgtcttgatgtcgtcgtcgtcgctgtcgccggcggggaggacgtccgggtcggacggcgactcggcggcggacacgcgccggcgcgagaagcggcggctgtcgaaccgcgagtcggcgcggcggtcgcggctgcggaagcagcagcacctggacgagctggcccaggaggcggcgctcctgcaggccgagaacgcgcgcgtggcggcccgcgccgccgacgtcgcgtcgcagaacgcgcgcgtcgagcaggagaacgccgtgctccgcgctcgcgccgccgaactcggcgcccgcctccgctccgtcaacgaggtgctccgcgtcgtcgaggagttcagcggcgtcgccatggacatccaggaggaggtgccgccggcggacgacccgctgctccgcccctggcagttgccctgctacccggccgccgccatgcccatcggcgccccgcatatgctccgctactgatgagtgatgaatgattgcccccgccaaccatacgaggcagacagagccggggctggtcggcaaacgagcacaagaagaattggctgcgtctcaacacacatgattattgctgctgatctgttctctctgtgtgtatgagatgatgctcgttcacatatgcatctgggttggttggactttcgatattgtaatgtcattatatgagtcagtggtatgataactcctacgcttgagcgtttattctctgatgcaacatttgcgtaccgagatccagtttccccttgatatgctgtttcatgggggttaatggtggcaaactgatttatatcagcaagacgttcagaagtttggaaaccttgggttcatgagatgcggtccacaaattggattttttactggtctggcacctgtccctaggacagatattattgtcttgtgttccccccccat

SEQ ID NO: 16765 - DNA, 4032 bp, Zea mays
  misc_feature (397)..(397): n is a, c, g, or t
ttctgtgctccatcacacacgatagtgccccaagcacccatagcgatgcagcttcgaaccagtctactgactccggtgctactcaactccaacatcgaagggactgtatgaagacaagggatgaaagaatagtaagtacatatatatttttataaatttacacaagtttaggtcaataatagttttctaagttcataaatttatgtgtacacacgtggctactacactccatagaccatattgatgtaatggcaagaagggatcaaccttctaggttcaaattgctagaacattcaactccaccatagaagctcctcgccaccataccccaagaaactaaaggattggtggtcgatgaataactgtaaagtcaccctctttaatggcttatataatngtttgtatatgtcgtagttgagtagagcagatgatggggtgctcctcaaagaagtcaaggaatgctttcataaaaagcccaatgaaattgacatcaagctaaagcacatgtagtgtgctctttgtaattagcccagttggtgcgtgcaacatggtgacgacaattctagtgataggagaaaaaagttttcattctaacttgaatggtggttatagctccacatcaccgaacaatgtcaacgcaccacatcctattgaccaccatagaggaagagctcaacacaaatggaagagggccgacaagaagtagcaatgattctcctgtcatggagaagagtatgttaaacaagctctacaatgctagccagaggatgactcaatcaaattgtttgagcaattcaacaagttgatggttcattaaagtatcgatatagacgatgacatgaaaatggtccataagttggctttaaaaaatcgaccaaagaattaaaattagacaggaaagaagatgcaaaagaggtggacgaggaagatggtgaagagtagtagtagtgtaactattatttttacgaattatgtatactttttattttgaacttttgcattttatttgtttttagatcatgtaatttttatttgttcaactgcatactcatatgaatttttattttaataaaacatcgtgtttcattttaaataaaagtctgtaaaaatgttgatgtgacgatgaagtggatgtaggcttatggtaatagttatgcactagagtgctatggtagataaggattgataatgaccgataacatgattggtagtacgatcgataggtgacttgatggttaatgggaacctgccttagtgaatgccgcgatggacgacatagttgatgccacgatagattaggcgacgacaaggtgaatgccgcaacgagcatagtggggaggctagggtatagagagagcaaacataaaaataaatagcatgaaaggatggagctaggaagaaatttagaagggtctaaactaatcagctacaacgatgtaatctcactaaacatggatgatgaaaatcataaattatgtaataagaaatatatgatgcaatctatctatatcgaaagaccgagccacgaatagacacaaattaaaggtcaaattacaactattattcatctgaggaagcagtctacacaagtaggtataattaattagtcaaatattcatggcctttaaattaataattaagaagcaaagaatattagtttagaaggtaacatagcatatcactatgtttcggggcaacaacatacaacatttttccatgtcttgaaaccgccttttaatcttttcattatcaattttttaagggtgtgtttggtttagctagctttttgaactagattcactaccaaaaatctgaaatctcaaccaaaagagtacaacaacataatagattccagaaaatgtacagatttatctatttcaatttagaatcacccgctaccctaaattttccagattctcgtaatccatgttataagctatcattctcttataaaatttatactggacaattatttcaagtaaacaaatttcagtttttctataatcatcagctcacaacagccttctacacctcacagttagataattagattcatattttcaataatctatagttaaaccaaacataccctaaatatctccttattatagcataccatcaagttaccaatagagagggctcaaaccccacccgcccctcctaaccaccgtctctcatagtgcacagagagagcagagaccgtttggctattactattaggctatctcttgccgttttatctatcttatcttctatttaaaattttaaatttaaatttataaataatacaatcagcagtataaaatatgtaaatagtattttgcaccaccacatgtctgttggccacatccttaatcagatagttgcgtagacctgcaatcccacgaagagcaagaaacgtcacgccggaaacattatcgttaagggctagtttgagaaacctatttttcaaaaatatttttatttttctaagaaaaaaattttattttctcttggaaatatgaatcctttaaaaaaatagagtttccaaattagaaaaaaacaaatccgtttatctatggcatctcgcacgttgtagcgcacatgcatgcacggcgcagcagcagcaattgtcaccgcagcggcaggactcccgacgccaagcgtggaaggcaaggtaataaggcggacacgcctcccccgcctcgctaccctccaaatccaccacccaacccgtgcgcaacaaacagccggcacgccacgcagcctctccttcacaggaaccaccggaaaaaaaaatcctataaaacgacgcgcccgcctccgcccccccccccgtagctccttctcctacacagaaaagccgtcgcctactcgcctccggccaaaaaactgactccacacacgacccaaatcttttcctctccacaggcgactcccaacgcaacagcagctcgtcgagcgagtcgtcgccggccggccggtatatacgcaagaaagccaagaaaaacacttctgcctcttcctccatatccaagaaccaaaggtagctagctagccgcgactcgttggctagacgattcaagcagcagcgcaggatggtggcgccggtggtgattgcgtcggccgggctgggcatgctggccggcgtggcgatggccaaccggtccctcgggaacgggctcccggcggcctccaggtgggacgcgcgcccgcgctgcgccacgtgcggcggctccggccgcgtggagtgcatctgcaaccgctggtccgacggcgactccggctgccggacctgcgctgggtcggggaggatgccctgccgcagctgcggcggctccggcacgggccgaccgctccctgcacggctcaccgtccagcaccagaagccgccgccgccgccgccgcccggctacaactgatcgatggtggatgattaggtatccgtatccgtggattatatacttctcgcgggcgatttgcgatgcgacccatacaagaaagaaatcagttaaactgcgatatgatgcgctctagctagttaatcatatatacatatatacacgtccgatccattcgtgtggatgacatccatgttgcatatgtacaagtacatgtctcttcttcaagagtcaagactagctgtaattgagctgagcatacttggtgttgctgttgttcagttaatttgcaaaaacgcacaacacaagaaagaaggagaaaaaaaacagagtggaaatgttttttttttaagatctggagaacaacatgattgagaagggagggaaggtgattctgagcacagttttgttggaaaggctgtagttaattctggtggatgtaatatattatatgtatgtatatgcttagattcgttaatatatatgcatatatatgcacccacatgaatatgatttacagagattatattaatttgttgtgagtgcatgcccttttcctggatgctatttttatttcttgttagttcttcagatctgctcagttggtgtggccggatcgcccttaataaaattgttgcccgcgttctggact

SEQ ID NO: 16766 - DNA, 1162 bp, Zea mays
ggtcgtagctccttctcctacacagaaaagccgtcacctactcgcctccgggcaaaaaaaccgactccacacacgacccaaatcttttcctctccacaggcgacttccaacgcaacagcagctcgtcgagcgagtcgtcgccggccggccggtatatacgcaagaaagccaagaaaaacacttctccctcttcctccatatccaagaaccaaaggtagctggctagccgcgactcgttggctagacgattcaagcagcagcgcaggatggtggcgccggtggtgattgcgtcggccgggctgggcatgctggccggcgtggcgatggccaaccggtccctcgggaacgggctcccggcggcctccaggtgggacgcgcgcccgcgctgcgccacgtgcggcggctccggccgcgtggagtgcatctgcaaccgctggtccgacggcgactccggctgccggacctgcgctgggtcggggaggatgccctgccgcagctgcggcggctccggcacgggccgaccgctccctgcgcggctcaccgtccagcaccagaagccgccgccgcccccgcccggctacaactgatcgatggtggatgattaggtatccgtatccgtggattatatacttctcgcgggcgaggtgcgatgcgacccatacaagaaagaaatcagttaaactgcgatatgatgcgctctagctagttaatcatatatacatatatacacgtccgatccattcgtgtggatgacatccatgttgcgtatgtacaagtacatgtctcttcttcaagagtcaagactagctgtaattgagctgagcatacttggtgttgctgttgttcagttaatttgcaaaaacgcacaacacaagaaagaaggagaaaaaaacagagtggaaatgtttttttttgaagatctggagaacaacatgattgagaaaaggggagggcaggtgattctgagaacagttttgttggaaaggctgtagttaattctggtggatgtaatatattatatgtatatgcttagattcgttaatatatatgtatatgcacccacatgaatatgatttacagagattatattaatttgttgtgagtgcctgcccttttcctggatgctatttttatttcttgttagttcttcagatctgttcag

SEQ ID NO: 16767 - DNA, 1773 bp, Zea mays
  misc_feature (1765)..(1765): n is a, c, g, or t
tattaggtttgtatgactttttatgagttttattaggtctgtatatactttttattaggtttctaagacctagtctgacttagttcaaagccactaggttggggctgttgtgatggttttcggtttgttctctattaaatataactgataatatctctattgaaatctagctataaattaaaacataaaaataaatataataccaacgatatagtacctttgactcggtggcacaccagcagcagctctcaccgcagcgcggcacgaggacgccgggacaccaagcggggaagacaaggtaacaagacggacacgcctcccccgcctcggtacactccaaatccaccacccaacccgtgcgcaaacaggcacgaaacgcagcctctgcttcacaagaccgctcgaaaaaagtcctataaaacgacgcgccccccccccgcccggccgggagctcctccagtccttctgctacacagaaacgccatcgcctccgcccaaaaaacagcctccacacacgacctaaatcttttcctgcccacgggcgactcccaaacccaacagcagcaagaaagccaaggaaaacactcatttccttcttccttccttctctaccatatagccaagaaccgaaggtagcttgcgacttggcaagctacaagttgggcgattcaagcagcaggatggtggcgccggtggtgatcgcgtcggcggggctgggcatgctggccggcgtggcgatggccaaccggtcccttggggacgggctcccggcggcctacaggtgtgacgcgcgcccgcgctgcgccacgtgcggcggctccggccgagtcgagtgcttgtgcaaccgctggtccgatggcgactcaggctgccggacctgcgcggggtcggggaggatgccctgccgcagctgcggcggctccggcaccggcaggccgctcccggcgcggctcaccgtccagcaccagaagccgccgccgccggccggctacaactgatggaataattaggtatccatatccgtggattgtataattcacgcgggaatatatatatggtgcaacccatccaggaaatcagttcaactgcgagatgattatgcatgtacatgcctcttcttcaagaccggttgtaatatattgtgctgaggacactcggtgtcgctgttgttcagttaatatgcaaattgcacagcacaagaaagaagaagaaaaactgtgttgaaatggtttttttctttagagatctaaggaaaatatatgattgagaagggagagctgtccgtgattctaaacacagttttgttgtatgtagttaattctggtggatgtaatgtatcatacacatgcttagattcgttaatatatagatgcacccacatgaacatgatttactgagattaaatttgttgtgagtgcccttccccctcgatgctattttcgtttatggttagtctctcagatttgtttagtggattgccctaaaaaggggattgaccgggttttaatcaatagtagatcaaaaatctcttccaatctatattaatatctccaatccatatagattgaaaataatcgaaaaaaaatcttaggacatgttcgtttccacctaaatcaaaggggttgaggggattcaatcttttctattcaattttgactaaaagtaatttaatcccctcaattcacccttaactaacaaactcttattatattactatattgtgctccgtggatcggatctaatctcttttatgctgtgttttgtnctggggta

SEQ ID NO: 16768 - DNA, 750 bp, Zea mays
ccggccgggttcgccgttcgatgcctaccgctgcccgggtcgtgaatggtgaccttctccaccgacgtgcgtgacgcctaaccaagccccgccccgccccgcccccgcctcccttccgccgcaggagacggggtcggcacggggcgatgaggagcagcgaggccatggagctcctgggcttccctccctactgcaggccttccccttccgaggtgaaggctgcgtatagaaggatggtgatggagtcccatcccgatcgtgtcccaacgcatctgaaatcgcaggctgagtcaaaattcaaggagatagcagaagcatattcttgtttgaaggacggaagaagatcagggagtaggatgggagttcatgttatgcgttctggtgttccgactagccacggaagatcaaatagaacgttggttaaagccccgtttctcctcataacgtttgcagcagtttcttttggcgccttcagcgcatcaagagcgtatcaacggcaaaaggaactgtgttcctctcagaacccctttctaccatagaggaagacggtgggctctgtccatgttcacataggcgaggagagcttcttgctacgttgtatacagatgtaaaacaatcacaccatcctgaataaacgtgccaacctgtgcctgctaactttgttgtttcagactttcgaaacatgtaaaatcacttctgtattggtttcctgatttcaaaaaaaaaaaagcggcccccccccccccccat

SEQ ID NO: 16769 - DNA, 892 bp, Zea mays
agcgtccgcctaaccaagccccgcaccgccccgcccgcccccgcccccgccccgccgcaggagacggggtcggcacggggcgatgaggagcagcgaggccatggagctcctgggcttccctccctactccaggccctccccttccgaggtgaaggctgcgtatagaagaatggtgatggagtcccatcctgatcgtgtcccaacgcatctgaaatcgcaggctgagtcaaaattcaaggagatagcagaagcatattcttgtttgaaggacggaagaagatcagggagtaggatggaagttcatgttatgcgttctggtgttccaactagccacggaagatcaaatagaacgttggttaaagccccgtttctactcataatgtttgcagcagtttcttttggcgccttcagcgcatcaagagcgtatcaacggcaaaaggaactgtgttcctctcagaacccatttctaccatagaggaagacggtgggctctgtccatgttcataggcgagaagagcttcttgctacgttgtatacagatgtaaaacaatcacaccatcctgaataaacgtgccaacctgtgccttctaactttgttgtttcagactttccaaacatgtaaaatcacttttgtattggtttcctgatttcgtctgccttgttgctactacgttcagttagctttgctttaaaactgcttcgagggcaaccagaaacacacaacagcatgtccaagcatttaacagaatcattgaccattcactcccaggcaacatggcaaccagaacaattggcaggatcagcaaccagtaagatttacaagaagcaccacaatagtttgataactgtcagcattacaggaaacatcccacagtctaagatgggagcaaag

SEQ ID NO: 16770 - DNA, 692 bp, Zea mays
cattgggtaccgcggcgccggccggtgtccttctccaccgacttgcgtgacgcctaaccaagccccgcaccgccccgcccccgcccccgcctcccttccgccgcaggggacggggtcggcacggggcgatgaggagcagcgaggccatggagctcctgggcttccatccctactccaggccctccccttccgaggtgaaggctgcgtatagaagaatggtgatggagtcccatcctgatcgtgtcccaacgcatctgaaatcgcaggctgagtcaaaattcaaggagatcgcagaagcatattcttgtttgaaggacggaagaagatcagggagtaggatggaagttcatgttatgcgttctggtgttccgactagccacggaagatcaaatagaacgttggttaaagccccgtttctcctcataacgtttgcagcagtttcttttggcgccttcagcgcatcaagagcgtatcaacggcaaaaggaactgtgttcctctcagaacccctttctaccatagaggaagacggtgggctctgtccatgttcataggcgagaagagcttcttgctacgttgtatacagatgtaaaacaatcacaccatcctgaataaacgtgccaacctgtgccttctaaaaaaaaaaaaaaacacggccgcccaaacatgtaaaatcacttttgtactggtttc

SEQ ID NO: 16771 - DNA, 2544 bp, Zea mays
aacatgcccaatagttggcagagtgagtcccactaaaatgtaacaggttaaggctacctactgtttcactcctgctaagatatcttgtgtgtaaaactacttaatatcccccaacttggcaaaatgcagagcattgtgctaggtaggatacaccaggaccacaaaatgttcaattgatacaagaagataatgtaccaatgctaagctttttcactagcggcagtagtagcatcagccactattatgttaaacgacaacggctgccaacctgaagaatggggcaccaaccacttttttgtgttgattatgacattcagaacctgaaggacttcagcaagggcaagatgcttcaggcatgttttcttgaacatagtagcagcttgatacctagattgagaactctttatctcaggataggctggagcagaagacatgaaagcatgaacagtgtctagagtttcttttgggtattttgcattatcatccattatattaacacatttccagagatcttcgtcttttctcagaaataatgacattttccctaactttttcttgacaacagcttgatgctgcatggcaacctgaagtgccttcttaacatcaaattttggtagattagcatcaccataacatatacagtctgttatatattgttctgttgggggaatcttctcagtcttcagaacttccaaagcacctaagatatatcttacaagatcttgaggatctgaagatggctgtggacatcccgggttggctccccagtgtccaatattttgcatgttgctaggcatgttaggtcgagttggaggtctgtagctataaccattgtaaccaggttgaatgatatgatgggcaccaggatggtttggatggtagttggcatgcaaacctggttattcccgccgagccacgagggtactcagaaatattaaccgatccgtatcaggataattgattggtggtccatgataatgtgggccgcttggccagaattgcattggtgcagtaggaataccattatgcccagctagagctggacatgagttgcttctatgtgagtttgataattgaaaattgccagatgatccaccatgaggacgatggttcactggtttctgttgtcttggttgctttgaggattggggtttctgttgtcttggacgaccattgttagtcacttcaggagcaccgtttttagatgaagagtcagttgacgcaccaggcttcttaccatggtaaaagtcatgaggaacactcttttgatgggaaagagtggattttacaggctttttgggctgggaagatggctggtttttttgtgtattcagctgaaccacctgtgccccaccctcatcttgcaaatcagaacttggtagtgaggatgatgaaggctgagattgatttggctcgggagcagtgcttcctttaggactaccaggtagcccatcaactgaagcttcatctgactggtttttccgaggttgcctaactttagattgtttgtctgccttgctgttaccacctttttgctgatcacacggtatgctattctgtccttgagtactgctatgtggagttgcaactgaagaatctgaatccatgttcttcgatgcatttgaatggtccacactgccatttgttatgctacttatgtatggggactctgccaatggtggttccccagccacgaggtctttccatagccaaacatgttttgctgcagcagtaagcgcttgagacacatttggaggttgtgctagtagaatattgtaccgcctcatcactagcttatgaagggcattcgagaagtcccgatcaccagaaattagcaaataatttgccggtggaggattgtcaatagcccagattaacatgtcaactaagatctttttatcacttgcatctttaatacctgccatttattacaagatagaaaaaatagacaacgttcagccatcacagatgaacaaaaaaaatgtttggcattgaggcacaaaatgtgcagatgcatgagtttcaagcaaaaaaaaaagtacttgaatgtaccaagattcttccatgaaagctaagttaaaacttaaaactaaacttggaaacagatggctaaataaattgtgccatgtcgactggcaagatcctataaaagaataataggttgctgcagtggagtcattcttcatcacaatgaaatatctgcggatcttaaagatggaaacgctaatcaaaacagtacttcacattgctcatcaataaagaagtagctttcacaatagctcagaagactaaaaatcacatcactgataagataccagtctagtccttagaaaaaatctggataagaacttaagaagacagcacaccatgggaacagtcgacctatttagggcctgtttggcatggctctacctatttagggcctgtttggcatggctccagagcaaaactctaagagagagctggccatagcatgtcaaacaccctaactccatagagactccagagttgtaactctatagagtttttggagctgcagcacaa

SEQ ID NO: 16772 - DNA, 3399 bp, Zea mays
  misc_feature (2943)..(2943): n is a, c, g, or t
tcgaaacaccttgccgcgctcgttcgaggacctggctggttcgtgcttgccaaccacgacacgcagcatatagcctctggctggcctcaaccggcgccatggagctgctggtgctactcctgctcttcctcgccctcccagtcctcccggcgcgctgcggctcggtgactccgcggcggtcgctccacctcgagctggcgcgcgtggacgccgcggcggccgccaacctcacggaccaggagctcatccggcgcgccgtgcagcgcagcctcgaccgaccggggatcgtggcgcgctctggcagcggagccgcggacgaggcgggcaaggccgtcgcgagcgaggccccgctggtgcccgggggcggcgagtacctggtcaagctcggcaccggcacgccgcagcacttcttctcggcggccatcgacacggccagcgacctcgtctggatgcagtgccagccctgcgtcagctgctaccgcagctcgacccggtcttcaaccccaagctctcctcctcctacgccgtcgtgccatgcaccagcgacacctgcgcccagctggacggccacaggtacgtactcgacgacgcagggctcgcgcactgcatgcaccaccagcaaggttactactacgtgcaatcgagacgcaagcctactgacaccacacacacgcaaacagatgccacgaggacgacgatggagcgtgccagtacacctacaagtacagcgggcacggggtgacgaagggcaccctggccatagacaagctggccatcggaggcgacgttttccacgtcgtggtcttcggctgcagcgactccagcgtcgggggccctcccgcgcaggcgtcggggctggtcggcctcggccgcgggccgctctcgctggtgtcccagctctcggtccgtcggttcatgtactgcctgccaccgcccatgtctaggacctcgggaaagctcgtgctcggcgcgggcgcgggcgcggacgccgtccggaacgtgtcggaccgggtcaccgtcaccatgtcgtccagcacgcggtacccgtcctactactacctcaacctcgacgggctggccgtgggcgaccagacccccggcaccaccaggaacgcaacgtcgccgccctcgggtggtgctggtggtggaggaggaggaggcggcatcgtcggcgctggcggtgccaacgcgtacgggatgatcgtggacgtcgcgtcgacgatctcgttcctggagacgtcgctgtacgacgagctggcggacgacctggaggaggagataaggctgccccgcgccaccccgtcgctccgcctgggcctggacctctgcttcatcctgccggaaggcgtggggatggaccgggtgtacgtgccgacggtgtcgctgtcgttcgacgggcggtggctggagctcgaccgggaccggctgttcgtcacggacggcaggatgatgtgcctgatgatcggcaggacgagcggggtgtccatccttggaaacttccagctgcagaacatgcgcgtcctctttaacctgcgccggggcaagatcaccttcgccaaggccagctgcgactccttgccatagatagataggttccgcctggactggaaacttcgtctcatgatcttgcactccgtgacaggattttagagaatttgcacatcggagattagatattggtgctctgtattagcttctgacagaaattcctgaactgtatatgcagaaacgcgtaaccattcagtaatcagagtagcaaatggaaggaccatcgtgtctttcactccgaaaaaaaaaaaaaaaacggaagcagcatgaaccctagaagcctagacttcatggacacaaaaaagtatttaagcgaagaaacagaattcagtagacagtgccatcaatttctctagttccaacctttcaatccggcgaaataccagaagtatttgaagagacttttcagatgataaaagctaccacaagaacattcagaaattgtctcatgtcaggaaccacctctatttcccccacggctcctatattttacttttatactcttaattaattaagcttatttgcttctcagcgcaagcgtataagcacaatcagtatagcgtagggtatgcattagcaatggacatgaagggtagatgtgccgccgggcatcaaaatacaataccgaaactacctcagaatcatcgactgaaaccaaaacttgagcccgcagcacctctccacgacgtcgccttcaagcctgacgttccagcagcccgagtatgtccagggtctgcagcagccggcactcggtaaggatgacgctgagcccaacgttcgcgactgccagcgcctcttcttcagccaccaccttagctgctgctgcgttgaaggcaagccctgaggaaggtctggagggggcatgttcctcttcagctcaacgagcagcttgcagtgccggcctagcgcctcgatccctttggcagagatattcaggcagttgctgacgtccagcactttaagtgcaggaagacattctgcgtgcttctccacggtttggtcagtgatctcgctcattgggacctgcaggacattcaacaaccagtggcgctttcgtaagagatcattttgtcgcactatgttcctactaaaatgtatttatttttttttggtaaaacatgatcgccaaacgaaaggtgtaaattaattttgtgtatatgtgctgcgaatgaatcggtgcatgacgcgtgccccgtccgactgttgaggtaatctgcctttttcgagatcgtcaattctggaggaatgagtgcgaggcgcgagtctcaatgggtaccagtatatggcagcacagtatcaatggaagttcagagttagttatgaagagagagtgtgaatagggatgtttggtttataggtactaattttagtcctctattttattttattttagtntctaaattattaaatacagaagttaaaatagagtttaattactatatttatcaaattagagactataaattagtttatagaaaacaaacatcctaaagttttctctagataaaatctgttattgacttaccaacagttaaaacttgtggttgtcaggcttttatatgagtttgctataagtgtccaaagcggtacgccattttttattatataatgtaaatttatttaagtcaattatacacaaaaatttaaaatttttatattctctatatttactagaaatataagatcatgcaataacatgtaaacggacaaacacaattaggacccatttattttcccttgctaaacttcagcactatattttttactaaaatttagctactaaagaaactaacatgttgattaaaagtgttgtgctaaaagtttagcacacattagcactatgctaaaagt

SEQ ID NO: 16773 - DNA, 1879 bp, Zea mays
ttgggtacctcgcggccggccgggctaaaccccaccgccgattctccctattgcttcgctgtcgcctgggagacgccggaggcggcgatggcgaagaagctagggaagaaggcgcgcaagttcgcgcgcaagaacctgcagtctgccgccaagcgcaaccgcaagatccgcaaccagttcaagcaccgccgaggaccccgcggaggtgggagcgccggccgggaggatggggacgagcacgtgctgcagcgggtcctcgatcccaccatggttaccgacgatgctgctgctactttgatccacggtttggagtttccagaggacgatgctgaactagatgctgatctgtctgacagtgatggttatctttctgaggatcctggatgtccatactattctgacagtgaggatgagaaagctgccaaagattgtatcatggaagaaggtttggacagacagaatgatgacatgaatcgagatatcaagaagcaaaagaaaaagttgaagaagttgctggataaggaccctgaatttgcaaattttctcgaaaaatggcagtcggagttggagagctccagaagtaaaggagattctgatgaagagggtatggattctatggatgatgacgatgactccaatgatgggaatttaccaaatgctaaggtccttacaagaaagacgataagtgaatggtgccagttagtgtcaaaggaacctaaagcacctgccttgcgtaatctactaaatgcttttcgagatgcttgtcgatatggtgttcactctgatgggcccttgatgcagagatttcaaagtgccagggtgttttatcaaataataatgtttgttctttctgagtcggacaacattttccgtgctcttttggaaattcaagatgacgttaacaaaggaaaaattatgaacctgagaaattcaaagaaatggctaactgttgatcctctcataaagtcctacttatcaagttctcttgatcttcttagtcaacttacagacaacaagatacttgcctttgttttgactcggttgagggtatcagtggtccttttctctgcatatccatcaacatcaagtaggcttgtcaagattttatttcgcttgtgggcaagtggtgatcggagtttgtctctgtcggcatttcttatgatccgagaagtagcttcactgttacctgactgtttggatcactgtttaactaaatcctacaatacataccttgccagtaccaatcttgtgaatgacagaaacacaaagcatatttattttctgatggactgcctggtagagctgtattctcttgatgttcagaaatcatatgagagggcaataatctccgtggagcaactgaatgctattcttagacaggcttctaaaaccaaggaaaaggaagatctcaggaagatagataactggcaatatattagttgtgtcaacctatgggttcggtttctgtgttgtcactataaggattacaatctccatcccttattttctcaagttcttcttaataagaggagtggctcacttattcccaggcacaaggtacttaccgttgagactgaagcttgtgcagatgctgaacgagctttccacttgcagtcagatgttctatccaattccatcgttgctctttgactgcctagaattaagagaagtttctcagaaagaacaaacacaaagaacaaagatcaacttttcgtcgttggtgaaggtgccaaagaacctgctgaaatcaaggattttcaagaggagtgtattctttcagcgattcagattctatcagcacattttgcccagtggagttaccatgtttccttcccagagtagccaccattcctcttgtcctcttgaagaggctacatga

SEQ ID NO: 16774 - DNA, 1366 bp, Zea mays
actgatcagagggccaggtgctatccacgaacgatagtgtaatgtctaggaacgatagctgatttggaaaacctgcaaagtctattcacaacagattttatttcgcttgtgggcaagtggtgatcagagtttgtctctatcggcaactgtttggatcactgtttatccggctcctgcaatacataccttgccagtaccaatcttgtgaatgacagaaacacaaagcatatttattttctgatggactgcctggtagagctgtattctcttgatgttcagaaatcatatgagagggcaataatctccgtggagcaactgaatgctattcttagacaggcttctaaaaccaaggaaaaggaagatctcaggaagatagataactggcaatatattagttgtgtcaacctatgggttcggtttctgtgttgtcactataaggattacaatctccatcccttattttctcaagttcttcaagtaataagaggagtggctcacttattcccaggcacaaggtacttaccgttgagactgaagcttgtgcagatgctgaacgagctttccacttgcagtcagatgttctatccaattccatcgttgctctttgactgcctagaattaagagaagtttctcagaaagaacaaacacaaagaacaaagatcaacttttcgtcgttgttgaaggtgccaaagaacctgctgaaatcaagggattttcaagaggagtgtattctttcagcgattcagattctatcagcacattttgcccagtggagttaccatgtttccttcccagaagtagccaccattcctcttgtcctcttgaagaggctacatgagcagacaacagttgaatcacttcgccgtcctattaagcgtttgatagaccaggtgacggagaacaaggattttatagaaaggaaaagagaggttgtatccttttcaccaaatgataaggcgtcagttgatagcttccttcaggaggaggtcagcagaaccgcttcattcactcggttctatgcatccgtagctgaaaaccgtcaaccaaaatggagaaaaacactttaaaataccaagggaatttctgagagacatctggaattggttggtttccaagtgagggccacgaagaaccacatcaatgtagaacattttagtgcagatatacgccgaggcagctattgtgtaaacctctagtgagactgattcctacgagtcctcgagtgctcaacaattttgtacgattgtaaccttaattccgaagtgagttgtcaagtgatgaatgaaatttgctgttgcttttgaaaaaaaaaaaaaaacataccggccatcatcccactgtaccaaagaaagtcaactaaccacc

SEQ ID NO: 16775 - DNA, 2601 bp, Zea mays
tcagagcgcagctgctgctgcccgtcgtcgtcttggcgcgcgacgaagccgagctgagctgacggatgggaccgggcatgtgggtggcctggcctgggccactcggcagtttcacgatgttgttggaagcctggaaaaagtgtagttctggaagtgagccgtcctctttgtcctcatctggttgttttaatctctactactattataatcctactgtaggcgtccacacccgcggcgcggtgcacgttctgcctccggcaacccgccccgcccgcggccgcatccctcccgcatcccgcggccgcaccatcaacggcgcaacagccgcatccagtccctcccgcatcaacagcgtcgcagccagtccctcccgattcgcgcttaatccccgcatccagtccctcccgcatccagtccctcccgcggtgcaatccagacgcaaacaactccattgaccccgattcgcgtacatgctctctcaccgcaatccctgttctctcctcatcaacgcctctcgataaactccatggaaggttcgcactgatgcgctctgattccttgctccacgctctctcctgctctcgcgctctacatggaaggtgaggtcgacgcccaaatcgacggaatctctgctctgcgctctcccctgctcccgcgctctacatggaaggcgaggccggcgcccaaatcgacgggatcactgctcggacgggattgcggcctcgatccgcgctctccagattcgcccagattgacggcgtccgcgccgtgcttgcccagatcgatggaatttgcggtctccagatgcaagtccggggctcgctatccgtggaaggcgaggagagacgatgcatcggctctcgattcgcgctctacatggaaggtgaggcagatcagggggagtgtgtagagaaatccaagcgaaaccccgcgagagcgaggcgacggcagacggaggcgagtgggtgagccgcgggcgagagacgaggtagcgggctagcgggatggcgtcgccggttgtagtggccgcgacgctgctggtggtagcactggcggcattctgcggcacggacccgctccgaacggacaacatggtggacttcccggggtttgagtcccacctcgtcgacctccctgatcccgccgagatgccgacgcacgcggatgaatgggagcgactctgtggagccgatgtgcggttctgcggcgaggtgcaggggcccgagagcatcaccttcgaccagcagggccatacacgggcgtcgccgacggccgggtcgtcttctgggacggcgagcggtgggtcccattcgcgatggcctccccgcgctggacgcaggagctccacggagggccgaaggcctcgccgctggagtatctcccagcgagcatatctgcaaccgcccgctcgggctctgtttcgataagactggggacctgtacatcgccgacgcctacttcggcttgctcaaagtccgccgcgaggccgggctggccacgctgctcgcaacggaggccgagggcgtgcgcttcaacttcaccaacgacctcgacctcgacctcgacgacgagggcaacatctacttcactgactctagcattcactaccaaagacgtctgtgatgccatgccctcgctctcttccctctgctttgcgcgcttggttggatgctcacttgattcctactgaccacggggatggtgatcgactgattgttaacatcacttgattcctctgctttatattgattcctactgaagatggacaatataaaaacctaaaatggaccaattctttctttgagggatacaaccctactctggtgtaacttatacttgttctagcacttggccctctgatctggtgaataagttatgcagaagaaaaattatgttttattttatatttaactgtactttgttgtagcttgtaggtactgatcagagggccaggtgctatccacgaatgatagtgtaatgtctaggaacgatagctgatttggaaaacctgcaaagtctattcacaacaggtacactgccttcccaattaaggaaaaactgacactcatatcccattgaatttgctggctatgcatacctgttcagttcacaatgatataaccacttactttatgtaatgtgaatacgtttattaaaatagttatgatcagcatatccttccttaatcgacatatttttttcttctatgtaccttctattcaggttacgaatactgtaaagataatttagaatttctcatacaaatccttaaccactgtaaatatatggggaatttctaaaatgtgtttagattcatacatgtacaagtttgtattatgtttttatgcatatttatgaatctaccttataaatcgattttatattggtgtctcactttatccctctttaaaacacacacttgctgttttcaaatttcaagtcactaattggtactggtcttcctcaaaaaaataccactgtaattaggttgccgatgcagtgatatataatggtcacctattatgaagaaatagtgaatgggagaagggttgagttttggagcccggtgcatgcaaatcatataccaggtttatgctataa

SEQ ID NO: 16776 - DNA, 3296 bp, Zea mays
tgtttggtagttcgcaacaatctctggtggctagaatcatcaaaaaactgaaacaaatagacaattcatgtcgagaaacacccagagcaaaagttgtagatctcaaaaaacaactttatagttaattcctttttcatttgaaattgtctagcaaatggaaattacatttggtctctcatatatgaaatttgatctttttaaactaccttggatgggaaaatgatttaaatgtaagttatagatcttaaaaggtaatgcaactcatagttgataacttcttcatttgaaatcatatgtatctatgaaaaattgtgcttgaattttgtcatatttaaaattcaaattcttcgaacgatcttagatggacaaataaccaaaagaaaagttgtagatctcataaagttataaaactaatttatagctgacatctttttcatattaatttatttaggattttaaatacttatttaaaaccagataaaaataaaatggtcagaacggatattcataatattggacgcaattgtcttatgggtgcagtagtaaggagaaaagcacatgaatgaagctagaggtgttttagtgctggtttgataacaaagggaattggagggatccatagaggagtaaatcttgctattaaaaattgaatcgcaattgattttttccccaagcatagatccctttcaaattccatcgtcaccaaaccaaaccagttttgggtgagtggtcagggaacgagcgaagtttgatgtattgagttcaaatgcgggtgactgcgaggcgcaacgtttttcatgtgacttgtagttgtctattgggttttctcgggtattatttttttcctgttcttttggcatgattttgggtgttctaaaaacctccttagcgccagctctcattctacctcttaaaaaatcggcagtgatgagcccacccacggtgtacaagcgagttgatgcaccaactaacgagttgaactgaatactcctacttgcatagtagttctcaatcacaaagccatgggcgaaaattaattaaattaacaactcggtaaaactcaaattgtcttgccactgtaaatggttcggatatgaatcgcatgatgcgtgagcccgtacgtgctgatattatatatacagagaagtaggaaggatcccaggcatccctcccgatcagatccctcgacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaggggcaagccgccgctccctccctcgccgccgggcaccctccccatcgtggggcacctacaccacatcgggccccagacccacatctcgctccaggagctggtggccaagtacgggcacaacgggttcctgttcctccgcgccggcgccgtgcccaccctgatcgtgtcgtcgcccagcgccgccgaggccgtgatgcgcacccacgaccacatcttcgcgtcccggccgtggtccatggcctcccacatcctccgctacaacacctgcgacgtggccttctcgccgctcggcgaatactggcagcagaccaggaagctgatgaacacgcacctgctcagcaacaagaaggtctactccttccgccatggccgcgaggaagaggtaataaattgaggaaacgaaaattaaaggaataatcctccgtcctccaagaaaattaaaggaataatcctgcatgaattaattatacgcgcaggtgtgcctcgtcgtggacaacctccgcgaggcggccgccaagtcgccgtcgacggccgtggacatgagcgaggtgctggcggcgtacaccaacgacgtggtgagccggtcggtgctgggctcgacgcaccggaagaaaggccggaacacgctgttcagggagatgaccatgaccaacgtggacctcctggtggggttcaacctggagtactacatcccgcggtggccgctgacggacctgctcttcaggctcgtgtgctggaaggtcacgcgccacctcaagcgctgggacgccctgctggaggaggtgatccacgagcacgtggagatgaggaagctgtccggcgacaaggagaaggagtcggacgacttcatcgacatcttcctctccagatacgaggagtacggcttcaccatggataacgtcaagtccctcctcatggtaatcgattccatcgtcgtcctcctcattattattttgggctagaatccatgcatatatataggctgaggctctcaacgtaattaacttcctttccatgtggccggccggcttgacaaaacagaacgtgttcgaggcagccatcgagacctcatatctggtgctggagtccgccatggccgagctcatgaaccacaggcgcgtcatgaagaagctgcaagcggaggtacgggcgtacggagcggagaagaagctggacatgatcagggaggacgacctgagcagcctgccgtacctaaaggcgtccatgaaggaagcgctgcggctgcacccaccggggcccctgctgctgccgcactactccaccgccgactgccagatcgacgggtaccacatccccgccaacacgcgcgtcctcgtgaacggctgggccatcggcagagacccggcggtctgggagaagcccgaggagttcatgccggagaggttcatgcgggacggctgggacaagtccaacagctacagcggccaggacttcaggtacctgccgttcgggtctgggcgccggatctgccccggggccaacttcgcgctcgcgaccatggagatcatgctcgccaacctcatgtaccatttcgactgggaggtccccaatgagaaggaagacggtggcgggaaggtgagcatggacgagacgttcgggctgatgcttcgcaggaacgagccgctctaccttgttcctagggccgtctagctagctagttactgtgccgccgccgcctcctatccaagaatgcatgagtcttagacgtgtggcagtaataattgcgtggggtgtagtaaaataataagcacgtttgttgagttgtaatggattcacattatgtgcattcgagacaggtccaaggaattgtatctctaaagtgaaaatttcctttttcaccacgatgaatgcatgtcatactctctcaccggtaaaaaaagaaaaaaaaaggaccctagggccaaaaaaaaaaaaaaaaaaaaagggcggccgc

SEQ ID NO: 16777 - DNA, 2056 bp, Zea mays
gcccacgcgtccgcctacttgcatagtagttctcaatcacaaagccatgggcgaaaattaattaaattaacaactcggtaaaactcaaattgtcttgccactgtaaatggttcggatatgaatcgcatgatgcgtgagcccgtacgtgcggatattatatatacagtcgagaggccggccgggccgggatccctcccgatcagatccctcgacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaggggcaagccgccgctccctccctcgccgccgggcaccctccccatcgtggggcacctacaccacatcgggccccagacccacatctcgctccaggagctggtggccaagtacgggcacaacgggttcctgttcctccgcgccggcgccgtgcccaccctgatcgtgtcgtcgcccagcgccgccgaggccgtgatgcgcacccacgaccacatcttcgcgtcccggccgtggtccatggcctcccacatcctccgctacaacacctgcgacgtggccttctcgccgctcggcgaatactggcagcagaccaggaagctgatgaacacgcacctgctcagcaacaagaaggtctactccttccgccatggccgcgaggaagaggtgtgcctcgtcgtggacaacctccgcgaggcggccgccaagtcgccgtcgacggccgtggacatgagcgaggtgctggcggcgtacaccaacgacgtggtgagccggtcggtgctgggctcgacgcaccggaagaaaggccggaacacgctgttcagggagatgaccatgaccaacgtggacctcctggtggggttcaacctggagtactacatcccgcggtggccgctgacggacctgctcttcaggctcgtgtgctggaaggtcacgcgccacctcaagcgctgggacgccctgctggaggaggtgatccacgagcacgtggagatgaggaagctgtccggcgacaaggagaaggagtcggacgacttcatcgacatcttcctctccagatacgaggagtacggcttcaccatggataacgtcaagtccctcctcatgaacgtgttcgaggcagccatcgagacctcatatctggtgctggagtccgccatggccgagctcatgaaccacaggcgcgtcatgaagaagctgcaagcggaggtacgggcgtacggagcggagaagaagctggacatgatcagggaggacgacctgagcagcctgccgtacctaaaggcgtccatgaaggaagcgctgcggctgcacccaccggggcccctgctgctgccgcactactccaccgccgactgccagatcgacgggtaccacatccccgccaacacgcgcgtcctcgtgaacggctgggccatcggcagagacccggcggtctgggagaagcccgaggagttcatgccggagaggttcatgcgggacggctgggacaagtccaacagctacagcggccaggacttcaggtacctgccgttcgggtctgggcgccggatctgccccggggccaacttcgcgctcgcgaccatggagatcatgctcgccaacctcatgtaccatttcgactgggaggtccccaatgagaaggaagacggtggcgggaaggtgagcatggacgagacgttcgggctgatgcttcgcaggaacgagccgctctaccttgttcctagggccgtctagctagctagttactgtgccgccgccgcctcctatccaagaatgcatgagtcttagacgtgtggcagtaataattgcgtggggtgtagtaaaataataagcacgtttgttgagttgtaatggattcacattatgtgcattcgagacaggtccaaggaattgtatctctaaagtgaaaatttcctttttcaccacgatgaagccatgtcatactctctcaccggtaaaaaaaaaaaaaat

SEQ ID NO: 16778 - DNA, 2058 bp, Zea mays
ccggccggggcggaagcatcccttctcccgatcacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaagggcaagccgccgctccctccctcgccgccgggcaccctccccatcgtggggcacctacaccacatcgggccccagacccacatctcgctccaggagctggtggccaagtacgggcacaacgggttcctgttcctccgcgccggcgccgtgcccaccctgatcgtgtcgtcgcccagcgccgccgaggccgtgatgcgcacccacgaccacatcttcgcgtcccggccgtggtccatggcctcccacatcctccgctacaacacctgcgacgtggccttctcgccgctcggcgaatactggcagcagaccaggaagctgatgaacacgcacctgctcagcaacaagaaggtctactccttccgccatggccgcgaggaagaggtgtgcctcgtcgtggacaacctccgcgaggcggccgccaagtcgccgtcgacggccgtggacatgagcgaggtgctggcggcgtacaccaacgacgtggtgagccggtcggtgctgggctcgacgcaccggaagaaaggccggaacacgctgttcagggagatgaccatgaccaacgtggacctcctggtggggttcaacctggagtactacatcccgcggtggccgctgacggacctgctcttcaggctcgtgtgctggaaggtcacgcgccacctcaagcgctgggactccctgctggaggaggtgatccacgagcacgtggagatgaggaagctgtccggcgacaaggagaaggagtcggacgacttcatcgacatcttcctctccagatacgaggagtacggcttcaccatggataacgtcaagtccctcctcatgaacgtgttcgaggcagccatcgagacctcatatctggtgctggagtccgccatggccgagctcatgaaccacaggcgcgtcatgaagaagctgcaagcggaggtacgggcgtacggagcggagaagaagctggacatgatcagggaggacgacctgagcagcctgccgtacctaaaggcgtccatgaaggaggcgctgcggctgcacccaccggggcccctgctgctgccgcactactccaccgccgactgccagatcgacgggtaccacatccccgccaacacgcgcgtcctcgtgaacggctgggccatcggcagagacccggcggtctgggagaagcccgaggagttcatgccggagaggttcatgcgggacggctgggacaagtccaacagctacagcggccaggacttcaggtacctgccgttcgggtctgggcgccggatctgccccggggccaacttcgcgctcgcgaccatggagatcatgctcgccaacctcatgtaccatttcgactgggaggtccccaatgagaaggaagacggtggcgggaaggtgagcatggacgagacgttcgggctgatgcttcgcaggaacgagccgctctaccttgttcctagggccgtctagctaggcagctagctagttactgtgccgccgccgccgcctcctatccaagaatgcatgagtcttagacgtgtggcagtaataattgcgtggggtgtagtaaaataataagcacgtttgttgagttgtaatggattcacattatgtgcattcgagacaggtcgaaggaattgttcctctagagtgaaaaaaaaaaaaaaaaaaaaaaaaaaaaaaaaaaaaaaaaaaaaaaaaaaaaaaaaaaaaaaaaaaaaactgaaaaaaaaaagaagaaactaaaaactaaaaaaaaaaaaaaatagaaaaaaatagtaaaaaaaagaataaaaaatataatggggggcggttttaaaaaaaaaacaggtaacaccctcgagagtccggctaatattttttttattgggtcccccaaaaataaat

SEQ ID NO: 16779 - DNA, 1763 bp, Zea mays
ttcttgtttgttgattaacccttaattaatccgggcgcgcctgatttatcacaagtttgtatccctcccgatcagatccctcgacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaggggcaagccgccgctccctccctcgccgccgggcaccctccccatcgtggggcacctacaccacatcgggccccagacccacatctcgctccaggagctggtggccaagtacgggcacaacgggttcctgttcctccgcgccggcgccgtgcccaccctgatcgtgtcgtcgcccagcgccgccgaggccgtgatgcgcacccacgaccacatcttcgcgtcccggccgtggtccatggcctcccacatcctccgctacaacacctgcgacgtggccttctcgccgctcggcgaatactggcagcagaccaggaagctgatgaacacgcacctgctcagcaacaagaaggtctactccttccgccatggccgcgaggaagaggtgtgcctcgtcgtggacaacctccgcgaggcggccgccaagtcgccgtcgacggccgtggacatgagcgaggtgctggcggcgtacaccaacgacgtggtggagccggtcggtgctgggctcgacgcaccggaagaaagggccggacacgctgttcagggagatgacatgtccccaacgtggacctcctggtggggttcaacctggagtactacatcccgcggtggccgctgacggaccggctcttcaggctcgtgtgctggaaggtcacgcgccacctcaagcgctgggacgccctgctggaggaggtgatccacgagcacgtggagatgaggaagctgtccggcgacaaggagaaggagtcggacgacttcatcgacatcttcctctccagatacgaggagtacggcttcaccatggataacgtcaagtccctcctcatgaacgtgttcgaggcagccatcgagacctcatatctggtgctggagtccgccatggccgagctcatgaaccacaggcgcgtcatgaagaagctgcaagcggaggtacgggcgtacggagcggagaagaagctggacatgatcagggaggacgacctgagcagcctgccgtacctaaaggcgtccatgaaggaagcgctgcggctgcacccaccggggcccctgctgctgccgcactactccaccgccgactgccagatcgacgggtaccacatccccgccaacacgcgcgtcctcgtgaacggctgggccatcggcagagacccggcggtctgggagaagcccgaggagttcatgccggagaggttcatgcgggacggctgggacaagtccaacagctacagcggccaggacttcaggtacctgccgttcgggtctgggcgccggatctgccccggggccaacttcgcgctcgcgaccatggagatcatgctcgccaacctcatgtaccatttcgactgggaggtccccaatgagaaggaagacggtggcgggaaggtgagcatggacgagacgttcgggctgatgcttcgcaggaacgagccgctctaccttgttcctagggccgtctagctcgagacccagctttcttgtacaaagtggtgataaattggagctctgcagagctttcgttcgtatcatc

SEQ ID NO: 16780 - DNA, 2091 bp, Zea mays
ggagctgatggtgccgcagttcctactcaaggtgctgcacgccatcctcgccgcgcggtcgccgcgcccgcacgcgcccccgcccccgcccccggcagcgtcggcgttccggaggcgggaccggtggttccacctgccgctccacctgccgcccgcggcggagcacctgccggagccgtctcccgccgagccgctcgtggtggacgtgtacctggccccatcgggcggcggaccagaggaggtgctcgagaggtggaccgtggcgtgcgagccctggccctcgcccgccgccgcgggggaggggctggcggtcaaccgcgcgtacaagcgctgcatcacgctgctcaggtcactctacgccatgctccgcttcctgcccgcgtaccgcgcctttcgcgcgctctgcgcgtctggccaggtgtacaactacgagatgggccaccgcgtcggctccttctcgacgcccttctcccgcgccgaggaggcgaccatgcgcaccgaacgcctcgcccccgtcgagacccagctcggccgcctcgtcgtctccgtccagtacctccccagcctcgccgccttcagtttcaacgccacttccctcgcgtccgccgcgatcatcacggattacgtcggcagcccggcggcggagcctatgcgtgccttcccagcttcgctcacggaggccgccggctcgccctctccgcagccctcgcggcgccccaacacctgggcgtcgccagcgccctggccgcacacgatgaggcaaccggccaaattctcgcctccgccggcccattacgcgtcgcccacgccctcgccgccgatgtttgccgacccgcgcgcgcggtttagcggcgagactgcaccaatgagcataccgcaggcgggaggtggcaggggccctatgcaccagcaccatcggaacctgtcggaacccagtagggccttcatgtttcctccaccttcgccaaaatatctgcgaggggaggcagggaggcaggagtcacctacagagactaatcgatcgttcaagagggcagatggcatccgcatgggagatctctatgcaaacttgccgtctggttataaggtgattttactgcatttcgtccatattaaaactaggtgatgatgtctgtgtgctcagatgaaaacacagggttatgcagaagtatcatatctgaactactccgtactacttagtaagaccttctatcagtttatatgatagtgcattgagtagcgaaggacgactgttttttttatcctcatcataaaggctcgtggataaaaaatatcgtgtgttaaactacctggcatactgttcattctgttatctctttcagcttctttgggaattgtgaaccttaagatttagttagtgtgttcagccattggagcttcaatttaatggcaggcattttttgttggaagctattttttcagtatttttctttacctggaaaggttgacaggggtttctgattcatttagatgaagataaggattcaatagtcactgctacttttagaaattaaagaaacacaagcccactgagggcttggtctgtagggtggattgatggggaattggaggggatatcccctcctattcaattttgtgtaggaagggatttaatccctctcaatccccaccaatccccctcaaaccgaacaggtcctgaaacgacagacaaacagttgaggctgactactgttgccaaaactgcattatgccaaagatagtcggcgctaaacttgtagcagcatttaggtgtctaacaactgaactataacagcataagcctttgttgtcttatcttcttggaattggttttgatatttcaaggatacccacttacccagtgcttcattatggaaaatcttgtcatttcttcttttccaaatgttttaccatgcgtagatgatagccccactaaattattgcaataattttttttagatatttagccatcgtgaactattaattgaatccagtaagtttattatttatgcattttatttaggaacaacttaaactaaacagacagctatggacacgatgcatttgcatagtttgagtacttagccaggc

SEQ ID NO: 16781 - DNA, 1312 bp, Zea mays
cccacgcgtccgcccacgcgtccgtccacgcgtccgagaaggacggccggccagtttagcctagccacgctcgctctacctcctcaatcctgattagcttcaaaccgccatggccatggggctccccggcctccgctgccaccgcctcctcgctcgcgggtcactccctccactcggtcccgccctctatcgcaggcccctggagcgaacctcggctctccgctactcctccctccaagctcaagctggggacagtattggggaggaggccctgcgcatgttccttgaggacaggcaactgcacggcgatttcgtcaccaaggtctctgacatggtctggaggaggaatggcgccaatgttggtgcggctgaggcgaccacgggccaagggagtgcaatagatgttgctcagcctgaagacgtgcgggaagatgctgtggacgagggaatgttgagactagcggcgattactagtgattgggtgtccggtgacagcagccctcctttaagcaagaggctttctgccgaggaaaggcagaacgagagcaacaaaaggaaggagctgaatcttttgaaatatgaagcactcaaggatgaattgctgctcttgaccgcaggaactggagcagcatgtagtttatattgtctcctggttttctctctggagactgctgtcagttatgctttgggggttggtttcagttgcttgtatcttcaacttctgtatcaacatgctgataacctatcaaaggaagatattccagaagtttttctaaagaagaaagtgaagaaaattggcattacaagtgaagatttgaagaatacaatagagaagacattgggtggtgcaggactagctctttcatctccaaggcttataattcctgccgtgatttatggattgtcagctttatcacatcacttccaaaatagctttttcagttttgaggttcttccagggatgatgggtttcctcgcgtacaaggctgcagctttggttcaagtctacagagacaacgaggacctccgcttgatacttcctgatgaagaggccgctgacagtgacagcacttgatttatacgaattagagattatgttaacctagtggttgttgacaaatacaaaacagatctgttcaccaccgagtcaagcttcacttttgaacttttttttgtctttaggagatcctgaaattcgtttgcttatcttcttggaaggggggaaacaggaagagttgaatgaaaaatcattatatgttagagacagctgaaagctcaaaggaacacacattttttttgcccttgggtaact

SEQ ID NO: 16782 - DNA, 1169 bp, Zea mays
aagatgaatgtttaactggaactagcgagtgtgataaaatgttccttatcggcggaaggggcagatatttttcggttctgtgacggctttccgagtttggtggattgtgtcgagagagtcagagagggacaccaaagccggctacggccagtccccagtcagcctagcttcgctcgctgttcgttcgtcctgatagcttgaaaccgccatggccatggggctccccggccaccgctgctgccgccttcccgctctcgggtcggtcactccactctgtcccgccctcgctcgcaggcccctcccgcggacctcggctctccgctactcctccctcgaagcccaagctggggacactattggggaggaggtcctgcgcatgttccttgaggagaggcaactgcacggcgatttcgtcaccaagatctctgacatggtctggaggaggaatggcggcaatgttgatgcggttgaggcgaccacagaccaaggcaatgctgtagatgttgctcagcctgaagacgtgcgggaagatgttgtggacgacggaatgttgagactagcggcaaccagaggttgggtgcccggtgacagcagccctcctttgagcaagaggctttcagctaaggattggcagaatgagagagacaaaaggaaggagctgaatcttttgaaatatgaagcactcaaggatgaattgctgctcttgaccacagggattggagcagcatgtagtttatactgtctcctggttttctctctcgagaccgctggcagttatgctttggggggtggcttcagctgcttggatcttcaacttttgtgtcaacatgctgataacctatcaaagcaagatattccccaagtttttttaaaaaagaaagtgaagaagtttttccaaggatgatgggtttcctcgcatacaaggttgcagctttggttcaggtttacaaagataacgaggatctccgcttgatacttcatgaggaagaggatgctgcccgtgaaagcccttgatgcatacaaattagagattatgttaacctgttgataaaaacagaacagtctgatttactgagtcatgcttcagttttgaaaaaaaattttttaccccccgtttggatcattagaattgaatttcattttaataataataatttaggcctttatcc

SEQ ID NO: 16783 - DNA, 2361 bp, Zea mays
tattttctaagattcgaagccccttagcaagtcacggacccacccgaaacagaagcgtcctcacaaatcggggaaaccacgcgcagtcccgggacgcgatcgcagtggttgttgggtccgccgtccgcgacagcgaagctacaaatccctcgccgctagttgctacacaccaaatcattcgaaacgccaaaataaataaattcgtgcttcagtgacggcaccaacagcgacccgttcgatacccggattcaaaaccggagaggaatccatccccaattcccttcctccccacccccaacgtcgcccaacagatctggttctccttcccaaacagttcgaattcgatcgcgccacggtccgtcacccgcgccagccagatttatgcagccatgcagagcggcggggcccggtgcagtttgactactgccgctgccgctgctatggggctgaggagggaccggtttcgggatccgcaatggcgagcctgtcggactcggcgggcgcaggcggcggccgcgccggcgcggagctgatggtgccacagttcctactcaaggcgctgcacgccatcctcgccgtgcggtcgccgcgcccgcacgcgccgccgcccccggcggcgtcggcgtcggcgttccggaggcgggaccggtggttccacctgccgatccacgcgccgccgccgccgcccacggcggagcacctgccggacccgtcccccggggagccgctcgtggtggacgtgtacctgtccccatcgggcggcgggccagaggaggtgctcgagaggtggaccgtggcgtgcgagccctggccgtcgcccgccgcggccgccgccgtcggggaggggctggcggtcaacagggcgtacaagcgatgcatcacgctgctcaggtcgctctacgccgcgctccgcttcctcccggcttaccgcgccttccgcaggctctgcgcgtctggccaggtgtacaactactgcatgggccaccgcgtcggctccttcgccgcgcccttctcccgcgccgaggaggcggccatgcgcaccaaacgcctcgcccccgtcgagacccagctcggccgcctcgtcgtctccgtccagtacctccccagcctcgccgccttcaacttcgaggtcacttccctcgcgtccgccgcgatcatcacggattacgtcggcagccccgcggccgagcctatgcgtgccttcccaccttcgctcacggaggccaccggctcgccctttccgcagccctcgcggcgccccaacagctgggcgtcgccagcgccctggccgcacacgcttgggcaaccggctaaattctcgcctccgccggcccattacgcgtcgcccacgccctcgccaccgacgtttggctatctgcactcgcggtttagcggtgagactgcaccaatgaccataccgcaggcgggcggtggcaggggcactgtgcaccatcggaacatgtcggaacccagtagagccttcatgtttcctccaccttcgccaaagaatgtgcgaggggaggcagggatgcaggagtcaccgacagagatcaatcggtccttcaagagggcggatggcatccgcatgggagatctctatgcaaacttgccgtctggttctaagattaaggacactaaggatgaatctggcaggttctctggtgtcttctcttctagtggttcaccaagacatggtttctcaagaagttcaagcagattgtccatgcaggatgatactgatgatgcagattttccttttgctgtggatgatgtttatccagattcacgaccagggagtagtggtggaaaggacacgggggatcaggctggttcgtcatcccataaatcccaagatgctgctgttgggtatctcgtccacctgctgaaatctgcacgtccactgagagattctacctactcatctcatacatcaaggggtgaatctaccgaagcaggaagcaccagctctttcttgtcccgcaggacatccgacgcactggaggagtttgaatctttcaaggaaacaagggagaacctgctagcacgtagtagatctcggctgcaagattcattggataagccctagtgttgatgcagtctgtggttcgattcctcaaaaggtgaagggtccaaactgtagagtaaagatcatatggcgaggctgggtaaactctttatttcagactagtccgtgtgtaaatagctaattaactggcgcttgattccgaaagagaatacacaggtcgccgttaattctattgttggaaacttgtcattcttaaactcaaagcaggaatatcgtgtgcctttgttcatagtgtttgtttacaagtgaaatcaacatgatgatctatctttatc

SEQ ID NO: 16784 - DNA, 1888 bp, Zea mays
tgcaacagagctgaaataaaatctgcaaagtactttgatattttaatgtaaaaaagatatacctctttcacttgcttttcatcgcacagaatctgatttgctccagctagtcgccacgcttccaggactggtagaagcaagtgcttttggcggattatcatgtggaaccacgaccaaggcgactaccttgttttgatctatttcagatgtgcctcgggctgattcattgattccctacagtaaatctgttggttcagcacttcagctgtgggcatgacttgttgaactggctcgggcccaggttcttgagctggagggtgcaaaggaggcaccgttggtgattcttcaacttttgattttttttgttgtcctctatggccagtacagagatatgttgtcccagattaactatttgcgggcctctctatcttgttaccatgtaaattaagtaaagtattgattaaaacctgtgcagggtacaactatccacatgaataaataatagttatacaaataaataaacaattctcgtgttaccaaacctcttcctgttccaacgttgtaaatactgacttttctagtgtctgccttgttgagcgctttcacatgagcatcaactaaatctgtgacatcaacataatatctctaatgcaggttccatcagctgttggataatctgttcttttaacctatagaaagatcatgcctaaccatcatctccatctcatagcactgcttgcccaaaacatattaacaaaccaaaattcaatcagcgtggatcatatggagcataggtttaagtaaccaaaccaattgccactaagtagaaggaatgtcaaaggagctaagcagctctcgcctcattctagtaagcaatagtaaccctggtacatctggaaatgttcacatggctagatgagccctttgcttctgaagcaatcgacggtctccctgatggtcacatcaaacggaaggaaacaaacgcccagatcgatcaacttcttggagggctcctttgctctcatcaaccaacctgtttgtcctctttgatagttgattctatgaactgggaaatcatggtacatatcagcaattctatcggtgaagtcaaacaaacattccatggacgccaagcacaaccctgtgtagatgggttctcatacgtcacgatcgagattgtgccatgtctctaacatcgaccaccctgtgttgacagggtccgactcaagccgttggcctggttaattttcaacctcttaggtgttgcaacagattattcaggctggtattgactgatgacatgaaaaatggacccagagtagtccctggattcagcacaaccagctgcaaaccttccctttcggcgaactcccacttatatgccttcgtgatgtggggctgcgtagctatcgtccttccccgttgcccgcatgatctatagctacaccgcctcagagaaccttcgtgtccgagtaggcggattgctcccaatgccgaagatgggacccgcatcgccggtgggaccctgctcgtatctctcctcaccctgtggaatccgtagtatgagatagagttctagatcataagcctctgagagctccacctccatccaggggatcttcgtgttcgtagccgagggcaggcaggggtagtggcggctatgggagaagcggatgcatccttatccagatgggttgcggctgcgcggtggcgggggacgacactaagcaggatggggcaggctcgcggggggtgaggatggcgactttcatgggtgcggttgttgcgctgccgccgcggagagatggagcaagagctggcgcacagagctggcccaggctctagagatttccgcagggggtctagggtttaggggcgacgcgccgtc

SEQ ID NO: 16785 - DNA, 2889 bp, Zea mays
  misc_feature (2884)..(2884): n is a, c, g, or t
ggtgaacagagtaactttatttggtataccaaagtatcgttatgttgcaactccaaccgttcgtgatggaaagcataaaccttgacaaggtaatgactaatgagttatgcaaatgagtaatgacatattccctcaattttgtggtgatcgtgggttccaacaatgtgcaatgcaactgcatcttcttctgaaacaaagggaaaagtctgcataccaacacaggctcagagcatggtgagtggtggagacaaagcagatgctcaagatgctccccgtgctagccatcacgttcgttcccagtgcgatgatggcacatatcaacacactgttcgtcaagcagggcacgacgctagaccctttctctagaagcccccaatccgcaccgctgacggcaccactgtattccaattacatgatttaactggaaagtatcatccattcattgcatgtattttgtaccattcagtcatagaccaacactatggcaaattagtacctgaacaatagcctataagaaacatgaaagcgaatctagttaaagaaaaagatgaaaccgaacatagagcgttcagagtttatggtgatggtacttgcagtagacagtagcgcgagtgcatcatgcaacagagctgaaataaaatctgcaaagtactttgatattttaatgtaaaaaagatatacctctttcacttgcttttcatcgcacagaatctgatttgctccagctagtcgccacgcttccaggactggtagaagcaagtgcttttggcggattatcatgtggaaccacgaccaaggcgactaccttgttttgatctatttcagatgtgcctcgggctgattcattgattcccagtaaatctgttggttcagcacttcagctgtgggcgtgacttgttgaactggctcgggcccaggttcttgagctggagggtgcaaaggaggcaccgttggtgattcttcaacttttgattctttttgttgtcctctatggccagtacagagatatgttgtcccagattaactatttgcgggcctctctatcttgtgcccatgtagattaagctaagtattgtttaaaacctgtgcagggtacacctatccacatgaataaataatagttatccaaataaataaacaattctcgtgttaccaaacctcttcctgttccaacgttgtaaatactgacttttctagtgtctgccttgttgagcgctttcacatgagcatcaactaaatctgtgacatcaacataatatctctaatgcaggttccatcagctgttggataatctgttcttttaacctatagaaagatcatgcctaaccatcatctccatctcatagcactgcttgcccaaaacatattaacaaaccaaaattcaatcagcgtggatcatatggagcataggtttaagtaaccaaaccaattgccactaagtagaaggaatgtcaaaggagctaagcagctctcgcctcattctagtaagcaatagtaaccctggtacctatatcattatcatatagtttagttttttccagtgcgtttaggcggtttaatatgagccaagtattactgtagcagttctatagaataaaacgtacatctggaaatgttcacatggctagatgagccctttgcttctgaagcaatcgacggtctccctgatggtcacatcaaacggaaggaaacaaacgcccagatcgatcaacttcttggagggctcctttgctctcatcaaccaacctgtttgtcctctttgatagttgattctgatgtgaaaaaagtaaaaatgtcattaccaaaatgaacagctagccctgcttacacaaacctgatgcatgttcttagaaaatgtatgacctatgaactgggaaatcatggtacatatcagcaattctatcggtgaagtcaaacaaacattccatggacgccaagcacaaccctgtgtagatgggttctcatacgtcacgatcgagattgtgccatgtctctaacatcgaccaccctgtgttgacagggtccgactcaagccgttggcctggttaattttcaaccttcaagaacgacttgcgctataagtttgtttattgcatgaaaacccatttgcgattcagttgtgatgcagtgaatgataatggataaccaacctcttagcggtcgcgacagattattcaggctggtattgactgatgacatgaaaaatggacccagagtagtcccgggattcagcacaaccagctgcaaaccttccctttcggcgaactcccacttatatgccttcgtgatgtgggctgcgtagctatcgtccttccccgttgcccgcatgatctatagctacaccgcctcagagaaccttcgtgtccgagtaggcggattgctcccaatgccgaagatgggacccgcatcgccggtgggaccctgctcgtatctctcctcaccctgtggaatccgtagtatgagatagagttctagatcataagcctctgagagctccacctccatccaggggatcttcgtgttcgtagccgagggcaggcaggggtagtggcggctatgggagaagcggatgcatccttatccagatgggttgcggctgcgcggtggcgggggacgacactaagcaggatggggcaggctcgcggggggtgaggatggcgactttcatgggtgcggttgttgcgctgccgccgcggagagatggagcaagagctggcgcacagagctggcccaggctctagagatttccgcagggggtctagggtttaggggcgacgcgccgtcggcaggcctgtgggatggatgtgctggttagggtttcttgaccaagatggacgcgcgggatggggaccagagatcccgagctcgcccaattgattaacgnccggc

SEQ ID NO: 16786 - DNA, 1174 bp, Zea mays
gagcacacaagtttaggcagatgcattgtaaatcagaagcgctacataagacaagccgataagccatcattgatgtttgctttggttggtttttcttctcggtgaacagagtaactttatttggtataccaaagtatcgttatgttgcaactccaaccgttcgtgatggaaagcataaaccttgacaaggtaatgactaatgagttatgcaaatgagtaatgacatattccctcaattttgtggtgatcgtgggttccaacaatgtgcaatgcaactgcatcttcttctgaaacaaagggaaaagtctgcataccaacacaggctcagagcatggtgagtggtggagacaaagcagatgctcaagatgctccccgtgctagccatcacgttcgttcccagtgcgatgatggcacatatcaacacactgttcgtcaagcagggcacgacgctagaccctttctctagaagcccccaatccgcaccgctgacggcaccactgtattccaattacatgatttaactggaaagtatcatccattcattgcatgcattttgtaccattcagtcatagaccaacactatggcaaattagtacttgaacaatagcctctttcacttgcttttcaacgcacagaatccgatttgctccagctagtcgccacgcttctaggactggtagaagcaggtgcttttggcggattatcatgtggaaccacgaccaaggcgactaccttgttatgatctatttctgatgtgcctcgggctgattcattgattccctacagtaaatctgttggttcagcacttcagctgtgggcatgacttgttgaactggctcgggcccaggttcttgagctggagggtgcaaaggaggcaccgttggtgattcttcaacttttgattttttttgttgtcctctatggccagtacagagatatgttgtcccagattaactatttgcgggcctctctatctcttcctgttccaacgttgtaaatactgacttttctagtgtctgccttgttgagcgctttcacatgagcatcaactaaatctgtgacatcaacataatatctctaatgcaggttccatcagctgttggatactctgcgccgctggccgacccgaagatcatgcctaaccatcatctccatctcatagcactgcttgccc

SEQ ID NO: 16787 - DNA, 1553 bp, Zea mays
  misc_feature (5)..(5): n is a, c, g, or t
ctcgnagccggccggggggggcgcccccgggccggcccggaatcccatcgcatctgctccaccaccggcacatcgccgccgaccttattcctccgccgctcgaggagtcagccgagccaacggagggagaccatatgggcgcggaggcagcgcatccgcagcaacagcctccctcctccgtccgaccctgcagggaggcggcggcgcccgcggtgctggggctgcagctctcggcgctgatcgaccacgtcgcgcgcgtcgactggtccctcctcgaccgcgtccctggcgaccgcggcggctcgcagcaggtgtccattgtggagttgaatcatattcttaatgaagtgaatacccacatccttccttcccacaatgatctcaccccaataactacaatagccggtggaagtgttgccaacacaatccgtgggctctcagctggttttggaatatcaactggaataattggagcttgtggggatgacaaccagggacttttgtttgtcaacaatatgagctttagtggtgtagatctcacaaggttaagggccaaaaaagggcacaccgctcagtgtgtgtgcttggttgatgcaagcggcaaccgcaccatgcgtccgtgcctatctagcgcagtcaagatacaggccaatgaatttagaaaggaggatttcaaaggctccaagtggcttattgtgagatatgcacaacagaacatggaacagattattgaagctattaggattgctaaacaggaaggcctttcagtatcattagatttggccagttttgagatggtccgtgactctaggtctaagcttattaaccttttggagaccggtaacattgacctttgcttcgccaatgaggatgaagctagagaggttatagggggaggtctggaatcagatccagaggaggcgcttgcgttcttgggcaagtattgcaaatgggctgtggtcacacttgcttcaaagggatgcatggcaaagcatggcaaacaggtcgttcaagtgccggccatcggggagagcaacgcggtggacacaactggagcgggcgacctgttcgcgagcgggttcctgtacgggctggtgaaggggttgccgctggaggagtgctgcatggttggggcgtgcagcggcgggtcggtgacgcgggcgctcggcggagaggtgcggccggagaactggcagtggatgtacaagcagatgcacgccaggggcatgctgctccctgagctcaagaactgaactaatcatgctgcagctggtgttagctgcatgctgcaccagctgttgtatctctcagcactcctacctttcccctgctagaatattgaaccactcctgagattgaaccaatcagatggagtgtattgataattgcacttcatatgtgtgctagtgtactattcccttggtctaaaatatcatgtcattttatcttttcaagactagactagacacacaattattattattattatgtaaattgatacaaaccatatgtagatatatagacgaatttgtttttggaaaaaaaaaaaaaaa

SEQ ID NO: 16788 - DNA, 1789 bp, Zea mays
ttgggtacctcgaggccggccggcgcatcgataccaagcaggggtaatgttgaagagtgtccacgaagcttgtgtgtccgcggtccgccttgtcccccacctcctataaaacgggtgcgacccccgcccccgcccgggagacttgcaatcccatctgctccggacagagccctcgctccacaccgccggcgacctttttcctcctccgctcgaggagtgggccaacggagggagaccatatgggcgcggaggcagcgcatgggcatccgcagcagcagcctccctcgtccctccgacccggcagggaggccgcggcgccgcccgctgtggtggggctgcagctctcggcgctgatcgaccacgtcgcgcgcgtcgactggtccctcctcgaccgcgtccctggcgaccgcggcggctcgcagcaggtatccattgatgagctgaatcatattcttgatgaagtgaatgcccacatccttccttcccgcaatgatctcactccggtaactacaatagccggtggaagtgttgccaacacaatccgtgggctctcagctggttttgggatatcaactggaataattggagcttgtggagatgacaaccagggacttctgtttgtcaacaatatgagctttagtggtgtagatctcacaagattaagggcgaaaaaagggcacaccgctcagtgtgtgtgcttggtcgatgcaagcggcaatcgcaccatgcggccatgcctatctagtgcagtcaagatacaggccaatgaatttagaaaggaggatttcaaaggctccaagtggctcattgtgagatatgcacaacagaacatggaacagattgtcgaagctattaggattgcgaaacaggaaggcctttcagtatcattagatttggccagtttcgagatggttcgtgactctaggtctaaacttgttaaccttttggagactggtaacattgacctttgcttcgccaacgaagatgaagctagggaggttatagggggaagcctggaatcagatccagaggaggcgcttgcattcttgggcaagtactgcaaatgggccgtggtgacacttgcttcaaagggatgcatggcaaagcatggcaaacaggtcgttcgagtcccggccatcggggagagcaacgcggtggacacaactggagcgggcgacctgttcgcgagcgggttcctgtacgggctggtgaaggggctgccgctggaggagtgctgcaaggtcggggcgtgcagcggcgggtcggtgacgcgggcgctcggcggggaggtgcggccggagaactggcagtggatgtacaagcagatgcacgccaggggcttgctgctcccggagctcaagaactgaatgaaactattgctgctgtagctttagctagctaaatgcctgcatgctgcaccagctgttgtatctcccagctctcgaagactcgtagcatcacccagggccggtcgagtggccagtatccagccttccgttgttaattgctggcgttacctttcccctgctagtctgttaatgttactagaatattggtgtccatgaccatgcttgattgctggcatggcgaaggacgggcagatacattagttgatttgtagagccactcctaagactgaatcaatcagatggagtatattgattactgcacttcatgtgtgcgccagctgcctagctagagttctatttcctacgcccaaaatttgtatgctgttctgtctttgtaagtacatactcattccgtccaaaaataaaatttgttttagcct

SEQ ID NO: 16789 - DNA, 2671 bp, Zea mays
  misc_feature (2655)..(2655): n is a, c, g, or t
acccccccttgcacctccagtcctccattcccagtctagatctcgatccacctccatggcggatctcgccacggacctcttcggggagccgatcgaggcgcaccctccctggttcaagcccgacgccttcctccgcgccagcttcgatccggacgcctacgtcgccgagctccgctcctacgtcccgctcgagagcctcgccgccgagctccgcgcccacctcgacgcgctccgcgccgagctcgtcggcctcatcaaccgcgactacgccgacttcgtaggcctcagcgcgcgccttaagggcgtcgatgccgccgccgcgcggatgcgcgccccgctcgccgacctcagggacaaggtcgccgccttccgcgcgggggcatcagccgcgctcgccgcgctccgggcgggactcgagcagcgcgccgccgccgccgccgcgcgcgagctgctcgagctcttgctcgacgccttccacgtcgtctccaaggttgagaaattgatcaaggaactaccaactgcgccatcggatttatcgaatgctgaagttcctaacagtgacactggaacaccaaatggggtggctggaacgggtgtcagcgaaacacaaagcattctcttagaaagaattgccagcgagatgaaccggcttaaattctccataagtcatgcacagaacctcccttttattgagaacatggagaagagggtccaaggtgctacaaaactgcttgatggtagcttggagcgctgctttgtggatggtctggaacaccgtgatgctaaagttatatacaactgtttgcgtgcttatgctgcaattgacaacacatcatcagccgaagagcttttccgtacagcagtggtgtctccattgattcagaaaataatccctcaaaattatgcaagagctgttgctgggacatcatctgatgagctggaagacgattatcaacagataaaggaatgtgtacaaaaagattgtaaatttatattggaaatatcttcctcagaaaactctggattgcatgtttttgattttctgggtaattcaatactcaaagaagtcctttctacaatccagaaaggcaagcctggggccttttctcctggaaagcctaaagaattcttgaggaactacaaagcgagcttaggatttcttgattttcttgaaggttactgcatctccaagtctgctgtaacgaagttccgctctgagcctgcttacacagatttcatgcgacaatggaatgttggtgtctacttttcgttgcgatttcaggaaattgcgggtggccttgattctactcttacaaatacctttagtcctactggatcgaatgaggctcaacagaaaccgttgctcttgaagcaaagtattaagctcttagaaagtttggattcatgttggggtgatgaggttcttgtattctctcactgcgataaattcctccgtctgtccttgcagcttatttcaaggtatacaacatggctttcatctggtttaacggcacgtaaagcttctgacgggagcccaaattcacctgcagatgctgaatgggcactgtctatacctatagaagatttcatatatataatgcatgatgtgcatgctgtaattggcgagctttcagaatcaggcagcttcattggacatgtgaatcagttactagggtcatgccccattgaagtatttaatcttgtgaaacaaagtatactgcaagctgttgaacctttaaaggaactgttgcctgcaataatcaatgttatgattggaatcatagttaagaagtctaacgaggacttgaagcacctgaaaggaataacagcgacatataggatgacgagtaaacttccagtcaggcattctccatatgtatcagggattttacatccgttgaaggtgtttcttgaaggggaccgtatacgctatctatcagaagatgataaaactaagttgtgtcgtgggtctacagataagattactgcaatttactatgacttggtctctgaagttgtcactgtggcaaggaaaaccgagtcttcgttgcaaagactgcgccaaggtgcacaaaggcgagtaggagctagtacagatgcctcagataacatcatatctgatacagacaagatctgtatgcagctatttcttgatattcaggagtacgcacgaaaccttcgtgcgataggaatagacgcgagagagattgattcctacagagctctatggcagtgtgttgccccaaaagacaaacaagagaacattcagttttgatgtaaagaacgctgtcagtacatataaagttgtctgcccgtagatctctcaaacatgtaggcgtatctgatgttgtccttttcggtttgaagtacttattatggatgcatacgtagagtagatagagagctggattttggtacccattttattgttaggatggatggtcacctccagatataatccagaactggagaacgtgtaccagtatatgatttcattttgatgtgaaatactaggatactgttgaaaatcgttcgtgtctcctcaagttgtcacgagcgtgaatcttagctctggctagttgtgaaaaaaaaaaaaaaaaaaaggcccctagggccaaaaaaaaaaaaaaaaaaaaaaaaaaaaaaaaaaaaaantaaaaaaaaaaaaaaa

SEQ ID NO: 16790 - DNA, 1608 bp, Zea mays
ctcaatgtaaaccattgctcttgaagcaaagggtgaaggtcttatattgtttgtattgatgttggagtgatgaggttcttgtattctctcactgcgataaattcctccgtctgtccttgcagcttatttcaaggtatacgacatggctttcatctggtttatcagcacgtaaagcttctgacaggagcccgaattcacctgcagatgctgaatgggcactgtctattcctatagaagatttcatatatataatgcatgatgtgcatgctgtaattggtgagctttcagaatcaggcagctttattggacatgtgaatcagtcactagggtcatgccccattgaagtatttaatcttgtgaaaggaagtatattgcaagctgctgaacctttaaaggagctgttgcctgcaataatggatgtcatgattggaatcatagttaagaagtctaatgaggacctgaagcacctgaaaggaataacagcgacatataggatgacgagtaaacttccagtcaggcattctccatatgtatcagggattttacatccactgaaggtgtttcttgaaggggaccggatgcgctatctatcagaagatgataaaactaagttgggtcgggggtctgcagataagattactgcaacctactatgacttggtctctgaagttgtcactgtggcaaggaaaaccgagtcttcattgcagagactgcgccaaggtgcacaaaggcgagtaggagctagtacagatgcctcagatagcatcatatctgatacagacaagatctgtatgcagctatttcttgatattcaggagtacgcacggaaccttcgtgcgataggaatagacgcgagagagattgattcctacagagctctatggcagtgtgttgccccaaaggacaggcacgagaacatcccagttttgatgtaaagaacgctgtcagtatatataaaataaaattgtcaacccgtagatatctcagtatgtgaaaatgatacggttggcactggttcatccagtcttcaacgacatgacaccctgtcagtttgtgaaacaaggacgtgtttggtttgatgaatgaggtggtacatttctctcttacttcttatttttatatttggtttttagaatagtacgagttgattcatcaccatttcattcctcgtaagctaataattagtatataagtaatgaatgagttgatcctatggaaatttatagatgaaattatgatgcatcatattataaagcatgagtgactctacgaaccaaataagtgttgtttttgcaattgcggccatgattggagttggagctggagcggctatagcctgtgtgtcactggtgatgacaggacaggagcgtcgccggctatagcctgtgtctctgtttggcacgtctttcgtcttcgggcccagtcctgaggggagatgtttgtgccctcgtcctcccagcttccaagtctaggagctcctgctccttgatgctggcacagtgggataaaataaaaatctacatcagacagtggttggcaaattgatctgtcttcccaacaggccacaggcctcatctgctctggcctctggcacggtggtcactgcag

SEQ ID NO: 16791 - DNA, 780 bp, Zea mays
taaagttcagcagtgatggcaggcggattctgttaaccactaaagctggacgtgtccatgtgctagattcattccatggcaatagcattgcgtcgtgcaatgtgaagccagtggtaaccaactcaacactggaggcgtcgttcagccctgatggaaaccatatcatatctggctccggtgacggtagtgtttatgcttggaatgttaggagtggaaaggtcgcgcgctggggaagcacagacgacgaaccgccgctggtaaggtgggctccaggatccttgatgttcgtgacaggatcatcagaactgtcatgctgggttccggacctgtctaagctgggatcctttaccattagcaagtaggtgaaaatgataagaggtggactgcccttgcaaaccctgctcgtccctgtatgctctgtcgtgtggctactcatcctttagccaggtggccgtggtaaacttgcaacctgttacaattgaatgactcgtgtagagcatcggcagtggcgatctggcttctgaagccagcggctagacaatgaagatggatccatgctttagttctgtaaaccggagattgtagctgagtattgctgcatctccttgtttctggaaggcatcttggctcgtaaagattctgcaactcagaccagatggctaatatagagagagcaaagaaacaatggatagctgggctgcttgttctgttttcagttggattccttgaactgatgtgtgattccgttgtgcatgcaccgattcataaaaaaaaaaaaaa

SEQ ID NO: 16792 - DNA, 5253 bp, Zea mays
ctcttccccgttcccccgtcgcctcggcgttccgccgccgactccgacgagggggccccacctgtcatcctcctcccccgccgccgttcgccggacggcagcgcgacgaggagccgtttaccccttcctgccccgcggcatccgcgttcgcgttgtgcgccgctgatccgagcggaccgcttcccgcgctgatcgctttctccgttcgacccctagggtttcggcgttcccctgtctccccgcgcccccttggaggcagcaccagagatctcgatcttccgcggcctcggtcgcgctacgcagttgaccccgctcgatttatcaccggggaattagagaggcgttttccgggggagtttcttcgcggggaagaggggccatggcctcgagtctgctcaccacggacaggagatggggtgctactcctgcaaggaaatctggtatgactgttctaggaaaagtcccaaaacctattaatttaccaagccagaggttggaaaacaatggtcttgatcccaatctagaactggttccaaagggcacccacacctggggcagcaaagcaccatccacaacaccaaatgcatggagttcctcgtcaattctgtctaccaagaaacgatggaagttccagttcatctagccacttcaatggtcgaccgtcctctggcggaggctcaaggccatcaacagctggaagtgaaccacttggttcacccaatgcttggggtccaaattctcgcccatcttcagcatcaggcacatttccatcatctcatctaccaatggccacaaatcgtccccgaagtgcggggacaagacccggaagttcacaactttctcgatttgcggataatgcttcagataatgtgaaagcgtcgataaggactattgatagaccggggtcttcatcacatgggcctgggttcacactaagtactggtgatttcccaacacttggctctgaagcaaatagtcaacgaggccatagttcgaaagggcgcccaatttctagttcgggtaaagaggtgtcgcaaggtgaacaagtgaagagcctaacaactggaactggtgaattaatttcacaatccaataatcaacctgttgatatcatgaagacagagcagcatgcacacactggaggtgctcctgtcctcgccacaaatgtgccaaatgaaggcctgcaaccgcggccatatccaccaaattttcctatgcctcatccgcagtttgattcatggcgtgcacctcctggtcacccccctgagggaatgtggcatagaggactagtgccaggtgggccatacagaccagttggcccccctggtagttttcctgtcgaaccatttggttattatggtcagttcccacccaactctgaagttgcagcaaggcagggcccagggcatggtggatatcaggctaaaaatggagatgtgtatcatcctacgcctcctaattcctatattatgaatcagcctgttattccagtcagaccagtttatcagggtccagtgccgtatgatgggtattatggccctcgagcacatttcaataatgccaatgttagagatcctcattttgttggaggtcctggaatattaaatcaattccctaatcagaatgacaggtttcaccctggacatcctcaaaacagaccaggcagacatgaaacagttccaagggagcagctggaatctgataaaatacatgtgtttcatcgaggaaaccctgggagtttgcatgataattctgatcgtctaggaggttcccgtgaatttgaaaggaatgcgcagccagcatcgccacttcttccacatcctgatggaaaccggactgatgtgaacatgaggacagatacaagggacacctttagtgaaagtgaaagaaccagggtacttacaaaatcggtgcctaatcagagaggttcggttggtacagaacatttgtctgtttatgacaatgcacattcccatcacagagaaactggcgatggcactctgcgcaagaaattcaaggaggatggttcagctgcactgcatcctgtaattaagaagaatgcagctttaaccgcgcgtccggagagtttgaacaacaaagccagaaatgttgatgcacgtaatctcccagaatcacgcttcgtccaaggaattcaataagcataaaaaaagcactgatgtttcatctaatgatgtcatgggtatggcatgcaaatctgacccggcagtttctgtttcctgtgtttctcctgcggtgcagagactaccaaacgtgcccatcaagggtacaattcttggtccggcacatccacagttaactgaatttagcaaagctgaaaagcttggtgattcaattagcgatcatgtacataggaaaagtgattcttcaagaaacagttaccatggtccttctaaagataggccagctaataaattcggaagtcatggacggcgagaaagttccacaactgatctgaggaataatatcgatcatggccaacaacctgagattgcttcgcagctgcaacctgcgattgtacctgatgatatgccagcttcactcgattatgagtctcagcgtgcacaaatgaaggagttggctgcagaacgtgcaaaaaagttgaaagctgaggaagaggaacggataaagaaccaaaaagcaaaagcgctcgcaaagttggaagaattgaacaggcgatcatcagtacttcagaagaaatcaaatgatataaaagtagaaacttatgatgcacatgataagcaacatgctggacttgatgtgactgctaaacttgacacttcaactgaaccacatgatgttattgcgcctgataggcttactgatcttctgcctcctaatgatcccaatcatactatggttcatatacaggcccagtctacagcacaatcacatgctttagatggtggcaaagaccctgatgctcatgcaacctcgtctttggtcaagaacactcacagcaacatggagcctgttgtgcagaagagtatctcgcagttgcatgacatcactgtggtaaaggccaagcaagggtacaggaaaagacatgtgtcagaagagaaaatttctgatgagaaggcaagtgcttcaataaccactagaaatattacgaaaaatgttgatgttctcatcgacacagtgacggctgttgttgcaccacatgatgatccacctactcagaacaagaagggaacccgacatttgagaagtaagaaaaagttagatgatgctccagttacttctaaacatccacctgtggtgttgaatgagccgaatacagtgaaagtctctaccgagccaaagacacatactggtggtgttatcatcagcagctctattgttcccactgaaggtactattgtaactgttggaagtataactgttggtggaatttcacttaaacctatgaatcaggagcgggttaaatcaccagatggaacaaataatactgaaagtagccaaccaagacctcagcaaacgagaaaatctggaaagcatcagcatgttcttcggcctgttgagaagccacatgggaatgatggtatcttgtgtgcaccagttaagccaccagtgccgaatgagcactctgatggagccatgccgactgcagcagtagctgacctcactaaaccagtagggaaagccataaatgatggggagaatgtgacaagaacaaagagggctgaaatggaaagatacgttcctaagcctatgtccaaagaactgcaacaacaaaatccaagtgatgataaggaagcagttgataagcccagtggtgctaaatcacatcctgcagccgaacccaagaaaactagcaaagcacatgggggtaaatctaatccttcttggcgcaagaggaatccagatgaatcagctttggtggcaccaaattctgttgagcaagcagacgtctcttatgaatcaaaggaggttcagaacttcacctatcagaagcagcctgttgaacttggcaagcaagatacacagttaaaattcagtgtagatgctgctgctgaaaatagctcagctccagttcaaacagttccgctatctgtcggtggcgcaaaacaacatagtgcagctaacagacaaaggcgacagcatgttaaggctcaaagaaatgaagcaagtggctactcaaatgagagcaaaggtagcgagggcaagaatgatgttgtctatcaatcagcaacacccgtcatggattcgaactcatccaatcacaggaatgtgccaagatctgatgtgaaaaacagcggcgtagtttcacactctagagcctggaagccgaaaaccaattcccatcctcaggacagctcagacggcaagattgctgttgacgggcaagtggattcccatggtggtaggcttgagatgaatacgtccaaaggatctgatacaattacccatctagtgaccagtagtgaaccgacgaaaaggagtgatggcaaagaggtctcacacagcaaacatgagaacctggcacgggaagatggtaaccagaagggtgagactgaacaggagcaggctaatcctacactacgtcgccaaggccagcccaatgcaaggtaccacaggggaggtgggtcacacaggggaagggggggttatgacactgggaggccaaaccatgtcacaaatgtggagaggcggaagggtggcagccatcttgaataccagccagtcggaccccaaaacaaagctgcagacttccaacagagcctgggcatggaagaacgaaccgaggggcctcctgcttctggacaagcgttcaggcagcgtggacacaacagggggctacgcccagcaggccgctttgtccagcgaaaccctgcttctacgcctaccactaattctcaccaaaatgaataatcttccgcggctgccacatccactgagcttcaggaactcgcgcttgtggtggtgtttcacaacagataggtttggatgcgcggcaggtgtccttctacgactaaactctactggtggtgagcattaggatcctgtaatgataatagtctttgtcccaagggcacctggaccctgtgattgtgggaatttgcctttgttgggatgcaatgttggaacgtgtactaacagagttgttgtgtttgagaacttggtttaaatgttagcctgtgatgctaatgagaacagaaagtgttggtttttgcccaacttcctggcctcagtggataatatgctggcatcaccataccaaaaaaaaaaaaaaaa

SEQ ID NO: 16793 - DNA, 2141 bp, Zea mays
  misc_feature (951)..(951): n is a, c, g, or t
  misc_feature (961)..(961): n is a, c, g, or t
tagagctaaagaagaaaggcagtgagtttgacccaatggctgttgcctattggaagcctggtgaacccgtgccattcctgtttctggctcgcgcacttgatctcatctccaacgagagtggccgtattgttattacagaaatcctatcaaatgtgtttcgtacagtgatcgccacaacaccggatgatctccttgcaactgtatacctctcagccaaccggattgcgccacctcatgaggggattgagcttgggattggggatgcatcagtcatccgtgcacttgcagaggcatatggacgcaaagaggagcatgttaagaaggacctcaaggaattgggtgatttggggcttgtggcaaaagcaagcaggtcatcacagaagatgctgtttaagccaaaaccactgacaatagctcgtgtgcttagcactttccggacaatcgcaaaggaatcaggcaaagacagtcaagataaaaaaagaaaccatatgaagggacttcttgttgctgcaactgactgtgaaccccagtacatcacacgccttcttcagtcaaagatgaggattgggctagcagagaaaactgtccaaatggcgctagggcaagctgccgtatatgctgacaaaaatcctttgccaccaaaagttcaatcacctttcgaagaggctgcaaaaataattaaacaagcatattcggttcttccgatatatgataaaattgtcccagcgatactcgaagtaggagtttggaagcttccagagacatgcaaattttccataggtgtccctgttggccctatgttagcaaaagcaacaaaatctgtctcagagatcatcgacaagtttcagggtcttgaatacacttgcgagtacaagtatgatggtgaaagggctcagataccattgcatggagggtggttcagtagagatttatagtcgcaactgctgaaanaaacaccggnaaagtatccagatgttgttgatgcagtttctagattccgtaaggctacagtcaaatcatttgtcttggactgtgaaattgttgcctatgatcgtgaaaaacagaaaattttgccttttcagatacttagcacacccccccgccggggtgtcaccataaatgacatcaaagtttcagtctgtacttttggcttcgatattctttacataaacgggaaacctcttctccaggaacaactcaaaattcgtcgagagcatctttacaactccttcgaagaagtgccaggtgtttttaaattggctactgcgattacatcaaatgacctggaggagatacagaaatttcttgacacagctgtcaactcgagttgtgaagggttgattatcaagacattggataaagacgcaacatatgagccagcaaaacgttcaaacaattggttgaaactgaagaaggattacatggatagcattggagactctttggacttggtacctattgctgccttctacggtagaggaaaacgaacaggtgtctttggatcattcctcctcgcatgctatgatgagcagaacgaagaatatcaaacaatatgcaacataggtactggattttctgagcaacagcttgaagaacgttctgcgagccttcgaagtaaagtgatagaaaaaccaaaggcatactatagatttggcgacacaatgaaccccgatgtgtggtttgagccatcagaggtctgggaggtcaaagctgccgatctgagcataagccctgtacatcgtgctgccaatggtatagtcgatccaaataagggtatctctctaagattccctcgcctattgagattacgtgacgataaaagcccagaacaagccaccacgtctgaccaagtcgctgacatgtaccggtctcaaaagatcaaccacggttataaccaggaggatgaggacgatgactgatgttgacttaattcttgttgctggatgggatggttcactgtgtaaacactagtcttcgcagtttccagcttgttctcaaccgtaacctgttgatttaccggttcctgtttctatgatcaaatgaacaggtattgaccggagattgcattttctaataaaaaacaacaaattcttacattataaccaaatgaacgcggatgaaccacgatgcttattaaggtc

SEQ ID NO: 16794 - DNA, 832 bp, Zea mays
aacgaaaaaaccccccaacaaggacagagcagaaacctagccagaaattcgtccaggataggggctgtatcgtagggagtagtcgaagcggactggacaggagccgagcaaactatctgcagaagaggttcaagggttgccgtgcggactccggagctgtgagaatctaccccgaggtaagctcttagagtcgtagtcaaagaggagaagccaggccgggaacaaacagaaaagagaagagcaacaaggagtacaggactcagtgcaccaagaataggaaagagcaaagaccagaacaattaacttcaagatgcttgaagtgaggactacaagaaggccggctctcgccgacatctctggtggtgggttctttatcaggacagtagaatcgccaggagctgtgctggtgaatggtgctgtcaagcggccggctcggcagtttctgtcaccttcaaacaacaaggagaatgtgccaccagtgggagctttgagggctacaccaaagaggaggacccccttgcctgactggtacccgaggacaccactccgtgacatcacatcaatcgtcaaggtggtggactatttcattgctattttatgcgttcttctctgaaagcgttgcacaccatcaccatttctgctaatgtctatttccattttgttgtatttggtgcatgcactgtactctataatatgatacagtgtggcaatgtttcatttgtgagtccttgtgttcagaatgcctggttagtggccaacaagataggttatgtagtaggtttggtaattggtattcagaatgttgagccttgtacactattattctataatc

SEQ ID NO: 16795 - DNA, 1782 bp, Zea mays
ttgggaccctcgaggccggccgggaaccctattttttatttataaacactgccaattagtccgcgccggacctccaacccgcccccacggcccacgccatcctccgcaccccccacgccggacaaccggggctcgccgcgccgctacgctcccaagccggaactccgaactcgccgcgccgttctcactgtggcaccagagctgctcgatctgccccgccctcgcccctcgcccctcgcccccttgccggaggggcgcgaactcgcaaaaattattgggtgtgcatttatacacccatgttctttgctgaccctgtctggtagcagattaaggtttggttgcggaaaatattggtgggttgtccaccatgacgagtccgccaagggtgagcatggagatcaccgacgacatgctcaagagcatggaggtcggcctagctttccgggactataatggtagaattagttctatggattttcacagcaaggctaccaactatcttgtgacagctagcgacgatgaatcaatccgcctatacgacactcaaaatgcagtatgtttgaagactattaatagcaaaaaatatggggtcgaactagtgtgcttcactgataacccaaatattgtcttatattcatcaaaaaatggctgggatgaatctctgcgtctactctcactgaatgataatcggtttcttagatattttaaaggtcaccttgacagggttgtctgcatctcattttgctctgagaaagaaaattttctctctggttcacttgaccgtactgttctcttatgggatcaacgggctgaaaaatcacagggcttactgcgtgtgcaagggaggcctgcagtttcatatgacgatcagggcatggtatttgcagttgcctatggtggtcacataaggatgtttgatgctcgaaaatttgaaaaggggccttttgagatcttctctgttggtaataacgattcagaggcccatgtcataaagttcagcagtgatggcaggcggattctgttaaccactaaagctggacgtgtccatgtgctagattcattccatggcaatagcattgcgtcgtgcaatgtgaagccagtggtaaccaactcaacactggaggcgtcgttcagccctgatggaaaccatatcatatctggctccggtgacggtagtgtttatgcttggaatgttaggagtggaaaggtcgcgcgctggggaagcacagacgacgaaccgccgctggtaaggtgggctccaggatccttgatgttcgtgacaggatcatcagaactgtcatgctgggttccggacctgtctaagctgggatcctttaccattagcaagtaggtgaaaatgatgagaggtggactgcccttgcaaaccctgttcgtccctgtatggtatgtcgtgtggctggttgaagcgactcatcctttagccaggtggccgtggtaaacttgcaacctgttacaattgaatgacttgtatagagcatcggctgtggcgatctggcttctgaagccagcggctagacaatgaagatggatccatgctttagttctgtaaaccggagattgtagctgagtattgctgtatctctttgtttctggaaggcgtcttggctcgtaaagattctggaaaaaaaaaaaaaaaatggctaatatagagagagcaaagaaacaatggatagctgggctgcttgttctgttttcagttggattccttgaactgatgtgtgattccgttgtgcatgcaccgattcaaaaaaaaaaaaaaaa

SEQ ID NO: 16796 - DNA, 903 bp, Zea mays
cattgggtacctcgaggccggccggggcccgggaagctccaacccgcccccacggcccacgccatcctccgcaccggctggaccagccccacgccggacaaccggggctcgccgcgccgccacgctcccaagccggaactccgaactcgccgcgccgtcctcactgtggcaccagagctgctcgatctgccccgccctcgcccctcgcccccttgccggaggggcgcgaactcgcaaaaattattgggtgtgcatttatacacccatgtcctttgctgaccctgtctggtagcagattaaggtttggttgcggaaaatattagtgggttgtccaccatgacgagtccgccaagggtgagcatggagatcaccgacgacatgctcaagagcatggaggtcggcctagctttccgggactataatggtagaattagttctatggattttcacagcaaggctaccaactatcttgtgacagctagcgacgatgaatcaatccgcctatacgacactcaaaatgcagtatgtttgaagactattaatagcaaaaaatatggggtcgaactagtgtgcttcactgataacccaaatattgtcttatattcatcaaaaaatggctgggatgaatctctgcgtctactctcactgaatgataatcggtttcttagatattttaaaggtcaccttgacagggttgtctgcatctcattttgctctgagaaagaaattttctctctggttcacttgaccgtactgttctcttatgggatcaacgggctgaaaaatcacagggcttactgcgtgtgcaggggaggcctgcagtttcatatgatgatcagggcatggtatttgcagttgcctatggtggtcacataaaggatgttgatgctcgaaaaattgaaa

SEQ ID NO: 16797 - DNA, 5072 bp, Zea mays
  misc_feature (5012)..(5012): n is a, c, g, or t
cccctggaagtgaaccacttggttcacccaatgcttggggtccaaattctcgcccatcttcagcatcaggcacatttccatcatctcatctaccaatggccacaaatcgtccccgaagtgcggaaacaagacccggaagttcacaactttctcgatttgcggataatgcttcagataatgtgaaagcgtcgataaggactattgatagaccgggaatgctgcaggcctagaactgggtctagatcaggattcaattcaatatgttattcagttcatatatatgtattttacctgtgtaggggtcttcatcacatgggcctgggttcacactaagtactggtgatttcccaacacttggctctgaagcaaatagtcaacgaggtaactatgtgcaacacaaagtgctgtctatattttttttgttttcaagctttctgcccctgccatattgtttctttggttgtatagtttttatgtttagcatgtcaaattatgagctgccttgaatactacatatgtgctagatataaatgctagcattggtaaattatttgggcaaatatgtttttttcgtattttttttttgaattacaatggcctgtgtcatctacttagtttgtgtatagggagagttctctttacatgtctttttttattccaggccatagttcgaaagggcgcccaatttctagttcgggtaaagaggtgtcgcaaggtgaacaagtgaagagcctaacaactggtataatatatttcatcattacaacgtaggttgatagcagcaactattgttcgatacgtattgcctgacctagtaatgggaaatatcttgtgtgctaggaaatggtgaattaatttcacaatccaataatcaacctgttgatatcatgaagacagagcagcatgcacacactggaggtgctcctgtcctcgccacaaatgtgccaaatgaaggcctgcaaccgcggccatatccaccaaattttcctatgcctcatccgcagtttgattcatggcgtgcacctcctggtcacccccctgagggaatgtggcatagaggactagtgccaggtgggccatacagaccagttggcccccctggtagttttcctgtcgaaccatttggttattatggtcagttcccacccaactctgaagttgcagcaaggcagggcccagggcatggtggatatcaggctaaaaatggagatgtgtatcatcctacgcctcctaattcctatattatgaatcagcctgttattccagtcagaccagtttatcagggtccagtgccgtatgatgggtattatggccctcgagcacatttcaataatgccaatgttagagatcctcattttgttggaggtcctggaatattaaatcaattccctaatcagaatgacaggtttcaccctggacatcctcaaaacagaccaggcagacatgaaacagttccaagggagcagctggaatctgataaaatacatgtgtttcatcgaggaaaccctgggagtttgcatgataattctgatcgtctaggaggttcccgtgaatttgaaaggaatgcgcagccagcatcgccacttcttccacatcctgatggaaaccggactgatgtgaacatgaggacagatacaagggacacctttagtgaaagtgaaagaaccagggtacttacaaaatcggtgcctaatcagagaggttcggttggtacagaacatttgtctgtttatgacaatgcacattcccatcacagagaaactggtgatggcactctgcgcaagaaattcaaggaggatggttcagctgcactgcatcctgtaattaagaagaatgcagctttaatagagaaaattgagagtttgaacaacaaagccagaaatgttgatgcacgtaatctcccagaatcagcttcgtccaaggaattcaagaagcatcaaaaaagcactgatgttccatctaatgatgtcatgggtatggcatgcaaatctgacccggcagtttctgtttcctgtgtttctacctgcggtgcaagagcactaccaaactgtgcccatcaagggtacaattcttggtctggcacatccacagttaactgaatttagcaaagctgaaaagcttggtgattcaattagcgatcatgtacataggaaaagtgattcttcaagaaacagttaccatggtccttctaaagataggccagctaataaattcggaagtcatggacggggagaaagttctacaactagttcattaccagtagctgatctgaggaataatatcgatcatggccaacaacctgagattgcttcgcagctgcaacctgcgattgtacctgatgttcggcccgcgcctacggtttttcctattcagcgtgcaaaaatgaaggagttggctgcagaacgtgcaaaaaagttgaaagctgaggaagaggaacggataaagaaccaaaaagcaaaagcgctcgcaaagttggaagaattgaacaggcgatcatcagtacttcagaagaaatcaaatgatataaaagtagaaacttatgatgcacatgataagcaacatgctggacttgatgtgactgctaaacttgacacttcaactgaaccacatgatgttattgcgcctgataggcttactgatcttctgcctcctaatgatcccaatcatactatggttcatatacaggcccagtctacagcacaatcacatgctttagatggtggcaaagaccctgatgctcatgcaacctcgtctttggtcaagaacactcacagcaacatggagcctgttgtgcagaagagtatctcgcagttgcatgacatcactgtggtaaaggccaagcaagggtacaggaaaagacatgtgtcagaagagaaaatttctgatgagaaggcaagtgcttcaataaccactagaaatattacgaaaaatgttgatgttctcatcgacacagtgacggctgttgttgcaccacatgatgatccacctactcagaacaagaagggaacccggcatttgagaagtaagaaaaagttagatgatgctccagttacttctaaacatccacctgtggtgttgaatgagccgaatacagtgaaagtctctaccgagccaaagacacatactggtggtgttatcatcagcagctctattgttcctactgaaggtactattgtaactgttggaagtataactgttggtggaatttcacttaaacctatgaatcaggagcgggttaaatcaccagatggaacaaataatactgaaagtagccaaccaagacctcagcaaacgagaaaatctggaaagcatcagcatgttcttcggcctgttgagaagccacaggggaatgatggtgtcttgtgtgcaccagttaagccaccagtgccgaatgagcactctgatggagccatgccgactgcagcagtagctgacctcactaaaccagtagggaaagccataaatgatggggagaatgtgacaagaacaaagagggcgcagatggaaagatgttccttggcctccgcccggccggccgcgacaacaaaatccaagtgatgataaggaagcagttgataaacccagtggtgctaaatcacatcctgcagccgaacccaagaaaactagcaaagcacatgggggcaaatctaatccttcttggcgcaagaggaatccagatgaatcagctttggtggcaccaaattctgttgagcaagcagacgtctcttatgaatcaaaggaggttcagaacttcacctatcagaagcagcctgttgaacttggcaagcaagatacacagttaaaattcaatgtagatgctgctgctgaaaatagctcagctccagttcaaacagttccgctatctgtcggtggcgcaaaacaacatagtgcagctaacagacaaaggcgacagcatgttaaggctcaaagaaatgaagcaagtggctactcaaatgagagcaaaggtagagagggcaagaatgatgttgtctatcaatcagcaacaccggtcatggattcgaactcatccaatcacaggaatgtgccaagatctgatgtgaaaaacagcggcgtagtttcacactctagagcctggaagccgaaaaccaattcccatcctcaggacagctcagacggcaagattgctgttgacgggcaagtggattcccatggtggtaggcttgagatgaatacgtccaaagatacaattacccatctagtgaccagtagtgaaccgacgaaaaggagtgatgacaaagaggtctcacacagcaaacatgagaacctggcacgggaagatggtaaccagaagggtgagactgaacaggagcaggctaatcctacactacgtcgccaaggccagcccaatgcaaggtaccacaggggaggtgggtcacacaggggaagggggggttatgacactgggaggccaaaccatgtcacaaatgtggagaggcggaagggtggcagccatcttgaataccagccagtcggaccccaaaacaaagctgcagacttccaacagagcctgagcatggaagaacgaaccgaggggcctcctgcttctggacaagcgttcaggcagcgtggacacaacagggggctacgcccagcaggccgctttgtccagcgaaaccctgcttctacgcctaccactaattctcaccaaaatgaataatcttccgcggctgccacatccactgagcttcaggaactcgcgcttgttggtggcgtttcacaacagataggtttggatgcgcttgggtgcgcggcaggtgtccttctacgactaaactctactggtggtgagcattaggatcctgtaatgataatagtctttgtcccaagggcacctggaccctcacgtgtgattgtgggaatttgcctttgttggatgcaatgttggaacgtgtactaacagagttgttgtgtttgagaacttgatttaaatgttagcctttgatgctaatgagaacagaaagtgttggtttttgcccaacttcctggccaanaataaaaaaaaaaaagaaaaaaaaagaaaaaaaaaaaaaaaaaaagaaaaaaaataaaaa

SEQ ID NO: 16798 - DNA, 705 bp, Zea mays
ggcacacaggggaaggggcggttatgacactgggaggccaaaccatggcacgaacgcggagaggtggaagggtggcagccatcttgaataccagccggtcggatcccaaaacaaagctggaggcgacttccagctgagtcagggcatggaagatcgaaccgaggggcctcctgcttctggacaagcgttcggggagcgtggccacagcagggggctacgcccagcaggccgctttgtccggcgaaaccctgcctctacgtctaccactaattctcaccaacatgaataatcttccgcggctgccacatccgctgagctgcaggaaaaaactcgccttcgtggtggcgtttcacaacatatttggatgcacttgggtgggcggttggtgtccgtcgtcaacgacgagtctacggtggtgagcattaggatcatgtaacggtattagtctttgccccaaagggcacaccctggcccctcacgtgtcacgtgtgactagattttttccagaggaacatccacccttgtttgggatgcaacgttggaacgtgtgctaacagagttgtgtttgagaactgggtttaaatgttgttagcctgtgttgctgatgggaactgagagtgttggtttttgcccaactttcatggcatgtctttgtttgattgttggctctgttgttcatggcaatcgctttggatcctcgcgacc

SEQ ID NO: 16799 - DNA, 884 bp, Zea mays
tcagttatgctcgcccttctataataaattgaatcatctagctgttcaagttgccaagtctaacttaaaaaaaataacattttctaattctatcttgcaggaccacattttaatccaaacaatctgacacacggtgcaccagaagacgaagtccgtcatgcgggtgacctgggaaacattgttgcaaatgctgagggtaagacctgtagcaaccagtagtacacttgtgatattcattagcaaatttcttcttctggattatgacttttttttatggcatgcttgctttgctgctcgtgctgcgggcatagccgaggcaaccattgttgatacccagattcctttgactggcccaaattcagttgttgggagagcgtttgtggttcatgagcttgaagatgatttggggaaagggggccatgagctcagcctctctactggaaatgctggtggaagactggcatgtggtgttgttggcctgactccattgtaggttgctcgccgggtgcccgggttgcagttgcagctacgctgttacatccttgccttggtggacttttgtcttcaatcgtgttattgggacagtgacctttttgtattacttggattcattccatgcatgtggtatggtgcgtaatagcctttgcaggtcgactgtataaaaagcaatatttagttgaggaaataagtgttgccacatatccaaatcgatctatgaagcactatgaacatcaaatgttattttgattttgttttaaccttttttaaagctatttctaaaaataatattcgagagtttttttcttctaaaactaacatgtttggccgcattaatttccttaatgtggccaaattgtgttgtcacgctatcccctctgatgcag

SEQ ID NO: 16800 - DNA, 2192 bp, Zea mays
  misc_feature (1816)..(1816): n is a, c, g, or t
cacataatgattcttacatctgacaatatgtataattgacaatatttttgcattaattaataacaaaggaagtactttttgattattatttaaccagagatggggatcctgacggggagttatcccagggagaatgggtgtgggaaagaaatgccccccgcaatcatcgtagggatccccgtggagaatatttttacattacgggaacaaggataagaagttaaaacccgacgaggaattccccattaccatctttaattaatcatctaaagatttagggttgtatcatataatctttaagaggtcttttgtatctctagattgtacatgcacttatatacattggaggtgcgagagtgtgcaaatttacctacctctctttttatgagcattttgccttttggaaatgggcgactggagacaaatatgtttgtagaattaaaacttttatgacagcccacacgaaaacgaaaagctctctccgtttccatgccttgtgacttattttttatttttttataatccatgcccttgtgagttgtgagttgtgacgcgagctgcgccacacgtggcacatcagaacccatctggctgccctgccccgggttcatcgccgtggcggccgtagccgaggccggggtcgataatacactggggccctccaggccggccgggagtcacccaccccatccaaggccctcccaaagtcccaaaggccgccgccgcccgccagcccaccatggccgcgcagtccttcctcctcgccgccactgccgccgccaggtcccccgcggtcttcgccgctccctattcctccgcacgccctttccactcggtccacttcgtcgccggcccgtggggcgccgccgccgccagggcgctcgtcgtcgcggacgccactaagaaggccgtagccgtcctcaagggcgcgtctgaggtcgagggcgtggtcacgctcacgcaggacgacgatggacctacaactgtgaatgtccgtatcactggacttacccctggacttcatggcttccacctccacgagtttggtgatactaccaatgggtgcatatcgacaggaccacattttaatccaaacaatctgacgcacggtgcaccagaagacgaagtccgtcatgcgggtgacctgggaaacattgttgcaaatgctgagggcatagccgaggcaaccattgttgatacccagattcctttgactggcccaaattcagttgttgggagagcatttgtggttcatgagcttgaagatgatttggggaaagggggccatgagctcagcctctctactggaaatgctggtggaagactggcatgtggtgttgttggcctgactccattgtaggttgctcgccgggtgcccgggttgcagttgcagctacgctgttacatccttgcctggggtggacttttggccagttccctattgagttcttatcaaactatgagagttgttcaccactagcgcacacacattttgcttctgaaatgcaactggttttgtgtctactcttacccctctgaatattgatattgtataacaggacctacaactgtgaatgtccgtatcactggacttacccctggacttcatggcttccacctcgtgagttttgttatcttcaatagctttgggcattaacttcttcattgcaaacatgatgatgacacaatttcattttgcagcacgagtttggtgatactaccaatgggtgcatatcgacaggttataatttcccattgatcttaattatgcctgcaattgtgatcttttttcttaatgtggtactccctccattcnaaattacttttttttgaaagatccagaatgacccggcatatatatagtaataaggagttagagttttacaagtgcaagttgttagttgtgcacaaatctcccacatgagcagactgctcaggtgggtaaaaacagaaaaacaaactactcgttatatggggcgccaacaaaaaagttgaagccctttgcacctgcgaagcaccaaattctagctacgtccaataattctacaaaccacctgttgaagtcccttagagagcgtttctttggaaatctgctggtaagtttctcaccaaacacacaaactggtaaaggtggccagcatgtgcactctaccgtgagcaaaacatattgcaacaaggctcgcataccaatc

SEQ ID NO: 16801 - DNA, 1084 bp, Zea mays
atcgccgtggcagccgtaggtgaggccgaagtattttaaacgcgagcccaccggcccgccaggcagtcacccaccccatccaaggccctcccaaagtcccaaaggccgccgccgcccgccagcccaccatggccgcgcagtccttcctcctcgccgccactgccgccgccaggtcccccgcggtcttcgccgctccctattcctccgcacgccctttccactcggtccacttcgtcgccggcccgtggggcgccgccgccgccagggcgctcgtcgtcgcggacgccactaagaaggccgtagccgtcctcaagggcgcgtctgaggtcgagggcgtggtcacgctcacgcaggacgacgatggacctacaactgtgaatgtccgtatcactggacttacccctggacttcatggcttccacctccacgagtttggtgatactaccaatgggtgcatatcgacaggaccacattttaatccaaacaatctgacgcacggtgcaccagaagacgaagtccgtcatgcgggtgacctgggaaacattgttgcaaatgctgagggcatagccgaggcaaccattgttgatacccagattcctttgactggcccaaattcagttgttgggagagcatttgtggttcatgagcttgaagatgatttggggaaagggggccatgagctcagcctctctactggaaatgctggtggaagactggcatgtggtgttgttggcctgactccattgtaggttgctcgccgggtgcccgggttgcagttgcagctacgctgttacatccttgccttggtggacttttgtcttcaatcgtgttattgggacagtgacctttttgtattacttggattcattccatgcatgtggtatggtgcgtaatagcctttgcaggtcgactgtataaaaagcaatatttagttgaggaaataagtgttgccacatatccaaatcgatctatgaagcactatgaacatcaaatgttattttgattttgtttcaaaaaaaaaaaaaaaaatttctaagaatgaatattcgagagttttttttcttctaaaaaaaaaaaaaaaaaa

SEQ ID NO: 16802 - DNA, 1051 bp, Zea mays
gctgatggccagcaggctggattggtccgggttcttggtgaacgcgcgggggctgtgggaggactccaaggagcggccggtgtgggtgcgcgatctcgacgacgccgacccccgcgccgccagccccctcgcgctcgtcaccgacgctggccgcgtcgagccgctcgccagctgcgtccaggcggctctcgcgtggtcctcgctgcgttccgacagtatccacgaggtcaaattcccacacgaatggaaaatcgatcctccatcgctgaataccggtgcccgtcagcaaactgttcaaccagagacgcaaccgatgcaagctactctagcaagcactgaagaccagcagcactagaggacatttcttcctttttgtgtgtgtgtggactgccccaagattggccggaagtccccagttcccccactggccaccgatgcaccgtcggtgccaaccgctgccaaagtaacagaagccgcctccgctcagctcatttctttggactatacagataaagctaccagcagtgcatgtagtcttggacacttccgtcgtctaaaagtccctttgtttcgacgtataaaaacataggtaaaaagtttagttatccgtgcctccgctccccttgctgtagaataccattgttgtttcatgtaaaatagatgagagcagtgacttgcaaaagtcttgcggtttgggagtcggagcattggttgtacacttgtatgaaataatgacgaatccagttttcactccagtttgtatactctctatactttaatacttactctatgtcgatcaagatgccaattggtgttggtgttccaaattttgaaaccagatcgtcggctatcccaaatcctaggacagcttctctgaacatgttgttacctttgatttttgactgtcaaagtcaaatgtcatcaaagcattgtctggtgtctactccgcacaggtgaatcattccgttttagattcatatttcagtcgactcaaatactttccaaagcattaccttctgctagtggtcctaaattttctcaagagcctgca

SEQ ID NO: 16803 - DNA, 2418 bp, Zea mays
gtgcagcgcaggtgcagcgcagcgcacaagaggggagggaaaagccaaagaagccaccgcttcccttccgcggcttccacaccacctgagctcggccggtggcggtctgcttccgaccgtccgccggtttgcttgcttcatctgcctccgccgcacctcgcctccgtccagccagccagccagccagcgccaagtcaagcgatccggccgcacccagcctcgacctccccggccgacccgtgagggcggtgtgtttggccttcaacggcctcgactcgcctcgagggcggggctcttccaccacctgcaggccgggagaagaaaaaaaaaggcagcagcttggattcttgctaggggcgcgcggttggtcagctcgagagagaagctgaccgggtttgggcgtcgagatttcgattgacttttgaggtacccggggtatagtctacaatacaggttgcttcttcttgcacgctgctttcttggctctgtggctaccgaccttgctggctttccctcccgaattagcggctgagctccatccagaccttgcaaagattggacctttggggggcggttcgctcactcctagcttgcctcgctggctggtctttgagcttctcgtgctacgagccaagggaggccatcttttcctgctcggttctgtcgtgcaaacgggaaagattgagctgatctgctgctagctggggatcctgcagaggctaccgcgttcttcttgtctggagtgcacagtgcatgggcagtgggtgaactggtagagagcaagatggggaattgcatcgacaccacggcgcgggtagatcacagcatgaacaatgctgcctacccatcaaaagtgaccagcaagacaagtttgtcgtcagtcccttccacaattaagagcaactcaagtcgttcaacactgactcttccatcaatgagagatcgaaatgagcttcctactcctcggacagaaggtgaaatattgtcatcttctaatttgaaggcattcacgttcaatgatctaaaaaatgcaaccaagaacttccgaccggacagccttcttggggaaggagggtttgggcatgtctacaaaggttggattgatgagcacacgcttgctccttcaagacctgggagtggtatggttgttgctgtgaagaagcttaaaccggaaggttttcaaggacacaaggaatggctgacagaggttgattaccttggccaacttcaccacaagaatcttgttaagctcattggttattgctcagatggtgacaaccggcttctggtgtatgaatttatgcccaagggaagtttggagaaccatctgtttagaagaggcgctgatcctttgtcatgggcaataaggctcaaagttgccattggagctgctaggggcttgtcatttttacatgatgctgaaaaccaagtcatatatcgtgatttcaaggcatcaaacattcttctcgattcggaattcaacgcaaaactttcagattttggcttggcaaaagccggtccaactggggataaaacccatgtatccacacaagtcatgggtactcatggatatgcagctccagagtacattgcaacaggccgcctctctgcaaaggcagatgtctatagcttcggggtggtgttgcttgaactgctcactggaagaagggctctggataaatcaaaaccaggctttgagcagaacctagttgactgggccagacctcacctgggcgacaagcgcagactgtaccgtatcatggacacgaagctgggaggacagtaccccaaaaagggcgcaaatgccattgcaagcattgcctcgcaatgcatttgcggtgacgccaagctgcggcctccaatgtcgcaggtgctggaagagctggaacagctacaagatgccaaatatggtgcaccatcgccattagtcgacatccggaaagcctcgcacgccgcccccaaatcgcccatgagcagcaccccaaaatcgccgctgagcagcaccccaaaatcgccgatgagagctcaaccggcagcacggccttcgccacggcgctcgcttggagcagcagcacctttggcaggataccgcactgcccaagtgcactagaactttgcccaagtgcactagaactggacttattagcggggccaaggccccctgtaggctgtgtgtttgtgggttcaagctgtgagcactgagcagtgttgtagcttttgcttctactgatgtttcggcgatggtgtgtgccacgggaatatgaccatgtcaaccttatgataagttgtcaggcctggttcattattgacctgtgtcgtgactgttccgaaattcactcacctggcatcaatgccttgatctattattgtacgttgcaatggaatctcacaatcttaaccaaaaagaaaaaaaaaaaa

SEQ ID NO: 16804 - DNA, 1578 bp, Zea mays
tatgagcatgacttacttgttgaggaggtccaaaaccacgcagtttttatccaagatctagctaggagcgagcgcctctttgctgctttggtaaagttcagttcagaccaagactggtgctacagatcgtgaaagctaccctgcaactgccaccacctctgtgcagtgcaatccaccactgctaccgaaagggcatctgcacaagcatccttctttctcaagggtatatacgtaaatccctactcccagactccggagcgtagcgtgcagtgcaggtgcagtgcagcgcacaagacaagaggggagggaaaagccaaagaagccaccgcttcccttccgcggcttccacaccacctcagctcggccggtggcggtctgcttccggccgtccgccggtttgcttgcttgcttgcttcatctgcctccgccgcacctcgcctccgtccagccagccagccagccagcgccaagtcaagcgatcctgccgcacccagcctcgacctccccggccgacccgtgagggcggtgtgtttgcccttcaacggcctcgcctcgcctcgaggtgtgagctcctccgacacctgcttttctcggcgccgccgtttctgcaagcagggttatcttcccttctcgccgccaggagtgagtctgtgagtgggtcactgggcggggctcttccaccacctgcagggacaaaaaaaaaaaaaggcagcagcttggattcttgctaggggcgcgcggttggtcagctcgagagagaagctgaccgggtttgggcgtcgagatttcgattgacttttgaggtacccccggggtagtctacaatacaggttgcttcttcttgcacgctgctttcttggctctgtggctaccgaccttgctggctttccctcccgaattagcggctgagctccatccagaccttgcaaagattggacctttgggggctgttcgctcacactcctagcttgcctcgctggcggatctttgagcttctcgtgctacgagccaagggaggccatcttttcctgctcggttctgtcgtgcaaacgggaaaggttgagctgatctgctgctagctggggatcctgcagaggctaccgcgttcttcttgtctggggtgcacagtgcatgggcagtgggtgaactggtagagagcaagatggggaattgcatcgacaccacggcgcgggtggatcacagcatgaacaatgctgcctacccatcaaaagtgaccagcaagacaagtttgtcgtcaatcccttccacaattaagagcaactcaagtcgttcaacgctgactcttccatcaatgagagatcgaaatgagcttcctactcctcggacagaaggtgaaatcttgtcatcttctaatttgaaggcattcacgttcaatgatctaaaaaatgcaaccaagaacttccgaccggacagccttcttggggaaggagggtttgggcatgtttacaaaggttggattgatgagcacacgcttgctccttcaagacctgggagtggtatggttgttgctgtgaagaagcttaaaccggaaggttttcaaggacacaaggaatggct

SEQ ID NO: 16805 - DNA, 1822 bp, Zea mays
cattgggtacctcgacgccggctcgggcccacgggcccgcgcgcgttcgaatcccattactttctcccttaaaacctcctctcccctcgttctcctccgcctcctcctcccacctccccacacgggcacacctgccctccccgtcgccgcggacccactcccatggcaaagctcccgcgtctaccctgctcgtttgccgttctcgcgctcatgtgcatcatcccgctcacagcgccgcggcctgcactgtcctcgcgcgcggccccaagggacggtgtctccttcgccggcgcaggcaacacgatacatcaacttcttaaagatcacggccttcccggaggactgctcccgcgcggcgtggagtcgtacaccctggacgagtcgaccggcctgctggaggcgcggctgtcggcgccgtgctacgccacgtacgacaacggcgaactggcctacttcgacaacgtggtgcgcggcaacctcagcaagggcgcgctccgaggcgtggagggcctctcccaggaggagctcttcgtctggctccccgtcaagggcatcctcgtccaggaccaggaacccggggtcatcctgttcgacatcgggttagcccacaagagcctgtcgaggtcgctcttcgaggacccgccggactgcaagccgtcggcctccggcgggatgagcgccgcctccgccgccaggagggagggcacgcaaggtgttactggactacggttgaggcgagagatggcagcagcaggcagcgaccagagtcaggagcagaggtgaggaggaggaggaggagctctgagacgacaacacccgagacaatggcgagccagttttccgctttataaaatcctgcggtgagtgagtgagtgagtgagtgagagagagagagagagagagagtgccgccgccgccgcaacaagaaatacaacagctgcagcttcctgcagaggttggaatgtatctactaagatgtgggtacctttttgcagttcttttttctcgcttcttttcttctcttttagcccaagctcctctcttgtccatgcactgtgtgaattaagtttgtcagtcagtcaattgttgttataaacaaagcacgcaggggagaaaaagaacaagggaaagagttggctgagaagccagttgggggatccgcggactgtggtctggcctagaatgatagatttttgttctcgtcagggataaaattcttctggtgagggtttgttgcatgtgccagctcagcggggagtgagctgggcacagcacatcctccatgtgggcttgtgttggcttggctggttgttggttggttcacttcttccgtggattgataagtatatatatataatattatgctaggtttggttaggccttatatatagcactattaaagaatatagaagttgcatttctttttatgtcttgatgaaaggtatctctgtcaatctgtctgtcaagtagctgtattggaatttttaaaaaatatatatatatggctgtattcctttcaaaaaaaaaaaaaaaggttattgttccagtacgctcacttgctcaagcctccatccggccaaccggaaaccagctacgtcgcgtatggtatggagtatgcatgatgaggcagtggtggacggacggatggatggatggaaagggatgtggattttgttttgttttccttgtcgcccgccatcacccacccatgttctcctcgctttaatcttgtggcttgttcgctgcggctttaatccgactgcggctgcggcttctacagtattttctctctagggattgcagctgcaacagtattttgcag

SEQ ID NO: 16806 - DNA, 3201 bp, Zea mays
  misc_feature (142)..(142): n is a, c, g, or t
catcgcccctcgttctcctcccgtccgccccctcctcccaccccccacacctgccctccccgccgccgcggaccccctcccatggcaaagctcccgcgtctacgctgtccgtttgccgtgctcgcgctcgtgtgcatcctcncgctctttgcgccgcggcccgccctgtcctcccgcgccgcgccgaaggacggtgtctccttcgccggcgcaggcaacacgatacatcaactccttaaagatcacggccttcccggaggactgctcccgcgcggcgtggagtcgtacaccctggacgaatcaagcggtctgctgcaggcgcggctgtcggcgccgtgctacgccaagtacgacaacggcgacctggcctacttcgacaacgtggtccgcggcaacctgagcaagggtgcgctccgcggcgtggagggcctctcccaggaggagctcttcgtctggctccccgtcaagggcatactcgtccaggaccaggagcccggggtcatcctgttcgacatcggcttcgcccacaagagcctctcgaggtcgctcttcgaggacccgccggactgcaagccgtcggccgccagcgggatgagcgccgccgccgccgtcgccgccgccaggtggaagggtaggcaaggtgagattccgacacgccactgtttcagatttgttcgggggacgtggttcccttctcgatttgttaggaacctcttttttttctctcgcttggccggtaggtagatagatggtctgtttcttcgtcgcgcttttccagacgtctactccatggaattctttagctaccccaagattccgtccactcgttgtggttttagccgaattcattgaacttataggctctgatttcgatgtccagttcgccgattggatttcgaatcggctgtaaatcttagcccagctgatgaggagatgcagctgcaggcgttggattccgagagttgatttatcagaattttctttttttttaaaaaaaaatgtgatctcggttcgccttccttggagatcagtgcacgcgcccagttacaagttgacaacttcggttcgttcggtgtgggagggggagctggaaagattgaaatttgatggcgtctggagttggaagcttgtggaggagtaggggatccattaaagacttcagttacagctgaacttttgggcattaactccgcaggaaactcgttcatttgtctgcggaatcaaaccatggctctggcagcggaattctgagcacctcaggttcattttttttaaactcttgcacaggaaatagttcgtagcatgattacttggattcggtaaaaaagggggaaaattcctttctgggttgcaagtctattgtgattgactgaatccactgtcattggacctatgggcacttggtcagattacagcgagaatcgtgatgagggtgtcaagacggagtgtattaagcattactcttagatgcttcactcgtggccttctatgcttttgcagcaaagatttttgcctgatgcaggcttttgtcgatctatcagtattggttaccagtccaaatttgtccttcttaaaacccttaggccttgttcgtttgcgttggattggtgggtcggaacgattcctaaccggattgcttctctaatttatatagactttcattagcgggaatcattccgggtgtaatccgacacaaacgaacaaggccttagtttgtcacgggcagggccagggctgtgtgtgcctcgtctcatcacctgtccccttctacagcgtcctttctcagtggctgccacctgacctccgttggtaaaataaaataaaaagaatgaatggaaagctggtgcagcaaacacgaacccttgcaagagcatacacatgacatgagctcaccacccactttgtttcccccaatggtcgaacttcacatgattgatgtgaaccctaagcagcataggactctccttttatggattccttccacaatttccccgtgcaatgttttttttttgtttgagttcatcaaaatacagctggtgcctttgatagcgggggtctaacgaaggtgtttactggcaggtgttattactggtctgaggttgaggcgagaggtagcagcagacagcgacgagcatcaggagcagaggtgagggagggagacaatgcaacaccccgagacgacgccgaattccggtttcccgctttgtaaaatcctgtggtgagtgagagagagagagagagtgctgccgcaacaaaaaaaaaaaaaaaatacaacaactgcaacttcctgcagaggttggaatgtgctacgtatctactaagatatgggtacttttttgcggttctttttttttctttcttctcccttttttttggcctgagctcctctcttgttcatgcacatgtgtgatattaagtttgtcagtcaattgttagtataagcaagcacgcagaaaaaaagaaaagaaaaaaggttaagctgagaagccaatcgtcggggctgtggtctggctggccgtggcctatgatagattcttgttctcctcctcagggaggaaattcttctggtgagatgagagtaggttgttggtgcatgctccagctcagctggggagtgagctgggcacagcacatccttcattcatgtggggcttgtgttggctggtggttggttcacttctccttgtggattgatgagtgtatatgtatataataaaaccatacaatatacttatatatgctactgcgattattctttctgctagcccaggttgggctacagggcgaccgctatacatagagagcatttataaagaataatgtaaaaagttgtagttcctcccatgtcttgtggtgtgcaagtcttgatgaagggtatgatctatctgcacccattctctcccgacctatatcaatcggctctcgctgtagtccggaataaaaagaagaaatggtggcggtattcctttcactcgtgaaaaaactgaaaggccatccatctatccggccaacgggaagggaagccagctacgtcgcgtatggcatgatgatgcagacatggggggtgtggatggaaagggatctgaattttgttttgttttccttgtccccgtcagtcacccatgttctccgtcccagctttatttactggtctccatttcggtagcacgttgcctgattgattgtgcccggcgttaaatg

SEQ ID NO: 16807 - DNA, 662 bp, Zea mays
ctccccgtcaagggcatcctcgtccaggaccaggaacccggggtcatcctgtttgacatcgggttagcccacaagagcctgtcgaggtcgctctttgaggacccgccggaatgcaagccgtcggcctccggcgggatgagcgccgcctcccccgccaggagggagggcacgcaaggtgttactggactacggtttaggcgaaaaatggcagcagcaggcagcgaccaaagtcaggagcaaaggttaggaggaggaggaggagcttttagacgacaacacccgagacaatggcgagccagttttccgctttataaaatccttcggtgagtgagtgagtgagttagttagagagagagagagagagagagtgcccccccccccgcaacaaaaaatacaacagctgcagcttcctgcagaggttggaatgtatttactaaaatgtggggacctttttgcagtttttttttctcgcttctttttttttcttttagcccaagctccttttttgtccatgcactgtgtgaattaagtttgtcagtcagtcaattgttgttataaacaaagcacgcaggggagaaaaagaacaagggaaaaagttggctgagaagccagttggggaaaaaaaaaaaaaaaaaaaaaaaaaaaaaaaaaaaaaaaaaaaa

SEQ ID NO: 16808 - DNA, 1470 bp, Zea mays
gagccgccgggaccatttaccagtttcaatcccattactttctctccccgcggccgcatcgcccctcgttctcctcccgtccgccccctcctcccaccccccacacctgccctccccgccgccgcggaccccctcccatggcaaagctcccgcgtctacgctgtccgtttgccgtgctcgcgctcgtgtgcatcctcccgctctttgcgccgcggcccgccctgtcctcccgcgccgcgccgaaggacggtgtctcctttggcggcgcaggcaacacgatacatcaactccttaaagatcacggccttcccggaggactgctcccgcgcggcgtggagtcgtacaccctggacgaatcgagcggtctgctgcaggcgcggctgtcggcgccgtgctacgccaagtacgacaacggcgacctggcctacttcgacaacgtggtccgcggcaacctgagcaagggtgcgctccgcggcgtggagggcctctcccaggaggagctcttcgtctggctccccgtcaagggcatactcgtccaggaccaggagcccggggtcatcctgttcgacatcggcttcgcccacaagagcctctcgaggtcgctcttcgaggacccgccggactgcaagccgtcggccgccagtgggatgagcgtcggcgccgccgccgccgccgccagatggaagggtaggcaaggtgttattactggtctgaggttgaggcgagaggtagcagcagacagcgacgagcatcaggagcagaggtgagggagggagactatgcaacaccccgagacgacgccgaattccggtttcccgctttgtaaaatcctgtggtgagtgagtgagagagagagagagagtgctgccgcaaccaaaaaaaaaaaattacaacaactgcaacttcctgcagaggttggaatgtgctacgtatctactaagatatgggtacctttttgcggttcttttttttttcatttcttctcccccttttttttggcctgagctcctctcctgttcatgcacctgtgtgatattaagtttgtcagtcaattgttagtataagcaagcacgcagaaaaaaaagaaaaggaaaaaaaggaaaagggttaagctgagaagccaatcgtcggggctgtggtctggctggccgcctatgatagattcttgttctcctcctcagggaggaaattcttctggtgagatgagagtaggttgttgttggtgcatgctccagctcagctgaggagtgagctgggcacagcacatccttcattcatgtggagctttgtgttggctggtggttggttcacttctccttgtggattgatgagtgtatatgtatataataaaaccatacaatatacttatatatgctactgcgattattcttcctgctagattaggttgggctacagggcgaccgctatacatagagagcatttataaagaataatgtaaaaagttgtagt

SEQ ID NO: 16809 - DNA, 593 bp, Zea mays
ggcgtggagggcctctcccaggaggagctcttcgtctggctccccgtcaagggcatactcgtccaggaccaggagcccggggtcatcctgttcgacatcggcttcgcccacaagagcctctcgaggtcgctcttcgaggacccgccggactgcaagccgtcggccgccagcgggatgagcgccgccgccgccgtcgccgccgccaggtggaagggtaggcaaggtgttattactggtctgaggttgaggcgagaggtagcagcagacagcgacgagcatcaggagcagaggtgagggagggagacaatgcaacaccccgagacgacgccgaattccggtttcccgctttgtaaaatcctgtggtgagtgagagagagagagagagtgctgccgcaacaaaaaaaaacaacaactgcaacttcctgcagaggttggaatgtgctacgtatctactaagatatgggtacctttttgcggttctttttttttttatttcttctcccccttttttttggcctgagctcctctcctgttcatgcacctgtgtgatattaagtttgtcagtcaattgttagtataagcaagcacgcaga

SEQ ID NO: 16810 - DNA, 1121 bp, Zea mays
atatgtcaacaccatttacacatttttaaatcccattactttctctctcttaaaaccccatcgcccctcgttctcctcccgtccgccccctcctcccaccccccacacctgccctccccgccgccgcggaccccctcccatggcaaagctcccgcgtctacgctgtccgtttgccgtgctcgcgctcgtgtgcatcctcccgctctttgcgccgcggcccgccctgtcctcccgcgccgcgccgaaggacggtgtctccttcgccggcgcaggcaacacgatacatcaactccttaaagatcacggccttcccggaggactgctcccgcgcggcgtggagtcgtacaccctggacgaatcgagcggtctgctgcaggcgcggctgtcggcgccgtgctacgccaagtacgacaacggcgacctggcctacttcgacaacgtggtccgcggcaacctgagcaagggtgcgctccgcggcgtggagggcctctcccaggaggagctcttcgtctggctccccgtcaagggcatactcgtccaggaccaggagcccggggtcatcctgttcgacatcggcttcgcccacaagagcctctcgaggtcgctcttcgaggacccgccggactgcaagccgtcggccgccagcgggatgagcgccgccgccgccgccaggtggaaggttaggcaaggtgttactggtctgaggttgaggcgagaggtagcagcagacagcgacgagcatcaggagcagaggtgagggagggagacaatgcaacaccccgagacgacgccgaattccggtttcccgctttgtaaaatcctgtggtgagtgagagagagagagagagtgctgccgcaacaaaaaaaaaaaaaatacaacaactgcaacttcctgcagaggttggaatgtgctacgtatctactaagatatgggtacttttttgcggttcttttttttttctttcttctcccttttttttggcctgagctcctctcttgttcatgcacatgtgtgatattaagtttgtcagtcaattgttagtataagcaagcacgcagaaaaaaagaaaagaaaaaaggttaagctgagaagccaatcgtccgggctggggtctggctgg

SEQ ID NO: 16811 - DNA, 1135 bp, Zea mays
cattgggctacctcgaggccggccgggattacttttctcccttaaaacctcctctcccctcgttctcctccgcctcccccgccgacctccccacacgggcacacctgccctccccgtcgccgcggacccactcccatggcaaagctcccgcgtctaccctgcccgtttgccgttctcgcgctcatgtgcatcatcccgctcacagcgccgcggcccgcactgtcctcgcgcgcggccccaagggacggtgtctccttcgccggcgcaggcaacacgatacatcaacttcttaaagatcacggccttcccggaggactgctcccgcgcggcgtggagtcgtacaccctggacgagtcgaccggcctgctggaggcgcggctgtcggcgccgtgctacgccacgtacgacaacggcgaactggcctacttcgacaacgtggtgcgcggcaacctcagcaagggcgcgctccgaggcgtggagggcctctcccaggaggagctcttcgtctggctccccgtcaagggcatcctcgtccaggaccaggaacccggggtcatcctgttcgacatcgggttagcccacaagagcctgtcgaggtcgctctttgaggacccgccggactgcaagccgtcggcgtccggcgggatgagcgccgccgccgccgccaggagggagggcacgcaaggtgttactggactgcggttgaggcgagagatgacagcaggaggcagcgaccagagtcaggagcagaggtgaggaggaggaggaggagctctgagacgacaacagccgagacaatggcgagccagttttccgctttataaaatcctgcggtgagtgagtgagtgagagagagagagagtgccgccgccgccgcaacaagaaatacaacagctgcagcttcctgcagaggttggaatgtatctactaagatgtgggtacctttttgcagttcttttttctcgcttcttttcttctcttttagcctaagctgctcctctcttgtccatgcactgtgtgaattaagtttgtcagtcagtcaattgttgttataaacaagcacgcaggggagaaaaaagaacaaggaaaagagttggctgagaagccagttggggaaaaaaaaaaaaaaaaaaaa

SEQ ID NO: 16812 - DNA, 1001 bp, Zea mays
acgtctcctcctaccctcacacacctgcactccccgccgccgcagaccccctcccatggcaaagctcccgcagtctacgctgtgcgtttgccgtgctcgcgctcgagtgcattctcccgctctttgcgccgagggccgacctgtcctagccgcgccgcgccgaaggacggtgtctccttctcgcccggcgcaggcaacacgatacatcaactccttaaagatcacggccttcccggaggactgctcccgcgcggcgtggagtcgtacaccctggacgaatcaagcggtctgctgcaggcgcggctgtcggcgccgtgctacgccaagtacgacaacggcgacctggcctacttcgacaacgtggtccgcggcaacctgagcaagggtgcgctccgcggcgtggagggcctctcccaggaggagctcttcgtctggctccccgtcaagggcatactcgtccaggaccaggagcccggggtcatcctgttcgacatcggcttcgcccacaagagcctctcgaggtcgctcttcgaggacccgccggactgcaagccgtcggccgccagcgggatgagcgccgccgccgccgtcgccgccgccaggtggaagggtaggcaaggtgttattactggtctgaggttgaggcgagaggtagcagcagacagcgacgagcatcaggagcagaggtgagggagggagacaatgcaacaccccgagacgacgccgaattccggtttcccgctttgtaaaatcctgtggtgagtgagagagagagagagagtgctgccgcaacaaaaaaaaacaacaactgcaacttcctgcagaggttggaatgtgctacgtatctactaagatatgggtacctttttgcggttcaaaaaaaaaaaaaaaaatctcccccttttttttggcctgagctcctctcctgttcatgcacctgtgtgatattaagtttgtcagtcaattgttaggaaaaaaaaaaaaaaaaaatttgcggccgg

SEQ ID NO: 16813 - DNA, 1799 bp, Zea mays
ctcgctgctatctcatgaatgttttcgcgcgctctaaatatcaaattagtaggaaaagtaacagttctctttctcttggtccattagagttgggagaagactgtggattgctatagtcctggtcaagggttgatgcctgctagtttcaaagttagatctgtacctttagatggcaatagcgaagcatttgaggaggttcttgacccagattttggagagtcagctattggacgtgtagcacctgttgactctggtgagtatttctgtcgaatcatattatagtcatgaagaccagagggcctgttttcatctgttttaaatgataagctctctttttctaaggtctttggtggataattctgttaagggcatatggaaaaattactggagactatgctctacaagaaagggttgatgtgcagacaggcatcaggctaatactgaatttgtgcctgtctgatggatttgacatgtttcctacattgcttgtaactgatggatcatgtatgattgatcggcggatgggaatccatggtcatcctctggagatccaggctctgttctattctgctttacgctgtgcccgagaaatgattggggtaaccgatggatccaagaacttgatccgtgctattaacaacaggctcagtgctctgtcatttcacatcagggagtattattgggttgatatgaagaagataaatgagatttatcgctataagactgaggagtattcccatgatgctattaacaaattcaacatctacccagagcaaattccatcttggcttgcagactggattcctgtgaaaggcggttaccttataggcaatctgcagccagctcacatggatttcaggtttttctccctagggaatctgtgggcgattgtctcatctcttgctactcaaaggcaagcagagggtattctgaaccttattgaagccaaatgggatgacatagtagccaacatgcctcttaaaatatgttaccctgcactagagtatgaggaatggcgtatcatcactggcagtgatcccaaaaacacgccctggtcgtatcataatggtggatcttggcctacattgttatggcagttcaccttggcttgtatcaagatgggtaggcgtgacttggcacggagggcagttgaggtggcagaaaagaggctctcagatgacaagtggccagagtattatgacaccaggacaggaaggttcattgggaagcaatcgcggctatatcaaacttggagcattgctggatatcttagctctaagatgttattggactgtccggagatggcatccatactagtatgcgatgaagacttcgagctgctggaaggttgtgcttgcagcttgaataagaatgctcgcaccaaatgctcacgtcgtgcggccaagtcgcaggttcttgtgtagttccatgcctgttcttgacccaaaagctgcaacgctccttcaacttgttgtaattgttcgtcacagaagctggcactagttactagttacttaagcagaatgatcacaaaccacctatgccgatttttttggcgagttcgtggttgatccatttatacaggagtatatgttgttgtctgtacattttatctgatggattttatgtatcctgccggtcaactcaagttgattggtagtttttgttatgtaagcagacagcatgtaaatatcaccgctcgttacaagtgtactgttacaagtgtcatgttcttgtgacccgaaagagaaaaagaggggaggagaggggaggaaaaggaaaagggggggcccggtacc

SEQ ID NO: 16814 - DNA, 1319 bp, Zea mays
  misc_feature (218)..(218): n is a, c, g, or t
tcaaatccctattgcataaagggaaaactctcctttcatgtgaagtctcgcagtcctgtctatcgaagccaatacgtaagcattcagcttggatatcctgtctgcttttcgatggccagatcaaaatctgacgttagaaaaaaacaagacgacatgcatcaattgcaggctagaggttcccccaaagattcgttttgagaagatcacgtttttctggntgttgtttcagtaggactccagtgagaggaaaaccacatagggctagtaaggaaactcaaatctatagtttatttttatctctaatcctctctaatatcaaagagaattcgaggttcccaaagtagcctgtttttttggcaacataaaaaaactataagtattaaacaactttcagtattaggtaatgctcttccatctactttttggtcgcttaacacggcatgtatcctgcaccggccggcaggcctttgtgtgcatcacctgctttatccttattgctttgtggaaaagaaacattgcagtgtaggtgcaccagctgctaatgtggatctctcaccccacaccaagactagcaaccactcctcttaccagcaaagaaataatattgtgatccctgaccacggaaccacacccccagagaaaccattctacatattctcatatacactcattagcacatagcgctaggcgccataccaaccatgagcgacctgttatcctacatttccaaggtcatgtgcatcaaggcaagatcggaggcaacacaagccggcgaggacggcggctgcccagcggacgagtgccgcgtctgcctgtccaagattcggctcggcgaggctacccgccgactgccgtgtcgccatgtgttccaccgggactgcgtcgaccggtggctctcgtcctgcaagcgaacctgtccgctgtgccgagtttatgtggccgatgggaacaagcagccggtggcggcaaagcacaccagccgtgaagcacaggcactcgccgacgaccttgttatctggttctccaccgtgcttgttcccggtttctgatgccaaattccttcgtctgttcgttcgtttgaaaaagcttgattggtgtgtattttttttattgcatgcatgatacatgtacgtacctacgttactgttaattgtccttagaacagtttctagaaaatctgtgtgtatgtagcatcttgttgcatgaactgattggaacttctgtgtttgcagctgattactgaaaataagaagttcgagcaaatatatgttatcgaaatttatggtaaaaaaaaaaaaaaaaaaaacgcccctagggcc

SEQ ID NO: 16815 - DNA, 1367 bp, Zea mays
gtcgcgatgtccccgtccgtgagcggccgccggtcgaatctctccttgggtgaaaactccgcgccgcccgcgcggaacacgaaagcggggaggaacgacagcagccatcagaagaaagctccaatctttctcgccctctcgcggttcggaggagggacccgggcgcaaagactctaaagcgcaggtgagctccgggcggggaagatgttccccagcctgatccaccacgctagccacggccgacccgacgtcgccgtcgccgaggacgcaccacgcagtggctgcgggttagggctgcccgggcacggcggcgggcccagcgtggtgctcacggccgatcccaagcctaggctccgctggacggccgacctccacgaccgcttcgtcgatgccgtcgcccagctcggcgggcctgataaagcaacaccgaaagctatcatgaggacaatgggagtgaagggcctcaccctttttcacttgaaaagccatcttcagaaatacagattgggaagacagtctggaaaagagttaacggagcaatcaaaagatgcttcttaccttatggaagctcaaagtggaacaactttgtctcctagaggttctactccagatgtgaaagagagtcaagaagttaaagaagcactcagagcacaaatggaagtgcaacgaagattgcacgaacaagtggaggtccagaagcatatgcagatccgaatggaggcgaaccagaagtacatcgacacgatactagataaggcgttcaagatagtatctgagcaactgagtggcttcagcatatctgaccaagacctaccgattctcacctctgctagggccatgcttagccctgcagatcacttgagttcgtctgtcttcccccagctctccgtcagctccgttagccttcacaatcctggtcctggaggagggaaaggccttccgcatgttgccgacagccacgtgttctcccagaggccacctgaacaattcaagcgcaaatcacgttgagaagcattgctagctcgacgcagatgcatgacctgatcaagggcacactggaaaatcagaggaatttcgtctgacatgtgcacggtgcaatcgttcgcccatcctcccgtagcacatctgtgaaaatcaaggttatcttggtctatttcggtacatctagactgacctttattaatatctaatgtaatgcctaagtggactagataagtaattcgcttgttgtataaactgcccagctgtaggatccagttttaaagtcctgttccacgcacttaaaacttgggggccgtctcttgggcggcttcaaaaaaaaaaaaaaaaaaaaacataaaaaaagaataataaagaaaaattacata

SEQ ID NO: 16816 - DNA, 837 bp, Zea mays
  misc_feature (802)..(802): n is a, c, g, or t
gccggccgggccgggagtcgctctaaacgggcttgcggggccgcgacccgcccgggtcccggcaaaggtcacaccttcctccctcgtccacatccgtgcctccagccaccggccgcctggggcggcgctcttgccaccggctgtcgagcccggcgaccttgccgccgtttccacgccgcctgacctgcccccacgacctgttgccgtcacgccatccgacctgccccaggacagcccaagcccccgcgaggccgcgacctgctggggaggagattgataggagaggtggtcggcggcgtggataccaacgacggagacatagggattgccgcccgtcgccccctgtttccgatacgctgaagcctcacgccacgagcgagcagagggccccaactgccagcagcaaccttaggcactggttgcttgaagtaaccaaacattcggacgcgcataaaatcgccacgcacgcatcgctggtttgccgccgcagagcagaaggcactccaggaccgcagcgtgcgctgcagacgctgaaggctggatgtggctggaagaggtgaggcggagggagcgtggagagcttcgcgctcggcggtttgaggccgccgcccgagcgtgccgcacggcctcgctcgcgctctccaatcgcaaggagtttgtcaccccacatcacggcgccgtcaactcgctccaggttgatttgacagaggggaggtacctgctctccggggcatcgggatgggtcggccgctggtgttcgatgtgtggaacgcgaccgaatatgaaaccgggttcatagcanagcacaggaacatactgcttgtggacagcaacacc

SEQ ID NO: 16817 - DNA, 1592 bp, Zea mays
cccggaacccctcttcccctttgccatcaccgccgaccgccttcttgatgtccctcacgtgcatcgccatctggtacacgtgctccagcttcccatccgcgtcgcgcagcagggcgccgtacgcctcgtggtcctcctccagccgcaccacctcccggcacttggccagcttctcctcgtcgagatccttcgtcttcacgtccgcgttggcgtctgccttcttcccagcatcggccaagcggagaagttcgcggaaggcgtcgacttgctcgtggtcgggccgggggcccaggaggcggatcgagtcgcgcgccgaggagacgtcggcgacggcgcgggtcatggcagacagcacggacgggtggcgcaggcctggcatgcgccccaccaagtcgatctccgcggcacccgacggcgtgcgcggggacgcctgctcgaggtcccgctcgcgcggggacctcggcgtcctcaccgcgggcagcgaggggaggcgggagagcacgtaggcaaggatcgggtgtgactgcggcgtcggatccatggcggcggctgcgacgacgacgacgcgatcgttctcgttcgctcccgttggcgggatcggtggctcgcgaacggaacggatcggaggagacgagaggacgagcgagtcgtaggatttctggatttgggatccggaccggaaaaccgggaaattttattcgagagcttgagtgaacggccgcgcgttccggggtccggtccggacgcgagaattggcagctacgatgggccgtaagaagggcttctgccagcggcacacagagacgaaagcccatttcagccagtaagaaggatggcataataacaggcagccaaaattgagagtgacaagtaccctgccggcagcggaccgacaaaatagcaaatttctcggcttccgccacacccgctccaggtcccctcccccaaactgaaacgaagttgcggcggtcgcgactgagtgcagagatgctgcagttcccggcgctgatgcggcagtggccatcgccgccgctgatcccggcgtccacgctgctccccgtgccggccacctcccaggaggacgagcttctcctctccatggccgagtccgacctcgaggataagctgaacgagatccggaagaccaacagccacctggttatcatcgggaagcccacgggcgacaccaaggaggagtacgacgctgaggtggaggacgacgatgcagacaacgtcgaggagtctgacggcgacgacttcgaccaggagaccggttgacccaggtggctcccccgtgcttcgtcggcgtccttgagcgtcgtcatccccgctgtccagtctgtatttcgcaatccctgagttgctccttctatctagatacgctgttaccctattttgctgctgtctgttctcaggatctgagcatgtccttgtcgtgtggaccttgtgtatgaaacaagtacatgattaatcggtccaatttaaatgctatattagtttcctctaaaaaaaaaaaaaaaaaaaacttcttggcccccttgttgtttgtgccatgaccagcaaaaaaaaaaaaaaaaaaggcccctagggcc

SEQ ID NO: 16818 - DNA, 1181 bp, Zea mays
ccggccgggatcaattgagggcctccgccacaagccacagcgctccggagtcctgcccgactgctccacaggccactcgtcaccccaaaccaaaacgaagctgcgggcctgcggcggcagcaacagagagcagagatgctgcaattcccggcgctgatgcggcagtggccatcgccgccgctgatcccggcgtccacgctgctccccgtgccggccacctcccaggaggacgaggtcctcctcgccatggccgagtccgacctcgaggacaagttgaatgagatccggaagaccaacagccacctgattatcatcgggaagcccacaggcgacaccaaggaggagtatgacgctgaggtggaggacgacgatgcagacaacgtcgaggagtctgatggcgatgacttcgaccaggagactggttgacccaggcggctccccgctccccccatgcttcgccggcatccttgagcgtcgccatccccactgcccagtctgtatttcgcaatccctgagtcgctcctgctatctagatgttctgtgttaccctattctgctgctgctgtctgttcccggaatttgagcatgtccttgtcatgtggacctcgtctatgaaactactagatgattaatcgatccaatttaaacgctgtagtactttcctctatctgtgccagatactgctacttctttccattttattctttgtgccaagaccaataagttcttgtcaaaaaccaaaaaaaaaaagccgccctttctggtcggaacttcctgtatgaaaattcggtagcacaagattttggttcgctcaacagaaaagagacatcaaggagcaaaaatggagctattagtaatatcgacttggcatagtaacacacggctattgtgatagtcaggtatcatcaacctggacattcacatcgatgattccttaaaaaaaacaatgttgaactataaagtgtctgttgccgtgcattgctggatgtgcccattaattttcattgatccctgctgaatttctattcttgacccaaaaaaaaggttgcattaattttgagttccctaatttaataaggccagtttctatactgtgttatttgcaatgcatactttgaagctatgaatatcgaatacattgtgtcttatcttccccattctcttttttctgaacctctgta

SEQ ID NO: 16819 - DNA, 1299 bp, Zea mays
aacaccttcgtctccccgtgcacaacgagagatccccacggccgccgaggaacccctcctcatcctccttgcacaccccctcggcccctctcatgcccgcagggtcagaggccgtgggcgagcccggcggctgcggacacgtcgaggaggagtacgagattcgcaacgacgagggctttgtctacaaggttcaccgagggctctaccccgacgccgcgccctccaccacccagacggcggcgggccccgaccccaaggctgccggcctccgccgccgccgccgcgcgctcctccgcctccgcgccaagcgcctccgcgacctctcccgctgggaggccctcgcctccgaacttctcgccccgcttcccgctcccccgccaccggctccgacatcccaatcccctcccgtcgctgcctcctcctcctccttggtctctgtcctcgacgagctcctcgcacaggctgacattcaagttgagctgatgaagaaggtgtgccagtggtgcgacgaggccaactctatctgcgacgcaggagaggctgccattgtcgattcgatagttgcgctgcctatgtggggcgccaactcgtcggagctagtggcagcgctatgcagcccagataaaaatacccctggtaagttggatgaaccgaatgggtgccaagaagcttctggagtgtcttcagcggcagctgaaatgataaaaaatagtgtcgagaaacagacaatgggtcatgaccttcctcccattctcactgagagcaggacgaggaaaagagtagctaatctttcaggcacaaagaggaagaaggcatcaggcactccacgatcaataacgagaagaaaggcagcgtccagtccagcaagagttccagacatatttggtagcccggggccactaaccaggagaagggcagcagctcaaaatgtaccaacagggaactcgtaataggtggctcttatctacaagccaaaacgccttataatttggttggaacagagagagccatgtgtttgtacacaagtgttgtttgttgttgatgtagctagaaaatccaaaataactactcactccgttcttttttatttgtcgcatattagtaaaaaataaactagccgacgacaaatattcaagaacggaggtagtagttcataattgggggagtgacttttttttggctagtgatgtcaccactttagccatcaattgaacatcttgtgtatttgtgaagttccagccgcagatggtatttagtgtgcaatcaagtattgctgtattggcaaaaaaaaaaaaaaaa

SEQ ID NO: 16820 - DNA, 878 bp, Zea mays
ctaataaaccgtgcccctccgtcccaaccgtccgccgcctccctccctttccgctccgccaagaccctcctcctcaccccactcacccagctcccctcgagcccagaagcaccgcgcgcaccatgcggccaccgagagggcgcggcggcggcggccggttcggcggaggtggaggccgaggcggcggcggtggccggttcggcggcggaggccgtggtggccggttcggcggcgggttccgcgacgagggcccgcccgcagaggtcgtcgaggtgtcgacgttcctgcacgcgtgcgagggagacgcggtgacgaagctcaccaacgagaaggtgccctacttcaacgcgcccatatacctgcagaacaagactcaggtcggcaaggtcgacgagatcttcggccccatcaacgaatcctatttctctgtgaagatgatggaagggatcattgcaacatcgtacaaggaaggcgacaagttctatatcgaccccatgaaattgctgcctctttcgcgcttcctgccgcaaccaaagggacaatctcaaggagcacctagaggtggtggccgtggtggaaggggtggtggccgaggccgtggtggttcgttccgtggtggaagaggaccaccaaggggtggtggccgaggtccaaggggtggtgaccgtggtggttttagagggcgaggaaggttctaggtgtaatttgagtttgatgatgttttttgttgaagcatcatagctacccaattggaaacttccatgttcttgtaacctgatatgtttaaggtagcagaacattttgtttgtggaacttggattctcaattgaaacaaagggtttgtacctgttccgttcctaacaaaaaaaaaaaaaaaa

SEQ ID NO: 16821 - DNA, 1274 bp, Zea mays
atcgattacagcactagcccccccgcctgccttaatgcccgcgcgccatcacttgctggggggagctctgccgagacacgcacgctgctggagataggcatccagacacggcaccaccaccagtccaccaccaccaccaccgtgacgtgagtgcccgagcgcgcggccgccatcaggctcccccgtcgtcctcgccgggtggctaggtcagagccgggagaggcgggggccggcgctaggctaggctaggcagcggcgtgcgtgcgtggccgccgcgcgatcggcatgggcgacggcgaggcggcggtgccgagcaggttccgcacggtctgcgtcttctgcggcagcaacgccggccgccgcaaggtgtacgccgacgccgccctcgagctcggccacgagctggtgcggaggggcatcaacctcgtctatggcggcggcagcatcggtctgatgggcgtgattgctcggacggttcgtcacggcggctgccatgtcctcggggtgattcctaaagcgctcatgcctattgagatatcaggtgaaagcgtgggagaggtgagggtcgtggacgacatgcaccagaggaaagccgagatggctcgtcagtcccaagccttcatcgctctcccaggggggtacgggacgatggaggagctgctggagatgatcacctggtgccagctcgggatccatgacaaaccagttgggttgctgaacgtcgacggctactacgacccgctgctcgccctgttcgagaaaggcgccgccgagggtttcatcagcaccgactgcagccagatattcgtctcggcgccaaccgcgagcgagctgctcacaaagatggagcaatacacgcgggtgcaccaggaggtagccccagcgacgagctgggagatctcggagctcggctacggcagaggaggaggagaaggagacgccggcgccgccacgccgccagcagcagcagcaggagcaggagcagaagagggaaaaggcggctcgtagcacccacatccatctcctgaagcgttaccttcctccacctactgcttgctgatgtgatgacgcgtctgttacggtttcctggcaaatttgtttcgtcaaagtcgatctctccaaagtccaaagtccaaaacccggttgaaccaggtgccgggtcgggacgtactggggagacgacgatgatatctctgtgttgggtgcttggattgtgtaagctatctgctgctggtactattcttgttttctttttttcaaaaaaaaaaaaaaaa

SEQ ID NO: 16822 - DNA, 1906 bp, Zea mays
cccacgcgtccgcccgcctgccctgacagcaggagccgcctccagtatcccccgtcaatgcttgcgaggacagaagacacctgacctgatctgaccaggcagatcgagtggcttgccgtcgcgtgcaaccgcaaccgccgctggtattatatagagacccctattacatcggtcgcgccgcgctgtggcgctaatagtcgtcgatcgttccatcgaccggcggccggccagcctagctcttggctcttgctccgatcggatcgagcgccggacaagtcaaggcagccgtacgtacgacgatggcgcagggcagccgcagcgctgccgtgcccgccgcagcgtccttcttcgcccttctcgccgtggcggccccgctgctcctgtgctgcgcgccggccgccgcggagctggccaggctggagcacccgcccaaggacggcggctcgctcagcctgctcgtcgtcggcgactggggccgaaagggcacgttcaaccagtccagggtcgcccatcagatgggcagggttggggagcagctcagcatcgacttcgtcatatccaccggcgacaacttctacgagaacggcctgacgggcacggatgacgaggcgttcgagcagtctttcaccgatatctacacggcgaagagcctgcagaagccgtggtacctggtgctgggaaaccatgactacaggggtgacgcgctcgcgcagctgagcccggtcctgcggaagatcgacagccggttcatttgcatcaaatcattcgtcgtcaacgcagaaatcgtggagttcttcttcgttgacaccaccccgtttcaactcaagtactggactcaccctaaggacgatcactacgactggagaggggtggcgcctcgggaaaactacataaacaatctgctcaaggatttggacggggccatgaagacatcgactgcggcgtggaaggttgccgtgggccaccataccatgaggagtgtcagtgatcatggtgacaccaaggagctactgcagctactgcttccagtcctccaggccaacggcgtcgatttctacatcaacgggcatgaccactgcctggaacacatcagcagcagagacagcccaatccagtacttcacaagcggaggcggttccaaggcatggagaggagtgcagaaccccaccgaagatgacctcaagttcttctacgacgggcaaggcttcatgtccctccagctagaccgtagccaagccaagttcaccttttacgatgtcgacgggaaggcgctgtacagttacacacggtcgagcctgatggaaacaggccaccacctccaagcctccggctacgtcaacgaggaatgaagcaggggcgagtcagcatgcagcgctggagaactgagatcgatgcagttcaagcgtacgtataaattctcgagtgcttgatgtggttcatctgtcaagggcaacaacagttaggtttatatgtgtgcccttgcatctctcgacatctgtcactgccgtccggtactatttggggtcatgccatcgattcgaaaacatgacatggtaggggcagccatgatgtagcaaaaaaaaaaatagtgcaaatattcattatcgaggagttaaaacattaattgtgtggacagcggccgagcataggaccaaaatcagcagggggcaatcaacagattatgtaaaaattacatggttcagtggtgcgacaataaagacacagtatatatatggaaatatatcgtatgcaatcaagcgatgtgctacaccccaaaaaaaaaaaaaaaagactgttgtccttatacctaaaacctagtaccaattttagatctaacgttttttttcacctaaatagaagtactcaataaattttaattggatataccaggtcaagctgatgggcc

SEQ ID NO: 16823 - DNA, 1638 bp, Zea mays
gccggccgggtccgggcgccgcggtcgatcctaatagtcgtcgaccgttccatcgaccggccggccggccagcctagctcttggcaggctcttgctccgatcggatcgagcgccggacaaggcaaggcagccgtacgtacgacgatggcgcagggcagccgcagcgctgccgtgcccgccgcagcgtccttcttcgcccttctcgccgtggccccgctgctcctgtgctgcgcgccggccgccgcggagctggccaggctggagcacccggccaaggacggcggctcgctcagcctgctcgtcgtcggcgactggggccgaaagggcacgttcaaccagtccagggtcgcccatcagatgggcagggttggggagcagctcagcatcgacttcgtcatatccaccggcgacaacttctacgagaacggcctgacgggcacggatgacgaggcgttcgagcagtctttcaccgatatctacacggcgaagagcctgcagaagccgtggtacctggtgctgggaaaccatgactacaggggtgacgcgctcgcgcagctgagcccggtcctgcggaagatcgacagccggttcatttgcatcaaatcattcgtcgtcaacgcagaaatcgtggagttcttcttcgttgacaccaccccgtttcaactcaagtactggactcaccctaaggacgatcactacgactggagaggggtggcgcctcgggaaaaatacataaacaatctgctcaaggatttggacggggccatgaagagatcgactgcggcgtggaaggttgccgtgggccaccataccatgaggagtgtcagtgatcatggtgacaccaaggagctactgcagctactgcttccagtcctccaggccaacggcgtcgatttctacatcaacgggcatgaccactgcctggaacacatcagcagcaaagacagcccaatccagtacttcacaagcggaggcggttccaaggcatggagaggagtgcagaaccccaccgaagatgacctcaagttcttctacgacgggcaaggattcatgtccctccagctagaccgtagccaagccaagttcaccttttacgacgtcgacgggaaggcgctgtacagttacacacggtcgagcctgatggaaacaggccaccacctccaagcctccggctacgtcaacgaggaatgaagcaggggcgagtcagcatgcagcgctggagaactgagatcgatatatgcagttcaagcgtaaaaatagtgcaaatattcattatcaagcatctctcgatattttgatataattctcgagcgcttgatgtggttcatctgtcaagggcaacagttaagtttatatgtgtgtgcccttgcatctctcgacatctgtcactgccgtccggtactatttggggtcatgccatcgattcgaaaacatgacatggtaggggcagccataatgtagccaaaaaaaatagtgcaaatattcattatcgaggagttaaaacatttgtgtggacagcgggccgagcatagaaccaaaatcagcagggggcaatcaacagattatgtaaaaattacatggttctgtggtgtaacaataaagacacacccagtatatatatggaaatatatcatatgc

SEQ ID NO: 16824 - DNA, 1580 bp, Zea mays
cctaatagtcgtcgatcgttccatcgaccggccggccggccagcctagctcttggctcttgctccgatcggatcgagcgccggacaaggcaaggcagccgtacacgtacgacgatggcgcagggcagccgcagcgctaccgtgcccgccgcagcgtccttcttcgcccttgtcgccgtggccccgctgctcctgtgctgcgcgccggccgccgcggagctggcccggctggagcacccggccaaggacggcggctcgctcagcctgctcgtcgtcggcgactggggccgaaagggcacgttcaaccagtccagggtcgcccatcagatgggcagggttggggagcagctcagcatcgacttcgtcatatccaccggcgacaacttctacgagaacggcctcacgggcacggatgacgaggcgttcgagcagtctttcaccgatatctacacggcgaagagcctgcagaagccgtggtacctggtgctgggaaaccatgactacaggggtgacgcgctcgcgcagctgagcccggtcctgcggaagatcgacagccggttcatttgcatcaaatcattcgtcgtcaacgcagaaatcgtggagttcttcttcgttgacaccaccccgtttcaactcaagtactggactcaccctaaggacgatcactacgactggagaggggtggcgcctcgggaaaactacataaacaatctgctcaaggatttggacggggccatgaagacatcgactgcggcgtggaaggttgccgtgggccaccataccatgaggagtgtcagtgatcatggtgacaccaaggagctactgcagctactgcttccagtcctccaggccaacggcgtcgatttctacatcaacgggcatggcccactgcctggaacacatcagcagcagagacagcccaatccagtacttcacaagcggaggcggttccaaggcatggagaggagtgcagaaccccaccgaagatgacctcaagttcttctacgacgggcaaggcttcatgtccctccagctagaccgtagccaagccaagttcaccttttacgatgtcgacgggaaggcgctgtacagttacacacggtcgagcctgatggaaacaggccaccacctccaagcctccggctacatcaacgaggaatgaagcaggggcgagtcagcatgcagcgctggagaactgagatcgatatatgcagttcaagcgtacgtataaattctcgagtgcttgatgtggttcatctgtaggtcatgccatcgattcgaaaacatgacatggtaggggcagccataatgcagccaaaaaaaattagtgcaaatattcattatcgaggagttaaagcattgtgtggacagcggccgagcataggaccaaaatcagcagggggcaatcaacagattatgtaaaaattacatggttcagtggtgcaacaataaagacacagtatatatatggaaatatatcgaatgcaatcaagtgatgtgctacaccctatcaaaaaaaaaaaaaaaaaaaaaaccaggcctaaaacctcctccctgcccttgcgagaagcctgctacgct

SEQ ID NO: 16825 - DNA, 1560 bp, Zea mays
gaaaccttcgcgcggtgatggagcacgcgcacgcgacctcgacacgcacgcagcagccagcaggtgaccgccgtcacgcgaccgcttcccacactcccttccccaccagccgaaaccgaggctgacgctgcgcgagccaaccggcggtgatgcaggcggcagtcggccaccgcggcgccaaccttggctccccgtcactctcgcgcttccggtatggcttccgcctccccggccggtcccgcctcttctctgagggcgtggcggtggcgccactccgcgtcggctctctgccccagccacggacccatggcagcggcggtttcgcgcacctcggggccatggatggggaggcgccgaggctgccgcacgccctcaggagaatgcttatcgatcatcagaaaatggcatgtcccaaccttctgaaagctgctgtactttcaaccatgacattgcttgctgtacctcttgaggcgtcagcggagatgtgccagccacctagttctttcgccaatatgccaatttttattgttgtagctctaataggagctgctgttggcggattattagcacgccaaagaaaggcggaattgaagcggctcaataatcaacttcgccagatcaatgcagcacttagaaggcaggcacagattgagtcatttgcgcctggccttacttatgcgccagttgggagaacaaatgaaactgatgttattgttgacccaaggaagcagcagttggtcacaaacctgagaaatgggaagaattacatgaggaatcaagatcttgataaggctatagtggagttcagaacagctctggagcttgcagagagcataggtgatcgttttgaagaaaagaaagctgcccgaggactaggcgcatcgctgcagaggctcgggaagtaccgagaagcaatgagacagtacagcaaggttctggagctgtccaaggagacaggtgaagattccggctgcaccgaggcctacggtgccatagcggactgctacaccgagctgggcgacctggagcgagcggcgaaggtgtatgacaagtacatatcgaggctgcagcccggcgagtaaggtagatttctttacagacgagacagcgagttccttcccgttcgttgagttttgtgttttgtcggtcttgttaaactcactgcaggtattggattgttttgagaacggttttaatattcgtatataaataactattgatttaatcaaaaaaataaaaaaaaatcacaacgcactcgcccagctagtctccatccgtgttttacttaaaaagaaaggtgaatcgttgaatgtgaacaccgaaaatgcacgtaccagtccgtttgcggtgtctggtgtgtgtttggttatggaacagttgggacagctacatcatctctcgttcctccatttttgatttcagaggtagagacaacactagaataatcttgtaacctcggaatctaaacaaggggcgccctagagcggcgggacgtattttgggtgagagtcacgactcacgagccgtgcgcgcgcgagagaggggcagaccgttactgca

SEQ ID NO: 16826 - DNA, 1362 bp, Zea mays
aaaaacaacctgcacgcgtcatcatctgtggttttgctcttggttggcccccagttggccttcccgcaggcgcagcaaggtgggagaagaaactggcttccaagatgggcgagcatggaggtggtggcaatgggaacccgaggtctctcgactggaagcgcgatttttgatcgcttcagggtgcattgtggatgctcctatctgaagctacactgtttccgtgagttcagaatgatctaaacttgccttgtgcgtgccctgcagctgctccttgttccgagttactttgtttcgaaacgatgccgcttatatatatatagcaagcacttctctccactggccaatggtgaaaaactaagctagtgcttgctctgtggggatctttacaagttccgttgttatatcctttgttgctactcgtgaagttcctacattatttgccatgccaagttcttttgctcgctagcttcctgtgaagactgtaccatgagttgtacctttgttataagctataatgtttgtaatttgcttcatattatgtggttgatgagaagaggaatcctgagtttacggtgtcccactctcacctctccttgatggttttcactgcccccactgtatgcatatgcatccagttggcttgtgaactggtggtgagacattataagttttttttttttttgacagaaaggggtaaaccccctatttcgttatgaaataggaaatagttccttacaaccgacaccacggagtgaaacaaccggcactacacctatcctgacagagattaaagtgttatgctttttttccttgatcgagcaagctcagaaaaggagcagaaaagactgcgccaacacaggattgaccgcctccttcgtaatttggatcacaaactcaacaacatcagtaggatccatgagtttcttgctgttatgttatttatggtcttccaaatggaccatagaacagccccacgacccaggataaccaagtttttaagatctttgttagtctcatgttcaaccagtctccaaaaaagggagtcacagttatggggatatctttagactaaaggcagcctgaatcactctccaaataaaagtggccacgggacagttgatgaaaagatggttattttgattccaaaatgccacaaaacagcaatcaaaggacccctaccagtacttttcctcaaattttctttaggtaaaattttatctttcagaataagccacagaaagactgatttttttaggcatttccactttccaaagaaatttgaaggggacttttgcacaattgctcctaatttgagaatctagggttttaacagtgaaccctctcttatgcagatgccagacc

SEQ ID NO: 16827 - DNA, 2328 bp, Zea mays
  misc_feature (11)..(11): n is a, c, g, or t
gggcctgcaanactgacgggcggccgcgcgggaggttgagaagccacggtgagaccaactggcacgagaccattacctagaacatcctaatcgaaaagtcctaaaaccctagcgaaggcgagccttccacttccctcagcctgccgccgccaccgccgccgccgccgccatgtgcccagcagcggcgaccacgagctccgccaagccgtcgaagaagcggaaacagcccgtcatagcgccgccggagtcggactctgaggaggaatctgtctacgacactgcctccgacgatgacgaggaggaagaggagacgcaggagttagagagtgaggatgtagacgaggaggtggaggaggggagcgaggacggcgaggaaaatgaaattggtgacgatagcgaggtggaagaagaggaggtgaaggagaaaaaagaaaaggaggagacggtgaaggagaaaaaggaaaagaaggacatgaagcaagagggaaagaaggcgaagaagcaagaggaaaagaaggcgaagaaggacaagaaggaagaggaaaaaaaggtgatggaggacaagaaagaagaggaaaagaaggcgaagaagaagagcgaggggagtggaatcctgtctaacaagctcttctcggagctccccctctctgagctcactgccaaggccatcagagagatgaactacacccacctcacccagattcaagctagatcaataccacatctgttggaggggaatgatgtgatgggcgcagccaagactggctctgggaagactcttgcattccttataccagcgattgagatgctatatcacacacacttctcaccgaggaatgggactggagctattgtggtttgcccgacacgggaacttgctatccagacacacaatgttgccaaggagttaatgaaatatcactcacaaactctcggatatgtcattggtggtaataatcgaagaagtgaggctgatcagcttgcaaaggggatcaatttattagttgctaccccaggcaggcttttggaccatctacaaaataccaagagtttcatatacagaaggctaaagtgccttgtcattgatgaagccgatcgcatacttgagcaaaactttgaggaagacatgaaacaaatatttaaacgccttccccagaataggcagactgttcttttttctgctacacaaactccagaggttgaaaaatttgctaaactgtcatttgagaaaaatgaagaaagtaaaaaaaaacctgtttatgttggagttgatgatgataagtcaaaggctactgttgaaggcctgcagcagggttattgtgtcatttctagcgataaaaggttcttggttctgtatgctttcctaagaaagaagcggaataagaagataatggtgttcttctcatcatgtaattcagtaaagttccacgctgaacttctgaatttccttgggatagagtgttctgatatccatggaaaacagaagcaacagaagcgaactactacattctttagcttttgcaaggcagaaaagggcatcttattgtgcactaatgtggctgcccgtggacttgatattcctgacgtggattatatcttgcaatatgaccctccagatgaaccaaaggattacattcacagagttggtcgtaccgcacgtggtgagaaaggcaaaggaagtgcattgctgttcttactaccagaagaactgaagtttctaatttacctgaaggcggccaaggttaccctgacggaatatgagttcaatcagaagaatgtgccaaatttgcaatcgcagcttgagaatattgttggtgagaattactttctgaaccagtctgccaaagaagcctacagatcctacgttttggcatatgactctcactctatgaaagacatttttaatgtccatcaacttgatctgcagaaagtagccgcgtcattcggtttcaagaatcccccgaaagtgaacctggacctggacagcagtgcggcgaagcatcggaagaagaggagagtagacggtgggaagaggcatggcatcagcgcttcgaacccgtacgggaggaaggacaaaggcggtggcggcgataaacgacagttggcgagattctagaaaggaaggaagagcaggagcgtttcactattgttgtgttcgtaccagggctttgattgatgttacctggcttgggaaaaatcttgacaggccactaaggttggctataaattttgggttgtcttgatatatttggtgtgtaacgcaatcagcctgctcgatgcgaaaattggattattgctttatagtacttgtggtttccaaaaaaaaaa

SEQ ID NO: 16828 - DNA, 1404 bp, Zea mays
  misc_feature (32)..(32): n is a, c, g, or t
agggatattttaaacgctaaaacgtgacagtngccctcccggcgacggagtccggcgaggcggggagctcaccgtcggcgagcgggggcagatcgcgcggcgcggaagtccgggcgagcgaagccaacagaaggtcctccggcaagcgatcgatctcgcagcaagcgggctccgtggctgccgtcgattccatcggttcccccgcctcctcggctcctcgattttcacgattcttccgctgtcggtcttggggtgggggatgacggagggggagagcggggtgcggcggtggctcgtagacatcagccgctggcgcccttcccccgcccagttcgacgctgcagccgccctcctaccgccgcacgagcgccccgccatctccaggctcgcacttgcaggttcgtgaaggaggacgacaggaagcgggcgctcgtcagtcgtctgctgcagtacccgctcgtgcaccacctcctccgcatcccgtttcacctgatcaacatacgccgcacaaccgaggggaaaccgtacctacagaataattcttcaggcttcccgaacttcaacttcagcacctcgcaccatggggactacgtcggtattgcatccgagccactttgccttgtcggcctggacatcgtgtccgtttccgagccccatggagaaaccgccgccgagttcgtcagcaacttctcttcgtgccttactgaccatgagtggagctgcatcgttcgtgctggcactcccagggacgtgctgacagagttctacaggtattggtgtctcaaagaagcatttgtcaaggccataggtgctggcgtcggatttgggttgcgccgactggaattccaccacgaaggctggactgacatttctattcgcatcgatggagaagtgtctaagaaatggagattctggcttttcaaacttgatgagacacacttggcatctatagcaaaaggggatccagaggatgctataaacaccttcaagaaaacactgtccaatgtgatcattgcagaggaccagttatcttctgcgctacacagtccagaagaagctttcactctgcagacagtggaagagcttacacaatctcaggggtaactggccaacagatgctaggcattcttgaaacctacagtgacctacaacagctggagcatgtgtctgaatcccagaggactccagcctccgataatctaaatatacaggcacatgtgaatcatggaagggcttctattgcagaaagtggcgttatatcctttgattttctatgacacaaggccataccaggggattttgaatcgtctgctgtctctatatcatgtgatgctgtatggatgttgttttgatatatcaagtttacgtgagtgattgcatttctttctaaaaaaaaaaaaaaaa

SEQ ID NO: 16829 - DNA, 787 bp, Zea mays
  misc_feature (754)..(754): n is a, c, g, or t
  misc_feature (776)..(776): n is a, c, g, or t
ctcgaggccggccgggatatggaccgcgagtattttaaacgctaaaatgtgacagtcgccctcccggcgacggagtccggcgaggcggggagctcaccgtcggcgagcgggggcagatcgcgcggcgcggaagtccgggcgagcgaagccaacagaaggtcctccggcaagcgatcgatctcgcagcaagcgggctccgtggctgccgtcgattccatcggttcccccgcctcctcggctcctcgattttcacgattcttccgctgtcgatcttggggtgggggatgacggagggggagagcggggtgcggcggtggctcgtagacatcagccgctggcgcccttcccccgcccagttcgacgctgcagccgccctcctaccgccgcacgagcgccccgccatctccaggttcgtgaaggaggacgacaggaagcgggcgctcgtcagtcgtctgctgcagtactccctcgtgcaccacctcctccgcatcccgtttcacctgatcaacatacgccgcacaaccgaggggaaaccgtacctacagaataattcttcagccttcccgaacttcaacttcagcacctcgcaccatggggactacgtcggtattgcatccgagccactttgccttgtcggcctggacatcgtgtccgtttccgagccccatggagaaaccgccgccgagttcgtcagcaacttctcttcgtgccttactgaccatgagtggagctgcatcgttcgtgctggcactcncagggacgtgctgacagagttntacaggtattg

SEQ ID NO: 16830 - DNA, 1652 bp, Zea mays
gatgtgaaaaccaactgtctctccagctctcagaagttagaattagtacctaacaatggtctttggcgccaaacatggccactttttattgcaacccattttgatcaacgtttatctaacattccaatcagatgtctgggctatgttttcaagcaaagttggagcctgggactcaaatttcattggcttcaagagaaaatttctgatctcactggggaaacccctgttgctgtaaaccctgcacttgtgggtcatcatctgttttcgttttggtctttccgtcattcaggcagcgccggtaatcagctggtcgtggctgatcactcgtgccgtgcatgtaggaagtagtgagcatgtttagtttcagtagtgggccggctgcacaactcagacgtggggatggacgcgttagtaggcgggttatgcggctggcatcttgtattcagttgtaatctctgttgaataaagatatatacactcagaaaacgctgggcagtagcacagcaccaaaaacactcgtgtattttcaagttcttcactgttcgtctgtgtccaactccgtcgtgttctcagccccgacgccggcgttcatcgccgggtcacaggctcacagcccatcgccgggtcacgtctgcgcctgacaaccccagctaaaatctgttgctgctacaggttttcagagccgtgtaagttcaggtttctaggatcctgcagaaacaagaccgtgtgactcggttctcgcattttcaggaattccggcctgctctcaatcctgaagtcagcccgccgacatgcccgtgatgattgcgaaccgacaaagtagtcgaatcttcgatctcaggcatgtacgtggcagctgttcagagactgcaaagagagagctgtagtatggtcgttaagccctgcctcactatagtggagcgcagtaggtagtaatgctacttaaaacggagagctcggcgcatgccgcacaaaggcagcgctagtgcagcgtccactccgaccgtttcacaccatgaggcgcgcaaaacctcaagcaaaccatgatgagttccgttcacgctcgaggccccgagactgtatatatatagccaccactccatcagagacttcatcagggttcagtgaagtgtagtgcagccaaggcagcagagcgtgaggtgcactaccaggcaacaaggaaaaaaatggagctccaggcaaggtgcgtctgcgtcgtcgcgatgctcctggtggccagcttcgcggggctggatacggcgcacggcgcgggagagtgcggccgcgtcccggtggaccaggtggcgctcaagcttgctccgtgcgcggcggccacgcagaacccgcgcgccgcggtgccgccgagctgctgcgcgcaggtgcgcgccatcgggcgcgtccccaagtgcctgtgcgccgtcatgctgtccgacaccgcgcggaaggccggcgtcaagcctgccgtggccatgaccatccccaagcgctgcgccatcgccaaccgccccgtcggctacaagtgcggcccatatacccccccgcgacccgccctcgtcggccctgttgaaagataacgacatggcgtcaacatcatttgctttattccgcctctctcactgtctgttttttttttctctctctctcactctgca

SEQ ID NO: 16831 - DNA, 720 bp, Zea mays
gggtacctcgccgcccgccgcgcaataagggttcagtgaagtgtagtgcagccaaggcagcagagcgtgaggtgcactaccaggcaacaaggaaaaaaatggagctccaggcaaggtgcgtctgcgtcgtcgcgatgctcctggtggccagcttcgcggggctggatacggcgcacggcgcgggagagtgcggccgcgtcccggtggaccaggtggcgctcaagcttgctccgtgcgcggcggccacgcagaacccgcgcgccgcggtgccgccgagctgctgcgcgcaggtgcgcgccatcgggcgcgtccccaagtgcctgtgcgccgtcatgctgtccgacaccgcgcggaaggccggcgtcaagcctgccgtggccatgaccatccccaagcgctgcgccatcgccaaccgccccgtcggctacaagtgcggcccatataccctgccatgaggtgatcatgaggagccaagtgatggcgggcagtgttgtggcagtggcacctgaaggactccaaactctgactgccaatatgccgtgacctctgtcgcatcttactttccaaagatcccgagaataatgtggctgtaataatgcctcaactttggaataaaattgtatctttttcaccaagtcgataacactgtaaaatgcaattgacaagaacagtttccaaactgcagtcaaaaaaaaaacaaaaaaaggcccctagggccaa

SEQ ID NO: 16832 - DNA, 1504 bp, Zea mays
cgttgctgtcgctccgacacgtataaatatacagcgacgcccccgcccgcgcgcgccgcccacgcgtccggcgagcaacagagcagaagcaaagcgcagagctagcaagtgaccgaccgagagcaaataggcaaggcaacgcaggcaagatggtgcagcaagccgcgaaggaggtgatcccgctgctgacgccttacaagatggggcagttcgagctctctcaccgggtggtgctggcgccgctgacgaggtgccgctcctacggcaacgtgccgcagccacacgccgccgtgtactactcgcagcgcgccaccaggggtggcctgctcatcgcggaggccacgggggtgtcggccaccgcgcaggggttcccggagtctcctggcatctggacgcaggagcaggtcgaggcgtggaagcccatcgtcgacgccgtccaccgcaagggcgccatcttcgtctgccagatctggcatgtgggcagggtctccaccaacgagctccagcccaacggcgacgcgcctatctcgagcacggacaagcagatctccccggacgccgagtccggaacggcgtactcgaagccgcgccggctgcggaccgacgaggtccccgggatcgtcgacgacttcaggcgggccgcacggaacgcgatccaggctggtttcgacgccgtcgagatccacggcgcgcacgggtacctcctggagcagttcatgaaggacagctgcaacgaccgcacggaccagtacggcggcagcctggagaaccggtgccgtctcgccgtggaggtcgtggacgccgtcgtccgcgaggtgggcgcgcgccgcgtcggcatcaggctgtcgcccttcgtcgacttcgtggactgcgtggactcggacccggtggcgctcggccactacatggtgcagcagctcaacaggcatagcggcttgctctactgccacatggtggagccccgcattaccgcccacgggcgcaggcagatccctcacgggctcttgccgttccgaaaggcgtttcatggaacgttcatcgccgccggtgggtacgatcgggaggaaggcaacaaggtggtggcagaagggtatgctgacctcgtcgcgtatgggaagctgttcttggctaacccggacctgcctaggaggttcgagctggatgtggcactcaacaaatacgaccgctccaccttctacacgcaagatcctattgttggctacacagattaccctttctttgaagaagaagatggcaagaatgaggagtgaatctgataatgtggagggttcatcaagtataagttcgtcattatttccaccattcattattggccattgtggtggagtcattgtgtcatgttgtttcattctgtactagtgtggtgtgaagtgaaataaatctatttggtgaaattgttataaaataaaaaatagacttgtcggatttaccctctaaaaaaaaaaaaaaaaaaaaaaagaaaaaaaaaaaaaaaaaagcggcc

SEQ ID NO: 16833 - DNA, 1545 bp, Zea mays
gagagcataaccgaatagaaatagctttggtggtgcaaacaagcaagcagcagagcagatcaagtaaaggtagcaatttgagtagtgtgcaagctaagatggggcaacaagaaaaggaagtgatcccgctgatgaccccgtacaagatgggacagctggagctctcccaccgcgtggtgctggcgccgatgacgcggtgccgcgccatcggggacgtgccgcagccgcacgccgccgtgtactactcgcagcgcgccagcaggggcggcgtgctcatcaccgagggcacgggggtgtccgccaccgcgcagggcttcccggggtcccccggcatctggacgcaggagcaggtggcggcgtggaagcccatcgtcgacgccgtccaccgcaagggcgcgctcttcttctgccagatcgcgcacgtcggaagggcatccaccaacgatttccagccggacggccaggcgccggtctcgagcacggacgcgcagctcccacccgacgccgagtccggcacggtgttctccaggccacgccggctgcgggccgacgagatcccggggatcgtcgacgacttcaggcgcgccgcgcgcaacgcgatcgaggccgggttcgacggcgtggagatccacggagcgcacgggttcctcctggagcagttcatgaaggacggcgccaacgaccgcgccgacgagtacggcggcagcgtcgagaaccggtgccgcttcgtggtcgaggtcgtggacgctctggtccgtgaagtcggcgcgagccgggttggcatcaggctctccccgttcgcggactacttggactgtgcggattccaaccccttggcgctaggtcactacatggtggaacagctcaacaggcacgaggggtttctgtactgccacatggtggagcctcgaatggccatcgtcgacgaccgcaggcagattccgcatcgactcctgccgttcaaggcggcgttcaatggcaccttcatcgccgcgggcgggtacgacagggaggaagggaacaaggtggtcgccgaaggctacgcggacctcgtcgcatacggaaggctgttcttggccaacccagacctgcctaaaaggttcgaggtagacgagatcctgaacaagtatgatcgttccaccttttatacacaagaccctgttgttggctatacagattaccctttccttagggaggacagcgaagacttagctgctcaagcttaatggcgtggatgatcgatgtaatcacggttactgcacgatcgagatcgatactacatccatttgaatatatatatgtctaagatgcattgtttttgttttaagttagttttttttatatttgaccaaatttatgtaaaagatatatgtgctaaactagttgagtataccggtgtgttgcaacgacaaacgctagtctgtatcaaatgattttattaaactttactatagccagacttacaacaccatatcttgtacatgtgtgtatttgttcaagtaaaaatatataatggtggacttggaggcaaaaaaaaaaaaaaaa

SEQ ID NO: 16834 - DNA, 1483 bp, Zea mays
cccgggtcgacccacgcgtccgaagcagagcgagaaaccgagcaaagctagtaagagcagagagctgcaagtgacctgcggtgttgcatcacatctgcagcagcagcacgccggcaagatggtgcagcaagccgcgaaggaggtgatcccgctgctgacgccttacaagatggggcagttcgagctctctcaccgggtggtgctggcgccgctgacgaggtgccgctcctacggcaacgtgccgcagccacacgccgccgtgtactactcccagcgcgccaccaggggtggcctgctcatcgcggaggccacgggggtgtcggccaccgcgcaggggtacccggagactcctggcatctggacgcaggagcaggtcgaggcgtggaagcccatcgtcgacgccgtccgccgcaagggcgccatcttcgtctgccagatctggcatgtgggcagggtctccaccaacgagctccagccgaacggcgatgcgcctatctcgagcacggacaagcagatctcccccgacgccgagtccggaacggcgtactcgaagccgcgccggctgcggaccgacgaggtccccgggatcgtcgacgacttcaggcgggccgcacggaacgcgatccaggctggcttcgacgccgtcgagatccacggcgcgcacgggtatctcctggagcagttcatgaaggacagctgcaacgaccgcacggaccagtacggcggcagcctggagaaccggtgccgtctcgccgtggaggtcgtggacgccgtcgtccgcgaggtgggcgcgcgccgcgtcggcatcaggctgtcgcccttcgtcgacttcgtggactgcgtcgactcggacccggtggcgctcggccactacatggtgcagcagctcaacaggcatagcggcttgctctactgccacatggtagagccccgcatggctaccgtcgacgggcgcaggcagatccctcacgggctcttgccgttccgaaaggcgttccatggaacgttcatcgccgccggtgggtacgatcgggaggatggcaacaaggtggtggcagaagggtatgctgacctcgtcgcgtatgggaggctgttcttggctaacccagacctacctaggaggttcgagctggatgtggcactcaacaaatacgaccgctccaccttctacacgcaagatcctattgttggctacacagattaccctttctttgaagaagatggcaagaatgaggagtcagtctgatcacaactaataatgtggagggttcatcaagtttgagttcatcattatttccaccatttattattattggccattatggcggagtcattgcgtcgtgttgtttcattatgtactagtgtaaagtgaaataaatcatgtactagtgtgaagtgaaataaatctagctatttcgtaaaattattataaaccaaatcaacacttgtttcttccaaaaaaaaaaaaaaaaaaaaaaaaaaa

SEQ ID NO: 16835 - DNA, 800 bp, Zea mays
  misc_feature (776)..(776): n is a, c, g, or t
cctcgaggccggccgggcggcagagcagaagcaaagcgagcaacagagcaaagctaagcacagagctagcaagtgaccgaccgagagcaaacaggcaaggcaagatggtgcagcaacagcaagccgcgaaggaggtgatcccgctgctgacgccttacaagatggggcagttcgagctctctcaccgggtggtgctggcgccgctgacgaggtgccgctcctacggcaacgtgccgcagccacacgccgccgtgtactactcgcagcgcgccaccaggggtggcctgctcatcgcggaggccacgggggtgtcggccaccgcgcaggggttcccggagtctcctggcatctggacgcaggagcaggtcgaggcgtggaagcccatcgtcgacgccgtccaccgcaagggcgccatcttcgtctgccagatctggcatgtgggcagggtctccaccaacgagctccagcccaacggcgacgcgcctatctcgagcacggacaagcagatctcccccgacgccgagtccggaacggcgtactcgaagccgcgccggctgcggaccgacgaggtccccgggatcgtcgacgacttcaggcgggccgcacggaacgcggtcgaggctggcttcgacgccgtcgagatccacggcgcgcacgggtacctcctggagcagttcatgaaggacagctgcaacgaccgcacggaccagtacggcggcagcctggagaaccggtgccgtctcgcccgtggaggtcggtggacgccgtcgtccgcnaggtgggcgcgcgccgcgtcggca

SEQ ID NO: 16836 - DNA, 982 bp, Zea mays
atgagaaaaacataacttgagttatggatcgattataacgaacaaacattgcggtgccccggcgcgttcctacccctatggatcgattggcaaacaaccgccgcccgtccgccatggatgcctaacctagacggcacagaacttcattattagttccatgacacagcgcaagctagctagctgggtacactggtagctaccgcaacttggcgaaaaggttgcggtgcttctttctttaatcattcaagagcaaggcagcactgcacaagcccgccgtcggtacacaccggccaccgtcgcgtagcttcacgtgcatcgttttgctggcgtggcgttgctgtcgcgctccaaagcaatgcaaccaccgcaccctccagatcgcatcaatacaaaaccgcgcggggcacactcgctgcctgccaccacagaataatggagcggcagactcgattcgtcctgctcgtcttcgccatcggggctctcctcgccagctccgccgccgcggacttgtcggcggctgctggttccctgcacgcgctgccgctgcggcgcgtggaggacgacgacgcaagcagcttcgtggaggaggcggcgtacccgccgaggagggcgctgtacgggggcgggtccatcagctacggggcgctcaccgcgaacaaggccgtctgctacggctcgtgcgccgctcgtgggcaggcgtatacccgcggctgcctggccatctacgggtgccgaggtggccgttaattaaccagaagcagcgcgtagctagcagtcgatgtctgttaattacatgtctgtttcttgtgctgcttctcgtttttcttctaatccccttctcttgcttcaaacaagccaagatccgatccatatatacatgttgtcgctcccaggttctgcattgtaattttccaccataataaatattgtattttctataaaaaaaaaaaaaaaaaaacaaacaaaaaaaaaaaaagggccc

SEQ ID NO: 16837 - DNA, 598 bp, Zea mays
aaccgcgcggggcacactcgctgcctgccgcatgcactgcctgccaccacagaataatggagcggcagactcgattcgtcctgctcgtcttcgccatcggggctctcctcgccagctccgccgccgcggacttgtcggcggctgctggttccctgcacgcgctgccgctgcggcgcgtggaggacgacgacgcaagcagcttcgtggaggaggcggcgtacccgccgaggagggcgctgtacgggggcgggtccatcagctacgggacgctcaccgcgaacaaggccgtctgctacggctcgtgcgccgctcgtgggcaggcgtatacccgcggctgcctggccatctacgggtgccgaggtggccgttaattaaccagaagcagcgcgtagctagcagtcgatgtcagctcgctcggcctgttaattacatgtctgtttcttgtgctgcttctcgtttttcttctaatccccttctcttgtttcaaacaagccaatatccgatccatatatatgttgtcgctcccaggttctgcattgtaattttccaccataataaatattgtattttcaaaaaaaaaaaaaaaaaaaaagcggcc

SEQ ID NO: 16838 - DNA, 1474 bp, Zea mays
gcacgaggtgcacaccaccctcgtctccgcgcccgcgccactcacatcgtgatcgagacgacccgcgtccgccgatcgagccccgcccgcgtcctccgcggtccgcgcccgcgcaccatctcgcctcgcattcccgaaagtatctgtattccttgatcaacatgtcgcgggaggagaatgtttatatggccaagctggctgagcaagcagaacggtacgaggaaatggttgaatacatggagaaggtggctaagaccacagatgtgcaagagctcactgttgaggagcgtaaccttctatctgttgcctacaagaatgtgattgcggccccccgtgcctcatggcgcattatctcctccatcgagcagaaagaggagtcccgtaagaatgaggaacatgttgcacagatcaaggaataccgtggcaagattgaggctgaattgagcaacatttgtgatggtatcctaaagctgcttgacacgcaccttgtgccttcctccactgccacagagtcgaaggtgttttacctcaagatgaagggtgattatcacaggtaccttgctgagtttaagactggtgctgagaggaaggaatctgcagagagcacaatggtagcttataaggcagctcaggatattgcattggctgaactgccacctattcatcccataaggcttggacttgcacttaacttctcagttttctattacgagattcagaactctccagacaaagcttgcaatcttgccaaggaggcgtttgatgaagctatttctcagttggacatgcttggtgaggattcctacaaagatagcaacttgattatgcagctcctgagggacaacttgaccctctggacggaggacggcattgaggagggcttagaatcctcgaagggcgatgctggtgagggtcagtagcctggtaaacttagattgatggttcgacgtgtttctcaagcacatcgtgttggacgcccagtgctgacagaaggcttttgctgctccatgcattccaagcttctgccctttcgttcgcaccctcttcatgttgttggctggtagtggtcagatttagtcccattggtttagttggccctgggtccatctgaactgatgtattgttactgctatggaagtcattcctttagttttgctctggcagtggattgctgttgggtcgtgttttcagtctttattggttccgatcggacgctgttgcggcaaaccacccctgtagatactcttcacatgctgaagaaaactaccagcagccgtttagcctgaataattgttaaatgataggttaccgttgaggctgattggtttttaattttattttaccctgttacatcaagttcttgggtaacatatttttaccgttgaggctcaaaaaaaaagaaaaaaaaaaaaaaggggaagccggagacccaatggatcatgatctaaatgattcttcacaattcattgaaacc

SEQ ID NO: 16839 - DNA, 1344 bp, Zea mays
aatataggcaccccgcaccccgttcgcgggcccggccgcggactcctcgtccccgtgcacaccaccctcgtctccgcgcccgcgcccgcgcccgcgccactcacatcgtgatcgagacgacccgcgtcctccgcggtccgcgcccgtgcaccatctcgcctcgcattcccgaaagtatctgtattccttgatcaacatgtcgcgggaggagaatgtttatatggccaagctggctgagcaagcagaacggtacgaggaaatggttgaatacatggagaaggtggctaagaccacagatgtgcaagagctcactgttgaggagcgtaaccttctatctgttgccttcaagaatgtgattgcggccccccgtgcctcatggcgcattatctcctccatcgagcagaaagaggagtcccgtaagaatgaggaacatgttgcacagatcaaggaataccgtggcaagattgaggctgaattgagcaacatttgtgatggtatcctaaagctgcttgacacgcaccttgtgccttcctccactgccacagagtcgaaggtgttttacctcaagatgaagggtgattatcacaggtaccttgctgagtttaagactggtgctgagaggaaggaatctgcagagagcacaatggtagcttataaggcagctcaggatattgcattggctgaactgccacctattcatcccataaggcttggacttgcacttaacttctcagttttctattacgagattcagaactctccagacaaagcttgcaatcttgccaaggaggcgtttgatgaagctatttctcagttggacatgcttggtgaggattcctacaaagatagcaacttgattatgcagctcctgagggacaacttgaccctctggacggaggacggcattgaggagggcttagaatcctctaagggcgatgctggtgagggtcagtagcctggtaaacttagattgatggttcgacgtgtttctcaagcacatcgtgttggacgcccagtgctgacaaaaggcttttgctgctccatgcattccaagcttctgccccctcgttcgcaccctctttatgttgttggctggtagtggtcagatttagtcccattggtttagttggccctgggtccatctgaactgatgtattgttactgctatggaagtcattcctttagttttgctctggcagtggattgctgttgggtcgtgttttcagtctttattggtttccgatcggacgctgttgcgggcaaaccacccctgtagatactcttcacatgctgaagaaaactaccagcagccgtttagcctgaataattgctaaatgataggtt

SEQ ID NO: 16840 - DNA, 1191 bp, Zea mays
cccgccgggccggccggcctccgccctagcgccactgagccactcaacgtcgagatcgagacgacccgagtccgccgcgcccgtgcaccaccgaccgtcgaactcccgaaagtaactctatttcttgatcaacatcaacatgtcgcgggaggataatgtttacatggccaagctggctgagcaagcagaacggtacgaggaaatggttgagtacatggagaaggtggctaagaccgtagatgtggaagagctcaccgttgaggagcggaacctcttatctgttgcctacaagaacgtaattggggcccgccgtgcctcatggcgcattatctcctccatcgagcataaggaggagtcccagtcgaaggtgttttacctcaagatgaagggagattatcacaggtaccttgctgagtttaagactggtgctgagaggaaggaagctgcagagagtacaatgatagcttataaggcagctcaggatattgcgttggcggaactggcatctactcatcccataagacttggacttgcacttaacttctcagttttctattacgagattctgaactctccagacaaagcttgcaaccttgccaggcaggcgtttgatgaggctatttctcagttggatacgcttggcgaggattcatacaaagatagcaccttgatcatgcagctcctgagggacaacctaaccctatggaccgctgacagcacaacggaggacggcatcgaggagggcaatgaggcctcgaagggtgatgctggtgagggtcagtagtctggtaaaacctcgattgatggttcggcatgtttttgaagtctactgtgttggaaaccatgttctaatagaaggcgtctcccgctccatgcattccaagattctgtcctccccctccctccccccatgttgtaggctggtagtggtcaaattagttggccctgggtccatttggactgatgtattgtttactgctattgaagtcattcgttctcgttttgctcttgcagtggatcgctatagccttgtgttttcaatcttttagggcctgtttgggaatgcagtttcaaaatactgtaattttgagataccatagtttataattgtacatgacataaatactacggtattgctttaccacaataaaactatagtattgctcgaaaaaaaaaaaaaaaaaagcggcc

SEQ ID NO: 16841 - DNA, 1302 bp, Zea mays
ggctgccccgaggccggcccgcggacgggccccctcggcccaaacgccgacacggcattggcgcgttgaccgcacgacctgccgattccttcgagcgatatagggcgcccccgtccacaccacccctcgtctccgccctagcgccactgagccactcaacgtcgagatcgagacgacccgagtccgccgcgcccgtgcaccaccgaccgtcgaactcccgaaagtaactctatttcttgatcaacatcaacatgtcgcgggaggataatgtttacatggccaagctggctgagcaagcagaacggtacgaggaaatggttgagtacatggagaaggtggctaagaccgtagatgtggaagagctcaccgttgaggagcggaacctcttatctgttgcctacaagaacgtaattggggcccgccgtgcctcatggcgcattatctcctccatcgagcataaggaggagtcccgtaagaatgaggaacatgttattcagatcaaggagtaccgtggcaagattgaggctgaattgagcaacatttgtgatggtatcctgaagttgatcgactctcaccttgtgccttcctccactgctgcagagtcgaaggtgttttacctcaagatgaagggagattatcacaggtaccttgctgagtttaagactggtgctgagaggaaggaagctgcagagagtacaatgatagcttataaggcagctcaggatattgcgttggcggaactggcatctactcatcccataagacttggacttgcacttaacttctcagttttctattacgagattctgaactctccagacaaagcttgcaaccttgccaggcaggcgtttgatgaggctatttctcagttggatacgcttggcgaggattcatacaaagatagcaccttgatcatgcagctcctgagggacaacctaaccctatggaccgctgacagcacaacggaggacggcatcgaggagggcaatgaggcctcgaagggtgatgctggtgagggtcagtagtctggtaaaacctcgattgatggttcggcatgtttttgaagtccactgtgttggaaaccatgttctaatagaaggcgtctcccgctccatgcattccaagattctgtcctccccctccctcacccatgttgtaggctggtagtggtcaaattagttggccctgggtccaattggactgatgtattgtttactgctattgaagtcattcgttctcgttttgctcttgacagtggatcgctgtagccttgtgttttcattctaaaaaaaaaaagagaaa

SEQ ID NO: 16842 - DNA, 3139 bp, Zea mays
gtctgacaaaactcaagtcccaacatctacaccacatgagcaaacaccttcaaaaggtatgttagaaaggcctactcaattaccaatgcacatgtatcttgttttcttttattttgttacctgcttaaaatttgttattttgcaaatttgttttcttgtagttggatatagattgttcttgcagaatagtagagatataaaggattttcatgtgagataaatttgcaaagtttctttttacctgttgatttattgatctttgctgtagttttttaagaagtagcatgtactatgctttcattcagttgttaatctgtctcatttagcctatataaactcaagcaaaaagcgagcatatgcatcaaatcaaggatttggacatgtatggttaagttcgaccacaagaaatccaacactctaatcattagaatcgataatccaattataataaccgtacccaaccctgatttaaacaggcccttccttattttcccaagatgcggcaagcaacgaagactagttttctcttctggtagtcaagcatcatttgctacgaatatctcaattactgtccgacgtatcggatgacagaggtctttgacggtgcatcggctgtgttcacctggccgtcaaagaacatcaacagatcaatcaactttttcctgaattaaccagaatcccaagcttcaacgcagcaaaccgcctcagcgttactcgaatggtaagtacacagcgtgcggccagcgctcccattcagatcgaccgacgcaaagcaccagtcaaagacccgaacaagtaaagttcaacgcagactttctgctcccagactctccaacacgttcacacagccaaacgaagacaacggctcatggagcgcacggttccacacctgaaagcgctgccgtgcatgcacaccatcgtccacagcccacgccccacagtgtactgctatgctacagatcctactcttggagccaaccgagacccaacggcgccattgtagaccaggaaaagctcgcagcatccatctggcggtctgcccgtttagacgattattgcttattggagcaggagcgttcgatgatggagagcgagcagcagggcacggcatgcagacctctctccttccccgctgctgcagcagcagcaatgcacaagggaaacagaggaggggaacaggcaggaaaaaaggtgacagacaaacagaggcgcaatcatggccaccccgcacggcgattcccacccacaggaacggaacaagcgcaagcgtccacggccccatatccttggactctcccacgcccccttattctctcacctgcacgcctcccacttcctttctcgggcgacgtgacattccctccctactactactactcccaggtcctctctcatagcagcagtagagacgtggagtagtgtttcttggtttccaatcagcccataacatcctgtgccatagcattagcatcacataatggaagatggaagaattggcgcaacttgcaagacgaccacaagacgacgccctgcgccgtgacaaaactttgcagcttatctgtgcgcccctccccgcggccgcctccacctcaagcagcaaaaccccacacagcgagcgagcgaagtagacagacgctggctgagatacacacacacacacacatcaactgaaaacgaggagtttttgttcatcatgggggtacagagcagcgagggccagatgatgttctcctccatcgccctgctgcagcagaggttcagggagctggagaggatcagggagaagcgggaggagaggctactccacgtgctcgccccgcgccctgtggccaccacctccccgagggagatgcccgtgaagtggttcttccatccggagctgctctacccgtgcaggccactgcgggacaccgctgccgcctccttattcccggcctgtgaatgcaaaagcttccagctccacggcgataacgaccccatcacggtggagctgtggcccagtaagacttacaactacaaacatgtctctggtgaagtcgacgtcgacacctcgctgcacctctagactgctactgctactaaaaaaatgttccaatgccctataaacttctgttaaccacttggtgttgctctcgcagttttttttttggtagcctactactatgttctcttcttctgttgtaacaaggggtattaggaggggtgacggtgtgctgtaattattaccagtagtacgatggtcttgcagttcctttcttgtcatcttttggcactagaactgcttgcatcttccaacaaggcactgttatcatccgagtatgagagtaactctgcagggcaaccattctctgttacgtctggacactcgtcatcattggaggaatcatcagagcctttcttcttccgcttgatgatcttcttggaaatgaggcggttcacacccttgttgtcgacatcaacacattcactgcttattggcttgaatagaactttgcccaccttccttgcattagcttccactatctattagcaagcgacgccagttaaaggtagtaaaaacaattacagaaactaatggcatatttctttctacaagaaagaacgaaaattttggtgaattgcgaaacagaaactatggattcctagggatgcagcaatccaactacatgggaaattgggagttgcacttgttcgttttgctctcaattcacgtggattaggtgggatcgagtgggttttaatcccgaacaagtcaaaaaaattcataaattttaccgatctcatccaatccacatgggatagaaataaccgaattatgccctattaagggcgtgtaccagtaccaacataattcagtattgagttctggattgacaattgactagtaccttttcttatctattagatttttgtatactttctttttctagcttcaaataaaaaaacaagtctaaaagaagactagcattagcaccacataactgaagtgtcgacatgttatagaccaaaagcatctaaaaaattatatagcacgaaaagtattaacgtaacagtgtatttctctcatgtaaatggacatgtcccacatatactcagctatgcacacctgaaggccatcatcaagtgttaacgtcctgca

SEQ ID NO: 16843 - DNA, 641 bp, Zea mays
ttttttttttttttggggggggaaaaatatttttattttattgtttggcgcaacttgcaagacgaccacaagacgacgccctgcgccgtgacaaaactttgcagcttataagtaggcgcatgcccaagaccaccaccacctcaagcagcaaaaccccacacagcgagcgagcgaagtagacagacgctggctgagatacacacacacacacacatcaactgaaaacgaggagtttttgttcatcatgggggtacagagcagcgagggccagatgatgttctcctccatcgccctgctgcagcagaggttcagggagctggagaggatcagggagaagcgggaggagaggctactccacgtgctcgccccgcgccctggggccaccacctccccgagggagatgcccgtgaaggggttcttccatccggagctgctctacccgtgcaggccactgcgggacaccgctgccgcctccttattcccggcctgtgaatgcaaaagcttccagctccacggcgataacgaccccatcacggtggagctgtgagtagtacgatggtcttgcagttcctttcttgtcatcttttggcactagaactgcttgcatcttccaacaaggcactgttatcatccgagtatga

SEQ ID NO: 16844 - DNA, 1140 bp, Zea mays
tccaccgcggtggcggccgcccttttttttttttttttttttttttgctcacatttggaaactattatgatctgaaatgttaatataatacacagttttgagttgtacaccatatcagctaatatgggagcatgtttaccatcatacattccagatgccggatagcatagagaagacggtgaaatcgtagtttttatttaagactagtcttattacaagatcacatgaattcaggacaattttattttatacagtagctcacaaattcagaaggtcaggcctgatgcagtgatgggagctgtctgaggtcgtgggttcgcagcagctggggagccctttctccagaaggtactcatgtggggagccttcggcactggatttgcccacaagtagctcacgaattcattacttcatgacaccactaaatgacatgaaagtgacaccttttccagacccccttcatccagtgcaataacatagctcatccattcattcctcttgaacttgattggcatccatatttgggatctccacttcatctggaaagcagccttcgatgaagtaggtcgagcacgggtacccgcgggaggaggcggcgacggcgcgggcctcgtcggcagagagtccccgcctcggcgctgccgaggagcccatgaacccgccagcgtggccgataagcgcgagaacccccagggccgcgccggcgggccggggcggagcgaagtaggatgtcccgggccggaagggcgcccagtcgggctcggccatccgcgccatggcgctgtcgatcgcctcctccaaccgccgggactgctcggaggcgtccgtcgcaggtgcagaaggccccgcggcgtcctcttcaagaaccttcaccgcgcgccggcgagtgtggttgtgccgacggctcagaaccacgccgggctggggctgggccccgaggcggcgcgccaggaccgctgaccgggagcagagcacgcgcgccatggatgccttcaagtaacgcgtccggagtcagagctggcgcccgggagacggagcagcagcagcctgtgagcgcttgcgtccgacggcgagctggtgtgcgcgtcgcgaagtttgggggatcgttgggatttcccggccggcctcgagggtcccaat

SEQ ID NO: 16845 - DNA, 3947 bp, Zea mays
cccacttcggccttcccttcgcctccccgtccgtccgcccgtccgtccatccgccgcgcgctaaacttgggggaggtgcccagctggctggttcgccgctcggcgaacggtgatcgcgtggcccgtggcgacgctggggaggacggcggggggcacgcacggcacggccggctggcatgggttccgggacgtggcgcaaggcctacggcgcgctcaaggactccaccaaggtcggcctcgccaacttcaacagcgagtacaaggatctggacatcgccattgtgaaggcgacgaaccacgtggagtgcccgcccaaggagcgccactttaggaggatactcttcgcgacgtcggcgcaccggccgcaagccgacgtcgcctattcgatatgcacgctggctaggaggctgtccaagaccaagagctggatagttgcactgaaaacgttgatagtgatacacaggctgctcagagaaggcgacggcacattcaaggaggatttcctcacgtattcgtatagaggaaacgttctgcagatcccgcagttcaaggacgactccagcccattagcttgggactgctccgcctgggttcgcacgtacgcgctctacctggacgagcggctcgagtgcttcaggatcctcaagtacgacgtcgaactagatcggctgctcaagttaccccatgcttctggcaaggcgcacagcagaacaagatccctgccgctcgcggaacttctggtccagttgccagcgttgcagaagctgcttctcaggcttatttactgccagcctgaaggtgcagcctgcacaaactacctcgtacaatatgcgttggctcttgttttgaaggaaagtttcaagatatactgctcaatcaatgatggcatcatcaaccttgttgacatgtattttgagatgccgaagtatgatgcaatcaaggctcttgaaatctataaacgagctggtcagcaggcagaaaaactctctaacttctatgaccactgcaaacttcttgagctggccaggactttccaatttcccactctgaggcagccgcctccttcatttcttgtgacaatggaagagtatatcagagaagcaccccgtgctgatactgagagcaagagtttggaaaactatgaagagaatcaacctagtgataatgaagcagcatctccacagggagccgagaaaccagtggaagatgaaaagtatgaagctgcagagcctgaagcggagccacaaccatctgctgatcctttggaagaagcagtggaacctcagccacgggcgactaccgggaatctattaaacttggatgaagaagtaaaccccatgattgcagaccttgaagcaagcaatgcactggctcttgctattgtagcaccaggtaatgaaaacaagatggcaacttctcaagacttatttgcccttgacaagactggatgggaattggcactggttactgcaccaagtaaccacacaaatcaacaagtggacaatcaattggctgggggatttgacaagctattgctagacagtctttacgaagacgaggcaaggaggcagcaaatagccagtgtgacctacactgggagtactgcagcaaacccatttgaccacaatgatccatttgccatgtcaaacagctttgcgccaccatcaaatgtgcagttagctatgatggcagagcaacagcaatattaccatgcgcagcagcagcagtattatcagatacagcagcagcaccagatggtgatgctgccgcctcaaacataccagcagcagtcgcagtattctgccccttctcaatctgggttatccaatccttttggtgatccattcagtagcctcgtcacgatggctaatccaccaaagcaaagcaattcaaatttagtctgaattgcatttttttttgtgtctattgctcccactaattcagaccatacacaacattgacaattttgaggagcaacttgtacagttcaaaaactttgaatactgtatcttaacgatgcgctgtactgcagtagtgctcacatttggaaactattatgatctgaaatgttaatataatacacagttttgagttgtacaccatatcagctaatatgagagcatgtttaccatcatacattccagatgccggatagcatagagaagacggtgaaatcgtagtttttatttaagactagtcttattacaagatcacatgaattcaggacaaatttattttatacagtagctcacaaattcagaaggtcaggcctgatgcagtgatgggagctgtctgaggtcgtgggttcgcagcagctggggagccctttctccagaaggtactcatgtggggagccttcggcactggatttgcccacaagtagctcacgaattcattacttcatgacaccactaaatgacatgaaagtgacaccttttccagacccccttcatccagtgcaataacatagctcatccattcattcctcttgaacttgattggcatccatatttgggatctccacttcatctggaaagcagcctgcatatatgtcgatactccgtgtaaggcagatgctatagaaactgttagagtatattaggcatgttataatatattaggcaactactaatatggttggtttaggattgattataatcctggataacatttcttgtatctaagataacattccttgtatctaagataatcttccttatctctaggatagccttcttgtcttcaagtcatgtactcctatatattctctctaaagacttgttccatatggattgagtaggtttagatccatagcaagtcaaaatacaactcaatcagttcaatccacatcgaattgaaataaccaaacaaggcctaaaggctcgatgcaatacatccaacatattatacgcaatctctccttgcagaaacaaagcataacgataaaatgtctcgaaattgttctgatttctagaagttcttatgcacgcgtttcagttcagaattgagcacatccgaatagcgaaatggagatcccaaatagtcagataccttcgatgaaataggtcgagcacgggtaaccgcgggaggaggcggcgacggcgcgggcctcgtcggcagagagtccccgcctcggcgctgccgaggagcccatgaacccgccagcgtggccgataagcgcgagaacccccagggccgcgccggcgggccggggcggagcgaagtaggatgtcccgggccggaagggcgcccagtcgggctcggccatccgcgccatggcgctgtcgatcgcctcctccaaccgccgggactgctcggaggcgtccgtcgcaggtgaagaaggccccgcggcgtcctcttcaagaaccttcaccgcgcgccggcgagtgtggttgtgccggcggctcagaaccacgccgggctggggctggggctgggccccgaggcggcgcgccaggaccgctgaccgggagcagagcacgcgtgccatggatgccttcacgtaacgcgtacggagtcagagttggcgcccgggagacggagcagcagcagcctgtgagcgcttgcgtccgacggcgagctggtgtgcgcgtcgcgaaggttgggggatcgttgggatttcgcctccgagccgggggggggcgagcgtcggtagatatagcatttactcaagggcttttccgtaaaaaagtcagtagccagctagccgactagtcggtccagaatcggctgcgtgtcccacactcacacgtccgttttggacggaaaccggcaaaccgcaggctgtgtccgccggtttatctcaggggtatttccgtaataatgaaatatgtacgaggggttattcagaacattagctaccgcccacctctagcttaggggtctgtttggttgggctgtggctgtgaaaaaagttgctgtgggctgtgagctgtggaaaaagctgt

SEQ ID NO: 16846 - DNA, 2392 bp, Zea mays
ctcactagtcccccccccccccccccccgccggcccgggactcaccgctaggtttttcctcctgccgccgcctcccagaccgtctcctccgccccagccgggatgccgacggtgagcgtcggccgggatcgtctcttggctgccattggtcgaacctacacacaggaggagttcgaggcgctctgcttcgagttcggcatcgagctggacgatgtgacgacggagaaggctattatcaggaaggagaagcacctcgaggacgacagtgaggtggacgaagatgacgaggtcatctacaagatagaggttgccgccaacagatatgatttgctatgttttgaaggactagcaagagctcttcgtgttttcactgggactgaagcaagccctgtattccaagtttcatcaatccctcggggttcaatgcttcagatgcatgttaaaccagagacttcaaaaattagaccgtacatagtttgtgctgtcctaagaggggtaacttttgatgaagcaagatacaacagcttcattgatcttcaagacaaactccaccaaaatatctgccggaagaggacactcgttgctattggcacccatgatctggacactctgcaaggacccttctcatatgaggctctaccaccgaatgaaatcaattttgtcccattaaagcaggagaaaagcttcagagccgataaactgatggaattctataaatcagacatgaaactgaagaaattcttgcatataattgagaattctccagtgtacccagttatctatgatagcaacaggactgtattatcattacctcctatcattaatggcgcacattcagctatcacccttgcaacaaggaatgtctttattgaatgtacagctactgaccttaccaaagcaaatatagttctgaatacaatggttaccatgttctctgaatattgtgagactaaatttgaagtggaacctgttgaagtgatacatcatgatggaaggaaaacagtttaccctgatctttcatgttacaaaatggatgttttgttatctgacattcttgggcctattggcatctcccaggacgagaaacaggttgtctgtcttttgaataaaatgcaactgcaagctgaaagtcactccttgaaaggggaggctcgcatttcagtgtctgttcctccaacaagaagtgatattctgcatgcccgtgatttgtcagaggacgttgctattgcttatggattcaacaatgtgccaaaatcaaagccgaagtgtatgacaataggaggaaggcaaccattaaacagattctcagataaaattcgtgctgaggttgcaagagctggttatatggaggtgctcacatttatcttgtcttcacacgaagagaactttgacatgttaaacaggacagatgacaaaagtaaagcagtcattattgcaaaccctcgcacttctgaattcgaggttgttagaactagcctgatgtcgtgtttattaaaaacactgaaacataatatagaccatccaagacctataaagatttttgaagttggtgatgttgtgatgctggactcgtcacgtgatgttggtgcctctaataatcgcaggcttgcagctttgtactgcaatagggtttctggatttgaggaaattatgggattggtggatagtattgtcaaagttgtcagagctccacatgttaactttggcgagaattactatgtacctacagatgaacctgagttcttcccgaaaagacaatgtaaaattgtgacaagtgatggcaagcaagttggctacttaggaattgtccatgctgaggtcctaaggaaatttggcattccggatccctgcactttcgttgagatggacctcgaagcactgttgtaatgcagtcaacctgaaacaaaggaatgcttgaagctgatacctcatacctgccacatattggttttgttcgtaagcatggtggggtaccagcaagaagtgcatattacccaagctgcagtatctcgatgtacttctcaattgcattggattttgctgtgggaaaaaagggtacaacgatacagcaaatacccagcctaatttttgtgttagggattatgtttgcattgtaagggcttattcctatccaactttctatgaaaagtgtaccgtacatccttttgtaaaccatcgcgcgtccaaaagttatttctcaactcttgtcacctccacatgaggtcaccatgatgtaaagcaggttcagaatattagacctctaatatctccttgtgtttgtgaatggcattaaaatttgacattaaggattgtttggtttataaagactaattttagtccttttattttaaaaaaaaagcggccaaaaaaaaaaaaaaaaaaaaaaaaaaaa

SEQ ID NO: 16847 - DNA, 2807 bp, Zea mays
  misc_feature (2787)..(2787): n is a, c, g, or t
  misc_feature (2807)..(2807): n is a, c, g, or t
gcacgagaccattacctagaacatcctaatcaaaaaaaaaaccataagaacgcacgcgagtggccagtgggaaccaggaaacaagaaagtgagagggggaagctgcggccgacggccgagctcttgccgtccctatccacccctctcgcctttcgctcttgcctttcgctccgtccagccgccgcgtaaaatccgcggaaccagatgcccttatccgccctctgatcgaatccggccagaaagcccggttctttgtcgtcgtcctcggcatcgccgacgaccttgatggcactggaggcgggtagtagcggcggcggcgggaggggatggggtggcgggttccgaagtctgatgcggcggaagcaggtggactccgatcgggtccgcgccgagggccagccgcagctcgccaaggagctcaacgtgccggagctggtcgcgatcggggttggttccacagttggaccaggagtatatgttcttgttggaacagttgctagggagcacgctggtccagcattgacaatttcatttctgatagctggaatagcagccgcgctttcagctttctgttatgctgagcttgctagtcgttgcccctcagctggaagtgcttaccattattcatatatctgtgttggagaaggtgttgcctggttgattggctgggctctagtgctggaatatactattggtgggtctgctgttgcccgtggtatatctccaaatttagccttgttttttggaggacaggatagtgtgccatggattttagcacgccatcagcttccatggtttgatatcattgttgatccctgtgcagccgctcttgtttttgttgtcactgttttactatgtgtgggaattaaagagagttcatttgcacaaggagtcgtaacagttctcaatgcctgtgtaatgatatttgttattgtagctgggagttatattggcttccaaataggatgggtgggctacaaggtttctgacgggtatttcccacatggagtaaatggaatgcttgctggatcagcaactgtcttctttgcatacataggctttgatacagtcgctagtacagctgaagaggtaaagaatccacagagagatttgccattgggaattggagttgcattggctatttgttgtgcgttgtatatggctgtttctgttgttattgttgggctggtgccatatttcgccatggatccagatactcctatttcatctgcctttgcaaggcatggaatgcaatgggctatgtacgttgtgacaagtggtgctgttcttgcactctgctcgaccttgatgggctcacttcttccacagcctagaatacttatggccatggcacgagatggtctgttgccatccttcttctctgatgttaacaagcaaactcaagtacctgttaagagcacaattgtgactggcatctgtgcagctgctctggcttttgcaatggatgtttcacagttagcaggaatggtcagtgtaggcacactccttgcattcaccgtagttgctgtctcgatcttgatactcagatatgtccctccatatgaggtccctttgccgccttctatgcaagaatcattccgtttgaaccaggaatgtgatgaggaaagggataggggtcttcttggagttgggaactgtaacttatctcagacaaaggatgtgattgtggtagtagaatcagtgaaggatcctctcattgataaaagactgcataaaggcaagatggatgagacgaagcgccgaaagatagcctctttaagcatagggtctgtgtgtgtaggggttctgatccttgcttcttcagcctctgccacatggttgccttttctcccgatatgtattggctgcaccattggagttgtgctccttctggctggcctcagcttgctctcctggatcgaccaagatgctggcaggcactcttttggtcattccggaggattcacatgcccttttgttccagtgctaccagttttgtgtatcctgataaatacgtatctgttaataaacctgagtggtgacacatggatgagagttggcatatggctgctgctgggtgttcttgtgtacgctttctacggacgaacccacagctccttaatagatgttgtctacgttccggcagcgcaagctgatgagatatacaggagttcatcaggatatgtatcatagaaaagaacagctgcagctgcagtcatgtgacacgatagagccacagaaagaccgagcggatgacagttacttaaaaggtggttgtccatcagctgtagaaaattggttatcagccggggaagacggaactgactgttatttctttcatgctcggctagcatgatctcgtggatgcaacttggcaagatatatatgctgctcacgagccaggtcaatttatacattgttggagtgtgtgtagatgtggtgtatataaaaccaactgggtggagtatgtgatgcgatacataataatttgtctaattcatgtaaaagccctttgtgcggaaatgtgagtgcatttaaaggacctattgaaaacagtacacggacggcaaaagaagccaccttttttatatatcatgtatatgtcgtccacaaacattctcttcatgtgtcatgtatatttgaccttggtcaggggttcatgaatgtactttgtttcttggtgtggcttttattagggataaaaagtccactacaaaaaaaaaaaaaaaaaaaaaaaaaaaaaaaaaaaaaaaaaaaaaaaaaaaaaaaaaaaaaaaaaaaaaaaantaaaaaaaaaaaaaaaaagn

SEQ ID NO: 16848 - DNA, 1634 bp, Zea mays
tgttattgccgctggtagttatattggcttccaaaaggatgggtcggctacaaggattctgatgggtatttcccatatggagtaaatggaatgcttgctggatcagcaactgttttctttgcatacataggctttgatacagttgctagtacagctgaagaggttaggaatccacagagagatcttccattgggaatcggagtagcgttggctatttgttgtgcattgtatatggctgtttctgttgttattgttgggctggtaccatatttcgccatggacccagatactcctatttcatctgcctttgcaaaacatggaatgcaatgggccatgtatgttgtgacaactggtgctgttcttgcactctgctcgaacttgatgggctcgcttctcccgcagcctagaatacttatggccatggcacgagatggcctgttgccatccttcttctctgatgttaacaagcaaactcaagtacctgttaagagcacaattgtgacaggcatctgtgcagctgctctggcttttacaatggatgtctcacagttagcaggaatggtcagtgtaggcacactccttgcattcaccgtagttgctgtttcgatcttgatactcagatatgtccctccagatgaggtccctttgccaccctctctgcaagaatcattccgtttgaaccaggaatgcgatgaggaaagggacagggctcttcttggagttgggaactgtaccttgtctcagacaaaggatgtgattgtggtagtagaatcagttaaggaccctctcattgatataccgctgcataaaggcaagatggatgagacaaagcgccgaaagatagcctctttaagcataggatctgtgtgtataggggttctgatcctcacatcttcagcctctgccacatggttgccttttctcccgatatgtattggctgcatcattggagttgtgctccttctggctggcctcagtttgctctcctggatcgaccaagatgctggcaggcactcttttggtcattctggaggattcacatgcccttttgttccagtgctgccagttttgtgcgtcctgataaatacgtatctgttgataaacctgggtggtgacacatggatgagagttggcatatggctgctgatgggtgttctcgtgtacattttctacggacgaacccacagctccctaacagatgtcgtctacgttccagtagcgcaggctgatgagatgtacaggagttcatcaggatatgtatcatagaaaagaacagccgcagttacttcaaggtggttggtcattcagttgtagataattggttatcaaccaggaaagaggggaattggctgttatttctttcatgcttggccaacaagatctcgtggatgcaactttgcaagatatatatgatgttcacgagcctggtcaatttacacattgtttgttggagtgtgcgtagatgtggtgtatataaacccagctgggtggaatgatgtggtacataatttatgcaattcatgtaaaagccctttctacctttctactgaaatgggagagcatttaaagggcatattgaaacagtacatgaatggcaagagaagctaccttttttataaaaaaaaaaaaaaaaa

SEQ ID NO: 16849 - DNA, 1610 bp, Zea mays
tcagctacgtaggcccccccccccggctggctgcccccgctgctctcctctcctccgagatcccggcaccgtcctgtcccgccgcgccgacagctccccgcctagactgctgcacgcgcggatctcgcgtcgccttccgcccagctgcgatgcatattcgcgccgccgccgccgccgccgccgcacttgtcctcctcctcgcgctctccgtccccgtctccgccgccgaccaggatgctaatggcgctgccgggaatggcactggagtcggcgccgaccgcctggaccgccgcaccaagatgttcctccaccacacggtgcgcgcggccgcggccggggcgcacgacacggggctggggctcctcgacgccttcttcgccagcctgtccatgatcgtcgtcagcgagattggcgatgagacgttcatcatcgcggcgctgatggcgatgcggcaccccaagtcgacggtgctctcgggcgcactgtcggcgcttgtagttatgacggtgctgtctactggactaggcaggattgttccgaatttgatatcgaggaagcacactaacagcgcggcgacagtcctctatgcattttttgggctacggctcctgtacatcgcttggaggtcagattccaaggcatcacagaagaaggaaatagaagaggtagaggaaaagctggaagcaggccaagggaagtcaacatttagacgtgttttctcgagattctgcactcctattttcctggagtcatttgtgttgaccttcttggcggagtggggcgaccgaagtcagatagctacaatagcgctggcgacccacaagaacgcggtcggagtcgctacgggagcgaccttggggcacaccatctgcacgtcgatcgcggtggtgggcggcagcatgctggcctccaagatatctcagggcacggtcgccaccgtcggaggcctcctcttccttgggttctctctttcgtcgtatttctacccgccattgtagtaccaccctgtcatgcgagccccctatttgtttcttggccagcttcctcattgatccagtgacccttgtcctgcggcattttttttcctgtactagtaaagcatacatggatatgtgtagtaggtagggatatatacgatcattgccaatgtataccatacaagtcatgtcatggattcaaaaacagacggaagagctttttgtcacgaattcaaaaacagacggaagagcctttgtcacgaattcaaaaatgtaacctgtatatacacatcgtgtttataccatttcgtttcctgcgtgcagcgcgtatgcaccaacgccgatggcaagctgcaagccaggtagtactagtagttgaaccaccaccgccaccggccgatgatttttccgacgtacgggtggctgtgtggctttctccggcacatggtggggaacatgccaagcaagtgtctgcactccctgagcagcaggtccccgatcagcgtcttctcctgccgctgctggtgggcggccggagacggagccagggacggagctagtgccggagccggaacgggaacgggagccggactcggacctggaccaggacccggagccggccccggaccagca

SEQ ID NO: 16850 - DNA, 2188 bp, Zea mays
cggccgggccgggtttgcaaaaatgtgcctatttgtatgtttaatactataaaaatagagattgtatattttatctatttatgtttttcttatggacaaaagagataaaaatgggctgtgaaatgaataggggtaatctagtctatctatttgtggtgtaagcaataaaagaatgcaaaatatagatggagtgttgttttctaaattaatttggtgaaactggtgttgttctacgaattgcttaaaaacagatgttattttctgaacttcttctcaaaccggtgctgttttgtgaattctccactttagtacagggactaaagtttagtccatactctatttggttctatgacctaaaatatttataaaagaattaaatgaattataagagaaccaaaatagtcctttgtattcttccgtcattagttcaactgaaataaaataggggcaaaaggtggaattaatatgatttagtctgttttagttatttcttgagagattagagactaacagtttaatcttgttttagtcccaccaatggcttaatctctctatcttttctctcacgattgttttttttttcacaaagaggctccaggagaattaccaagaagcacaaaatgccaaaaagcagaggacaatccaagtgatggacatcaatgacataccaaagccgaagagcagaaacgctttcatccgcaagagcggcagcggtgggctcccggcgaggcaccgatagcctaacctcctccgtcggctggatatctgcgacacttgcgaagttgtgcctagaaccgcaacgggaaagaaaaagaagcaaacggtttcttgttctttttttccctgtaccttgactgcctaggtttacctccagtgtaatattgtcaggtacataagggtgaaatgatatgatgtttctcgaggaaaaagaaagaaattagtcactgtttttgctatgctttggttgctgttattgctgttggtcagtgctggatatatatatgcataacatgtgtgcaggcttgatacatcaaggattcaaggtcagcggttttagcacatgggattggagtcgcaaactggcattcttatcttttatttctgtcgcgcttttgacagttttgcccctccagcaccaaaagttcacttgtactctttgggtaaagttgaattagcaatccgtatgcaacaaagcagacagcctgattggctgtcatttttgtggcggtggctgtatcgttgtgcggtgccttggttccctgctggctgctgtagcgccttgacttctctgtagcaggttcacgatccttttgacaactgccagccacacgcacggcaatgcgaggtcgacggcgttgggcaagctgggcatctggccggggacacgacacgatctaggcacaacaaggcaggacccattcaagcacaaccatctagacacatcaccatcacggcacggtctattaaatcagaaccagctatgggccatactgtgcccagccagttgaccgagccattagtctacgacacaggccacaacaatctatatctatactactattaagactgcactgccccgcctaacaactgcccgcccgatcccacagcgacccccgccaaccgcctgccgcgacccgtacgccgcgaccctcgcccgccaccagccgcaaggcgcgaacatcacagcatatttacagacatcatcacatatcaattcacttcgaacacgcactggcaattgccaaatggagaagaaaagggaaggaacgcacgaacagaggaggagatcgcctccgatgtgtaggaagagagagagaggaagtcacagagcagcgaggcctagaaagtcgacagcggacttggccatgatggcggtgaactcctggaagctgatgacgccgtctccgtcggtgtcggcctctttcatcatgtcggtgagctcgacatagcagatggggtggcccatgagcgccatggagcgcgcgagctcggcggcggagatgaagccgttgccgtcgcggtcgaaggcgcggaaggcctcggcgagctgcgcgtggtcgacggccacggcggggcggcagggccccaggagcagcggcgccagggaggagagctcgtcgaactccacggtgccgttgccgtcggcgtccatggcggcgatgagcgtgtggatctcgtccccggccgc

SEQ ID NO: 16851 - DNA, 1598 bp, Zea mays
gattgacgctgagcgcagccaaatccagccagcgataggaatatcgccaagaattctaccgtctgcgtctgcccgtcttcctctctctctctctctctcctctccctcattctggatccaccgccgcagccttagctgggtccgtcgctgtcgctccgcctcccgctcgcttgccgggcccgacacgcccgccaccgcctccgctttgtctctccggcgatccgacgccccacccggcgtctgtgcagagcagtcgtgaggagttctctgttgtgggctgcccggcgatggaccggggcgagcgtctcggccgcgcgctggacgccttcgggggcaacctgtgggcgctggttgacgcagcgctggacgcggccgctcgcgaccgccccgacgagcttcgcgcgcgccgcgatagcatcgtcgagcgcctctacgctgccgccgcgggctgtagcaactgcgccgggcgtccgccgtctgttgccgctttagcggccgcggggctggaggaagaggacggcgaggaggcggctccggcttctccgtgggcggaggctgacgcgcaagccggtggcgcggaggcacagaccgaggtgctcggcgccggcgagcctgatctcgagagcaagatcgtggccatcagggacttcttggaggaccctaatcagcccgagaacgagctggtgagcttgctgcagaacctggcagacatggatgttacctacaacgcactccaggagactgacatcgggcggcaggttaatggtctgcgcaagcatccttcggccgaggtcaggcggctggtgaagcagctcatcaggaagtggaaggagatagtggacgactgggtgcgcctggacaattccggcggtgacggcagtgcctctgttatgacagctgatggtgactccccacataaaatccaaggcagaagccaccaaagccctcgggtttcggggtttcagtattctccaagcccacagaggtttaatggttcaacttcagagatggctaacaatgggtttgagtcaacaatggatgcgaagcgtagggccagccctgtaccagcacatcataactccaggcagatgaacaacaatcatcattctactactattaccaccagcacgtcatctgctccagctaaagtgacaagggagcaaaagcagagtcttgtggaccttgacaggcttgattctgccaggaagaggctccaggagaattaccaagaagcacaaaatgccaaaaagcagaggacaatccaagtgatggacatcaatgacataccaaagccgaagagcagaaacgctttcatccgcaagagcggcagcggtgggctcccggcgaggcaccgatagcctaacctccttcgtcggctggatatctgcgacacttgcgaagttgtgcctagaaccgcaacgggaaagaaaaagaagcaaacggtttcttgttctttttttccctgtaccttgactgcctaggtttacctccagtgtaatattgtcaggtacataagggtgaaatgatatgatgtttcccgaggaaaaagaaaaaaaaaagtcactgtttttgctaaaaaaaaaaaaaaaaaagcggcc

SEQ ID NO: 16852 - DNA, 1082 bp, Zea mays
cattgggccctcgagcccgcccatcgaagttcataaagaaaacccaccttaacaaccgccgcgagagtcgccgcctcacctcagctcctcggacttggccgcgacgcgcgaaacctgaccgcaccaaacgcgggtcgcaatcgcaacgcaccgcgcggcgctgccgcatcgagagttttttttttgccgttctgcttttagggttagcggcccgccccggtgatcgcgggagaagggagcatctgtcgccggagtttggtgagtgcctggtctgccctggtgccctggcaccctgcatcggctgtcgttgtatttgtcttcccacgaccgactcagagctccctgatctcaagatctcgagagctgcgcgcggactttgggttggagccgtgcgtatcgatccaactccatccgccgggcaaatttgagtcaggaggaaggatatccatcggcgcttctgaattgggaggacgcagcgcatacgagattcgatgagattttgttgggacacagtttcgccgtgaattggttaggagccgatttggcaacagggaagctctcgaatgggagatccagcggcggcagtggcggcggaggggagatggtgagcggaagctttagccggagcacatccgcgcggctcacgtcgaggggtggagtcgggagcccgcgtgtctcgacgcctggagccgtgcaccggaactggtggccgccggcgccgtcggggccgtcgttcgatcgcgtcgtcttggcctttttcctggcctccgtcgcgctcgtgctctcctgcgctctctacctctacgtattccggtacttgggccggagccgtgtggtcgcggagttcgccggcgagaatctcgagtcctgcgacgtgttcgacggcgtctgggtgccggatcagaggcaccccttgtacaacagttcgcagtgcccatttgcagagagggggttcaattgcctggccaatgggcggaaggacaccgagtacctcaagtggcggtggaagcctcggggatgcgatttgccgcggttcagtgcccgggctctgttgcagtggctgagagggaagagggtcgtga

SEQ ID NO: 16853 - DNA, 1917 bp, Zea mays
gagaggaatccaatcccctgcctcgctcggcgctccgcgccacctcgaatccagttcacccacctcctccgtccttattcgtttcttccgccgcaagccagacagagttgactgtcaccgtgttccctcggggtgggcgatggggtcgtcggagccgtcgtcgcgttccgtgcagaacctcgtgctgtacgccgccagcgccgcgctcagctgcctcgtcctcttggccggccttcgccacctcgatcccaaccgcgccgcctctcagaaggcgcagcagcagaagaaggagatcgccaagcgcctcggccggcccctcgtctccaccacgccctatgaggacgtgattgcgtgcgacgtcatcaaccccgacagcatcgacgtcgaattcgattccatcggcggcctcgacaaggtcaagcaagcgctctacgagctcgtcatcctgcccctgcgccgccctgagctcttcgcctccggcaagctcctcagcccccagaagggcgtccttctctatggcccgcccggcacaggaaagaccatgctcgccaaggccattgccagggagtccggtgccgtcttcatcaatgtcaggatctccaatctcatgagcaagtggttcggggacgcgcagaagctcgtggctgctgtatttagtctcgctcacaagctccagcctgctattatcttcattgacgaggttgatagtttcttggggcagcgacggacaactgatcatgaagccaggccgcttcggaggccccagttcatgtccctctgggatggcttcaccactgatcagaatgctcgtgtaatggtcctagctgctacaaacaggccttctgagctagatgaggccatcctaaggcgctttactcagatatttgagattggaattcccgtccagagtgaaaggaacaagatacttcaggttgtgttgaagggagaaaatgtcgagcctaatgttgattacgatcacattgcaagattgtgcgagggctttactggatcagacatcctagaggtgtgcaagcaggcagcattctaccctatcagggagctattggacaatgagagaaacgggaggaaattagataaacctagacctttgagacaatcagacttggagagagccttatcaacatctagaaagtgcaagaaggctgcaagttcaggactgcagtcacccttgtgggttcggccgacagattcagaagacgatcaggtacagaacgcgatccttgagatatctaagctgatgtctcgaatagttgagagcagccagtcagagccccaagagccttcttcaccttaatctaatcctttcgctagatcgcgtgaaaattctacagcggagtaaccgcaggcattacgtcgatacccttaggttttctttcgcagcttgcagagaggttcagcgtatatatatatatgcattaattcgttttgcttggcgagggcgcgccgggttttttgaagctaactgcagctgggagtatggtgtttaagtttattattcaagattgatgcccctgtgggctgtaagctacagcactccatagttgtccggcctacacttgcccttagtttccttgcattttatcttcagtttagctagtctagggtagcgaattatacattcatataatgcagaaaggggcccttccgtctcgtcatcatattcctaaacgtgcgttcatttttttgtctgatcgttatttacatgcatgtactacttttgcttttatcttatttttttaaatctccgctaggaaaagttctttcggagcacaaactatttaaactttatcgagattattactggtggaagcaggctgcgttgcgatatatccatgactccatgagctgttgtatgttgcacgcccgcccgtcatggcgtgtacgagcagctctgca

SEQ ID NO: 16854 - DNA, 1730 bp, Zea mays
aaaaagctaaagctgtgtaagcagcagaatccaatccaatccccagctcgcgccgccccctctaatccctcctccgcaaggcagacagaggccggcgttcactcgggcatccgcgggacggacggggagcaaagcctcagcggcgagtgcgggcgatgaggtcttcggaggcgtcgtcgcggctcgtgcaggagctcgtgctgtacgccgccagcgccgcgctcagctgcctcgtcctcttcgctggcctccgccacctcgaccccaaccgcgccgcttcccagaaggcgcagcagcagaagaaggagatcgccaagcgcctcggccggcccctcgtctccaccacgccctatgaggacgtgattgcgtgcgacgtcatcaaccccgacagcatcgacgtcgaattcgactccatcggcggcctggaccagatcaagcaggcgctctacgagctcgtcatcctgcccctgcgccgccccgagctcttcaccttcggcaagctcctcagcccccagaagggcgtcctcctctatggcccgcccggcacaggcaagaccatgctcgccaaggccatcgccagggagtccggcgccgtcttcatcaatgtcaggatctccaatctcatgagcaagtggttcggggacgcacagaagcttgtggctgctgtctttagtctcgctcacaagctccagcctgctattatcttcattgacgaggtcgacagtttcttggggcagcgacggacaactgaccatgaagccatgactaatatgaagacagagttcatgtccctctgggatggcttcaccaccgaccagaatgctcgtgtaatggtcctggctgctacaaacaggccttctgagctagatgaggccatccttaggcgctttactcagatatttgaaattggaattcctgttgagagtgaaaggagcaagatacttcaggttgtgttgaagggagaaaatgtcgagcataatattgattatgatcacattgcaagtttgtgcgagggctttactggatcagacatcctagaactgtgcaagcaggccgcattctatcctatcagggagctgttggacgatgagaaaaaagggaggaaattagataaacctaggcccttgagacaatcagacttggagagagccttgtcaatgtctagaaagggcaagaaggctgcaagttcagcactgcagtcacctttgtgggtacggccgacaaattcagaagacgatcaggtacagaacgccatctttgagatatctaagctgatgtctcgaatagttcagaacagtgagtcggaaccgcaagagccttcttcaccttaacctaatccttttgctagatctcgtgaaaatctgcagcggagtaaatgcaggcattacgtcgataccgttaggtttccttatgcagtttgcagaggttcaacatatttatatatgtattaattcgttttgcgtttggaacctccaccggtttttttgaagcaaactgcagctggcgaagtggcaagcgtgccctcgtgtttaagttgatcatttcaaaatacgtgccccctgtgggccgtaaaactgagaactctatagttgtctggtcaacagtcggtcttggttgcctctgtattttatcttcggtttgactactctagggtggcgaattacaacatacagtataatgcagaaaggttcccaaacgtgcttcggttttaagcggccctcgagctccag

SEQ ID NO: 16855 - DNA, 1249 bp, Zea mays
gcacgcggtcgtcactgctgaccacaggtggccggccgaacaaaccctcggcacgatcgcctgcctccataaatctccctcttcacttcaggcgaagaggatcaaccaaaccctctaatccatttcggcatttccaacgccttcgccctaccagccacgtcgcttcgaggccgatcgaccgagcagctggtggcaatggcggcggcggcggaggtcgtgctgctggacttctgggtgagccccttcgggcagcgctgccggatcgcgctggcggagaagggcgtggcctacgagtaccgcgagcaggacctcctggacaagggcgagctgctcctccgctccaaccccatccacaagaagatccccgtcctgctccacgccggcaggcccgtctgcgagtcgctcgtcatcctccagtacatcgacgaggcctggccggacgtcgcgccgctcctccccaaggacgacccctacgcccgcgcgcaggcgcgtttctgggccgattacatcgacaagaagatctatgacagccagactcggctgtggaagttcgagggcgaggcgcgggagcaggcgaagaaggacctggtggaggtcctggagaccctggagggggagctcgcggacaagcctttcttcggcggcggcgccctcggcttcgtggacgtggctctggtgcccttcacgtcctggttcctcgcctacgagaagctgggcgggttcagcatccaggagcactgccccaggatcgtggcctgggccgcgcgctgcagggagcgggagagcgtggccaaggccatgtccgaccctgccaaggtgctcgagttcgtccagttcctccagagcaagttcggggccaagtgatcggaagcactgcgtgtgctgctagcctgctatgccctatgcaggccaggctggtgctttgatctgctcgatcagctctatgcccatgctagcgttgcatagcgcagttgatgtgtgatgtgtctggttggttgtagctgctctttgcctggtttcgtacgtcagtgtaaggtttcaggttttcagtgtctggggtagctctgcgttgcccttgcccctgccccctacctagcggctcttgagctcttcggctcgccagcaataaagttgcagaggctttagctaaaagtttctgtattttttagttgacgattattggtccgttcctgtcgcgtggtgtgttctcccctagaaattccttggttttcttaaaaaaaaaaaaaaa

SEQ ID NO: 16856 - DNA, 1108 bp, Zea mays
gggtcattgggaccccccggccgggggaaaaaacctctatcctttcggatttccacgccttcgccctaccagccacgtcgcttcgaggccgatcgaccgagcagctggtggcaatggcggcggcggcggaggtcgtgctgctggacttctgggtgagccccttcgggcagcgctgccggatcgcgctggcggagaagggcgtggcctacgagtaccgcgagcaggacctcctggacaagggcgagctgctcctccgctccaaccccatccacaagaagatccccgtcctgctccacgccggcaggcccgtctgcgagtcgctcgtcatcctccagtacatcgacgaggcctggccggacgtcgcgccgctcctccccaaggacgacccctacgcccgcgcgcaggcgcgtttctgggccgattacatcgacaagaagatctatgacagccagactcggctgtggaagttcgagggcgaggcgcgggagcaggcgaagaaggacctggtggaggtcctggagaccctggagggggagctcgcggacaagcctttcttcggcggcggcgccctcggcttcgtggacgtggctctggtgcccttcacgtcctggttcctcgcctacgagaagctgggcgggttcagcatccaggagcactgccccaggatcgtggcctgggccgcgcgctgcagggagcgggagagcgtggccaaggccatgtccgaccctgccaaggtgctcgagttcgtccagttcctccagagcaagttcggggccaagtgatcggaagcactgcgtgtgctgctatgcaggcggcaggccaggctggtgctttgatctgctcgatcagttctatgcccatgctagcgttgcatagcgcagttgatgtgtgatgtgtctcgtttgttgtagctgctctttgcctggttgcgtcagtgtaaggtttcaggttttcagcgtctggggtagctctgcctctgcgttgcttgcccctgccccctacctagcggctcttgagctcttcggctcgccagcaataaagttgcagaggctttagctaaaagtttctgcattttttagttgacaaaaaaaaaaaaaaaaaagcggcc

SEQ ID NO: 16857 - DNA, 1935 bp, Zea mays
  misc_feature (1011)..(1011): n is a, c, g, or t
ctagatatctagattatgataatccataagctggactataatcttgggaggaaacaaacagcgcctgagtcaggtccatttatctgtcacattaattactttactgcaaggatttgtgagacatcctcctccaaagcaaaaagacatcatccttctacagtaattctggtcgacagccacagtaaaataatctttacgttggttatcgtcgtcagatctatgacagccagactcggctgtggaagttcgagggcgaggcgcgggagcaggcgaagaaggacctggtggaggtcctggagaccctggagggggagctcgccgacaagcccttcttcggcggcggcgccctcggcttcgtggacgtggctctggtgcccttcacgtcctggttcctcgcctacgagaagctgggcgggttcagcatccaggagcactgccccaggatcgtggcctgggcggcgcgttgcagggagcgggagagcgtggccaaggcgctgtccgaccctgccaaggtgctcgagttcgtccagttcctccagagcaagttcggggccaagtgatcggaagcactgcgtgtgctgctatgcaggcggcaggccatgctggtgctttgatctgctcgatcagctctatgcccatgctagcgttgcatagcgcagttgatgtgtgatgtgtctggttggttgtagctgctctttgcctggttgcgtcagtgtaaggtttcaggttttcagcgtctgggcctctggggtagctctgcctctgcgttgcccttgcccttgcccttgcccctgccccctacctagcggctcttgagctcttcggctcgccagcaataaagttgcagaggctttagctaaaagtttctgcattttttagttgacgattattggatcgttcctgtcgcttggtgtaagaatctctagaaattccttggttttcttatttgttgtgccgtcgaggagaccgcggtgagcttaatgtgcgcgcgcgcggtaacattttgctccnaactaccttggatgctgcgaatggccaacaagagtattcggcgcgttaaggacaatcgggttttgggaggacagatggatcatgagttcatgaccctttaaggccctgttcgttttgcatggatttgaggtctgaaacggtttatgatcggattgtttatttaatttatataatttttgataagttggaataaattctgatccaatcctaaacaaacgaacgggtcataaggattatttcctgaacctttttaatatcgtgtgtgaaaaaatgctttagccagagaggttatgaatgaaaacatatctaatctatcatttcatcgagctattgttggagtaaaacagatcgagttctggaatttatcaaatctattggcaactatttctttacgataatcgaatgacattcctagaggtgccataaagatggaattttctctattcgatcaatgcacttccttctaataaacacccctccatcaaatagaaataagctgctttggaaactaaaactctctctctctctcaaaattaaaagcttcatgtggtatttagggaggggcgttattctcactaatgataatatagttaaacacgggtgaaaaggtagtacgaaatgcagcttttgtaatcaaaatgagactatctagcacattttctttgattgctatattgctagaaatatttggagaatcattaactttgcattacaagaaaaccacacataggaaaagactgggtggcggcaatattttggtatatttgactttgtcgtaatgatggagtcttttcttttaaaccaataccttcaattatgttggttcttttcaggggacatactggtttagattctatagattattgtagaaaaaagaaaatcaactggaggtccttagtccttacaatgtgtcgagcattagcg

SEQ ID NO: 16858 - DNA, 1971 bp, Zea mays
cattgggtacctcgaggccggccggccgaacaaccctcggcacgatcgcctgcctccataaatttcccgcgccactcccgccgcgacggataaaccaaaccctctaatccatttcggcatttccaacgccttcgccctaccagccacgtcgtttcgaggccgatcgaccgagcagcagcagctggtggcaatggcggcggcggcggaggtcgtgctgctggacttctgggtgagccccttcgggcagcgctgccggatcgcgctggcggagaagggcgtggcctacgagtaccgcgagcaggacctcctggacaagggcgagctgctcctccgctccaaccccatccacaagaagatccccgtcctgctccacgccggcaggcccgtctgcgagtcgctcgtcatcctccagtacatcgacgaggcctggccggacgtcgcgccgctcctccccaaggacgacccctacgcccgcgcgcaggcgcgtttctgggccgattacatcgacaagaagatctatgacagccagactcggctgtggaagttcgagggcgaggcgcgggagcaggcgaagaaggacctggtggaggtcctggagaccctggagggggagctcgccgacaagcctttcttcggcggcggcgccctcggcttcgtggacgtggctctggtgcccttcacgtcctggttcctcgcctacgagaagctgggcgggttcagcatccaggagcactgccccaggatcgtggcctgggcggcgcgctgcagggagcgggagagcgtggccaaggcgctgtccgaccctgccaaggtgctcgggttcgtccagttcctccagagcaagttcggggccaagtgatcggaaacgctgtgtgtgctgctatgcaggccaggctggtgctttgatctctgctcgatcagctccatgcccatgctagcgttgcatagcgcagttgatgtgtgatgtgtctggttggttgtagctgctctttgcctggttgcgttgcgtcagtgtgttttcagcgtctggggtagctctgcgttgcccttgcccctgccccctgttgcatactcctagctctcgccgagtttgacaatttcgtcagttaattcagattattcagttagtgcagttcagtcagttagtgttcgtcagtctgttagctaattcagtttcattcagagttagcagtgagcgcacgccggaaatagctggacgtgtgcgcgtctttcggagctcacctgacgcacgctgcgttcgtgcggggtggagcgcgtcgtgcgcggcaagaacgtggtcgtgggatggcacggctgtagaagcgttcgtgccgtgcgtttcgaccttctttgtttttgatcagataagtccttcgatatatgaataaacgagtaacagaaaagtgcggccagttgggcagcccccaaaacaactctccacgactcctcgcgcatgtgtactgcgttctcaggattcatcaccggcgatcatctccgatctagtccaacaattggtatcagaaccaagttgactgaagaagcatgtcggcgtatggccgacgcgatgacggaggaggcagaaggcgctcactgtcgctggtcttccctcgcggacgacgcagtggcagggagatcatcgtcgagcgcatcatcgagcggagctcgacggcggccatctaccccatgctcacgaaaaccaactatgccgagtggtcacttgtgatgcaggtaaatctccaagcacaatgcctctgggaggcaatggacccgggaaccgacaactttcgcgacgaccggaacgcgctggcggcgcttcttcgcgcagtaccgcccgaaatgcaggctgggcttgctcggaaggcgactgcgaaggaggcctgggactccatcaagagcatccgtgtgggcgcggagcgtgtcaaggaggcaaatgcagatcgattgcgaaaggagttcgctgatctcgtcttc

SEQ ID NO: 16859 - DNA, 755 bp, Zea mays
cgagaaatttactccttcggctgaagacctgccaggtgccttcgagcatatcgaaggtgaaattgatgactgaaagggaattaggcttacacctagttcctaattaattttggtggttgaattgcccaacacaaacatttggactaactaagtttgcccaagtgtatagattacacaggtgtaaaaggttcacactcagccaataaaaagaccaagttttggattcaacaaaggagcaaagtgggaaccgaaggccctctggtctgggagcaccggactgtccggtgcacaccggacagtgtccggtgcaccagaggactccagctccaactcgccaccttcgggaatttccagaggcgactccgctataattcaccggactgtccggtgtacaccggacagtgtccggtgcgccatgggaggtcggcctcaggaactcgccagcttcgggaaactccaacggctagtccgctataattcaccggactgtccggtgtgcaccggactgtccggtgcgactccggagcaacggtctatctccgcgccaacggctctctgccgcgcatttaatgcgcgctctgcgcgcgcagatggcaggcgcgcccactcccggcacaccggacaggaggaacagtagctgtccggtgtgcaccggacacccaggcgggcccaccagtcagaagctccaacggctagaatccaacggcagtgatgacgtggcagggggcaccggactgtccggtgcgccatcgagc

SEQ ID NO: 16860 - DNA, 792 bp, Zea mays
  misc_feature (24)..(24): n is a, c, g, or t
  misc_feature (45)..(45): n is a, c, g, or t
ttagttccgaggaagatgacgagnccgactctggtgggatttctncgggctcgatacccccagtgtcatgcgggactttatgaccgcatgtgacctactgcctctccggttgctccgatagtagccacagcctcggtggacgagggctgtggcccaagtcgcgaatgctttctgaaaggggaattaggcttacacctagtccctaattaattttggtgggtgaatgacccaaccacaaacatttggactaactagtttgcccaagtatatagaatatacaggtgtaaaaggttcccactcagccaataaaaagaccaagttttggattcaacaaaggagcataggggcaaccgaaggcacccctggtctggcgcactggactgtccggtgtgccaccggacagtgaacagtacctgtccggtgcaccaggggactcagactcaaactcgccaccttcgggaatttccagggcgactcggctataattcaccggactgtccggtgtacaccggacagtgtccggtgcgacaagggaggtcggcctcacgaactcgccagcttcaggaaacgccaacgggtagtccgctataattcaccggactgtccggtgtgcaccggactgtccggtgcgactccggagcaacggtcatctccgcgccaacggctctctgccgcgcatttaatgcgcgctctgcgcgcgcaggtggcaggcgcgcccactccggcacaccggacaaggaacagtagatgtccggtgggggggggggggggggggggactagtgagctctcc

SEQ ID NO: 16861 - DNA, 2710 bp, Zea mays
  misc_feature (651)..(651): n is a, c, g, or t
ggccggccgggagtcagttcccccacctcatgactcctgaggtcttgctctagctctagctcgagcgcgagcgccatgaccacgtctcgcggcggtaaacagcggcagccgctcctccactctcccacgcccgcagacgccaacggtggcggcgcagccaagaggcgcaggttcgtctcgttcctcgccgtcacggcagctcttgtcgcgtcctaccacctcctcgtgccaaccaattcgtcgcactaccacgcactattcctctccctcggttccaacgccaccgcggcggcccacctacgcgcgctcaccctccgcccccacgtcgctggcaccgaggccaacgcggccaccgcccgctacgtgctccacgccttctcctccctctccttcccagcacacatcaccccttactcggttctcctctcctaccccgtccaccgctccctctccctcgccgcggcgcccggccttgccgccaggccgttctccttggtgcaagagacctacaaagacgacccgtacgctgaggccgccgcggaggtcctcccgacgtacttcgcctactcgggatccggctccgtcaccgccgaggtcgtctacgccaactacggccacaacgaggattatgcttacctcgcctcccgcggngtcgatgtcgtgggcaaggtcgcgctcgtgcggtacggtgacatccactgcgaggacatggtgcggaacgcgcgcgccgcgggcgccgccgccgctatcgtgtacaccgatgccaaggacttcggcgggagcgcggcgaagggggagaagcgcaagtggttccccgacgcgcggtggctgccgccgacaggcgttcaggtcgggaccctgtactacgggcgccccggcccccccgcgcccctggggccgtcgtgcgcggctggggacgactgcgagcggctgagcatggaggagctggacggcccccgcgtgcggccgggcatcccggcgctgccagtgtcggccagggacggggagacaatcctcaaggcgatgggcggcgatgtcgcgccacccaagtggcagggcggcgacggcgcgcccgtgtaccggctcggccccggcccggccgtgttgaacctcacctacattggaaacgagactttagcaacaatcgaaaatgtgtttgcggtgatagaaggaaaagaggagcctgacagatatgtgatcataggcaaccatcgtgatgcttggacatttggagcagttgatcctaacagtggaacagcagccatgcttgagatcgcggagaggctgtccaagctacaagcgaaagggtggaggcctagaagaacaataatcctatgcagttgggacgcagaagagtttgccctgatagggtctactgaatgggccgaggagaacatggacactctagcttcaagagctatagcttacctgaacgtggacatatcagtgtttggtcctgggggtcttatgccccgtgcgacccctcaacttgatgaattgatcaaagaagcaagtaaaatggtaccagatcctgatgaaccatctcaaaccttgtatgacaccatgatgcgccatcatccaccgatcactagagtggctggtgctggaacagattttgcagcatttgtccagcatataggagtcccgtcactcgacatgtcttatgggctgtttgaagaataccctgtttaccactcgttgtatgatgattatgtttgggtggagaggtttggagaccccttgttccacaggcatgttgcagtggccagcgtttggggtctgattgcactgaaacttgctgacgacgagatcatacccttcaattacgtctcttatgcctccgaactggaggagtgcacaaaagatatcgtagataaatgtaaaggatttcctgtcagtttctctcctttgcagaactccatcaagcagctcgagagtgctgccaccaaaatttacaaagagaagaagttgctgcaagcagaaaactggagcctaaagacaagtaagtatacgctgaaagtcagggagataaacgaccggttgatgatggccgagcgagcgttcaccaaccgagaaggactggtcgggagaccatggtacaagcatatgatatatgcatcatcggatcaagacgactgggggaccaaagccttccctggtatagtctcggccatggacaaggctaagaagtccaacacaaccgagacgtggcgactgctgcagcacgagatttacagggttgccagggctgtgtccaaggcttctgcagtcctggatggtaaactaacatgatgtgcacgtgcactgcagattttcattctattctacatagatcgaagtacccgatggattcagtttccatttcgtttcttgaaagctgaagtgcgtggaatacctgtcaggcatcattggataattgtgtaaataatgaagaaatatgctcaagttagtgtcctatgaataaagaatagtggaatcatctctcacgatgattcccttgagagtatcgccaatcattttaatgggaaatgcatgttgttctggcctccgctatctcggcgaccgctgcaaattgagcgtaccatctgtgtataaatatatctcatctatgaggtgtggagctaggctgaaactgattggcgcggtgtcggactggccgaattttttgcattttggtccttcataggaaaaaaattcacgtttggatcct

SEQ ID NO: 16862 - DNA, 1647 bp, Zea mays
gaaattggaactgacagtatttgggctcttcgacaattatgaaagatgcttggtacaacaaagttacaactattgtttctaacaagatcaacacacaccgagtacaagaacattgatccataaaacaaataaaaataagaaaatgtcgattcttaccggtgcatcaaaattttggtcccttgttcctgtaccaataccaataccacgtgtgttgcgacgtcaaataagaataaatattataatttatcttagcaaaaaggcctagaaaggtatgagttgaaaaggactatgatacccttttttatagctcgctgatcgctcgtcctcctttatcaggcagaatggtactatgtgagagcgttgttctgcgtgtgactttctctcatgtctttgggtactttgtggcatatctgtggggtaacaacccacttttaggggttcaagttgttttcacggcttatcaatggggtaacgaactattcagagagaaataaacatacatgtttcacgtgtgacacaggacaatcatcaaacttatgctttataatattagagaatagatatggatagactttatttaataaaatataaaaaatgtgtgttttattattagttaggtaagtgtgaatttggactggaaccaacaattataaagacgggaggggagcaactcagaaaggagggcacaggttaattagctttgtaacatctttgtcgtgcggcttctccagtttactacttcgcatttcagcttcgccactttggtattataggaggcgccaatgccagattgggactgttatactcacgttctcggtaaccttaagttctcgtgcgtctaacggtcaatgtgtgtacctatgtactaatctacccttggccgtaaaactcatagtgctggcatgttcatggcaacttgaaagggaattaggcttacacctagttcctaattaattttggtggttgaattgcccaacacaaataattggactaactagtttgcccaagtgtgtagattatacaggtgtaaaaggttcaccctcagccaataaaaagaccaagttttggattcaacaaaggagcaaaggggcaaccgaaggcacccctggtctggcgcaccggactgtccggtgtgccaccggacagtgaacagtacctgtccggtgcaccaggggactcagactcaaactcgccaccttcgggaatttccagggcgactcggctataattcaccggactgtccggtgtacaccggacagtgtccggtgcgccaagggaggtcggcctcaggaactcgccagcttcgggaaactccaacggctagtccactataattcaccggactgtccggtgtgcaccggactgtccggtgcgactccgaagcaacggtcgtctccgcgccaacggctctctgccgcgcatttaatgcgcgctctgcgcgcgcagaagtcagaatcgcccatgctggcacaccggacatcaaacagtacctgtccggtgtgcaccggacacccaggcgggcccacaagtcagaagctccaacggtcagaatccaacggcagtgatgacgtggcaggggggcaccggactgtccggtgtgcaccggactgtccggtgcgccatcaaacagacagcctcccaacggcc

SEQ ID NO: 16863 - DNA, 759 bp, Zea mays
ttggtttgtgttggcatcaatcaccaaaaagggggagattgaaagggaattaggctttcacctagttcccaaataattttggtggttgaattgcccaacgcaaatcattcggactaactagtttgcccaagtgtatagattatacaggtgttaaaggttcacactcagccaataaaaagaccaagttttggattcaacaaaggagcaaaaggggcaaccgaaggcacccctggtctggcgcaccggactgtccggtgcgccaccggacatgtccggtgcaccagggggactcaggctcaaactcgccaccttcgggaatttccagaggcgactcggctataattcaccggactgtccggtgtacaccggacagtgtccggtgcgccaagggaggtcggcctcaggaactcgccagcttcgggaaactccaacggctagtccactataattcaccggactgtccggtgtgcaccggactgtccggtgcgactccggagcaacggctatctccgcgccaacggctctctgccgcgcatttaatgcgcgctctgcgcgcgcagatgtcaggcgcgcccatactggcacaccggacaaggaacagtagatgtccggtgtgcaccggacacccaggcgggcccacaagtcagaagctccaacggtcagaatccaacggcagtgatgacgtggcagggggcaccggactgtccggtgtgcaccggactgtccggtgcgccatcgagcagacagactcccaacggc

SEQ ID NO: 16864 - DNA, 1618 bp, Zea mays
gcacgagaccattacctagaacatcctaatcgaaaagatactgatacacggctcagtggctcacccaagccaagaccaagaaccccgggcggacgaaaagatggccgccgatgccgcacgcacgccggcgccgcacgcgctgctgctcccttacccagcgcagggccacgtgatcccgttcatggagctggccgaccgcctcctcgacaggggcttcgccgtcaccttcgtcaacaccgagttcaaccaccgccgcgtcgtcgtggccgccgccggcggccgggcgcccgatggccggctgcggctcgttggtgtcgctgacgggatgggcgacggcgaggaccgcgacaacttcgtccgcctcaacgcctgcatgaaggaggccatgccgctgcggctcgacgcgctcctcgacgccgacgacgagcgcctcggcagggtcacgtgcgtcgtggtcgacgtcggcatgtcctgggcgctggacgcggtcaagcggcgtgggctcccggccgccgcactctggcccgcgtcggcggccgtgctcgccgtcctgttcggcgccaagaagctcatacgcgatggcgtcatcgatgacgacggagctccagtgaagctggagaaccactcgttccggctggccgagtcgatgccccccatggacgccgtcttcctggcgtggaactacatgggcaaccgcgacgtcgagcgcatggtcttccactacctgaccaccactgcgtgggccgccgtggctaaggcggacgtcgtcctctgcaacaccttcgaggacctcgagccggacatcttcggcgcccactccccggcggccgcctccatcctcccgatcggcccgctgcgcacctggcagcgccggacgagcgaggcgccggccgggcacttttggcgcgccgacgacgaggcctgcgcgtccttcctggacgcgcagccccgtgggtccgtgacgtacgtggcgttcgggagcctgacggtcatgagccccgcgcagctccaggagctcgcgctggccctgctggcctccgcccgccccttcctgtgggtgttccggccagggctggcggccgagctcccgcccgcgttcacggatctcctgccacgccatgcgaggggcaaggtggtggagtgggcgccgcaggagaaagtgctcgcgcaccctgctgtcggctgcttcctgacgcattgcgggtggaactcgacgctggagggcgtccgccatggcgtgcctttgctttgctggccctactttagcgaccagttcacgaaccaggcatacatttgtgatatctggaaggtggggttaagggtggtgcccgacggtggtgatggcattgtcgccaaggaaaggatcatggagaggttgacgagcctaatgggtgacagtggtgtgaaggaaagggtgaaaagattgaaggaattggcagagaggagcatggggcctgagggcaaatctttgaagaacatcaacgccttcatggaatccatgacgaagtgattgttattgtgttattgttttattttcgggaatgactaccactgatgtccaacgcatgttccaacatccaacaagatcatacaagatatctgaaaaaaaaaaaaaaaa

SEQ ID NO: 16865 - DNA, 920 bp, Zea mays
gctttggtttgtgttggcatcaatcaccaaaaagggggagattgaaagggaattaggcttacacctagtccctaattaattttggtggttgaattgcccaacacaaataattggactaactagtttgcccaagtgtatagattatacaggtgtaaaaggttcacactcagccaataaaaagatcaagttttggattcaacaaaggagcaaagggccaaccgaaggcacctctggtctggcgcaccggactgcccggtgtgccaccggacagtgtccggtgcaccagaggactctaacgcaaactcgccaccttcgggaatttccagagacgactccgctataattcaccggactgtccggtgtacaccggactgtccggtgtacaccggacagtgtccggtgctccaagggaggccggcctcaggaactcgccagcttcgggaaactccaacggctagtccgctataattcaccggacatgtccggtgtgcaccggactgtccggtgcgactccggagcaacggtcatctccgcgccaacggctctctgccgcgcatttaatgcgcgctctgcgcgcgcagatggcaggcgcgcccactccggcacaccggacaaggaacagtagatgtccggtgtgcaccggacaccctggcgggcccacaagtcagaagcttcaacggtcagaatccaacggcagtgatgacgtggcagggggcaccggactgtccggtgtgcaccggactgtccggtgcgccatcgaacagacagcccagccaacggtcaaagtttggtggttggggctataaataccccaaccaccccaccattcattgtatccaagttttccacttcccaactactacaagagctctagcattcaatcctagacacaccaaagagatcaaatcctctccaaactc

SEQ ID NO: 16866 - DNA, 1284 bp, Zea mays
  misc_feature (377)..(377): n is a, c, g, or t
  misc_feature (413)..(413): n is a, c, g, or t
  misc_feature (461)..(461): n is a, c, g, or t
cgccctttaaaaaaagggggtccccccgggttccagggggaaaaagaaaaaagaaggtcccttgttcccccccccccccccccctgggggggggcaattcccgcaaagggggatggagggtatatgttaagggaaatgggctttttttttagcggggccacccttttaagggttgctacagggaggggatatttgttgaggccctggtggagcatcagtacttgccaggtttcaggagtctcagatcattttgcacaagatggaattcatgacttgagttggggcgaaacatgtgaagaacctgcacttagctgctaaagaacaaatattcagagttctgctgtggttaccaagagccattgtacgatgtagaggancttcgctccattgcaccagctgatgtgaacagtccnttcgacattcgttcaataatagcccgtattgttgatggaagtgaattngatgagttcaaaaaattgtatggaacaacactagtgactggttttgcaaggatatgtgggcaaccagttggaattattggaaacaatggcattttgtttacagagtcagcgttgaagggctcccacttcattgaattgtgcgctcagcggcatattcctttgattttccttcaaaacattactgggttcatggtcggatcaaagtctgaagctagtggaattgccaaagctggagcaaagatggtcatggcagtttcctgtgctaaggttcctaaaattacaataattgttggtggaagttttggggctgggaattatggaatgtgcggacgtgcatatagcccaaactttttatttctttggccaactgctaggatatctgttatgggtggcatccaggcagctggagttctcgctcaaatagaaaagaacaacaaaaggagacaaggagtggagtggagcaaggacgaggaagaagccttcaaagccaaagtcgtggaggcttacgacagagaaggaagcccgtactactccactgctaggctatgggacgacggggtcatcgaccctgctgacaccaggcgggttctgagcctctgcctctccgcttcggccaagccggttccggaagacacaagatacggtgtattccggatgtgaataaatgtgtgtgagtaataacgcagacgtgtttaataaaaagctgcctgcacgcacccaatgtgtgtgcacaaataaaaatttcgccctggtttctgtcgtcgaaatatgttaagagtgtgttcatttcatatattactaaaaacgaaaaaaaaaaaaaaaa

SEQ ID NO: 16867 - DNA, 1755 bp, Zea mays
  misc_feature (599)..(599): n is a, c, g, or t
aatgccccccctgtgagaggaaggtgtgaacccgcttacgcgccacacccacaaacgctcccaagacccaccaaaatatataattataccagagaaaatgcggaaaatacccccacataagtagacaaaccccccttttttcccgcgcggggtgtgggcggattttcatttaaataccaggtggcccacaggacaagttttttcccgactcggaaaaaaggggcccaaggaagtcccaaagcggaaattaaagtgggaggtttgggtccaccccaattagggccacccccagggtttatacagcgttttatgctttccggattggggaagtttgtggggggaattgtgagggggaataaacaaattttccccaggggaaccaggttttgggccatgatttccggcccaggttggaaattaaccctccctaaaagggaacaaaaagttgagggttcccccgcggtggcgggccggtttaaaactagtggatccccccgggctacaaggagaaaaagagaaagagttcattagtcccccccgcccccccctggtggggcatatattcctgcaatggcggatgagagtgtaatagttaaggngaaatgggactatatttctagcgggtccaccacttgtaaaggctgctacaggagaggagatatctgctgaggaccttggtggagcatcagtacattgcaaggtatcaggagtctcagatcattttgcacaagatgaaattcatggacttgagttggggcgaaacattgtgaagaacctgcacttagctgctaaaggaacaaatattcagagttctgcttgtggttaccaagagccattgtacgatgtagaggaacttcgctccattgcaccagctgatgtgaaacagtccttcgacattcgttcaataatagcccgtattgttgatggaagtgaatttgatgacttcaaaaaattacactagtgactggttttgcaaggatatgtgggcaaccagttggaattattggaaacaatggcattttgtttacagagtcagcgttgaagggctcccacttcattgaattgtgcgctcagcggcatattcctttgattttccttcaaaacattactgggttcatggtcggatcaaagtctgaagctagtggaattgccaaagctggagcaaagatggtcatggcagtttcctgtgctaaggttcctaaaattacaataattgttggtggaagttttggggctgggaattatggaatgtgcggacgtgcatatagcccaaactttttatttctttggccaactgctaggatatctgttatgggtggcatccaggcagctggagttctcgctcaaatagaaaagaacaacaaaaggagacaaggagtggagtggagcaaggacgaggaagaagccttcaaagccaaagtcgtggaggcttacgacagagaaggaagcccgtactactccactgctaggctatgggacgacggggtcatcgaccctgctgacaccaggcgggttctgagcctctgcctctccgcttcggccaagccggttccggaagacacaagatacggtgtattccggatgtgaataaatgtgtgtgagtaataacgcagacgtgtttaataaaaagctgcctgcacgcacccaatgtgtgtgcacaaataaaaatttcgccctggtttctgtcgtcgaaatatgttaagagtgttgttcatttcatatattactaaaaacgaaaaaaaaaaaaaaaaaaaa

SEQ ID NO: 16868 - DNA, 2104 bp, Zea mays
ttgggtacctcgaggccggccggcaccggggctgggaatgggaagacactgcagcccagctccagcagcactacagcagtagcgccaccgaacctgaaaactccgaccccccacgaaatcgcggaacctacccacgagccgagccatgctcagccgactcgccgcggcgaggcgacagctactgctatccccggccgtcgcgtaccgctcctcctcggcagcggcgacggcgtcggcggtccacgagagagcagcgcccgcctcggcctccgtgctcccggacaccctcgaaaggggctccgacgcgtaccagcgcaacacggccgccgtcggcgggttgctctccgacctgcgcgcccgcgtctcccaggtgctgcgcgggggaggcgccgaggcggtgaggcggaacgcggcgcgggggaagctgctcccgcgggaccgcatcgaccgactgctcgaccccggcgcgtccttcctcgagctctcgcagcttgcaggctcagatgtttatgatgaagcattaccatcagcaggtataataactggcataggacctgttcatggacggttatgtatgtttgtggccaatgacccaaccactaagggtggcacatactatcctcttactgtcaagaagcatctgcgagcacaggaaatagcttcggagtgcaaactgccttgcatatatctcgttgacagcggaggtgctaatctccccaggcaggctgacgttttccctgaccgtgataattttggccggatattctacaatcaagctaagatgtcttcagatggtatccctcagattgcagtagtcttgggttcttgcactgctggtggggcatatattcctgcaatggcggatgagagtgtaatagttaagggaaatgggactatatttctagcgggtccaccacttgtaaaggctgctacaggagaggagatatctgctgaggaccttggtggagcatcagtacattgcaaggtatcaggagtctcagatcattttgcacaagatgaaattcatggacttgagttggggcgaaacattgtgaagaacctgcacttagctgctaaaggaacaaatattcagagttctgcttgtggttaccaagagccattgtacgatgtagaggaacttcgctccattgcaccagctgatgtgaaacagtccttcgacattcgttcaataatagcccgtattgttgatggaagtgaatttgatgagttcaaaaaattgtatggaacaacactagtgactggttttgcaaggatatgtgggcaaccagttggaattattggaaacaatggcattttgtttacagagtcagcgttgaagggctcccacttcattgaattgtgcgctcagcggcatattcctttgattttccttcaaaacattactgggttcatggtcggatcaaagtctgaagctagtggaattgccaaagctggagcaaagatggtcatggcagtttcctgtgctaaggttcctaaaattacaataattgttggtggaagttttggggctgggaattatggaatgtgcggacgtgcatatagcccaaactttttatttctttggccaactgctaggatatctgttatgggtggcatccaggcagctggagttctcgctcaaatagaaaagaacaacaaaaggagacaaggagtggagtggagcaaggacgaggaagaagccttcaaagccaaagtcgtggaggcttacgacagagaaggaagcccgtactactccactgctaggctatgggacgacggggtcatcgaccctgctgacaccaggcgggttctgagcctctgcctctccgcttcggccaagccggttccggaagacacaagatacggtgtattccggatgtgaataaatgtgtgtgagtaataacgcagacgtgtttaataaaaagctgcctgcacgcacccaatgtgtgtgcacaaataaaaatttcgccctggtttctgtcgtcgaaatatgttgaagagtgttgttcatttcatatattactaaaacgaaaaaaaaaaaaaaaaaacgtgtgataaaaaaaaaaaaaaaaaaactcgagactagttcgctctctcctcgtgc

SEQ ID NO: 16869 - DNA, 1616 bp, Zea mays
  misc_feature (45)..(45): n is a, c, g, or t
  misc_feature (460)..(460): n is a, c, g, or t
catccgcgtttacagcacataaaaagcggggccaagcaagagctncggagagctaaatgtggggttgggccccgctcacctgagggccactccgggtgtgttgaagcttgaatgacgttcatatgtgtgtggctgtacgacgggaatatctggagtgcgataactcacattcatccgccggcgtagcccagtgtatgatgcccaagatatacgcctcggattattaaaggtcgcaccttgccgtgaatgggaaaaccaaaaaagtgggtgggtgtctagcgcgcgcgtgtaacgcaacctacttctttgaaactttgtcggatcccccgcggcactgccagggaataaataagggaaaatagcttcatgtagattaactccgttggggcgaccttggtgggaacatatagttacctgcaatggcggggaggggagtgtagatggtttagggagaatgggnaatatatttctagggggtccgccactggtagaggtgggttacagagaaggagaaatgtggtaaggaccttggtggagcatcagtgcatttcaaggtatcaggggtgtcagatcattttgcacaagatggaattcatagactagagtgggggggggacattgtgaagaaccggcggttagatggtaaaggaacaaatattcagagttctgcttgtggttaccaagagccatagtacgaggtagaggaacttcgctccattgcaccaggtgatgtgaaacagtccttcgacattcgttcaataatagcccgtattgttgaaggaagtgaatttgatgagttcaaaaaattgtatggaacaacactagtgactggttttgcaaggatatgtggacaaccagttggaattattggtaacaatggcattttgtttacagagtcagcgttgaagggctcccacttcattgaattgtgcgctcagcggcatattcctttgattttccttcaaaacattactgggttcatggtcggatcaaagtctgaagctagtggaattgccaaagctggagcaaagatggtcatggcagtttcctgtgctaaggttcctaaaattacaataattgttggtggaagttttggggctgggaattatggaatgtgcggacgtgcatatagcccaaactttttatttctttggccaactgctaggatatctgttatgggtggcatccaggcagctggagttctcgctcaaatagaaaagaacaacaaaaggagacaaggagtggagtggagcaaggacgaggaagaagccttcaaagccaaagtcgtggaggcttacgacagagaaggaagcccgtactactccactgctaggctatgggacgacggggtcatcgaccctgctgacaccaggcgggttctgagcctctgcctctccgcttcggccaagccggttccggaagacacaagatacggtgtattccggatgtgaataaatgtgtgtgagtaataacgcagacgtgtttaataaaaagctgcctgcacgcacccaatgtgtgtgcacaaataaaaatttcgccctggtttctgtcgtcgaaatatgttaagagtgtgttcatttcatatattactaaaaacgaaaaaaaaaaaaaaaaaa

SEQ ID NO: 16870 - DNA, 1711 bp, Zea mays
  misc_feature (1562)..(1563): n is a, c, g, or t
  misc_feature (1565)..(1566): n is a, c, g, or t
  misc_feature (1578)..(1578): n is a, c, g, or t
  misc_feature (1583)..(1583): n is a, c, g, or t
  misc_feature (1588)..(1588): n is a, c, g, or t
  misc_feature (1600)..(1600): n is a, c, g, or t
  misc_feature (1603)..(1603): n is a, c, g, or t
  misc_feature (1619)..(1619): n is a, c, g, or t
tttggggaaattggaaggggattacaattttccccaggaaaacaggctagggtcctgttttcgcccaagtttgaaatttacccttcctaaagggaaacaaaagcggagcttccacttcggtgggcggccgttttaggaactattggatccccccggccttcaagataataaatagagagattctctctaggtcccccgcccccccccccctggtggggcatatattcctgcaatggcggatgagagtgtaatagttaagggaaatgggactatatttctagcgggtccaccacttgtaaaggctgctacaggagaggagatatctgctgaggaccttggtggagcatcagtacattgcaaggtatcaggagtctcagatcattttgcacaagatgaaattcatggacttgagttggggcgaaacattgtgaagaacctgcacttagctgctaaaggaacaaatattcagagttctgcttgtggttaccaagagccattgtacgatgtagaggaacttcgctccattgcaccagctgatgtgaaacagtccttcgacattcgttcaataatagcccgtattgttgatggaagtgaatttgatgagttcaaaaaattgtatggaacaacactagtgactggttttgcaaggatatgtgggcaaccagttggaattattggaaacaatggcattttgtttacagagtcagcgttgaagggctcccacttcattgaattgtgcgctcagcggcatattcctttgattttccttcaaaacattactgggttcatggtcggatcaaagtctgaagctagtggaattgccaaagctggagcaaagatggtcatggcagtttcctgtgctaaggttcctaaaattacaataattgttggtggaagttttggggctgggaattatggaatgtgcggacgtgcatatagcccaaactttttatttatttggccaactgctaggatatctgttatgggtggcatccaggcagctggagttctcgctcaaatagaaaagaacaacaaaaagagacaaggagtggagtggagcaaggacgaggaagaagccttcaaagccaaagtcgtggaggcttacgacagagaaggaagcccgtactactccactgctaggctatgggacgacggggtcatcgaccctgctgacaccaggcgggttctgagcctctgcctctccgcttcggccaagccggttccggaagacacaagatacggtgtattccggatgtgaataaacgtgtgtgagtaataacgcagacgtgtttaataaaaagctgcctgcacgcacccaatgtgtgtgcacaaataaaaatttcgccctggtttttctgtcgtcgaaatgtgttgattgattgatggtacaagagtgttgttcatttcatatattactatctgatgaatgggaagtgttcttcttttgatactaggtaaaacgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacnncnngggggggcccgnaaccnaattnccccaaaaaggnagncgaataaaaattaatnccggggcgggattttaaaaagcggggaagggaaaaacccgggggtaaaccaaaaaaaacgccttggaaaaaaacccccttttgccaaggggg

SEQ ID NO: 16871 - DNA, 722 bp, Zea mays
gtcagcgttgaagggctcccacttcattgaattgtgcgctcagcggcatattcctttgattttccttcaaaacattactgggttcatggtcggatcaaagtctgaagctagtggaattgccaaagctggagcaaagatggtcatggcagtttcctgtgctaaggttcctaaaattacaataattgttggtggaagttttggggctgggaattatggaatgtgcggacgtgcatatagcccaaactttttatttctttggccaactgctaggatatctgttatgggtggcatccaggcagctggagttctcgctcaaatagaaaagaacaacaaaaggagacaaggagtggagtggagcaaggacgaggaagaagccttcaaagccaaagtcgtggaggcttacgacagagaaggaagcccgtactactccactgctaggctatgggacgacggggtcatcgaccctgctgacaccaggcgggttctgagcctctgcctctccgcttcggccaagccggttccggaagacacaagatacggtgtattccggatgtgaataaatgtgtgtgagtaataacgcagacgtgtttaataaaaagctgcctgcacgcacccaatgtgtgtgcacaaataaaaatttcgccctggtttctgtcgtcgaaatatgttgaagaagtgttgttcatttcatatattactaaaaacgaaaaaaaaaaaaaaaa

SEQ ID NO: 16872 - DNA, 2217 bp, Zea mays
ccccccccggggcgggccgcgtggggcccggccgtactcgtcaactcctgctgttcacgggtttgaagcgaaaattcgcccaaaccaggccggcgacggacgcctcctcgttctccacgccgccgccgccgccgccgccgcgttggctaggttgacctgaccgatcttgacttctctaggctcttgcatccccgacgacggaaatagcctccgagtttccaacagggtggctccggtcgaccacgaagcctcgatctgcatgacgaggctactcgtcatcctgttcgccggggcgaccctagtagtcgccaccaccgcgcacgagcaccatggtgaggcgcccacctgcgccggaggcagcgagcacgtgcttgcggagttccgccccggtgaggtgaccgtggacgggcacaacgaggactgggagagcgtggaggcctcggagttcgcgctgctgccggctctagatccagacgatgataaggcctactccggcggcaagatcgccgtaaaggctgtgcatgatggcgtcaacgtcttcttcttgcttcaggttgatggggcttacgcttacactaaaggggaaagtaacaaatgcccttctgttgctctgatgttccaagttggagagaaagccacattttacaatatgggaggatgcaaagatatgccaggttcatgcacaagtaaaagttgtagaggtcatgaggttgacattatgcacttctcaattggaaatgctatccctggacgactttacggtggcaatcacatagacaatgcagctgggaatggaaacgacagatttggtcaccttgttgatgtctatgcatggaatccacattgccgatacctcgatggagtgggccctaaagagaacaattcaaatgctcaaaatgattggcatggggcttggtggcacagttcattgaccttccattcaggctttgttgatgacgataatccttatggacaacaagatgagaagggtacatattattttgagttttcaagacccttaagaacaatggatcaatttcagcaggatgcacaattcacaataggacgtcccagcaatatgtccgtagccttgtggtacccagacgatggcaaagcatggagcaactccgatcattactcagccagctgcaactggttggttttggatatacaaccttcgtccgaagctacgtattaccgtccagctcctaatcgctcttgggatgctgcaactggctttgctttacttctttcagtggtagccatttgcatgtccatctttgtgggctaccgattttctaggaacaggagcactgcccagtttacaccacttgaacagatccagtttgctgaagaacgccattgattggaattgagattaggcgaagcatcaagcaacaatgtttcatctgttccaccattgtacctccaaagttgacagattgctgcattgaagttttgaaccgggttgttgtgatccagtatagggagatattgaaagcatacacgatacataatttaattacagactgccggtttttatcgtaggaaacaatttctatatgctatacatcaaaccggttattggcggctcatgactttgacgattgtttcattggttgcataatatttgaatatatctaaatttggttcgaatgctgaagtgaactttggcccctgataacactgatttgttgaaagatctgccccgtgcccgtaggatccctgtcttttcctacgatgagcaatccatagcaattctatttaaataaaaaatttagtttaaaatgggaggttttcgctcccttgttttggcaccctttcttccaaactaatccttaagagcatctctaaaagactagttaaatagctcgttaagacaaatattgactgttcaataataaaataactctgtaacagattagctatctgactcgctaagctatctgattctttaaattagctctctcactagctaaatttagctagccatttgattagtaaaactagatagatagcctgttggatataaatagacagtcaaacaaagagctaaaaataaaaagtctcttggatatgctctaaggagtgaagagtaaaatttgcgtatactcttagtaatttaagttaacaaacaagcaactagattgagttcaaatcaagtctaaaattttgccccaccctttgaatccattcaatttcacgaaaaatctgcag

SEQ ID NO: 16873 - DNA, 1553 bp, Zea mays
ccaaaaaccaccaccgcccccagcttccctaccgccctcgttccggagcctagggtttgggaagtcgaaggcctcggcgcttcgtttgccagcgcaatgccggatacgggagcgagaggccgcggcgatgagccggagcctgtgacgccgcagcagcaggcggaggagacccaggcggtggacgatcggcggttgctgcgctcgcagtacctcgccgtgaagggccttatcagcgacgagaaggatgaaatggcgagcgcggactctgataagttctgctccattatcaacagagtggagagcctgcaccagcttgttcagaggcccagggagcaaatagctgacgcagaaaccctgctggaccttactgctagtttggtagcatcagtaaggtcccaatcagttctgggaatcacaccttctgattttattgctggactgctgaagaaattttaaagaaaggaggttccaatgataatgtttcattggactgggctcgtcttgggcttgctacctcacgtgttttcttgtctgcatctggatgtgccaccatgattggtcccatgacgacagaagtgaagccacgaagagtttgtattaggaagaagaggactgcgaggccacatggaaacgcttgccctgaacagcttgctgatccatctgagaaaacaaagtctgatactgacaagaacatgtctgctatatttgatctcctgaggaggaggaaaagtgcaaggctggaacacattattttgaacaggacatcatttgctcaaacagtggagaacatatttgccttgtcattccttgtgaaagatggaagagttgaaatcaaagtgaatgaccagggacatcattttgtctatccaaggaatgcaccagtggcaagtgctgttgcctcaggagatgtggtctataaccactttgtcttccgatttgattttaaagactggaagctcatgaaaggggttgttccagagggagaagagcttatgccgcacaggtcctctcagaccatagccaacacaggaggaaacaatcctacccagtctgaggcacctttggccacaccaagcacaacgatcaggaagctttgcaggaaccgtggcctcatcttgcaagatgagttgatcgcgacaggtgcatatggagtcatggaacaggagatgttagccatgggcacgaacgacgccatggaagatgagatggtagctgccatgggtgtgacggaagctatgggagagaagaggaagtacaagcgcaagcgtctgttccaggacgtctgatgcgttgatccagctgaccgttgctgatggtgtacatgtctaggtagtaggtagagatgccaacccggctcacttcagcttagcttaccttagatgcatttgggtcaaagcaccccatttggtatgggttatggtggctcttggaatggctgagcgtcacgttattttggatgtgttcttaatgttagtttctggcgtacttaagactgaagtaaccatagtgaaggtgttggatgcttgggttgaattacaaaaaaaaaaaaaaaa

SEQ ID NO: 16874 - DNA, 2020 bp, Zea mays
gttaccctcaatggccgacgaccccctggactcgtccccgtcggcgtccgccgccgccgctgctggcggagtctcctccggcccccgcccagcgctccggccccggcgggaggcatttgagtacggcgctcggcgaccacggctcggggagtgctgacctccgcgacctgcttcttttcctctacatccaatcctacaagcgcctcgtgccgcgcgtgcacaaggactcgcccgccgtcacggatgtttggccgtcgacctccgccttcgatggatacctctccgcgctgtcgccgatccagtttgtacggagcaatagtcgccgttttatgccttcacaagcagatgaagaagctcatcagctatcgtatttacaaaagcatatggccaacattctaacacttttagcagattctattgatggcgagggagatgattctatggtattgacaatggagacttttgagcaccttggattttttttgcagctctctgaaggaactccattaagccaagcagctaccttttttgcgaattcggatccagacatgcccgctgctcctgtacctgctgctttggtacatgattgggtcttgcagcatatagcttcagcattagaatttatggcagagaagactgtggcaaaagaaaacagccaacataatgcatttgatcctgatgtcacaatgtctgatgctgtcacgaatacaagaattcatagcagttcaccaactggcagttctgcaccaaactatcctggatactaccgaaatgcatcatttgtggagggttgctcgaaaacttcagttgtcaaacaagcatcggatctgaaagggcattcaataaaggttttgaactgccatgattctgtaatttacattttagccccacttaagtatgcaactgtctatggatgttctgacactaccattattcttggtgctattggtaaggttgttaaagtggagcattgtgaacgtgtacaaattattgcagcttcgaaacgaatttgtattgccaattgtcgtgaatgtatcttctacttgggagtaaatcaccaaccacttattgtaggggataaccataaattacaagttgccccatttaatacttattatccacaactcggggaacatttggcacaagttggtgtggatcctaatgtcaacaagtgggaccaaccttttgtgttgggagttgttgatctgcatgactcattatctcatcctgccggggtttctgatgtccaggctgagtccaccacttgtctagatcctgatctatttacgaactttttgattcctagttggtttgaagtagaaggacctaccaaatacaatccatttaccctgcctgaagtttattgggcgtcccaaaggaaaaagcatgcttctctggaagatattcaaaagaatatccgggagctggagatcgatgatatccggaagaaagaattggcatgtgcccttcatgctcaattcaaagattggttatatgcctcagggaatatccgccagctatactgtttgcaaggcgaatgagcataagatggggttcttgtgtaagcgcgagatgcagcagtacgcgtctgcaagtgcaatccaattccgggcgcctccgaaatctgaaagtgacttccaagctgagttggtgtcgcctgccctgatgcacttggtatttcagctgtagcgtttgtggaggcaagtaactgtaacgtttttgtttgttccaattagtttttaccacttttcccattcagttggccgcaaggtttctgtaaatctttcggtactgttggtttcatatttagaaaattcacaaagcggccactcaattctctttttggaaagtaactttatttttttttccaaatggtgtttggtttttagggactaatgtttagtcccttcattttattccattttagtctctaaattgctagaattttagtttttgtatttgacaatctagggactaatatagaataagatgattagtccttacaaatcaaaaaaaaaaa

SEQ ID NO: 16875 - DNA, 1331 bp, Zea mays
cctcgaggccggccgggaaaaaaactacggcccatccgctaattttggctcggcccataacaattctgattacgcgactcgctgatcgccagcttgtggtcgcgatgccgtacaccggatatcctctagcgccttcccacaatcgcgcttctgcggttctgccgccgacgtccgcgccgccgacgtccgcgcccgcgtccctcgctgctttgccctctccaccctccgccatcaccgccgcggcgtccttctgtaccggatccgtcgcagccaccactccgcagatccgctgggttgacgtccacggagctgctccggggatgtcgtcctccgcttccagcgtcgagggcgacgccgccggagagttcacggaggtcgtaatcgtgcgtcacggcgagacgtcatggaacgcctcgcgcatcatacagggacacttggatgcagagcttaatgatattggaaggcagcaagctgttgcggttgctcatcgtctttctaaagaagtgaaaccagttgccatatactcttctgatctgaagcgagcagcagagactgcgcaaacaattgcaagaatttgcaatgtgccaaatgtcgtgttcgatccagcactgagagaaagacacattggagatctgcaaggcatgacgcttcaagatgctgctacagagaggccagaggcatacaaagcttttatgtcccacaagagaaatcaacaagttcctggtggtggagagagtcttgatcaactgtcggagcgatgtgtgtcttttctgtacgacattgttggtaaacacaaaggggagcgagttatcctggtttcacatggcggcaccatcagagagctctacagacacgtgagtcccacgaagccgctccacggcaaaatacacaacacgtcggtgagcgtcatcctcgtgtccgacgccaccggccggtgcatcgtcaagatgtgcggggacgtcagccacctccaggagacgggcgtcctggagaacgccttcggtggcgacaagacctccgcctgagattccaacattcatcacgcgccgagagctctcggcaattatcacgcgccgagtgagcgctcgtttcggccgtctttttttccactgtaccaatcatcctgttgctaccagtagtggtctagcggagaatgatgcacacttccccccgctgggaacgcggcgatttttgctggaacagttgaaggccgagccggggcgaatccttttggcctggccgtgcactgcttgctgaactgcacgtacgcatgtggagctgaaacgatctgcgttcgctcaaaaaaaaaaaaaaaaaagcgcccgaggggg

SEQ ID NO: 16876 - DNA, 877 bp, Zea mays
ctcgcggccggccgccagatggcaatccgtacattccgctcatattcctcaccggtgaccttcctcacctgcgtcagacagagaaagccgagattagcggcggcggcgatggcactcccggcgtcaagctccggcctcttccgcttcgtctccccccgcagccgtccccagtccactgacatcgtggccgctgcctcctggggagtcttcgccggcaccgccggcctttacctcgtccagccatttgactggattaagaagactttcttccagaaacctgaaccagaggcatgagtctccaggcagaaaaatgctgcaaatctgcaactttggtacaccacttttgtccgggatgattcctgatgataactcagcaaataatatgagaccccctcgtctttccttgtttgattttattcagatgtaggcattcctcttgcatgtaatattcacgaggggagtgtgatcatttgacttgtttttcatcacacagagaaactgcttggttcaaccgtgttatatggtcttgatggcatttctaaaatattggtccaaaaaaaaaaaaaaaaaaacctgtggcctgattattgtatttgttgcagtcactgtgtccgtataaattgatccaccaatatatctagggccccgattggatgtcgatattgaagaggataaatttgaatttggttgaataccaaatcaaatcagatatggtattgaaacaagatgtaattctaattatattgttttggacgtcaccgaattggagttttgaattgtgcggtaattctacgcaataccgagaggtgaggctttgtatcgggagagggggattctagttatagtccaatttcagggaattgagctgatttcaaat

SEQ ID NO: 16877 - DNA, 660 bp, Zea mays
cctcgaggccgcctcgcagcccgtacattccgctcatattcctcaccggtggccttcctcacctgcgtcagacagagaaagccgagattagcggcggcggcgatggcactcccggcgtcgagctccggcctcttccgcttcgtatccccccgcagccgtccccagtccactgacatcgtggccgctgcctcctggggagtcttcgccggcaccgccggcctctacctcgtccagccatttgactggattaagaagactttcttccagaaacctgaaccagaggcatgagtctccaggcagaaaaatgctgcaaatctgcaactttggtacaccacttttgtccgggatgattcctgatgataactcagcaaataatatgagaccccctcgtctttccttgtttgattttattcagatgtaggcattcctcttgcatgtaatcttcacgaggggagtgtgatcattttgacttgtttttcatcacacagagaaactgcttggttcaaccgtgttatatggtcttgatggcatttctaaaatattggtccaagatgcgtgtgtttaaaacctgtggcctgattattgtatttgttgcagtcactgtgtccgtataaattgatccaccaatatatctagggccccgtttggatgtcgacattg

SEQ ID NO: 16878 - DNA, 772 bp, Zea mays
atgttcgaattccagtccaaaggtatgggcctcgactatttttgccaatcaggcccatgttgttctcgtgggcttaggcgagcgggtgccccggcgccgcccgaaagacttagcagtccgtacattccgctcaccggtggccttcctcacctgcgtcagacagagaaagccgagattagcggcggcggcgatggcactcccggcgtcgagctccggcctcttccgcttcgtatccccccgcagccgtccccagtccactgacatcgtggccgctgcctcctggggagtcttcgccggcaccgccggcctctacctcgtccagccatttgactggattaagaagactttcttcgataaacctgaaccagaggcatgagtctccaggcagaaaatgctgcaaatctgcaactttggtacaccacttttgtccgggatgattcctgatgataactcagcaaataatatgagaccctctcgtctttccttgtttgattttattcagatgtaggcattcctcttgcatgtaatcttcacgaggggagtgtgatcatttgacttgtttttcataacacagagaaactgtttggttcaaccgtgttatatgatcttgatggcatttctaaaatattggtccaagatgcatgtgtttaaaacctgtggcctgattattgtatttgttgatgtcactgtgtccgtataaattgatccaccaatatgtctagctgattaaaaaaaaaaaaaaagccaaaaaaaaaaaaaaaaaggggcggcc

SEQ ID NO: 16879 - DNA, 5220 bp, Zea mays
gatcaagctcatccgagtataattacatatggtgcacataagcactaagggttaaagagtttctcaaacctcaccaaacactagaccgaaacctagagcaagcactatgagcagaactaatccaagtacttcacaaagtatctacgctaatcattcaacatgttctttgatcatttgggtgtctagagcaaccaaagatgagtctcaactcacttgctatgtttcttagctactcgttggttctatctattgttggccttggacatcaggcatccgatgacttatcaagagtgtttaccagacatgtctggtgccttatgtctctcttcaaagtcatatccgaagccctatcagacataaatgatgactaggattcgatgcacacatgtgtgtttgatgcactttgttgtcgttttcttttttgatataatgctctcatatccagtgcatcaccaaacacgtccttgtggtgttgagcaacatatgtccttctcgtttctctgtgtgtctttgtccagacttattctgtcttgtgtcttagactcttgtatgtactagtaggtctttaatatattttctaatgtgttgcttgatgtgttgataatttgtatcacctctatgcattagcttaaatccgtttatgcatcctttgaactatatctaaagctactagcaaataatgttaatccaaatagtcatgttgattatcaaacaccaaaactttattttaaatgggtctcgatccattcttcttataatatgcatgactaggtacagtggatgtgcgtatgtgtgtgttaattagctcacagaaagtatacagtgaactgagctcaattatattggtcgtgttatgtccatttgcagcgtggaatttatccattcgggttataatcctcaacttgcattggcacgaaaacatgtttcagagtagtgcaaattaaacatcaataaaaaaaccacaacattaagaaagggtccatggtgatcttgtcgtttctaggtgtgctttatagcggtgattgtgcgtaggtgtaagtagtgagtacagtgtttgtttatagggcaaataagtgcaaacaattatatcatattgggattattttcatggtgcactttagttagctgcaaatagaagtgaacactacactatgatcggtatagtgggatcagtacacgggtttcgccaacccgccgggcggttttgtggcctgcgctaactctctttaacgcttttggatacaataattatatatatcatattgtaatatggttttgtgtagatcattcctgtcactagtcgggtaattaactaataaccactgttcttttctgcatcggtgcttggttggacctatggagatccacgtaggcccctcgctcgtgacaacacacaagttagaaaaaggcatcaatattggctgtcagcccgagttcaatattgctcacactctcgtccacttccaagtcctgcactccaaagactttgactagtagctaagcagcaaccaagagctaacacattaattgtatatatagtagtgcatgcaattgttttaggggaacagaacgaaggacatagagaaattaaaatggatatatctcaaccactcgacacatgcatgcattgagcaaaaaaaaaagaactttcatgaaaagagaacccatttttttggtctactagagcaaccaccactagagactagggagaaaggaacccaactgaaataatctatcactctaatgaaaagaagtgcaaaggaagattttatatgctacaccaccaacaatatatctagcatgcgtacaacacaaaaggctagctgctgcatggaagcaagctaaaaaaatgctcaaggcataaatttcttttttctgatgattataatctgttgatcagttcaacgacgagtgaaggtggcacgtgcgtggttggaccctgtctaagacaggttagttgggcagtagatctcgctaatctatgcagatctcaaacgattaattaataatcatctcaactccattcccctctagctagtatgcaggcgagatagataagcatgagagagacgaaaccaaagaaaacttcacggttaagtcgcgtggtggtctgaagactcaagttcttcccaagtcagaggttgcatccaatatatttgctgtcacatggactttacaggccgtgtatatatgtaaaagcacggtccttttttcgcttggcgtattctgcctgctggtaagtgaaagttaagaaagaaaagacatgcatctctctcctagttagctagctagaggggctagagctttccactgcctgatcaacaacactgaggtctaaagagagacaaaaccaagccctttcggttaaaactaaagttcctgcacatgttggaacagctctgtacgttcctctgaacattctacacatatatatgaagtgcattgctaagtaagtagttctctagtactttagccctgcatataaattaaccttaatttatctaagtgtgtttcagctgctcatcaattcagcgtgtcagtttctgaacaagttgctgatcatggactttacaattcagcaacgctagctatagctatagttagtttctggactttacagttcagcaatggcaacctgttgctgtcttcgctatcttcctttgagctggtgaatccacaggtttggttggacatgtgatactgatgtgctagctagctactagtttatccacacaacaaacacggcggcagctgctttttaggtcgacagattttacgtgcagatgaaaaccacttgccacgcaagtaaaatctcagtgttgctagctagatttgatagatccgtttatttcactccgccgactccagccgtcactggaaaaagttaaccggccggttgcagatggggttcatgccaataattcggaggttgataggtatggacactactacctagccagctatagtaatagcagcagagacattttgatccatatatttttccagctaaaattgtactccctcctccactcacgaggtcacgaataagcaaaagagacattttgtttagacgtctcagcacgatatctccaaattacaattttgaccgagtatgtagcatcttttttactaaataaacatagtaaaagtactgtctttgtgtagatctactaactccgagttaaaatatacttgcatctttgcaaaataatatccatatagcataacaaaaaaacataacttgttcgtcggctagtagcatatgatctgagctcagattactttgctctaactacggccaaatttgcttgtttccgcttatagcaaacgtggttataatcggcataccgggcccaattggaccatacctgattgatctactattcgtcaaatccaactgtttttttttgcataaaagaatccaactaattcaaaaatgcttgcttgataaattataggcatatcattcgtctaataagctaagataagaaaataagcattttcatgaacaaagcctctcttttcatggctttgtcgtgggcttgtcgccatccaacattcgaacgaggctgtaagagcccaaaggaaggatgtgacaaaaacaatcagagatgggctggtggtagttgtgtggggacattgttgtttaaatgaaccaatttaaaataagccaaggattgcgataaaataaaatgttgtatgcgttggattggaagtgcccacattgtcttttccatgacctatctagagtaactgctagcagaaactaggatgcttaatttagcttccgacttctatctagactcactaaagaaagtaaaaatacaagcagatttgtccataaatttacagataaattttataatgaaatcttatacggattcgcgaacaaagtcttctctccgtagtagtataaacaagacgcttatgctacatgcctacatgttcgaattccagtccaaaggtatgggcctcgactatttttgccaatcaggcccatgttgttctcgtgggcttaattaagcaataggcctagctgcgcccgcaaaacttagcagtccgtgcagtccgcacatattcctcaccggtggccttcctcacctgcgtcagacagagaaagccgagattagcggcggcggcgatggcactcccggcgtcaagctccggcctcttccgcttcgtctccccccgcagccgtccccagtccactgacatcgtggccgctgcctcctggggagtcttcgccggcaccgccggcctttacctcgtccaggtcaggatccatcggcctgcttgcatctcgtatccgccgttagcccttcctgtgtatggaccgtgccttgcatgggtagaaggatcataagcccagccgtcgtttgatctgtggattttgtttgctgcttcggtgttagggttgtgttgtttgcgattggatccgtgttcttcgtgtgaacttcgttgttcctatggatctgcgaatgttggatcggtcttagagatcaacgctagctctctgttggggtgtgaggaaacatctagaattctagatgcttatgtcctagtcaaacttgccatctagatctaacgaagatggggatgaagggggatgaacagcccatgttttcgtgatgacaatctataaatttatcaatttgaattactatgtcaaatgtgtctcaggaatcaggaaattgttacaatacataaggaaaggcaaatgtcgaagtagacatacttacttgatacttaatcattatcatgcaagctatatttgaccaggatatatagatgctaattgagcgaaatacacaaatttctgtcaccactagccagtagccactaggcacttatgcagaaatttaacataatgctcactgatggttcctgccacttgaaattcgcaacacatcaatattgtaaatatgaattcgcagttaaccaatatggtcatgtggtggcatcattttgctttcacctgcagctattatttttcgcgggtgctgtgatatatcttgtgcctatatgctcttgtttgagcaacttattggggggctatgcacttgtatactatacctggagaaataagaagatgtgttcttatttcttaatgaaaacaagtgtatccctaggttgtaccagcaggttatctgtagtcctgataatgcatgccttatggttatgtcatttgaatttgtaacgaccagtagccaatggagctga

SEQ ID NO: 16880 - DNA, 2082 bp, Zea mays
aattcggcacgaggattcactacatgccaaatctggaggcaagagaaccgggagagggcgtgttgggttgctcgtcgtgatcccggacggcaatacctgcccttgcctacttgccactgcttgcgtacactgatgtccttgttcaatcccctctagaaagtagaaacattgcttaattggcttggctattgctgttagctccacacaaaagagagaaccggcggcgagctaggagctagccatggacggacacggcgcggtctcgccgtggagcgtgctaggcggggcggcggctgtgctgttcctgtggttggcgtcgcaggtgctggagtgggcctggtgggcgccccggcgcgtgaaccgtgcgctgagggcgcagggcctgaggggcacccggtaccgcctcctctgcggcgacctcatcgaggagcagcgtctccgcgcggcggccctggcaaggcccgtccccgtggatcggccacacgacttcctccctcgcgtcgcgcctttccttcaccgcgtcctccaagagcacggcaagctctcgtttacatggtttgggccgaccccaagagttctaatcaccgatcccgagcttgcccgggaagtgctgtcgaataagtgtggcgacttcgtgaagtcgctgctctctcccctgtcaacgctgctggttgctgggctcgtcgtccttgacggtgaaaagtgggtcaaacatcgaaggattctgaatccggcattccacgcggagaagctgaagggaatgctgccggcattcttagcatgttgcaacgaactggttgacagatgggagaaacagatctctgcttccgctgaaccaactgagctggatgtctggccagagttccaaaacttatcgggagatgtgatttcaagagctgcattcggtgttagctatgaagaaggcagaagaattttcctacttcaggcggagcaagctgaacgccttgttcaatctttcaagacaaattacatccctggcttctctctcctgccaacagaaaacaacagaaggatgaatgaaatcgacagggaggtgaagacggtcctgaggggcataatagagaagagacagaaggcagccaagaacggtgaagcaaccaaggacgacctgctgggcttgctactggagtcgaacatgaattacagcgactcggacggcaaatccagcaaggggattacggtggaggaggtgatcggcgagtgcaaggtgttctacttcgcagggatggagaccaccgccgtgctgctcacatggacagtggccgtgctaagcatgcacccggagtggcaggaccgtgccagggaggaggtcctgcaggtctttggtgaaaacaagccggacttcaatggtgtggcacgcctaaaagtggtgaccatggtgctctacgaggtgctgcgcctgtaccctccggtggcggccatcaaccgccggacacgccagccgacaaagctcggaggcgtcacgtacccggcgggggtcatgcttacgacgcccgtcatgttcatccaccgggaccctgccctgtgggggtccgacgccgacgagttcaacccggggaggttcgccgacggcgtgtccaaggcgtgcagggaccccggcgccttcgcccccttcagctggggcccgcgcgtctgcatcggccagaacttcgcgctcctggaggccaagctggccgtcagcatgatcctgcagcgcttcgcgttcgaggtgtcgccggcgtacgtccacgcgccctacaccgtgctgacgctgcacccgcagcacggcgctccggtcaggctgcgcaggctatgaatacacgatcggtgcttccgttaagcaatttctctccaatacccgaagactcttgtttattcatttcaaagttacgattacaaaacataatgcaaaatctcaaacttatatataccagagcatgtaaaagctagcaaaagctatattgtgataacgaaccaacaatatattactcctataacaaccccctaaaaaaaaaaaaaaaaaaaaaaaaaaaaaaaaaaaaaaaaaaaaaaaaaaaaaatccgcggaggggggccggtacc

SEQ ID NO: 16881 - DNA, 969 bp, Zea mays
cggcacggctggcggagtacgtgtacaagcgcaccggcaagcacgcggccgtcgtcaagtccgagccggtcccggcgccaccgccggagagcggcgccggcgacaacacgggggccaaggaggaggagaaggggcaggaggaggagaaggagaaggaaggaggaggcgatggcggtggcgaggagaagaagaaggaagggggcaaggaggaagagaagaaggacggcgagaagcaggaggaggagaaggagggcggcggtggcggcgagaaggtggaggaaaaggagggagataaagacgctgccgctgccgccgccgccagcatgtacatgcactacccgaggttcccgttcccgggaggctactacgcgccgcctccggggtacgtctaccagccggtgtacccagcgccggcgtacgcggcgtacgcgccgccgcaccaccagcccatggcgccgcagatcttcagcgacgagaaccccaacgcctgctccgtcatgtaactaaaaaacagaaggaccctggcgagagcgagagagggggagaaaggggaaaaaagaataataagaaggtgggaagagcgagggagctgcgtgcataacccagagccagagggaggttgtcttctgcgagaaatgcagcacccagcagtgtcccctgagcgaagcaaatgggcaacttttgtttgaaacaaaacaaaagtaccaggcttttttttgggggaggggcggttagatttcgctcttcttattttttttcttctttcttttgtaattttaaccctttctttcatcttttttttcctggtgtaaagcaagcgtggactttgtcggtttatggacgctagctatctttatgtaggatgatgtcttggcatgtactgcttgcagcttcagacttcatatatatatataactgtatttattataaaaaaaaaaaaaaaaaactcgagggggggcccggtaccca

SEQ ID NO: 16882 - DNA, 616 bp, Zea mays
  misc_feature (51)..(51): n is a, c, g, or t
gccgccgcccgccagcatgtacatgcactacccgaggttcccgttcccggnaggctactacgcgccgcctccggggtacgtctaccagccggtgtacccagcgccggcgtacgcggcgtacgcgccgccgcaccaccagcccatggcgccgcagatcttcagcgacgagaaccccaacgcctgctccgtcatgtaactaaaaaacagaaggaccctggcgagagcgagagagggggagaaaaggggaaaaaaagaataataagaaggtgggaagagcgagggagctgcgtgcataacccagagccagagggagggagggaggtcccctacagcacccagcagtgtcccctgcaactttgtttgaagcaaaacaaaagtaccaggcttttttcgggggaggggcggttagatttcgctcttctttttttcttcttctttcttttgtaattttaaccctttctttcatctttttttcctggtgtaaagtaagcgtggactttgtcggtttatggacgctatctttatgtaggtcgatgccttggcatgtactgcttgcagcttcagacttcatatatataaaactgtatgtattataatttttaaaaaaaaaaaaaaa

SEQ ID NO: 16883 - DNA, 3928 bp, Zea mays
  misc_feature (3132)..(3132): n is a, c, g, or t
gtttccgatgaggacgacgacgacaaggctggtcctcggacgcgcagaccaactagacggatgacctcgccggagaggtgggaggtaaagcccctgatcgcggcgggggtgttggatgccaagaactacccggtgttggatgaggatgaggaggggatgctttatcaggaggaagaagtggaggagcttgagattgaactcaatcaggatgagccccctttcttgtggggaaaagggcgatcctcatctgacatgtctccagtgaggatttccatgaatcctgaggggtcgatgagccgtgcggcagcgctacaatccgcacttactaaggagaggcgtgatattcgcacgcaggagcaaagaggaatggttgatgcaatccccaaggaccttaaccggtcatgggaggatcccatttcaagtggacggtatctgatgcaggagctgatgggcacaggactatcagcgcagagtgtgccggaatggaagatgacatatgggaaggccggaacatatgggcagaagtcgaggctttcgatccaggagcagagacaaagccttccaatattcaggctgaaaaaggagctgatcagtgctgttaatgacaaccaagttttggtggttatcggtgagactggctctgggaaaacaacccaggttacacaataccttgctgaggcagggtatactacaaggggaaagattgcatgtactcaacctcgcagggttgctgcagagtcaattgcaaagcgagtagcagaggaggttggctgtcgagtgggtgaggaagttggttattctatacgctttgatgactgcacagggcctgaaaccgtcatcaagtacatgacagacggcatgctcctccgagagatttgggcccttcggggccggccggcttattcagtggtcatgcttgatgaggcacatgagagaaccatctacacagacattctcttcagcttgctaaagcagctaattaagcggagaaatgatctcaagttaatagtcacttcagccactcttgatgcggagaagttctctggttatttttttgattgcaatatcttcacgattcctggaagaacgtttccagttgagatactacatacaaaacaggcagagagtgactacatggatgctgcactgatcacggtattgcagatccatctgaccgagcccgaaggagatatcctattgttcctgactggccaggaagagattgatcatgcttgcgagcgtctccatgagaggatgaaggcattcggtggggacataccagagcttataatttgtcctgtgtacagtgctcttcctactgaagttcagtcaaagatattcgaaccggctcctccttgtaagaggaaggtggttgtggctaccaacatagcagaagcatctattaccatagatgggatttactatgttgttgaccctggcttcgcaaagctaaatggctataacccaaaactagggttagattcactggttatcactccgatctctcaggcgtcagctaagcaaagagcagggcgtgctggacgcacaggtccaggtaaatgttaccgcctgtacactgagagtgcctttcgcaatgaaatgccaccaacaacgattccagaaatccagagggccaacttggggtggacggttctgaatatgaaggcaatgggaataaatgaccttttgtcatttgacttcatggaccctccagcatctcaagcactcatatcggctatggaacaactgtacagtcttggtgccttagatgaagagggtcttcttactaggcttgggagaaaaatggctgaatttccccaagaaccacctctttctaagatgctccttgctagtgtagaccttggatgcagtgatgaaatactgacaatcattgcaatgattcaaactgggaacatattctatcgaccaagggagaagcaagcacaagcagatcggaaaagatccaactttttccagccagaaggtgatcatctcaccctactcactgtgtatgaggcatggaaggcaaaggggttttcaggaccatggtgtgttgagaatttcattcaggtaaactcactaaggagggcacaggacgtgcggaaacagcttcttgagattatggacaagttcaagctcaatgtcatctctgccgggaacaattccaccaagatagggaaagccctcactgctggattcttcttccatgctgcaaggaaggaccccagtggcgggtaccggaccctagctgatcatcagcaagtttacatccacccgagcagtgccctctttcaccagcagccacagtgggtgatctaccatgaaattgtgatgacaacaaaagagtatatgagggatgtcacagcggtggacccaagatggctactagagttggcaccgaggtcgtacaagtcggtggacccaacgaagatcagtaagcggaagcgccaagaaaggattgaacctctctatgatagatacaatgaacccaactcgtggcgcctgagtaagcgccgctggtgatttttcatcatgtcttgcaggtctttgatgtaatgttactgtagtgtatatattaaggtgttctttcaatgcaaagactgggataatggcagcgcagtgatacatgtatagttttctcttaaatttggaagacttataaggaatatcttttcccttttaaactggatgccaactgatgatgaatttatcagcgatttgcttgatttatgctgctttggttgaaacttattgaatatttatcacagactcagcgtgtttacacattaaatctgggtatcgttatatgtagcaaaagttatcacatttgagaagataccccttgtgactggatcagtgatgatatgatatgcaacaggcgaaaagtttgacacctgattacaagaatgtgaaagatggaccaatagaggcactgatttcagatctggggctctgtctgtttattagccttttgctgtttgagctttgatttgtaggaaccttctgttttgatgtgttctaacctgtgtttcctttggctggattgttgaactactctccaacaataaaatactagtttcatgattatcggtgccagattctggaggttatgtttttgtcaaacgtttcatntcttaaatggccatgcactaacaccactgtgttttatgtgcagttaactcctgctgtcgcctgagctctgaaccgatgctttattttctgtcttgtgcatgcattgtccaatgggcgtgttacctgacagtgtctgcattttggatgccccaaacggagacatagagttgctgctttagtcgttcatttactttctgttttcccctgggctgttcactcctcgctgatccctgaccttagcttgtacgcacaaatttctgctgtacatcacaaattacaccaaacagaagttcaaatcatgtagagttttttttttctgctgaagctgcaatctgaaatttgaaaatgtttgtctggctaaagatcttatggaagcaaagcggactcttgaggaaaatcaaaggaagcggtatgttccatatgcgtgtctcacatgcactatttccatctccaaattgcttcttgaagaagtgatggttttgtttacttgcaggatgatggaaagtgggatagcagatgaagaggagaaaaaggtcaagagagagaatacggcggcatatagcagacgctaaggtctgttgcggcatgctggtaataatcctgcttaattacacaaataatcatgtagtactttttactgtaacttttttttgtgacatttttattgtcttggatttctacatcgaaaaaaaaaccgtcactcgatgtttccagagtcagatgcatgaaaaatcgcagcctatatcttttatagtttacatggtgacggtgtagtagtagtattgtggtagaagct

SEQ ID NO: 16884 - DNA, 4478 bp, Zea mays
  misc_feature (2729)..(2729): n is a, c, g, or t
  misc_feature (2872)..(2872): n is a, c, g, or t
ttttcttttcacaaagtgtccaaccggttgtactcgtatagtttggactttggagtgaaccatttatagagtagattttttctgttgatacaatttctgttatttatatttattggtcgtatttgtttgtttccgtaaacccgtttcatctgttccgttccggttcctgctcccgttttggatgatgaattgttgtgggagcgatttttttgggtacgtttcggtctgtttttcatcgctaggctgaaccaaacgtgcaacgctcctcgcacaaccaaacgacagcgcggcggcacggcatcgccattcgcccaccgaccacgggcagagcccaagcccagagaagtagtagaacccacggattctgcgcgagccaaccaatcccccccaacctaacccaatcccgtctcgccctagccgtctccatcccaccacctccccccgtccgctcgtccggccgcgccgcgccgtgcgcgacccaatctaccacgccacttacctcccgtcccgtctcgttctcgtcgcacctcgccacgcccgcagagagagggggcgcgctcgctcgagccgtgcgcgccagccagcgccatggcctcggaccaacaggccctcccggtcccggtcccggtccccgtcccgcccaaccctaacccgaccgcaccagccgacctgaccccgccctcggcgtccgccgcgcgcaagctccccatcaagcggcgctccccgcggccgtcgtcctcgcccccgtcctcttcttccccggcctcctccgacccgctccgcgcgcccggcggcggcggcggatccgaccagcagcagccgcccttcaagttccagcgcatctggtccgagtccgacgagctccgcttcctgcagggcctcctcggctgcggcacgcagggcctcgtcttcccgcgcgacctcaacgtcttctacgaccgcttctccgagtccatgccccagccctacacccgcgcccagctctcggagaagctccgccgcctcaagaacaagttccgcagcatgtccgcgcgcgtcgcgggaggcatagacccggcccgcctcgcgccgcacgaccgcgacgtgctccacctctgctccaggctgtgggaccccgccaacgccgccacctcgcccttcgcggccagcgccggaacgtcggggaacaagcgccgccgctccaacccgcgtggcacgcccccagacgcgtctggggatagcaactcccatgactacaatgggattagctcctctgctcccggtttgtttccggatggttccaacggcgaggttacgttttaccttgagcaagaaagcgggcagctgggcaatcatgaaggcgctgctcttgtagcagatagcaaattcgatgttgtggtgcaggagcagcctgaggccgtggttactctcccgaatgggaacaacggaattggcagtgagatgagtgcggagtgtaaaacggtggtgccgtgcagcaacgagcaccgaatggcaaatgctgtcctagatgtgtttgaggaatgcctgagggaggcaaagagtaacgggattatcaatggtggcaatgtggagagcgagctctccaagcggtggagagcacagaggatggatgagcttgatgtcttgagccggaggctgaggttgctcgtcgagtatgctgcagcggctgggcattgaagcgtagattttggtggttttggtgatgtgcctcccaccatttgcccctttgttgtgtatagaacctaggttattgtgctatgctttgtaatgtcttcctcagctggacccttagaaagcctactatatttgcctatgtacccctcgtgtttaataatttgagcagcataataatctatggtgttagcactgttatttgcatgggttcttgctgttgatatagatgatagctccgttagtgtaaatctctgggcttgctcgcttgcccagagggccagagtgcatccacgcttccatcccaacacgcccacccgcagcacccgcattccctccgggctcaacagagctctaccagaggacgatggagctgcttgggctagcagataggagtggtgggatagcacacttccttctctcccggtggcagcatgtgggagcaagctccaaggaggtgacagtttcctcttcacgatgctaccagggctggtctcctccttgcaggctatacaaggttttgggtgtgtgggctctagtgtcaccacggccttggccctcagaatccatggagaagcaggtgcttcattacctagcgtgagtagtggcgcgggagaagcaagatcatagccacctccgtctccgctggtatggcggtatctctaacccgttgtggtgcaggccgccgccgccaccaccgtgaaagttttgttttcatcgtattagttttgttctctctgttatgtacatactcatttgtgctgtgataggaagaggcaggccgcggtatggcttcgtagctatccagaatgagatgctggagcgtgagtcatccctgcgctaacattggaagggcaggagagataccgtggacatcgatgccacctcaggtgagagaatatgttaagtttggtagtgttcactttaattagatccaaattgcatcataagtttcaatctgtttcttggaatggatgggactattgcagcttgtggatttgggttgggagttcaaccgttcaagtatgtgttaccggtgtcaagtttgtttgatcgantacagtagccttgagagttgagctccatagagccaatgtagagggatacaatgcatgttctactgattaagattaagactgccagcacttgtatgtttctatatacaatcaaccatgaaatgtgttataattgtactggtagnaataccaagcaaatgcattcactggttgagtgttatggttgagaccaatttccaatttttgcacttacaaaaggtgaaaataaatgacatgttcatttcagaattggaattttaattgtttttttccatacaatggttactgtatatatatgtgaaagctaatattttaaataagggaaagtagatttccactgttaatttgtacaagtagtaagaatgtaagatatgacaatctaatttagcaccgctgcactgttggtaatggacttttaagagcctatctaaagacggaaattaacgacagctttcgtaaaggaacaagtacgtcatagcggtaggaaacatatcaagaaaattgagaacaaatgcaatttgttccatggctacaatgtgatcagctcctctgctcccgtgtcgaatatgttctaccttgagcaggaaagcaggcaactgggcgattacaaaggtataactcttatagcacacatcagattcggtgttgcaggagcagactgaggctgtggttgctctcctcaattggaacaatggaattggcaatgagataaatcataaatgtggactgcaaaatggtggtaccatgcagcagtggcatcaaatggcaaatgatgtgctggatgcctggacgtgtttgaggagtgagtgcctccgtaaggttaagagagaattatcaatggcgacaatgtggatggtggtgttgaggaaagcgaacttgccaagcggtggagagtgcagaggatggatgatcttgacgtgaccggaggctgtggttgctcatcgaggatggatggtcttgatgtcttaagccggatgctgaggttgcttgtcttctagtcgagtgctccaggggctgggcaatcaagcaagttcgctttcgcccatacagtatgttactacgaatagaagttaggttgctgtgttctatactttgtaatgtcttcctgagttctgctcttgccttttcggtttaaaaagactgctatatttgccttgggtattattgttgagtttaataatttgagcagtactaatctacaattactggattaacttaggaattataagtaaataagccttccaaaccaattgtagactgtttttccttgatacatctcttgtctaatacgaaatgtctaaataaaaataaatataacgtgtttatgaacaatatctcctctttttatcttcaatttagatattcactctcttggttctaatttatagattattttgatatttctaggtacattattttttgctatgtatctaaatatattgtatatctaggtgcatagaaacatctagaaaaaccaaaagaaagagacaaagggtggcagtacttttccagaatgaagtgattaaagatactttattattggttttttaagtaagtgtcaaagtcaataatttttaagccgataaaaaatcaggtgaggataccatactttggattaattgtatatatgtcactcaacttttataaaattaaacgtctagcttattttaatgccatggagtggcatgaaaacgaaccatttttcaaaagtttgagtggcatgtttaaaactgaccctactttttttatatg

SEQ ID NO: 16885 - DNA, 2635 bp, Zea mays
aatctaccacgccacttacctcccgtcccgtcccgtctcgttctcgtcgcacctcgccccgcccgcagagagacggggcgcgcccgctcgagccgtgcgcgccagccagcgccatggcctcggaccaacaggccctcccggtcccggtccccgtcccgcccaaccctaacccgaccgcaccagccgacctgaccccgccctcggcgtccgccgcgcgcaagctccccatcaagcgccgctccccgcggccgtcgtcctcgcccccgtcctcttcctccccggcctcctccgacccgctccgcgcgcccggcggcggcggatccgaccagcagcagccgcccttcaagttccagcgcatctggtcggagtccgacgagctccgcttcctgcagggcctcctcggctgcggcacgcagggcctcgtcttcccgcgcgacctcaacgtcttctacgaccgcttctccgagtccatgccccagccctacacccgcgcccagctctcggagaagctccgccgcctcaagaacaagttccgcagcatgtccgcgcgcgtcgcgggaggcatagacccggcccgcctcgcgccgcacgaccgcgacgtgctccacctctgctccaggctgtgggaccccgccaacgccgccacctcgcccttcgcggccagcgccggaacgtcggggaacaagcgccgccgctccaacccgcgtggcacgccgctccctcccccagacgcgtctggggatagcaactcccatgactacaatgggattagctcctctgctcccggtttgtttccggatggttccaacggcgaggttacgttttaccttgagcaagaaagcgggcagctgggcaatcatgaaggcgctgctcttgtagcagatagcaaattcgatgttgttgtgcaggagcagcctgaggccgtggttactctcccgaatgggaacaacggaattggcagtgagatgagtgcggagtgtaaaacggtggtgccgtgcagcaacgagcaccgaatggcaaatgctgtcctagatgtgtttgaggaatgcctgagggaggcaaagagtaacgggattatcaatggtggcaatgtggagagcgagctctccaagcggtggagagcacagaggatggatgagcttgatgtcttgagccggaggctgaggttgctcgtcgagtatgctgcagcggctgggcattgaagcgtagattttggtggttttggtgatgtgcctcccaccatttgcccctttgttgtgtatagaacctaggttattgtgctatgctttgtaatgtcttcctcagctggacccttagaaagcctactatatttgcctatgtacccctcgtgtttaataatttgagcagcataataatccatggtgttagcactgttatttgcatgggttcttgctgttgatatagatgatagctccgttagtgtaaatctctgggcttgctcgcttgcccagagggccagagtgcatccacgcttccatcccaacacgcccacccgcagcacccgcattccctccgggctcaacagagctctaccagaggacgatggagctgcttgggctagcagataggagtggtgggatagcacacttccttctctcccggtggcagcatgtgggagcaagctccaaggaggtgacagtttcctcttcacgatgctaccagggctggtctcctccttgcaggctatacaaggttttgggtgtgtgggctctagtgtcaccacggccttggccctcagaatccatggagaagcaggtgcttcattacctagcgtgagtagtggcgcgggagaagcaagatcatagccacctccgtctccgctggtatggcggtatctctaacccgttgtggtgcaggccgccgccgccaccaccgtgaaagttttgttttcatcgtattagttttgttctctctgttatgtacatactcatttgtgctgtgataggaagaggcaggccgcggtatggcttcgtagctatccagaatgagatgctggagcgtgagtcatccctgcgctaacattggaagggcaggagagataccgtggacatcgatgccacctcaggaaagcaggcaactgggcgattacaaaggtataactcttatagcacacatcagattcggtgttgcaggagcagactgaggctgtggttgctctcctcaattggaacaatggaattggcaatgagataaatcataaatgtggactgcaaaatggtggtaccatgcagcagtggcatcaaatggcaaatgatgtgctggatgcctggacgtgtttgaggagtgagtgcctccgtaaggttaagagagaattatcaatggcgacaatgtggatggtggtgttgaggaaagcgaacttgccaagcggtggagagtgcagaggatggatgatcttgacgtgaccggaggctgtggttgctcatcgaggatggatggtcttgatgtcttaagccggatgctgaggttgcttgtcttctagtcgagtgctccaggggctgggcaatcaagcaagttcgctttcgcccatacagtatgttactacgaatagaagttaggttgctgtgttctatactttgtaatgtcttcctgagttctgctcttgccttttcggttt

SEQ ID NO: 16886 - DNA, 2223 bp, Zea mays
ctgcctcctgcctagagcaatgcgagattatcaacaccagcgcaccctcccgcccgcccgcggctgccttttcccactccttccagcgatcgatattcctccttccttccttccttccttcctcgtgaaggcgtcgagtgagtcctgcgttcttgctctcctctgctaagcacttgtcacaggaagaccccctcgtattcgcgtgctcttgccttcacacccgggacgggagttccttgctaggggagagagcttcccttgctcgtgtcctcactcactcactcattcaccgacggtcccagtggactgaggtgagacttcggtcggagccggccggacggaacatacaggatggccgccgcgccgccgcccaaggccgacgagctccagccgttcccgcccaaggagcagctgcccggcgtcgccttctgcatcaccagccccccgccatggccggacgtgccatcttgcctttgctcagcagctcactcagttgtcacctccactctactctttttctgttcgttctttttttgtttgtccgttagcttgcgttgtctcgccgttcaaatctttctctgtgcttgccctcttattgctaaccgggacgggagtagttccgtttctcgctgcaccgcacgcttcgtgttttctctggtgccgagctttggttttcgtttcacctttcggacttggtggattgggattgggagcacccgatccttcgttcatgcaaagcgctcctgtcagctgggatcttcaccgttcttctttctctgtctttaatttgtcggcgctcgctcatgtgtgctgctgtaattctgcgtatggctttcttcgtattttctcctactacgattcttgttttccggagagaaaaaaaggtagctttccttgatcaagtacttgtcagtctaggattaatctcgcaatgcgttgatttgacttgaatccgccgtgaaagctaaagaaaggtggtgtggttgcacatctttttctgtacaattaaactctgtgtgcaagtcccaacgcatggaaatagaaggcgtgtgctactaggattaatctatactattagtcgcaatggtgaggcatgattgaagttgaagtttctctcacacctatggttgggaccctctatgttgcagcggaggccatcttgctagggttccagcatttcgtcgtcatgctgggcaccaccgtcatcatacccagcgcgctcgttcctcagatgggaggcggaaatgtgagcctcgagacgctgcctcgttctcttttttttttggttcagataagagggcactgaatttcgtttgcactgaattgacgccgccctgcgcgcgcgtgcctcgcttcccgcgcggccaggaagagaaggctcgggtggttcagaccatactgttcgttgctggcataaacaccctgttccagacgttattcgggacgcgccttccggtcgtgatgggcggctcgtacgtcttcgtcgggccgaccatctcgatcgtcttggctggacggtacagcagcgaagcagaccctcacgaggtaccttctgctgaactgctctgtttccttcaagagcgatagaacttgcgggggcaatgggtaaaaacccgctgggtattacttgcccaaacccgtacccgcgaagaaaaaatacgtccgctaaaaaacccatacccgtgacgggtataaaattttgcccaaacccatacccatgcgggtttcgggtacccaacgggtttcccatacccactaacatcaacataaaaaataattcatcatgtaaacgacaatcaatacattactaagctagcataaaatgaacaagtgataacaaattttagcctaaaaattgttacatgaagtttatttcaattagaacatattcaattaataatattatgagacatatttataagtaatgttgattttaaggcgggttttaaaaacccatgggtttgcgggtatgggtagtggaagaacaaacccatgcccacgtacccgttgggtttccatttgaacccattaacaaacccatgggtagagaaattggcccaaacacataccctaatagagcaaaaacccaccgggtttcgggtagcgggtactcattgccatctctagatagaacatactggtatcgacgaagctttctgttgctcacgcacatgaagaaattcctgcggacgatgagggggacgcagggcgctctcctcgttg

SEQ ID NO: 16887 - DNA, 1500 bp, Zea mays
  misc_feature (1424)..(1424): n is a, c, g, or t
gccgctgttaaaaaaggcgtcggggcaaagcgaggagcaaaagaggggggagaaaaaaaaagagggaaggagagacgtcgttttctcctgcgcgcctcgccgctgccacctcctctgttccccgcggatccttcttgacactccgtcgttgggggagccaagcgccaaaaaaaaaaaaaaaaaaaacccatctctgctgccgtgagctctttcctgcctcacactcttcttttcctactagtatttgtatttccggccaggcgggccggccagggattccagcggctcaatcccagtcaatcatagagcagagcagcccgtgaccccgtgggcgtgtgctgcgactgcgaggagggaggagggaggaggaggaggaaaaagagtgccgccgtttcctgggggcagccagattccattccttgcgcaggagtactacggctactccttgtactatttcctagtagcaggctgccgtggaatcagctgcctcctgcctagagcaatgcgagattatcaacaccagcacagcctccctccctccctcggctgccttttcccactccttccagcgatcgatattcctccttccttccttccttcctcgtgaaggcgtcgagtgagtcctgcgttcttgctctcctctgctaagcacttgtcacaggaagaccccctcgtattcgcgtgctcttgccttcacacccgggacgggagttccttgctaggggagagagcttcccttgctcgtgtcctcactcactcactcattcaccgacggtcccagtggactgaggtgagacttcggtcggagccggccggacggaacatacaggatggccgccgcgccgccgcccaaggccgacgagctccagccgttcccgcccaaggagcagctgcccggcgtcgccttctgcatcaccagccccccgccatggccggaggccatcttgctagggttccagcatttcgtcgtcatgctgggcaccaccgtcatcatacccagcgcgctcgttcctcagatgggaggcggaaatgaagagaaggctcgggtggttcagaccatactgttcgttgctggcataaacaccctgttccagacgttattcgggacgcgccttccggtcgtgatgggcggctcgtacgtcttcgtcgggccgaccatctcgatcgtcttggctggacggtacagcaatgaagcagaccctcacgagaaattcctgcggacgatgagggggacgcaaggcgctctcctcgttgcgtcgacgattcagatcatacttgggttcagtggcctctggcgcaacgttgtcaaattactgagtccgctggcagctgttcctctggtatcactggtcgggttcgggctctacgagcttggctttccaggggtagcgaaatgcgtggaagttggcctcccagaactgctnctgctggttgtgttttctcagtatctgcctcaagttctggacttttcgcagtccgtcttcagcccggtcagcgttc

SEQ ID NO: 16888 - DNA, 2421 bp, Zea mays
agtactacggctactccttgtactatttcctagtagcaggctgccgtggaatcagctgcctagagcaatgcgagattatcaacaccagcacagcctccctccctcgctgccttttcccactcatcccagcgatcgatattcctccttccttccttccttcctcgtgaaggcgtcgagtgagtcctgcgttcttgctctcctctgctaggcacttgtcacaggaaggccccctcgtgttcgcgtcctcttgccttcacacccgggacgggagttccttgctagggggagagcttcccttgctcgtgtcctcactcacgcactcacagactcactcattcaccgacggtcccagtggactgaggtgagacttcggtcggagccggccggacggaacatacaggatggccgccgcgccgccgcccaaggccgacgagctccagccgttcccgcccaaggagcagctgcccggcgtcgccttctgcatcaccagccccccgccatggccggaggccatcttgctagggttccagcatttcgtcgtcatgctgggcaccaccgtcatcatacccagcgcgctcgttcctcagatgggaggcggaaatgaagagaaggctcgggtggttcagaccatactgttcgttgctggcataaacaccctgttccagacgttattcgggacgcgccttccggtcgtgatgggcggctcgtacgtcttcgtcgggccgaccatctcgatcgtcttggctggacggtacagcaacgaagcagaccctcacgagaaattcctgcggacgatgagggggacgcagggcgctctcctcgttgcgtcgacgattcagatcatacttgggttcagtggcctctggcgcaacgttgtcaaattactgagtccgctggcagctgttcctctggtatcactggtcgggttcgggctctacgagcttggctttccaggggtagcgaaatgcgtcgaagttggcctcccagaactgctcctgttggttgtgttttctcagtatctgcctcaggttctggacttcggcaagtccgtcttcagccggttcagcgttctcttcaccgtcggccgcgcgggcaggtacgcctacatcctcaccatcggcggcgcttacaagaactctccgcccaagacgcaggtgcattgccgcgttgatcggtcgggccttatttcaggagcaccttggataagtgttccctatccctttcagtggggtgctccgacgtttgacgccggagaagctttcgctatgatgatgacttcgttcattgctcttgtagagtcaactggcgccttcatcggtgcttcgagatatgcgagtgcaactatgattcctccatcgattatcagtcggggcgtgggatggcagggcattggtctgttgctcgattcatttttcgggacagcgaacgggacatcggtttcagtagagaatattggactgcttgcgttgacacggattggcagccggagagtggtgcagatatctgcaggcttcatgattttcttctctgtccttggaaaatttggagctttgtttgcgtcgattccgctgcccgtatttgccggcatgtactgtctcttcttcgcatatgttggtggcgttggcctgagcctccttcagttctgcaacctaaacagctttaggaccaagttcatcatggggttcgctttcttcatgggcctatcggttcctcagtacttcaacgagtacacagccgttgcaagctatggtccggtgcacactggcgccagatggttcaatgacatgatcaacgtgccattcacgtcgaagccgttcgtcgctgggttggtagcctatatcctggacaacaccctccaggtaaaggagagcgcggtgaggaaggacaggggcaaccactggtgggagaagttcaggagcttcaagaaagacgcgaggagccaagagttctactcgctgccgttcaatctgaacaagttcttcccgtcggtctgatctcaaatggcgccgccgctgaatcaattctggaagcaacccttgttcatatgggccttaatgaggaacataattctgctggtctggccagtggaagcttctgtgtctccattgttggtcaattttgtgtgttttcggacgagatgggagtaattgaactgtagaaattattaggattgaagtatatcgcgttctttttgtgatctacatgaatcagcagcagattaaatatttgtaggcgtagatactttgatcagtcaaatgttataggagcaaaccaatcttgggcctgagggactagatgctaaaatagcccattagctgagcaatgtaagccaacaaggacccttaggtgagaaataaaatcaaacttttttcgacccgcaaaaaaaaaaaaaaaaaaaaactcgcaaagggggccggtacc

SEQ ID NO: 16889 - DNA, 2869 bp, Zea mays
  misc_feature (2772)..(2774): n is a, c, g, or t
  misc_feature (2787)..(2787): n is a, c, g, or t
  misc_feature (2792)..(2793): n is a, c, g, or t
  misc_feature (2795)..(2795): n is a, c, g, or t
  misc_feature (2799)..(2801): n is a, c, g, or t
ccacgccccttctttttctccgatcataaataacatgatctctttctttgtctttcattcccttctttctaattcaaaaaagtaaggagggcggtaaggcgcctatagtttgataggtaggctcgcaacttacaaagggcactcactgctcgcaggcctgctctttctattataatttctatttactccttgaaaataaataaggagaggattttagctctccaatctcttccaattctgcggctcccaaactagcgcacggttttattatcttagccctcaagaaagacaggctaccaaaccgccgctcgcgtcggtcacgccaggcctgacgcgagcacatcgcaatcctagccaccaaaacaatgcccggcggcaagcgccgccgcgcacgcaaccccaccgccggcgggcctcagcgtagcgccggcgcaggtcgtcgtcgtcccgtccccgagctcccgtcttttgtctcccccgcttctgtcgccgccgccttctcccccgcctcgggcggccgcagccgcgggcggtgcgcccgtcgttgcggcgcctactccgatggcgagtcctcccacgccgtcccctttagctatccttccctccgctcctgctccgcttatccggagcgtgatcaggcgcaggcactggaggtgaccatcgacaccgcaccctgcgccgacccagccgcttccgtcccgatgtactcgtacggccccgccgtgctcggtgagaccgggcttgtgctgagtgcggacgaggaggaggcctgtgatagagggctgcatctcgggttaggattccgggatggaggacacgatgagatggagctcaaattgaaagagctgacagaggaagatgtctccttcaagacgcccaagcggaagcaggagcagagggcgaaggccaacccaggatttttgttgattgggggagtcaggatttacacggaggacatctcatcatcagaatcggatcggatgagcagctctgatgtggatttagagcccaactcaggtgatggggagagatttgagaatgatgatggtgacagtgacgaggaagataggcaaggcgaggagagagattcaatatctgatagcgagtcattaggatcggaatcagatgaagatttgagcaccggggattcttcttcagttgacaatgaggttgttgctgattacatggagggtattggtgggagtgacgagctgttgagcagtaagtggatcactagtatgaatttgggtgatgcagatactatagagcagatgtatacaaatgacaatgatgggtttgtgaagaaggggaaggaaaagcttgagggttatgcactaatgactgcatccgagcagtatgggatgaagaggcggaactcccttgagcagcggaagggaaaaggaatggtttgtgacagggatttgtcaagcatgcaagtgatggaccaggaagatatgttcatggtgaacaatgtctggatgccaaacaggtcaagaaaggggatgaagacaggatcatcatcctctcagctctcacagtcgtggcctaaagatgataggaaaagcaaaaactatcagagcaggccaggtgaaaagaagcagcataggaaggaactcattgcaaagaagcgtcaacaacgagctctaagcagaggagttgacttagggcaaattaatagtaaattgaggaaaatggttgtggatcaggttgacatgttatgttttcatccaatgcactctcgagactgttctcaggtacaacgccttgcatctatttatcaattgaagagcgggtgtcaaggttctggcaagaagagatttgtaactgtgacattgactgggcactcttccttgccatctgcagatggccaagttcgacttgaaaagcttttggggactgaatctgagaactctgtctcgagctctaaaggcccagcacgactgaagggccattctgctccaggaaagtgtgtaaaacactgggaatccagtggaaataaatctaccaagaaacaggtctccttcgcagagcgtccagtatcttttgtcaagtgtggaaccattgtggactcccttactgaggcaatagctggcccaagtggtggtgatacctcgtgtgttaaacctgttgaaagtaactccacccatctaggctcctttgaggtgcacaccaagggctttggttcaaagatgatggccaaaatgggattcatcgagggcactggccttggtaaagatggccaaggtatagtgcagccgatacaagccgtgcatcgtcccaaatctcttggactaggtgtagaatttgacagtgtggctgaggcgatcaaagcaagggcagaacccatcaaattaatttcagagctgaggcggaatgtgtgggcaccagagacgagtggcgttggctcctttgagaaacacaccaagggttttggctccaaaatgatggtgaatatggggtttgtcccagggtccggactggggaaggatggccagggcattgccacccccttgaccggagtaaggcgaccgaaatcacggggactgggagccgaggacaaatattagcttacaccattttcgcatttgatgtatctttcttgtcgtgttccttgttacatgcggattacatagtttgctgggagggcgaacctttgagcaccctgaatggtgaaacaatgggttttcacttgtttctttcaacttctcaatgaagttttatatatttgttctatcaatgttatactaaaaaaaaaaaactatggccaaatgnnntaccattcattanctaannanagannngccttgattcgttattcgcttcggggcattttttttttgtcctaaaataataattaaaaaataggggg

SEQ ID NO: 16890 - DNA, 3409 bp, Zea mays
  misc_feature (2754)..(2754): n is a, c, g, or t
tttgtgccgttatatcgctggttggatccaacctacctaatagggctagagtgtgtgccgtcatgtcacctatcgataatgggttggacgcaacctaatggagctaaccgttgatccaggttgttgtctcgtaccggacctgttttttatctggacatgcttgtgcacgagaacccgccaatcaataatgcccacactgtgtgcctggccgtgcagaggaatggcgccagctctcacaattgcataggtgagaccttcataatttatgctaagtttacttgatgaaatgcaatttctctaaaacagtaatgataacactacaacgagaataattttaggagtaataagatgaaccatgggtcaggctaaaatcgcagacctcagcgccttcgacagttcgactgccaggtactaaccaaggataattagctggagtactgtgctatcattgcatcagcctatacatatgctagctgtcaaccactcaactgcttgggtcccttgtttaaggccaaaactttatctttgctttgtccagttgtagacctgatcacgcagttgaaacagagcaaccatgtgtgaattttgcgaaattcttgtgaaattccaaaaaaattcctatttgatgaaagaaatactctacacaccagataaggcagaggcggtgttaacgcttttcctcagctagaaattgcgtggatgcattcgttgaccgtgctctcccaaaaacgatgggcggctttctacgcggtccggatcctcgccgtcctaacaacttccggcggcgtgagtcgtgaccgcggtggtgcgaaagcaccacgaaggaaagcgaagctgcgaagagcggcctgtggcactggcagtgcacgtgtgccgtgtgtgctgcggcgcggcgcacacggcaggcactgcacagccagcgaggcagaagaaacacagggagcgccgcgcccccaccagacctgccctgccccacgcgtccgctcgccgggctcgggcgttccggaagaaacaagcctggaaaatatatggtatataaacaattcgaccaaccccaagtccagacccgcagcgcccgccggaggcggagggaaccgagccggcgaccggcagaccgcagagaagaggcctggagccgaccgcagagaagaggccaggagccgaccgcaggcagccgccaccgcaccagaacccgaggtctcgaggcaatcgagcgcacgcgggtcgggggctgcggccatgtcggtgagttgcgggctcgagtgggtggtgtgccttggctgcacgcggtgggcgtggaagcggctcacctacatcggcgcctacgacagcgagacgtggccgccggcgtccgccgacgagttcgagcccgtcccgcgcctctgccgcgccgtgctcgcgaactacgacgaggagctctccagccccaagttcgcgccgccggagcacggctacttcgatatcgaccccaagggcatcctcaagcgggctaactacgacgaggtccgcaacgcgtgcccgccgtacctcgtctacgtcgacgaggcgcacaaggagatcatcctcgccgtgcgcggcctcaacctcgtgcgcaacgccgactacaaggtgcctgccttccgttccgtcgtccagctcgcgagcaatcggcgatcggccgtcccgtcgtgagcgggagaggtttgacgggttgtcgctcgcgtcacgaattcctccgcaggtgctcatggacaacaagctcgggatgcagatgttcgacggcggctacgtgcaccacggcctgctcaaggccgccaagttcatcctggagcgggagacggagacgctgaggaacctgctgcgccgttacgggcccgagtacaagctcatcctcaccggccactcgctcggctccggcatcgccgcgctcatgaccgtgctggtggtcaacaaccgcaaggagttcgacaacatacccaggagccgagtcaagtgctacgccctcgcgcccgccaggtgtatgtcgctcaacctcgccgtcaagtacgctgacgtcatcaactccgtcgtgctccaggtacggaggcgcgttggaccttctatcttaaggtggtcgctccgtgcggtattaggatgttgccacggagttctccggatgttgatttttctgccttgatgaacaattgctctgttgggatggttttttggcgaggggagggggaaaggggatcaattggatcaaatgtgctttgcttgttgcctcattgagaatgtctttcaaagctgaattagtttgattagacggaacggcaggaatcgtttagttttcacgcgctaaagaaaggttgtctagaggaggtttaagtcatatctgtccatcatggaatgcaatgttcaatttgaggagcagcctgtaccgataaatggaccctgctttctcattgccccacaacgtgatgaatttgtttcatgcagcaagttgagttgatagagaatagagaccatggtttagatttttgaagaaacatagatagcgtgcttgaatatattatatatattctatttgtgtgtgctgcaagtctgcaactaccaatgttggttgttgttctgttgctgtcttgcttattctgaataaatgaacctttatgaactcagccaatcctgtattgtcaatttaattgttatctctggtagtaatgaaatcttagtctcatctgaagtctttgcctttatggtctctcttccaggacgactttttgccaagaacaccgactncgctagagtacatttttggttctatcttctggtaactagatcatgttcactgtctccagattcttatttgttcaggaaaaagaacaactgcatgtatgatcgagtttttcaccaggcctttatgctttggagtttggacagcttgccctgcatgctatttctcatctgcttgagagatacatttaaacaagacaagagaaaatttaaagatccaagaagactgtatgcacctgggcgaatgtatcatatcgttgagaggaaattttgcaggtaatgtatcatgtcattgcaaatagcatcttcccctgcttgcgaattgctcttttctttttttatgtcataaatgatataaacgaaaacctactcttctagtatatgggagctcctgcctatggattataatccatactacagtcttttcatgatttaaagcaaagatttttagtccttgtattttttctagcagaaagcagcaaagcttcagtctgctcatgcatgagagtatggaggctccaatcatgtattcttctatattgtttgaacagatgaaggctaccttcctcaacttccttacatttcttctggtcaattaaaagataaaatgaattacaaatattaagaataagttagagttcaggagcctagtacagatagg

SEQ ID NO: 16891 - DNA, 2203 bp, Zea mays
ggtggtgcgaaagcccacgaaggaaagcgaagctgcgaagagcggtctgtggcactggcagtgcacgtgtgccatgtgtgctgcggcgcggcgcacacggcaggcactgcacagccagcgaggcagaagaaacacagggagcgccgcgcccccaccagacctgccctgccacccactccagctcgccgggctcgggcgttccggaagaaacaaggctggaaaatatatgccggccggcaattcgaccaaccccaagtccagacccgcagcgcccgccggaggcggagggaaccgagccggcgaccggcagaccgcagagaagaggcctggagccgaccgcagagaagaggccaggagccgaccgcaggcagccgccaccgcaccagaacccgaggtctcgaggcaatcgagcgcacgcgggtcgggggctgcggccatgtcggtgagttgcgggctcgagtgggtggtgtgccttggctgcacgcggtgggcgtggaagcggctcacctacatcggcgcctacgacagcgagacgtggccgccggcgtccgccgacgagttcgagcccgtcccgcgcctctgccgcgccgtgctcgcgaactacgacgaggagctctccagccccaagttcgcgccgccggagcacggctacttcgacatcgaccccaagggcatcctcaagcgggctacctacaaggaggtcggcaacgcgtgcccgccgtacctcgtctacgtcgacgaggcgcacaaggagatcatcctcgccgtgcgcggcctcaacctcgtgcgcaacgccgactacaaggtgctcatggacaacaagctcgggatgcagatgttcgacggcggctacgtgcaccacggcctgctcaaggccgccaaattcatcctggagcgggagacggagacgctgaggaacctgctgcgccgttacgggcccgagtacaagctcatcctcaccggccactcgctcggctccggcatcgccgcgctcatgaccgtgctggtggtcaacaaccgcaaggagttcgacaacatacccaggagccgagtcaagtgctacgccctcgcgcccgccaggtgtatgtcgctcaacctcgccgtcaagtacgctgacgtcatcaactccgtcgtgctccaggacgactttttgccaagaacaccgactccgctagagtacatttttggttctatcttctgcttgccctgcatgctatttctcatctgcttgagagatacatttaaacaagacaagagaaaatttaaagatccaagaagactgtatgcacctgggcgaatgtatcatatcgttgagaggaaattttgcagatgtggaagattcccacctgaggttagaactgcaattccagtggaagggcgctttgagcatgttgtgttatcatgcagtaccacttctgatcatggcatttattggattgaacgagaatcacaaaaggctttagagctaatgataaacagcaagaaggaaacgactccacctccgcagcaaaagatggagagattgcaaagttttgaggaggaacacaagaatgctctccagagagcaaagaccctggatgttcctcatgctgcggacctgtctgaagaggagattcaggaggaggatagcactgcaccaccctctgatactcatagcgaaacaaccacggaaacaaaatctggaggtagaacgagttgggacgaactgatggagaagcttttcaccagggatgaagatgggagacttgtcgtgaacaaggacgcgatggcgagggaaattgttgtcctgtaacgagtgccgagactgctctgtccgtggtagtttattctattagcgagctgtataaaagagtaagctgcggttgtgatatatttaaaactgtattcaacaacttatctatacccatatttatattcaaagtacactctataaacagtgtaatatacaatgcaaaacagtgttttttgaccatatgggtgaactgttatatattgcacctatatagtcacccaaaatactgttttgcaccattttgcaatgtacattacacgtttgtagaatatagtaagaatatgtgtatgagtatgaataagttgctggagatagtaggactagtttggaaagtggaaacttaaatcttttcgggattctcgaggattaagctcttcggagttctcgaggattaaagagaaaattaatctc

SEQ ID NO: 16892 - DNA, 1250 bp, Zea mays
cccacgcgtccgggccaagatgatgctgttgtggccatatctcgtgcagtgaagagagcacgtgttggccttaacgatcctgatagacctattgctacgctgctttgctgtggtccaacaggagttggtaaaacagagctcaccaaagctctagcagctagttattttggatcggaatctgctatgcttaggttagacatgagcgagtatatggagaggcacactgtgagcaagctcataggctctcctccagggtacattgggtatggtgaaactggtactttgacagaagcagtcaggagaaaaccatttactgtggtattgttggatgagatagagaaagctcaccctgatattttcaacatccttctccaaatatttgaggatggacatttgacagactcacagggtcgcagggtttccttcaaaaatacgttgattgtcatgacttcgaatgttggttcaacatcaatttcaaaaggaagacagagcataggtttcttgaaggaagataccgagtcaggctcatacttcgcaatgaaatccttagtgatggaagagctcaaggcatttttccgtccagagttgctcaatagaatcgacgagatggttgtgttccgtcctctggagaagactcagatgctggccattcttgatatcatcctaaaggaagtcaagggccgacttttggccctcgggataggtttggaggtgtctgatgcaatgaaggacctgatatgccaagagggctacgacaaaagctatggcgctcggcctctgaggagagctgtcacccacattatcgaggatgtcatcagcgaagcgattctttttggcgagttcaagcccggtgacacgatactgatggacatcgatgcagaggggaagccatgcatgggccatctggaccaacagatcgtccaggtctctgacccaacacgggcaatctgaagctgtgttggaccttttccagtgtagtagattagggatctaaatcttttattctttcaagatagagattattaattctttgttacgtagatatatagagtagtatttcattatgtatatatatcaaccagatgatccagataggggaatctggtcagtcattggagttatttgaaattttcatccagctgtatgtatattgttgaattgtttctgattcaactggccatatatatcatcattaaactatcttcatcggcttacgagcctagttctcctctctctctctctcctcgtgc

SEQ ID NO: 16893 - DNA, 2170 bp, Zea mays
  misc_feature (2107)..(2107): n is a, c, g, or t
  misc_feature (2109)..(2109): n is a, c, g, or t
  misc_feature (2117)..(2117): n is a, c, g, or t
  misc_feature (2129)..(2129): n is a, c, g, or t
  misc_feature (2141)..(2141): n is a, c, g, or t
gcacgagaccattacctagaacatcctaatcgaaaaattgaagagagttctcggaaggttctcctcccgtgtccgcgtagctaaggtgtcccggggagacctgctgcacacgcggcggcgaggcctccatatctctctatcatcacggcgcgggggaggaagccagcgagtaagctgaaaggggagagggagccaggggttcacgcgctcgccggagacgacgacgacgacgacgacggaagatgggcggcgacccggggaaggtcatcaggaacgtgaagggcgccgcgcagaagtacctcggcgttggcttcctgctcggcttcttcctcgtgctcctcacctacttcaccgtctccgagcagttcgcgatcacggcgcccaacgctgttcggaggacatcgccgggccacgcgcacaccacgaggtcgccgatcacctcggccgtcgaagagaagaggcagcagcctcctgccatagaggagaagccacccaagccagaggttgcaccggaggagaagcctccgaaggaagagaagccgccacgcgttgatgttgaagggccccatgctgaaacagatgaggaccagaagaagcctgtccctgacgatgatggtaggagcagtggtatcagcggcggcgatggcgtcgccacggagagtgctccggccaagaagccggcgtgcgacatccagggcccgtgggcgtccgacgtgtgcgacatcgacggcgacgtgcggatccacgggtcggcgggcaccgtgctgatcgcgccgtccatcgagagcggcggcaacccgaacccgcaggagtggcgcgtccgcccctactcccggaagcaccagggcgggatcaaggaggtgacggtgcgcgagctggcgtccagcgccgacgcgccggcgtgcgacgtgcggtcccccgtgccggcgatggtgctggccatgggcggactgactggcaactactggcacgacttcagcgacatcatgatcccgctctacctccaggcggcgcggttcgagggcgaggtgcagctggtggtggagaacatccagccgtggtacgtgggcaagtaccgggccatcctgcggcggctgtcgcggcacgacatcgtggacatggaccgggacgaccgcgtgcgctgcttcccgggcgcggtggtgggcatccgcatgcacaaggagttcagcatcgacccggcgcgggagccgctgggccactccatgccggagttcaccgcgttcctccgcgagacctactcgctcccgcgggccgcgccggcgaggctggcgggcgccgacagcgaggaggacgagcgggcgcggccccgcatgatggtcatctcgcgccgccacccgcggaagctggtgaacttggacgccgtggtggctctggcgcggcgcgtcgggttcgaggtcgtcatcggggacccgcccttcaacgtcgacgtcggggagttcgccaaggaggtgaacgccgtggacgtgctggtgggcgtgcacggcgccgggctcaccaactcgctgttcctccccacgggcgccgtcttcatccagatcaacccgtacggcaagatggagcacatcggggaggtggacttcggcatccccgccgtggacatggggctcaagtacatcgcctactccgccggcgtcgaggagaccaccctggtggacacgctggggcgcgaccacccggccgtcaaggacccggagtccatccaccggagtgggtgggggaaggtggccgagtactacctcggcaagcaggacgtccggctcgacctccagcggttcgagcccgtgctccgcaaggccatgcagctcctcagggacagggagtagcagcgtcgcagagagcagcagatgaaagtacagttttttttccaaatgacttttagagttttcttccctccctatacctccttaattatatatatttctcaattcttttccatttttggtgttcttttataaagtaaaaaaaggataaatcaaagactcacatgcttacttgttaaaaaaaaactcgagaggggaaaaaaaaaaaaaaaaatatcgataccgtgttacctcaagggggggcccggtacccaattcgccctatngngagtcgtnttacgcgcgctnactggccgtcgntttacaacgtcgtgactgggaaaaccctg

SEQ ID NO: 16894 - DNA, 823 bp, Zea mays
tcgaggccggccccgctccgccattgaagagagttctcggaaggttctcctcccgtgtccgcgtagctggcgtgcgtgcgtgtcccggggagacctgctgcacacgcggcggcgaggcctccttatctctgtcatcacggcgcgcgggggagggagccagcgagcaagctgaaaggggagagggagccagccagccaggggttcacgcgctcgccggagacgacgacgacgacggaagatgggcggcgacccggggaaggtcatcaggaacgtgaagggcgccgcgcagaagtacctcggcgttggcttcctcctcggcttcttcctcgtgctcctcacctacttcaccgtctccgagcagttcgcgatcacggcgcccaacgctgttcggaggtcatcgccgggccacgcgcacacctcggggtcgccgatcacctcggccgttgaagagaagaggcagcagcctcctgccatagaggagaagccacccaagccagagcttgcaccagaggagaagcctccgaaggaagagaagccgccacgcgttgatgttgaagggccccatgctgaaatagaggaggaccagaagaagcctgtccctgacgatgatggtaggagcagtggtaccggcggcggcgatggcatcgccacggagagtgcgcccgccaagaagccggcgtgcgacatccagggcccgtgggcgtccgacgtgtgcgacatcgacggcgacgtgcggatccacgggtcggcgggcaccgtgctgatcgcgccgtccatcgagagcgcggcaccgaaacccgaagagtgcgcgtccgccctactc

SEQ ID NO: 16895 - DNA, 3059 bp, Zea mays
gataactcagctcagtcattacaggctagctgctcgctagctcacatcaccatggatgatgcctcaggtttgcaattgcaggctaactgcttgacccccaggagcgccacttcaattgtgagctcccatggtaggagtatatgccttatggatgataatggaggacaactcttgaagtcactggcacccccgccgggtttcctggtggcccaagcagccccctccaatgctgccactgagtgcaggccatctgaatgcaagttgattgacagatatgaagctccaccatttgctcagtctgtctaccctttacttgctgatctttatcatatatttgctgatattccatcgattggtagggctatggtttctgctcagaagttgcttacacaagttcacaagggggagccaatcagcagtgatatgttgtctgatgtgtatgtatttagaattgcaatagaagccctcaggatgggcttaaacagtgcagccaggtcccaaattgataccggagataaacatggctcaaatgatctggatttttcaaaactccaatctgatgagaagtgccacattcttcttgtgcaagctctcaggagtcaactaagagagtttggttctgtggtggctatagttgacgcgagctgcttagctggaataaggagacattggaacacccctgttccttcagaaatcactcaattagctagcagatgcttcaatcactatggtgctgaaaatgatgataaaattgaggtaccttcagcagacgacactgacaaaaaaagttggatatctgagaaacctgtggttgctgttggtgcaggagggacagcactcctgggcttttcatcattatcgaaatctcttcaggcttctgccttccttaagatggccccttacaaaagtccagcggttctgaagtatggattaatgcagctccaaagacatgctgctattgtattaagcaagatactccctcacggggttgttaccgctggctcgaaggcttctgctttgcagttcacggcttcagcagagaagattcgagcggtcacgcataccgtaatatcatcggccgagagaacaagcttattggttatgcggacttcattctacgaaataatgcagaagaggcacaggcagcctttcagaatatttccttgggcaacatttggctgcagcatggctgcatgtgctggccttgtgatgcatggagatgggatcgagtgcgcagccgaggcagcaccttctgttcccatgattgcttctctgggccgcggcctcgagagcttacgtctgacatcccaggaggtcagacaaacgaagggccaaaacgtgaaagaagctttgcgagcattaatgagcagcttgaagaaatcagcaaaataaagggccagcacttcacaactggagctgtatggatttttgtcttgcgatttgggggcaagactagaattatcgtaactgtaaagtgcactttccttgtttgccgcgatagtgaaattatgtgattatgcttgttagcgtggctagcttgaaactagggaccccctgagcgagataagtgtgtttttattaactttctgtacatacatacaagatataatgttctgttaacttattggcatagacataatccaataaggtttcaatgacctatggcaaattcgaggtgctcaggtgcaatcggatgcaatgtacagaagtacccccactggccactgttcctcgtcataatatcttttatttcatataagcaacgcaattacattttcagtattcttttttaggtcatgtttgcaactgcctactttgtgctttatcaccattttggtaacttgatgctggtacgttaacaatggacatatatatgcattttgtctgaagtaaaaaaaaaggttgactagagaatttagattaattcttggcatccttatgatatttgcatggctgatgttgcacataaagatatcccatgattacacaagagtgaaaaaaaacaaatccgtcctttgtatttccttattcgttaaaaaaaggccgatgctgacatgctgtgcaaatggaacgcgggctcttcagacagttgctgctttgagggtgagaaaatctgaaatctgattcgtgtagaaatctggctggatcgagttgtcggggctctgaagcgtctgcagggaagtcacgcctgaaagagcgagccgagccctgcacccttgctgatgttaaatcagcagtgccttgtatcaatcagaaatcagagttagaactgaggaactaatgaaaacctgagaggacgaggagagtcttgcagcctccattctgaccaaacaggatatcggtatccaatcggtcccccaccatgcatatctgggatgttgtgattccgaacctgtcatgaagcagtgtaagcatctggaaaacttgccgtgggctgtatggtttattattacacttaaaacattcacacatccttcgacgaaaatctcaaacacgggacatctttagaattgttcgagcctctttacttctttgccaggtagtccatcatgaaggtggatggcttcccgaccacgagcggttcttgcttagtcgaaccgagaagtgcaccgaccattgctccgccacctgcccattcttgggcgtcagtaagatgggtgacggcgtccctgtttgttgcgatgaaaaggcaccctgggttctcacggatgcacagtgtcccgtacctaaaaaaaacgcatcggcggcaagtttacaggccttgtggaacgatattggtgtgattctgtatgtatgaagtatgaacatgtaggcttcagcaatgcgaagctctgaagacttactgaactttgtagtagttgaagtagcgatcaaatcccaccacgaccgctcccacctgtaaaacaaaccctccaaaagcgtgccatttggttggtctacttctaacagcatgccacacccacccccagaacgtggagaaggatcatacgtacatcttcgtcgtgctccatgtagagaccaggcttgagctctatcttcttgtctccgtctgtctgcag

SEQ ID NO: 16896 - DNA, 1946 bp, Zea mays
  misc_feature (791)..(791): n is a, c, g, or t
tggcaacagattatttctaaaaaaaagtgtagcgtactagtaggagtaatcacttactcaagtctattgtatcatcgtctattgtaggcaccacgttcgagtctattgaaaaaatattagaaatgagagtatgtatggtagtctcttcgagagtaaagtccgatacatcaccgtcttctctaggcgccatgttcaagtctattgatttttttttaaaagtgaacaataagtaaaaaatcaaatggcaagtaaccagaccatgtacgtaccaaaatcattctcaataggtggctccatattcaagtcaaatgtagcattttcaacatgcaccaaaatcattctcaataggtggctccatattcaagtcaaatgtagcattttcaacatgcaacgccattgctttgttttggagttttgctgcttctgtttgttggtaccaggagcccaacgtaaggctttaataactgacgaacgctaagagcaggtgcaagtcacgaaacgacgtcctggatgcgcggtgcaatttgtagcaaaaatattctgggcgcgcagtgcaatttctagcgaaaatattctaggcgcggagcgcagtgcaaaaataaaaaggtgcaacatccatgcaaaaaagggaggccacaagaatcaaacttagaaatgcatgatagaaagcagcgttgctgaccaattgaaaccccaaatagaattcaatggatgagacaacgagaaatatttaatatgggtacaatcgaaaatatgacttcaacttaaacatttcttggtatgcgtattcntgtccaaaatgactagtatttcaataccgtaggggtagtccatactgtcagttggattgatctggttggatcgaaccagtttttttcggaccgtatcagattggattggcctgctaggacggctcatgatcaggatcaggtgcacggtaaccgtgtacgtaggaagctttacgtgcccaatcgaagacaataaaaaagcgaagaaagaagtactgcgaaaaaaacaaaatttgaagacgcctaacagcccgactgcttcgtttccacgcgcacgaaaccctagactagataaaaagttcccatttccctcaattccccaacttccctcgccgcaatctctcgccgcctccagtccagagccaccgtgagatctgcccgattccgccgcccggacccggggactccctcccctcctcgatccgttcgggcggccggccggcctagcttcaagtgcggggatggtgttctacttcaaggcgcggcccgaggccggcgactacaccatcttcatgggtcttgacaagtacgagaacgaggacctcatcaaatacggcttccccgaggacatctggttccatgtagataagatgtcctctgcacatgtgtatgtgagattgaataaaggtcaatcaatggatgacatgagtgagggtttgctggaagactgtgcgcagcttgtcaaagctaattccattcaaggtaataaagtcaataacattgatgtagtttatactccatggtacaatttgaagaagacgccttcaatggatgtgggccaagttggttttcacaaccctaaattggttcgcactattaaagtggaaaagaggatcaatgagattgtgaaccgcttgaataagacaaaggtggaacggaaacctgatttaaaggctgaaagagagctattagtgctgctcaaaaggctgaatgccaggcacagcttggacaaactacaaagagacaatattatatcacaaattttggcttcattttttcttgcaagaatgtggaatacaagctgtagtccggcacatgtgatgatttcttcatttttggtgcaggtaataaagtcaataacattgatgtagtttatactccatggtacaatttgaagaagaccccttcaatggatgtaggccaagttgggttttcaca

SEQ ID NO: 16897 - DNA, 1326 bp, Zea mays
cgaagaaagaagtatgaataaaacaaaatttgaagacgcctaacagcccgactgcttcgtttccacgcgcacgaaaccctagactagataaaaagttcccctttccctcaattccccaacttccctcgccgcaatctctcgccgcctccagtccagagccaccgtgagatctgcccgattccgccgcccggacccggggactccctcccctcctcgatccgttcgggcggccggccggcctagcttcaagtgcggggatggtgttctacttcaaggcgcggcccgaggccggcgactacaccatcttcatgggtcttgacaagtacgagaacgaggacctcatcaaatacggcttccccgaggacatctggttccatgtagataagatgtcctctgcacatgtgtatgtgagattgaataaaggtcaatcaatggatgacatgagtgagggtttgctggaagactgtgcgcagcttgtcaaagctaattccattcaaggtaataaagtcaataacattgatgtagtttatactccatggtacaatttgaagaagaccccttcaatggatgtgggccaagttggttttcacaaccctaaattggttcgcactattaaagtggaaaagaggatcaatgagattgtgaaccgcttgaataagacaaaggtggaacggaaacctgatttaaaggctgaaagagaggctattagtgctgctgaaaaggcagaaagaaaggcacagcttagagacaagaaacgtagggaagagatggagaggcttgagaaagagaagcaggctgatatcaggagctacaagggtctaatggtccaagagaagatgacttccaacaagcaaatcgcttctggcagcaagaccctgcaggaacttgaagaagactttatgtgagaggcggacattataaatgccatgctgaagatttccttgaactgcttctgtcgaagacagaaggggtaccacaggcttgtgagatactggatctaaatgactcatgggcaggccatggtctgttattatctcctcttgctgttgtggtctatgtaaaccttgtttacttgctgaaaaaacaacggtgcatgctctaactgtggttgatgtaatggtctgttgcccatcaagttgaaatggtaatggaattatggtttcctggatttttttcaaacaataaagacatggcagcagataacttacatattccattctttgcatggagaacggctcaggaacttctttgtttgtgtaagagtgttatagaaatgaaccacacttagcttacatttggagattctttaaaaaaaaaaaaaaaaaa

SEQ ID NO: 16898 - DNA, 840 bp, Zea mays
  misc_feature (68)..(68): n is a, c, g, or t
ttcagagcgccgatggtgttctacttcaaggcgttgcccgaggccggcgactataccatcttcatggngtcttgacaagtacgagaacgaggacctcatcaaatacggcttccccgaggacatctggttccatgtagataagatgtcctctgcacatgtgtatgtgagattgaataaaggtcaatcaatggatgacatgagtgagggtttgctggaagactgtgcgcagttttttttttctaattcccattcaaggtaataaagtcaataaacattgatgtagtttatactccatggtacaatttgaagaagacgccttcaatggatgtgggccaagttggttttcacaaccctaaattggttcgcactattaaagtggaaaagaggatcaatgagattgtgaaccgcttgaataagacaaaggtggaacggaaacctgatttaaaggctgaaagagaggctattagtgctgctgaaaaggcagaaagaaaggcacagcttagagacaagaaacgtagggaagagatggagaggcttgagaaagagaagcaggctgatatcaggagctacaagggtcctaatggtccaagagaagatgacttccaacaagcaaatcgcttctggcagcaagaccctgcaggaacttgacgaagactttatgtgagaggcggacattataaatgccatgctgaagatttccttgaactgcttctgtcgaagacagaaggggtaccacaggcttgtgagatactggatctaaatgactcatgggcaggccatggtctgttattatctcctcttatataaccttttgaacactcttaaaaaaaaaaaaaaaaa

SEQ ID NO: 16899 - DNA, 2203 bp, Zea mays
taggatttatctcccaccaacccatttaattttcgttattttttattgcacatgcttatcattacatgtactaaaactgatgaataatagcttcgactataatatctgtaactcatccttttcttttttgaaggttcgcactattaaagtggaaaagaggatcaatgagattgtgaaccgcttgaataagacaaaggtggaacggaaacctgatttaaagggtatgtcacatttatttgaaagcatttctgtcgtcatttttatgtcagcaactcagcattctataatgaacatggttaagtatttttctttttgtttttgggattcataatgtgagtatttatctcacaaagaaagtgaggatgtaatgtctaggctctgtttggtggagctgtagcttttccaaaagcacctcctgaagaagctttcgggaaaagcttgggaagctgctccttgaaagcttctctgcttttagtacaacaaagtgctgcttttatcagcttgaagaagctgctgccctgtttgggggagcctctagctttttgagctttctgtagaagcgaaagctgccagaagctccccaaatagggccttagatcatttcgattttgcagaatctagatgcgcaaaaggatgttatcatgataacaagatttttgggaatcgtgaaaatgtttgcgtatatgttggtatctgtttggtctatgaataaaaggcatggttgatggattatcgttttcaactgaatgataaatttgacgcgttggcttgtcgcatgtgcacttcagtcctgttatttgagtcaataatcatcacatcgtttcctgccagctgaaagagaggctattagtgctgctgaaaaggcagaaagaaaggcacagcttagagacaaggtaaagatatttctaatgctataccagccgtgttttcttttgttgccatgtgctggttatgtagaaatcaaagatctaacttgtttgtatttctagagcatagcaaattatatttatgggcagcaaactggttgtaacagatcttgtaggaaccaaatatttatgtagttgattctattgtaattaattttctagggcatatcaaattataaataggatgttggtactacctgacaaaataactgaactgctgaacttttgatagttagaatattgacataacagatcactggattatgtttttcttctgtttcagaaacgtagggaagagatggagaggcttgagaaagagaagcaggctgatatcaggagctacaagggtctaatggtccaagagaagatgacttccaacaagcaaatcgcttctggcagcaagaccctgcaggaacttgaagaagactttatgtgagaggcggacattataaatgccatgctgaagatttccttgaactgcttctgtcgaagacagaaggggtaccacaggcttgtgagatactggatctaaatgactcatgggcaggccatggtctgttattatctcctcttgctgttgtggtctatgtaaaccttgtttacttgctgaaaaaacaacggtgcatgctctaactgtggttgatgtaatggtctgttgcccatcaagttgaaatggtaatggaattatggtttcctggatttttcaaacaataaagacatggcagcagataacttacatattccattctttgcatggacaaccggctcaggaacttctttgtttgtgtaagagtgttatagaaatgaaccacacttagcttacatttggagattctttaattgaaggacggctcattttcctttactacatctacatgattgctatggttgaggattcttaggtcagttaaataaagcactttgatacgttctaaattataggttattttaaatttttagagaatcaaaacatctcaagattgacattcatcctaaattataataagtcattttaatttttaagaatcaaattatctcaaatttgatcaaaattagtaataactacaaaaatgtatagcatcaaatagacatactatgaaaatataattaaaaaatttaatgacattttataaatgctattattttattctataaatttggttaaatttaagatggtttaactctgtaaaaagttggaatggataataatttaaaataataagagataagagattatgtaataaaagagagagggttgatgtaaatttcaagggatc

SEQ ID NO: 16900 - DNA, 2375 bp, Zea mays
  misc_feature (389)..(389): n is a, c, g, or t
atccaatgagcttgaataggggctacaaagtgcaactataggtaaattggtaaaaccatcagctttgagtgttcaaataagttgcacatgcctaatacaaagtgtgttagcacttctgtttgactactaactcaattatgtgagaaaaatgcattttggacataggatgagctaaactgcaaaccctagagaaagtactagtgaaaggtgattttccatacttagtcaattggattatgtgctaatcatgtttgtccaagtcgtagggaagctcccaaaaaacgaaaaggtttggaaaagataggctcaaaagagccttaactgggttgttctatgactcaccgggccggtccgaaagcgcatcggaccgggtccgcagaggcctaganttagccatttgggacatccccttttatgtcccatgtgtcctcatccaccactaaggcaaataagataatgtctcaaaactaagccttgatgtaattctgttataatcggaaagtcatctagtctccatcatttgctcgaatcctagtcacaacatactttattggaatgttatgtttgtccaaagcccatcacataatatttcttggtattttattataaaccttcttcaagtcaacgaaaattatgtgtaggtctcactaggtttaaccagaaaatatatttcataattaatttattagtattttataggaacatattcgatgcaaactaatttactaatgcaaatcatgggaatcaataaaaggatagatgtgtgatgacctttttcaaaaatattataattcaaataactcctcccatctctcaccggatattttagaaatagtcttctctccattcttgtgttgatttatactccctctgtcctaaatttaaatttattttacattattgctagattcatgtatgcattgtatatatatgtctaagttcaaaatcatttatataaatatggacataaaaatctagagctaatatgactactattttattaatagattgtgtttgcatatgttagcctctatagcttgacgaagccagaaagcctagcttctatctcgatcatattttgtaagtttccacgaatgatagtaataagttgatttgcgtatgggtagccttgtagcaagagaaagttggaaagtgtaggtagtcggcgcgttcctgtgctcgaagaaactggtcagggtgcgtggtctggaaaggatacatatgttaataagctgctgtgatgatgactgatgatatctatatatcgctgtgtgatccacaagtgcacacgtgtcgcggatggccggccgggtcggtggcaaacgaccaactatggatcaatcaatcaagcatgattgtccatctggaacgatcgatctgcaaggaatgaagcatacgtagagtgtagcatgcatgattgacatggttaacggatggatgacgacgcgtggcgatcgaagccacgtgcacgtgcaccggccacgtttactgcgtcgggcctcgacacggcactcgcgccaggcaccgtaccattcccgcaccccgccccggccggcggcccccagcacgtacgcgtggcgcgagggcacacgcggctgggtgggtcgccggccaaccgaccagctcaccgttggttttaaaaaggacgcccagcggctcgacccaaattcggcacaccatctaggctagtctacagctagtacacaccccacaacaatataatcgtcgtcgtggcggattggagttgacagttgccataccaccagtactagctcgctcgctcgcttgctctcagaactgatcgctgtgaggagtatgccgtcgctgtggccaacgaggaagaagcgggcgcgaggctcggcggtccggtcgtggtcgcgccgccgcgggagcaagaaatcatcgtcgtcgtcgtcgctgggggcgctgtggcggcggatggtcgggccacgcagggggacccggacccggactcggacccgggcccgggggaagaagccggggctgctctcgcgcgccgcgcgggtgctctcctgcggccgccgctcctactgatcgatgccatccggcgcggaccggccggcgggcatcgaatcgtccgaatcgagatctgccgtgacgtgcgcgcgtgacttgtctctattcccttcgtgcgcgggttgttgccatgcccgcgagcgctgctgtttcccgtgtcgtgttcgtacctgcgtgggagctatagatgcactcgtgttgtgtgtataaatcattctgtatataaacttcacttgtaatgttgatgttgttgtcatggcgtccagcgtctcaattcttcgtgcccccgcagaaaaaaaaaaaaaaaaaaaaaaaaaaaaaaaaaaccccaacacaat

SEQ ID NO: 16901 - DNA, 653 bp, Zea mays
accgctatctaggctagtctacagctagtacacgacccacggcaatcgtcgtcgtggtcgtggcggattggagttgacagttgcgataccactagtactagctcgctcgctcgttctcagaactgatcgctgtgaggagtatgccgtcgctgtggccaacgaggaagaagcgggcgcgaggctcggcggtccggtcgtggtcgcgccgccgcgggagcaagaaatcatcgtcgtcgtcgtcgctgggggcgctgtggcggcggatggtcgggccacgcagggggacccggacccggactcggacccgtgcccgggggaagaagccggggctgctctcgcgcgccgcgcgggtgctctcctgcggccgccgctcctactgatcgatgccatccggcgcggaccggccggcgggcatcgaatcgtccgaatcgagatctgccgtgacgtgcgcgcgtgaacttgtctctatttccttcgtgcgcgggttgttgacatgcccgcgagcgctgctgtttcccgtgtcgtgttcgtacctgcgtgggggctatagatgcactcgtgttgtgtgtataaatcattctgtatataaacttcacttgtaatgttgatgttgttgtcaaaaaaaaaaaataaaaatgcgagcccaacacaat

SEQ ID NO: 16902 - DNA, 937 bp, Zea mays
attcggctcgaggttacacagggttattggattaaggcagacgacagccaggcgaaacctgtttctatggacaatgtcatgtgaaagtgcgctcatatgctgctgtatgcaggatgttcaccgagggcaccaagctctgtttggcaggctatgtcggacccagcacacccgaagcaggccaagcagagggtggctccaggaggaccaacatggcgaggaggttccttcaacgggcaccaagctggccagcggcacagcgacgacgcggaagacgacgacgccacacatgctgcatttgacgaatatagatacgcaccatattcgccttcagattctccgagccctagcgagagttcatccctcttcagcaactccgacgcagggtcgcacagcaccgacagcagcgagagcacgaggaactcgacaagcaccgaggagtacgagtacgtgttcggagccgctgatcagatgtaccgcgtgggagggggggcacctgtggagggtggctatccgacgtattcccgttcgaggtccagcttgaatgccagctcatcgggccgggaggcatacagcgcgggtacctacgctgagcacaggactcagggcggcggtcccggtgggctttgggttgagggcgacgagagcccgtccttgttatacactgacagaagtaaacagccgtcgaacagtacgttaagagaccagtataggcagttagataggagcgaacatgaccctggacaaaccaggggcggtgttttattgagaagaccatctagggacaggaccgcccagacattttattgatgttgcagggtttgggctgtagtctgtagagaaataaatagtgtaatgtagcctgtaatatgtatctcgctgcaaacatgtaaaaaaagggggagaggaatgtcgtagttcatatttgttaaatgcctag

SEQ ID NO: 16903 - DNA, 2436 bp, Zea mays
aaatgttcctgataatgagccagttaagccaccggctttagacaacactccttttacatttgttgaagacctgaaaaccttggaggtgctagccacaaagctgaagggcacgagaccattacctagaacatcctaatcgaaaaattataggtcgtttcagggtttgacatgcttgatgcagatttcaacaagaacagaagactttattgttgacactcttaagcttcgtaaatatcttggtgattatctaagagagtttttcagagatccaaccaagaaaaaggtaatgcatggtgcaggtcgtgatataatatggcttcaacgagacttcagcatatatgtgtgcaacctttttgacacaggccaggcttcaaaggtcttacagatggaccgcaacagcttggaacatcttttgcaccatttctgtggagtgtctgcaaataaagaataccaagctgcagattggagattgaggccccttcctgatgaaatgatcaaatatgctagagaggatacacactatctgctatatatatatgacctgatgagattgagactagtgaatgggtcatcatgtgaaaatgatcttcttttagaggtttgcaagcgcagcaacgaaatttgcttgcaactgtatgagaaggagcagctgactgatacatcatatctacatatacatgggttgaaagaaaacgagctgaatgcaacgcagctgtcagttctttctagtctatatcgatggagagatggcattgcccgtgctgaggatgagagcactggctatatattacccaataagactctacttgagatagcaaaggagatgcctgtgacaagtgggaagttgaaaagaatgattaaatcaagaaattcgattttggaacgaaatctcaaccatgttattaacaatataagggatgccatagcagcttctggtgcttttgaaagtatagtggagcagctgaagaagggaaaactggaagagttaacattggcagatgtgaagaacagcagtgaggacactgaaatgattcctgctgttgatgttgataacattgaagatccgagtgatgaatctgctgtagttcctgcagtgattacaaatgtcggtgctgctccctgtattacacgcgaagcttccttgggtaatatgcatttagaggaccttgtgcctaaaacaaaggactcgggtgcttcatcagggtttactggactgacagacaacaaaaagctcagcaatgaccagcagcaagcagcaaaggctactgttcaagtatcaaagaggcctacagcttttggagctctgtttggaaagccagctgctggaagaaggccagatcttttcctaggattttcaaatgttcagggtaagactaaggtggacaagataacgtcttccgtggtacttccttttcatcatttctcaggtggtgcaaaacttccatcagccgtcctttcagcgaaagaatcgttgcattctgaaccagacagcatccaacacagtgatccagcttgtcagttggaagaagtgatacagttggacatgggaacagacgagcaacaaccaccagaaaatggcaacgaggatgatggacactgtgagactgaagacacggagatgtcaaagtccccttcaggtgacccgtctgttaccgagcaacgattccgatcactcaacgaagaaagaaacgttaagcagatccagaagacacctagagaattcgaatttagtgttccggtggtgccttttgattatgccgaagccagaaagaatctcgtgtctagtttgcctaaagctgagaggagaaaggacgatgccgttgccagggctataaatacagactctggagataagcagaggggttcaaaaaagccaccaggtgggggagagaacgagggaaatttacagcatccacgaagacggcaggctttcccgccttcaggcaatagaaatgctacgtatcaccagtagcaagttgagatgtataactggcgaattggattattccaaaattgtgataaaagagtaccctacgtgttgtatatttggactggggatatctcggactcatgagaaaccaccgagactgctactgcaccgcggtgccctgacgtgttgctaacacgtgctaggtgactgagaatagttgggtattgcgttttttttaatatgttctgaacatgagaatgccctagtatttcattaggatgtgtacattttacaatgttttatggacaattactgttgtatttttacttttgaactccagagccctgttttggtcacgcactacaattttcacctaaactcttttccgaacgtttactatattgggctgtttggatccctttattttttatgtttttttttttctttttttatttttattttttttattgtttatttttttttttttttttttttattttattttt

SEQ ID NO: 16904 - DNA, 1351 bp, Zea mays
cgctatgagtgatatatgctaatgcctctgccaacaaacaaagaacagacctatcgctacacagtccgccgtggctctctgcaattaatggctgcctccacagcgtcgtcgtcatactctgccggtgtaagcgccgcctgctgtgtgtctccgcgccatggcagcagcttcgtcaagccgcagcgctctggacggccggcggcggcggcggcgaccctacctgcgtcaggcggcgaccagccgaacctatcgttagactgctgtcgtacgtgcatgcgtaggagtaagagtagggctagaagaggcgagcgaatcagggcttcagatgatgctgcgaccatcatggacgcgggcggctgggcagcacggcttgaagccccgccgccggtagccgtcgtcactggagcgtctagagggattggcagagccatagctgtagcacttggcggagcagggtgcaaggtggttgtgaactatgccaagtcaggcgtggaggccgaagaggtgtgcagagagatcgaggcgtccggtggaacggcggtgagcttcgctgccgacgtctcctgcgaagccgacgtcgagtccatgatgagggccgccattgatgcctggggaactctggatgtgctggtgaacaatgcagggattacacgtgacgcgcttctgatgcggatgaagaggacccagtggcaagaggtggtggatgtcaacctcaccggcgtttacctctgctcgcaggctgcagcgacgctgatgatgaagaggaagaagggaaggatcatcaacatcgcatccgtctccgggatcatcggcaacgtcgggcaggccaactactgcgccgccaaggctggggtcatcggcctcaccaaggccatggccagggagtacggcggcagaaacatcaatgtgaacgccgtggcgccgggctgggtggcgtccgacatgaccgccggactaggggacggcgtggaacggaaggcgctggagaccataccattgggacggtttgggagaccagaagaggtcgccggcctggtggggttcctggctgttcatcctgctgctagctacgtcaccggacaggtgctcactattgatggtggcctgtccatttgagggttttctgatcctgccaacagaactacagagtcaagcacaacgacaacaaaaaaaggaaatcagaagctacagaaggcagcaaaagactgctggagtttgaaaacaaaatgcatcgataactaaactgaagaatcattgttaaaaagaagctatgcatgggagagataaataaagtaaatcgtcttgcttcggaaaaaaaaaaaaaaaaaaaactcgagggggggcccggtac

SEQ ID NO: 16905 - DNA, 1795 bp, Zea mays
aagacgactataatcatgcttcatgccctacccagctatcctatccctatcccctcttttgctttccttcccctgcctgctcaattcttctcgtgctgtcacccctttcttcaatcgcctcccgattcccgcggggctcgcagatcccggaaggacaccccgccgcccccgatgagccgccaccgggtcgagacctgcgactcgtggcggcccccgcggaagaaccacgccggtgcgccgccgctcctccgcgcggggcctcggctcctcgccttcgcctcgctctccgtccgcgacggcggggactccgccgcggccgtcgccaaggcggttgaggaggcggttgtcgtacgatccgatgaggtgaaggaggcggtggccggggaggagaggaagaagacgaagtcgacggagcgcaggctgccccccgcggcgcagctggtgagccatccgctcgcgctgctggcgctagtacccaacagcgccgcgatctttgccgcgggggccgctgcgggcactgtagccaagaccgtcaccgcgcccctcgaccgcgtcaagatcctcatgcagacgcatagcgtgcgggtggcgggagagagtgccaagaagggtgttggatttctcgaggctatggcagacattggaaagaaggatgggcttaagggttactggaaaggaaaccttccacaggtcattcgcattattccttacagtgcagtgcaactcttctcgtatgaagtttacaagaaaattttccggagaaaggatggagagctttctgtatttgggagacttgccgctggtgcttgcgcgggcatgacatctacacttgtaacttacccactggatgttctccggcttaggctagcagttcaatctggacacagcactttatctcaggttgctcttaacatgctgagagaagaagggctggcctccttctatggaggcttgggtccatctcttgtagcaattgcaccttacattgctgtgaacttctgtgtttttgacctgatgaagaaatctgtaccagagaagtacaagaatagaccagaaacatctctagcaaccgctcttctttcagcaacatttgcaactttgatgtgttatccgctggacactgttaggagacagatgcagatgaaaggcacaccatacaatactgtttttgatgctattccaggcattgtggagcgtgacggtctaactggtctttatagaggttttgtgccaaatgcgttaaaaaatctaccaaatagcagcattaaactgaccgtgtttgacacggtgaagacactgatagctactgggcagaaggagatggacaaattaattcaagaaaatgaggagaaaagaagctaggaaaagagccttggtcaatcttgaaggctttggtagaaagcatgcctctttgcagactccatattgctatgtttcctcgtttgctggtgacatattttaggatctaggcagcgcatctttctgttccttttcaaatagatctagtttccagtgctttccgtagcatccacattcatagagatagaggtgggcattgagttgtgatctctttatctagtgtcggtagcattcccctacagatcttacctattttaatagaggatagtgtatcaatgtgaccgccccagattctttaaatgtaattattatacataatagccagaacaatcaaatatcatggagcacaggagcatgttctccttgtcaatgaattagcatctttgatttaacgaacatattgggtgtctcgtaaaaaaaagggggcggccgctct

SEQ ID NO: 16906 - DNA, 1613 bp, Zea mays
atatcccaataatctggggagccgattcggtaatttttttggaagcccaagtccagagcgggtccagcccagttcatcctccacctgctccgccggctgctcttcttctcccctctcgctatatccccgggggacctcacagccacatctctccactgctccgtccagcgcgtccacctcccaaacccctactcccccaggaagcaatggcttcccccacccagggccaggtcatcacctgcaaagcggcggtggcgtacgagccgaacaagccactcgtgatcgaggacgtgcaggtggcgccgccgcaggccggcgaggtccgcgtcaagatcctattcaccgcgctctgccacaccgaccactacacctggagcggcaaggatcctgagggtcttttcccttgcattcttggccacgaagctgccggaattgtggaaagtgtcggtgaaggagtaactgatgtgcagcctggggatcatgtcattccttgctaccaagcagaatgcaaagaatgcaagttttgcaagagcggaaagaccaacctctgtggtaaggtccggagtgccacaggcgtaggtgtcatgatgaatgatatgaagagcaggttctctgtaaatggaaagcccatttaccatttcatggggacatcaacattcagccagtacactgtggtgcatgatgtcagtgttgcaaagatcaacccacaggcacccttagataaagtctgcctgctcggttgtggtgttcctactggtcttggagcggtgtggaatactgcaaaggttgaatctggctcagttgttgctgtttttggccttggaacagttggacttgcagttgctgagggagcaaaagctgctggtgcttctcgagttattggcattgacatcgacaataaaaagtttgatgttgcaaagaactttggagttacagaatttgttaacccaaaagagcatgacaaaccgatacagcaggtcctggtcgatcttacagatggcggcgtggattacagctttgagtgcattggaaatgtttcggttatgagggctgcactggaatgctgccacaagggctggggaacctccgtcatcgtcggcgtcgccgcctctggccaggagatcgccacacgaccattccagctcgtgactgggcgtgtctggaagggaaccgctttcggtggcttcaagagccggacccaggtcccatggcttgttgacaagtacatgaaaaaggaaattaaggtggacgagtacattacgcacaacatgaacctggctgacatcaacgacgccttccacctgctgcacgaaggtggctgtctgcgttgtgtgctggcaatgcagatttgaaattcctaagctaagcagtttttgttttggaactagaactcctttttgcctcgttaggcctggacccgctgtataatgctatgttgtgttggatggctgacgatggttactgctgtgttgctagcaatgtggtacttgatctgtatcacggttgcaaataagtgctgtttctaaaacactccctctcggtgaataaggggttgtttggtttgaggaatcattccatccaaagtgaggtggtgcgtcatagatctattcctc

SEQ ID NO: 16907 - DNA, 1683 bp, Zea mays
  misc_feature (1599)..(1615): n is a, c, g, or t
atttttttggaagcccaagtccggcgggcggggagcccagttcatcctccacctgctccgccggctgctcttcttctcccctctcgctatatccccgggggccggggacctcacagccacatctctccactgctccgtccagcgcgtccacctcccaaacccctactcccccaggaagcaatggcttcccccacccagggccaggtcatcacctgcaaagcggcggtggcgtacgagccgaacaagccactcgtgatcgaggacgtgcaggtggcgccgccgcaggccggcgaggtccgcgtcaagatcctcttcaccgcgctctgccacaccgaccactacacctggagcggcaaggatcctgagggtctttttccttgcattcttggccacgaagctgctggaattgtggaaagtgtcggtgaaggagtaactgatgtgcagcctggggatcatgtcattccttgctaccaagcagaatgcaaagaatgcaagttttgcaagagcggaaagaccaacctctgtggtaaggtccgtagtgccacaggcgtaggtgtcatgatgaatgatatgaagagcaggttctctgtaaatggaaagcccatttaccatttcatggggacatcgacattcagccagtacactgtggtgcatgatgtcagtgttgcaaagatcaacccacaggcacccttagataaagtctgcctgctcggttgtggtgttcctactggtcttggagcggtgtggaatactgcaaaggttgaatctggctcagttgttgctgtttttggccttggaacagttggacttgcagttgctgagggagcaaaagctgctggtgcttctcgagttattggcattgacatcgacaataaaaagtttgatgttgcaaagaactttggagttacagaatttgttaacccaaaagagcatgacaaaccgatacagcaggtcctggtcgatcttacagatggcggcgtggattacagctttgagtgcattggaaatgtttcgattatgagggctgcactggaatgctgccacaagggctggggaacctccgtcatcgtcggcgttgccgcctctggccaggagatctccacacgaccattccagctcgtgactggtcgtgtctggaagggaaccgcttttggtggcttcaagagccggacccaggtcccatggcttgttgacaagtacatgaagaaggaaattaaggtggacgagtacattacgcacaacatgaacctggctgacatcaacgacgccttccacctgctgcacgaaggtggctgtctgcgttgtgtgctggcgatgcagatctgaaattcctaagctaagcagtttttggatgtgtcggcatagactgtcttttgttttggaactagaattcctttttgcctcgttaggcctggacccactgtataatgctatgttgctttggatggctgacgatggttaccgctgtgttgctagccatgtggtacttgatctgtatcacggttgcaaataagtgctgtttctaaaacactccctcggtgaataagtgatctgtatcatgtgtgggaaagatgtttactaaaaaaagaaaaaaaaaannnnnnnnnnnnnnnnnaatgtttggaaactgaatcatacccattggtgcaaacaagaaacatagatgaaggtggatggaccttc

SEQ ID NO: 16908 - DNA, 1733 bp, Zea mays
cattgggtacctcgaggccggccgggaaatagagagccgccgaggcgggagcgggaaaaccgccgcctggtggctcatccgcggctccacgcccaaaaccccaaattccctatccctatcccgcgcgccctgttcttcgtctatctctctcccgactcggaaggaaaccctaggcgccacgctagggttctcgaaccttcgctccccaccccccgattcggaagccctagcctggaaggttccgggaccttctggcgcgggaggatggcggtcgtggaccagtcgctgctgccccagatccatgccctcttctccgacccgcttcgcgtggtttcgtacaaatggctcagtcggaacttctctgtgtcatcaaatgatgccaagaggttgcttcaggactttgtcaacaaacatggaactgacctccaagtgatttacagtgtgtcggggtggttgaagagcaatccccaaaactattgtgtaaagctcatttcaggcccaaaacttgaagaagcaaggcaaattttcaaagattcttgttcagttcagatctacagtatccaggcctgtattccaaaagatacagctgtactttggaatcctgaatttgtgcaggcagaggagcttttcaaccagccttttgattatgagaactgtttgagagataataggttttgtggtgttttgaattcttttgtcaagcgaacatccaatggaaagcatgtgagttcattgccaccaaagcccttgaatagtgctgcagccgccgcgcagtctaagcctagtgttactccaaaggagcagtttgttactgctcggcggcaagatttgcctgtaagttcaaagcagggagcagacactaagtccgagaaggataattccacagtattagataaggctggcaatggtcctgttgtcaaagaacaatcagttgaggcccatgcaagcaaaagtaaagctcaaaatggaaaggccatgcctagtaatggtggatcgctggctaacatgtggggccgcgcatcagcaaaacctatgcctccaagtaccactaattctacagctgtagcaagtgttgcaggaagaagcagatggaaatagcagcgatgatgaacatgggataaactacaagaggggatccactaatgcaaataacagaaagagaacagtggtatttgattattcggatgatgaggaagatgacaatattgcacaaggactgtgcacacagctggttcctactttggctctttgtggcatactggtatactatgcggcgtactcagttggaatgggcccagttccttgggttatcatgtcagagatattctcaatcgacatgaaagcaatcgccggagggtttgtaaccctggccagttggattggttcctttgcgatttcatactcattcaacttcctcatggattggaaccccgcagcacattctttctgttctctgcagcgagcctggtcactgtgctgttcgtggcaaagctcgtgcctgaaactaaaggaagaacactagaagagatccaaacattgctcaaagccacatgagtggctaccattcgctcagtaggtaaagatccagttaaaaaaatgctgtaaatattcgcctcttgtaaattcttgtgcacggcaggtgaatgatttcgcctcttgtcgattctcctatattttagtctctttgatatatgttatttaggacaaagatacggtctacaacaaaaaaaaaa

SEQ ID NO: 16909 - DNA, 5326 bp, Zea mays
  misc_feature (4883)..(4883): n is a, c, g, or t
gcgggacccgctgtgttttttccagggatttttagaggcgccgaggcgggagcgggaaaaccgccgcccgggggcccgcccgccccgccacgcccaaaccccaaattccctatcccgcgcgccctgttcttcgtctatctctctcccgactcggaaggaaaccctaggcgccacgcgagggttctcgaaccttcgctccccaccccccgattcggaagccctagcctggaaggttccgggaccttctgccgcgggaggatggcgggaggggtcgtggaccagtcgctgctgccccagatccatgccctcttctccgacccgcttcgcgtggtttcgtacaaatggctcagtcggaacttctctgtgtcatcaaatgatgccaagaggttgcttcaggactttgtcaacaaacatggaactgacctccaagtgatttacagtgtgtcggggtggttgaagaacaatccccaaaactattgtgtaaagctcatttcaggcccaaaacttgaagaagcaaggcaaattttcaaagattcttgttcagttcagatctacagtatccaggcctgtattccaaaagatacagctgtactttggaatcctgaatttgtgcaggcagaggagcttttcaaccagccttttgattatgagaactgtttgagagataataggttttgtggtgttttgaattcttttgtcaagcgaacatccaatggaaagcatgtgagttcattgccaccaaagcccttgaatagtgctgcagccgccgcgcagtctaagcctagtgttactccaaaggagcagtttgttactgctcggcggcaagatttgcctgtaagttcaaagcagggagcagacactaagtccgagaaggataatttcacagtattagataaggctggcaatggtcctgttgtcaaagaacaatcagttgatgcccatgcaagcaaaagtaaagctcaaaatggaaaggccttgcctagtaatggtggatcgctggctaacatgtggggccgtgcatcagcaaaacctaagcctccaagtaccactaattctacagctgtagcaagtgttgcagctactgctgatgcacaaatttgtgcaaaggaagaagcagatggaaatagcagcgatgatgaacatgggataaagtacaagaggggatccactaatgcaaataacagaaagagaagagcggtatttgattattcggatgatgaggaagatgacaatattgtaagcattgcatctcctgagctaccaaaacagcataccccagaccctgttgttggaattgctgaagacgctgaagtaaatcaaaagagcttggaaaatgaacacgatgtaccaaacaatgggaaaggttcctcaacgggggtggattctgacttcacatctgaatgtaaaatcaaaacgatcgatcctatgaacgattctgggattactttaaaagaaaagagcagtgatcctccaatcaatgacaagaagcaggattctgctgctgagcctgcctccacctcaccaaagaggagaaaggttttgaagacacgcatagatgagaggggaagggaagttaccgaggttgtctgggagaatgaagcttctgcagatgacaaggcagagcagaatgtcaacactattgatgcgactgcaagcggggcgactgtcccaagcaaaccgaagcccgcaacaaacgctgacaaaagcaaagctccaagcaaaacagcagcaggcaacaagaaagctgcgaaggctggagccaagcaagggagcattatgtcgttcttcaagaaagcatgagccagcggggggtgcgcatgcaccaaaatgagacaggacttggttaagcaaactggcagtggcagttatacctgaacattgtcagtcaggccggcgagcaagaagggctgctccaagcaggcgaccgttagctgtatcgtttgttttagctagcgtagcgatggttgagtcaagcagcagagagcacgcattctagctgaggtagtactatcttgctgaagatgtacacgtacacatatacaataactgttgtctactgtgctgtctagaagagtaaaggtccaaggtggaagggcggaacagtttgagtgtacctgtgtctggttggtatggaccccactggaagagaggtacgccgtacgcatgggggtgactggactgtaatgtatgggctatgcatgcaaagtttggtcgggcgcccgtgtgtcttcaccgtttgttcaggttcagggcttgagtgccaaatctgaacttttggacgctcgctctgattacgttacggtgtagcacgatcgagtcatcgggatgagaagtgaacgaaaagcagtcgatggggggcaaattaaagagccaaagaccaaagagaggagtgaaatagaaggaaaggaagcagcgcgacccgtcgcacgtcttgtgttcccatgcattttttcattggcaagtttcacacggccagcagccgccaacggtatggcatgattacgccgcacacacacacacaacggctccgttcgcgccggccatggcccatgggcgatcaatcatggccggaagcaggctagacgctgcatgcgtcgtctaaccatccgagtaatctatctatgtattaactaatatgtacacgtcgttaacgcagtaatgaacccaatgctggctatctagtgcacacaccatcatggtcttggagggtgcgagctgggcaccggtggcgtagcaagccagcaaacggccgacagcaacgtagggagggagttggagagccagagccaccccatcgtatcggtatcgcgactcgtcaacacatgtttgctgttggtcctacaagatgacgattcatataccagcttggagttggagagccagagccacccctgcggccgaccgaagccagcggctaagcagctaaatgcctgaattaattaatagcttaattaggcacctgggctgggcaattgacgcccatccgacacctgaacggctctgctctgaatcgccgaactttgcattatttattatctttcgatcccgtgtgcacagctccaactgcgagatagagtattcctcagtcgctgtcgacaactgccagggtagagctagcgcacggaatactgtgatagagagagtattcctaagttccataaagataatttagaccttttaaagtttaaccgagtttttaataaaggaaaaaaataccagcatctatgtctccaattaatattccttctggccgcaccgcatcgccgcgccttgaggcagccagtggggccacgcacgcggcccatccccacacgtacgcgacggagggcccacgtcaccgtctcgtgcgtggcgtccaagaaaatctgcctgcctgtcctttccccgcccaaacgcatgacgcacgacgggatcagatcggccggccaatggggggaagtttttttttttttttaactgagcagacagaccaaagcactcgtgatcagttaccacattgtttgcgtgattgcaggttcacgtatgtaaataaattttgtgggggtgggtcgcttaattatggccaagaccgggcggatgggatgaataagggatatgtgtgatctggtaccataccacgtggtgcctgcggtacggggaatatgcaccgcgagactcatcagagagtcccatctcgcgtagtactgtaccgcgggtccacaaagcacacatattcagtcagtcgatctcgcgtggtaccgtccgtctatgacgtgtcgccgacgggtgggggctccgggctcccccccccccccccagtgcgtgtggagaatgtcaactccccacagcaaaaaaaaaaagcgagccggggtcgcctgggcgggcccacgcgtgatggaccagggatggatggatggaatgggccggaccgcggctgcaggggcacgtccaatccgttcacgtgggtcgtgtactcgtcgtgtggcgttagcgtccgcaatggccccaccacaagcaaagagagagagagagagagagagagagagagagggatcagggatcctagcgtagccgttgggccagcgaccgttagatagcctcggcttccggacacacacaccggcagaacgacctgctgcgtcccgtccgtcaccctgacccttcacgccccgcccacggcccacgggaccgcaacggcatggccgctcggtcggatcgccaccacgatgcgcggtccgaggatacatggaagatctgctggcccggaacacttatacgaacggacacattttaaaatactgttttatattatatactataatatctacagaatgcaaatctctactatctattaagacaatagtgtagaccgtccttgtgcccccgcctctcccctacgaaaactgcctccgcgcatgccagtgccgcccgccctccgtgcatgcatcgtcagcctgccttgtggggctagccctcacagcatgtcgcgctcacgcgtcagaacgcaacggcgcctccgcgctcgctcacccgcatgtcgcgctccacaccgccatctgcgcagcctcatccccttctatcctcatcaccccaccccagctcctccgccgaacagcgccaaacctccggtcggccggccggcgcaaagggacggccttttcgatccgagggttcaagtttacatcacggcgcgaggcgcaaagcccaagaaccccggtttcaattcttcgaaagccttagagcttgcagggacgggacgaacggaacggcaatgcgcaaaggcgccgcctccgcgcgcgactccgagagcaccacgccggcacagcgaaacctcttctccgcgcgaccgaactcagatctcgacgccgccgagcttcagaaggacggctccgggctccaggcanggggtgctttccgccgccgcgacacagatccgaccgctgccaccgccggagggggagaactactgaactaggaccgcggagcacctccaccgctgctactgactgcttccttctcgcgcctgcaaccgtggccccggcccactctgtgcagcaggggaggattgcttcgctttgcttcttctgtcttcctcgtgctgccgctcctgctcgcctcgtatgccctcgagagactagactcctcggggatttaagttttaaccccacgagttgtgggggtccttttcgcttctctctctgtccagtagtccagtccgcgctttagcaccaccatctactacgatttattaaataagttgtcatatagtaaacatcttcaataatataactacacaaggaaaaccgtagagttgaatgtctaagaacctataaaatttcacgaaatc

SEQ ID NO: 16910 - DNA, 1736 bp, Zea mays
gcacgaggccaaaggcccggtcccccgtcgccggccgggccacgtgcgccagctcctccacccagattttgacaacgccttcccaacttgctcgctcccgcaacgacagcgcgcacttggattcggcgaccaccggagcgcggaggaggcacaggcgccgatctaaagacgatggccgccgcgggctcctcgccgtccttctcctcctcgagtaagcggctggaagggaaggtggccctcgtcactggtggcgccaccggcatcggcgaggccatcgttcgcctcttcatggagcacggcgccaaggtctgcatcgcggacatccaggatgaggccgggcagcagctgcgcgacgccctgggaggtgacgcgcagggcgccatgttcgtccactgcgacgtgacgtcggaggaggacgtgagccgcgccgtggacgctgcggcggagcggttcggcgcgctggacgtgatggtgaacaacgccggcgtgacgggcaccaaggtgacggacatccgcaccgtggacttcgcggaggcgcgcagggtgctcgacgtcaacgtgcacggcgtgttcctggggatgaagcacgcggcgcgcgctatgatcccgcggaagcggggctccatcgtgtcgctggccagcgtggccagcgccatcggcgggacgggcccgcacgtctacacggcgtccaagcacgccgtggtcgggctcaccaagagcgtcgccgcggagctcggccgccacggggtgcgcgtcaactgcgtgtccccctatgccgtgcccacggcgctgtcgatgccgcacctgccccagggcgcgcgcgcagatgacgcgctcaaggacttcctggcctttgtcggcggcgaggccaacctcaagggcgtcgacgccatgcccgaggacgtcgcccaggcggtgctctacctggccagcgacgaggcgaggtacgtcagcgcggtcaacctcatggtggacggaggcttcacagccgtaaacaataacctcagggcgtttgaggattagttgaggcatttatgccagctctgggattgggagggagtattaccgctatttcttctgctgttgtgacaagtgtgtgcaagactaataaaccgcagcatgttcatgtagccaacagatgattgaacattccaagtatcattgctgaattcacgcatatagttgctcttcaaatagatcaagtacaatttcgtcctacagcgttgctgctgtggctatataatgaccttccaaaatcaagaagaatctaatcaccagctcgaggttgatgcgaagctacaaaagcatcattatcaagtgagcaggagctttcggccaattcagttacactagcccgtagggcatcccttttcttttcacaatgttaagtaggataccgttactagtgctctcaggctgcagcaaatccccttcgcaaacagccatgctcgtgggagtagaagcctgactggctctggtgttggcagtgttgcatgcctcagtctcagaattttctgtgcatctacctggcatagtaacacttgagctattgttcggcggtggatcgcttgggaaggtaggctctgaccaaatacctgcagcattaccctccacagtgcatgccctagttaattccgtgtcgatctcaaggttatgaatgaaactgatgaacttgtcagcagtatgatgtcctcattagaggcccaccactcctggtccaggaattaaggtcgatg

SEQ ID NO: 16911 - DNA, 1232 bp, Zea mays
cccgtcaccactgacgcccgcctcccccgcggcccttcccatcgccgcgtataaagcattgggtccctcgaggccggccgggagctcaccgccacctccacgctcgaagctcctcccgaaccggccgcatcgtcgccatggcagccgccgctcctgcaagctccgtgaaggaagtgctgccgtctcccctgacctccgcctccgagccccctccccttttcgatggcaccaccaggttgtacgtggcctatctttgcccgttcgcgcagcgcgcttggattgctagaaactacaagggtctgcaggacaagattaagatagttgccatcgatctcgctgacaggccagcgtggtacaaggagaaggtttatccagaaaacaaggtgccttctctagagcacgacaaccaggtgaaaggagagagcttggatttggttaagtacattgacagcaacttcgaaggtccatcgttgctccccgaggatcatgcaaagcagcagttcgctgaggagctgctcggatacactgacgcattcaacaaagcattttactcatgtttagtcgacagggaagatgtgtctgaggaagccgttgctgccttggacaaaatagaagacgccctggggaaattcaacgacggcccgttcttccttggccagttcagtctggtggacgttgcgtatgtaccgttcatcgagaggtttcagatactctattccaatataaagaactatgacgtcacaaagggcagacccaaccttcagaaattcatcgaggaagtgaacaagatcgatgcgtacacacagactaaactggacccgcagtttttgcttgagcaaacaaagaagcggcttgggattgcttaaagcctgtgaccaaggacgagactttcgccagaagcaccagcgtagtagatcggagctcgttttagtcggttgtgtgcttggatattacatctggtcttcaataaggcatggccttctgtaatggctgtgcttctgaaaataaataaactagttgtccaggtattatcgttgctttggtgacgtgtcgatgtcactgtatatatatgaatgggtgggaaagaatgatgatgtgcagtgtgttctgtgcaaatattgccgagatgaaggatcagtatccatgtagacattcatatattgctcatattgtgacacggcgcatgaaagacatggtttcggcccctaccacgcacaaaaaaaaaaaaaaaa

SEQ ID NO: 16912 - DNA, 1286 bp, Zea mays
ggcgattgggtatctcgaggccggccggcacgattcacacatttcaatcactcgcttcccatgaattcgctcgctttccctagctgcccgtcagcattgacgcccgcctccaccaccgcccccgcgtcctctccctttccctcgccgcgtataaagattcgctgcccgcgacaagaagatgcagctcattaccacctccgcctccgcgatcgaagctcctcacaaaccgttatcgtcgccatggcagccgccgcgcctgcaagctccgtgaaggaagtgctgccatctcccctgacctccgcctccgagccccctcccctcttcgatggcaccaccaggctgtacgttgcctatcattgcccgtacgcgcagcgcgcttggattgccaggaactacaagggtttgcaggacaagattaagatagtcgccatcgatcttgctgacaggccaacatggtacaaggagaaggtttatccagaaaacaaggtgccttctctggagcacaacaaccaggtgaaaggtgagagtttggatctggtcaagtacattgacagcaactttgaaggcccatcgttgctcccagaggatccttcaaaaaagcagttcgctgaggagctgcttgcatatactgatgcatttaacaaagcattatacttttgtatagtctccaaggaagatgtgtctgaggaagctgtcgctgctttggataaaatagaagacgccctcgggaaattcaacgagggtccattctcccttggtcagttcagtctggtggacattgcgtatgtaccattcatcgagaggtttcagatattctattccaacataaagaactatgatattacaaagggcagacccaaccttcagaagttcattgaggaagtggacaagattgatgcatacacacagactaaacaggacccacagtttttacttgagcagacaaagaagcggcttgggattgcttaaagcttgcggccgaggatgactctcgacagaaataccagcatagtagatcgacacttgtttagtcatttgtgtgcttgaataatgaatactacatatatggttttcaataagacatggtcctctatactgggttgtacttctgaaaacaaactagttgtcctgatattatagctttcgtggtgtgtttacgtcactgtatatgaaagggtggggagagagaatgatatgccatgtattctgtcaaatgtttttttataatgtcaagagctctgacttttaattaagaaaaaaaaaaaaaatatataagggccaccccg

SEQ ID NO: 16913 - DNA, 1643 bp, Zea mays
gttttctctcgtcccaaaagcttgcttcgcgctttcgaaaaaccacaccaagtcgggaaggcagaggcacagggagggagccgacagccgagagcaccttccgattccgcccaagaaatctccacccaatctctctgtcctctcctcccttctcatcatttcgccatgctgccatcgcacctcaacggccactccgccctcgggcgccgtcgcccgcgcctctccgccgccgccggggagtctccggcggcagcgggggtagaggcggcggctccgctggaggagcacgaccgcatctacttccaggcctactcccatctcggcatccacgagactatgatcaaggaccgcgtaaggaccgatgcttaccatgcagcgatcatgcgccaccagaaatttatcgaggggaaggttgtgctggatgtggggtgtggtactggaatactctctgtgttctgtgctcgtgctggcgcaaagcgagtgtatgctgtcgaagcctgtgaaattgttgtccaggctcgtgaaattgtaaaagcaaacaacctaactgatcagattgtggtcatccatggacgtgttgaggatgttgaccttgaggaaaaggttgatgttataatatcagaatggatgggctatatgcttctctatgagagtatgctgccaagcgtcctatttgcaagagataaatggcttaagcccgggggtcttattcttccttctcatgctacgctcttcatggcccccgtaacaaatcgtgagagatatgaagacagcgtcgatttctggcgtgacgtctatggcataaacatgtctgctcttgtgccacttgccaaaaagtttacatctgaggaaccctccattgaaacaattggtggagagaatgttataagttggccatctgtgttcaagcgcttcgattgctataattttacagctgaggaattcaaatctatcacttcaaaatacaaagtttcatcaatgatgttagctcccattcatggctttggtttctggtttgaggtggagttcaacgagcctatagagtcctctcataattttccttccagtttggatccacttgagattatacagaagaaaaggagacgatcctcagaagatatagttctgtccacagccccagaggatgagccaacccactggcaacagaccattttgtatttcccggatcctatagaggtgaagcaggaccaaattatagaaggttctgtaacagtgtcccaaagcgaggagaatccacgttttctgaatattcatctagagtgcttcacaggaggacagacattggttaaggactgcgccatgcgatgaactggtgtttttatgcttctagtggcttgatttcaggcgcgcaatggggtgttggcagggaggagctgacaatatttcagatttctttaatggaagtggagaatttgtactatttatgccaattatccgtctaatacgaaggcaggattttagtaattgtactccgtcttattctatagagtatatactggttgttgattttggatccgcacgctgtgacctaagtctcgcatccaagggtccctttggaacaaaggaaacatgaaggatttttttatgatccaaaaaaaaaaaaaataaaaaaaaaaaaaaaa

SEQ ID NO: 16914 - DNA, 1432 bp, Zea mays
ccgcgagcccaaaaccccaaactcctctggagctcttgtcctccctccctctccagccgccgccgccgccgccgccgccgcccagagccgagcatgccgggtgccttccactccctcctccttcccctcaaacggaagcgcaaatccaaacgccgcagcagacgcggtcaccgaaaggagaacaaccccaacatatccaagaaccacctcgccgccgctggagacccgtccttccacctgaaaagctgcacctctgtctcccccagagacatcggactccttgtccagccgctcggcaacctcttcctctccgccaccccgcgagctaacctccgggacgcggggctcggcgcgctccggcctcttccagacgacctgctcctcgacgtccttggcttgctccccgcgcgcgacctcgcggcgctctcggtggcgtccaaggcgctctacgtcgtcgcctcccacgacccgctctggcggaccctcgtcctcgacgagctcggcggcgccttcgacttcgccggatcctggcgcgccacctacatcgccgccgcctccggcggccaggcctacctcatccctcctcgcgctctgagaatcaagggcttctactccgactacctcttccagagctggctctgtgccaacatggagatgcggcacgagtggcttgcgcgcgacaacatcgagcgccgccgcggcttgtcggtggagcagttcattgccgaggtcgaggagcccaacaggccggtgttgctagaggggtgcattgatatgtggccggcgttacagaaatggaacagagactacctgctggagatctcagcgggtaaggagttcgcggtcgggccagtgagcatgccattagataggtacttccggtacgctgacaatgtccaggaggagaggccattgtacttgttcgatgcgaagtttgctgagagagtaccagagatggggagggactatgaggttccggtgtacttcagggaggacctgtttagtgttcttgggaaggagaggccggattacagatgggttatcattggaccagctgggtctggttcatcgttccatgttgatccgaactcgacatccgcatggaatgctataatcaagggggctaagaagtgggtgatgttcccaccagaggttgtgccgcctggtgtccacccgagtgctgatggagcagaggtcaccagccctgtgtctatcatggagtggttcatgaacttctatggggcttgtgagacctgggaaaagaggcctatcgagtgtgtgtgccgatctggggaggtggttttcgtgcctaatggatggtggcatttggtgatcaatcttgaggagtcaattgccattacccagaattatgtgagcaggttagatttcacaggcgcaaacccttccattcttttttcggaatcacgtcaga

SEQ ID NO: 16915 - DNA, 2741 bp, Zea mays
ccggccgggccggggtgtggttgctttgcttagcactggcacagcgcagcacatgaggcgaagaggagggagacgagtaattatttattaattaacaaagaagagaagacttcttccttcctcgtcgtctccagcccattccaattcttgattccatcgccccaccatccacaactcccctaatccttccaacctcctcgtcgtccagtccaccacctccacgcgcaatggccagcggctaggcggcaccaaccagatcacaaggattcgtttcatccggcagcgcagctctagagcctccatgggcagctacgcgtacaagtactgtatgtgcttcacgcgcaagttccgatccccggacgcccagccgccgccggacgtccgcgccgcccacctctccttcgcctctgacgcccatgccctccgccgcttcgtcgccggcgtccagggcgagtcccccgccgacgtcgaccgcatcctcgccatgctctccgggggccacagccatggaatcgcccgcctcgtcacaaggtcgccggcggcatccacgcccacgctcgaagacttcttcgccttcctcttctcccccgacctcaacccacccatcgcgcaccaggttcaccaggacatgtcagcgccgttctctcactatttcgtgttcaccgggcataattcctacctcactgggaaccagctcaatagtgactccagtgacgtcccaattgtaaaggcgttgcagagaggtgttagagtcattgaactcgatatgtggcccaatccttcaaaggacaatgtcgatattcttcatggagggacattgactgccccagtggaaatgatcaaatgtttgaagtccatcaaagaatacgccttctgtgcctcaaattatcctcttgttattactcttgaggatcacctcacaccagatctccaagctaaagttgctacgatgctcactgaaacatttggagatcttcttttcgtccctaatccagacccgatgaaagagtttccttctccagcatctctaatgaagagaataatcatatcaaccaaacctccacaagaatataaggagtttctcaaagccgagaataatcgcagtggcagcggaaacatagctgagttgccagaccaaggaagcctgagaagaatagattcaaatgccgatgaatctgatgggaaggatgaactggatgagcaagacgaggaagactccgacgaggacgatcccaaatttcagcaggatacagcctgtgagtataggaaactcatcaccatccaagctggcaaaccaaaaggccatttgcgggatgcgctaaaagtggatccagacaaagtcaggcggctttctttgagcgagacacagttagctaaagcgacaatctctcatggtgctgaagtcataaggttcacacagaagaatatactccgtgtgtatccaaagggcacgagggttaattcttcaaactacgatccaatgaacgcctggacccatggtgcgcagatggttgcgttcaacatgcagggccatgataaagcgctccggttgatgcaagggtttttcagagccaatgggggctgtggttatgttaaaaagcctgacttcttgctaagaacaggcccaaatggggaagtatttgaccccaaggctagtttgccagtgaagaaaaccctcaaggtgaaagtttatatgggagacgggtggcgcatggacttcagtaaaactcatttcgatgccttttcgcctccagatttctatactagggtagggatcgcaggtgtgaaggcagacagtgtgatgaagaagacaagggtgattgaggaccagtgggtgccgatgtgggatgaggagttcacgttccttctgacggttccggagctggccctcctgagggtagaggtccaggagtacgacatgtcggagaagcacgacttcggggggcagacagtcttgccggtatgggagctgaagcagggcatccgtgctgtgcccctgcacgatcgcaagggtgtcaggtacaagtccgtcaggctcctcatgcgatttgattttgtgtagccgagccgagccgccattcagattcagcttctgcttttttttcccttcttgtgtgaattgaatgtattactcccttccttccatcttcaacgtatatgtgtatgtatgtacttatttttgtcggaataaaagttgtatggaatggaatggaaggaaggagtagaactgtcttcaaactccagcttctagatctgtacgggtgattcagttttacttgctggcacattgtttgtttgtttactttactggagatagatttgtacattagcttgattattcttcatttagctactggctaagagatagattagccaatgtgtttgaaagcctttatcatggctatatgaataagataaggaggacacgtctttttgaatctccttggccgccgatatgcgtctggtatgtccaacgtctaaccagatgcatgtcggatatcatatgctttatttctaaattagctgaacgagagcttccattatttaaattgcttcagagcactggtctcttctaatggaccgatgagaccaagcaagatgtgcaaagcctcaaggaatatcttacctctcctccaattatggttgccccgaagacagaagagcctcgtttcctatacatcattataactctagatgtagttagcatgttcttagtcgttgagcactagaagcctttagcc

SEQ ID NO: 16916 - DNA, 1662 bp, Zea mays
ccacgcgtccggtgtgctgtttattacgtatctgtttatcagagtgcatgtctcatccagcctgcggttccgctcctgcctgccccgcctcagttgataaatatgctctggaagttcatatccaacatctggaggttcattatcacagagccaaattcaagcaggaaataattcttttagttctatggggatgttgcatgatgccagtgacactgctccatttgacataaatgattttccccaattgtctggtcgacctagttctgctggtggtccgcaaggacaatatggatcactgcgcaagcaaggagttggtgttaatacccttgtgcaacaaaaccaggaattcagcattcaaaatgaagacttcccggctttgcctggatataaaggtaacccttcggattataatgctatagagttgcatcacaaggaacaactccacgataatgtacctgtaattcaagcacagcagtatcctatggcaaggtcaggcttaggaagtagctacctacccaatcgacaacaacaccagcaaggtgctaattcagtccagaatggcggatcccacaatattttactgagaccacccagtcaaacttctagtttgggatcatatgatccatttctgcagcaataccagcagcctcagcctcaaaatcatttcagattgcagcagatgtcttcagctgcacattcatatcgggatcagattcaaaagattcaggcgggaccgacaccacctgatccatatggcttgttaggatttttgggtgttataaggatgaatgatgctgatttagcatctcttgctttaggaatagatttgacagcattgggtttgaacttgaactcgccagataatctatacaagacatttggctcaccctggtcgaatgacccagcaaaaggagatactgattttcgaattccagcttgttacctctttgacaaaactcctccactacagaccttactttttcagaggtttcacatagtaacactatttttcgtcttctatagcatgccaaaagatgaagctcagctgtactctgccaatgaactgtataatcggggatggttttaccataaagaagtgcacttatggctcaccagaatttcaaatgtggaacctctagtaaaaactcacctctatgaacgtggatcttactattgctttgacccagaatcctgggacacaatacgcaaggacaactttgttctccactatgagatggtagagaaaaggccagttctgccttcaacatcaccaaaccttagatgaaaagaaaatctaggacggggagaggaacaaagaaacatataacgatctgcaggaaggactaaggaggcaggaagtcgcagaacagaattggggatgtccaattaacaccccttgtaattactaaaactgtgagcgaatgttgcgtttttcttgcactccccccttcgccctcctaattaaactgcctaatgttcaggattagtttttctccagcttcaaaataacaacgcatagatggttttgatgttctgtcctctgtccaaccatatcatgtcgatgctcagcgaaagataaaatcataccatgtcgatgatcaaaagacgcctgggtcgacccgggaattccggaccaaaaaaaaactcgagagggggcgccgg

SEQ ID NO: 16917 - DNA, 1450 bp, Zea mays
gccggccgggctcaaagatgcgactttcgattcccctcttcctcgccgacggccagacgccgaacgtctcgccctctcccgacgctccccgcctaaagctggagctccccgcggtggcggccgccgccgccgccgaacccgatctccccccctcccgcgtgacaggcacggcctcccctcggttggaagggtttgctgtatcatgcattttttgtggataatcttcattttctcttgagtcaccgattcttttgttgtcttcaaaatgtcgggcttgctgaactcaaaccttaatagttcggcatcaaatctttcagactcagctggaaggccatttacagcatccttttcgggtcaatctggatcaattccaggttttcatcattctggcttgcataacactcatggaagttacaatcttccgagtatgcctggatcacttgcacaaaggaatgctgccatgagtggccttccgtcctctggggttcaacaacctggaggtagcattcctgggagattcccttcaaacaaccttccagttggcatgcctcagattcctcatgcacattcaggtgtcagtggtagagggatgaattttggcgcaggtccggcatttagtagcagcatgaatattggtggtaacatccaaggcttatcctcgggcttgggctccggtggtaatcgcaattctgttcatgggatgccagtatcttcatctataggaaactcgggtcaacggataagttctgtaggaaatatggtaagtgcaagcaatattggaagaaatataggcactggtggtttgtccgtgccaagtattgcatcacgaatcaatttgaatggtagtggtgggagtggtagtctgaatgtgcaaggatccagtcgaatgatgaatggattgcttcatcaacaagcaactcctcagttgataaatatgcttggaagttcatatccaacatctggaggttcattatcacagagccaaattcaagcaggaaataattcttttagttctatggggatgttgcatgatgccagtgacactgctccatttgacataaatgattttccccaattgtctggtcgacctagttctgctggtggtccgcaaggacaatatggatcactgcgcaagcaaggagttggtgttaatacccttgtgcaacaaaaccaggaattcagcattcaaaatgaagacttcccggctttgcctggatataaaggtaacccttcggattataatgctatagagttgcatcacaaggaacaactccacgataatgtacctgtaattcaagcacagcagtatcctatggcaaggtcaggcttaggaagtagctacctacccaatcgacaacaacaccagcaaggtgctaattcagtccagaatggcggatcccacaatattttactgagaccacccagtcaaacttctagtttgggatcatat

SEQ ID NO: 16918 - DNA, 1354 bp, Zea mays
cattgggtacctcgagccggcaaaaaaaccctatttcatgtgacgtgaacccctttcgctcgctccgagtgcggaggaaggggagctcgacgcacccaagtcgcccgcccacggaacgcgccgccgccgccgccgccatcacatcacagaggcctcgccgtcgtctcggatattccccgccgtaggaccagtttccctccagctgccggagaccatgtcgggcggcctggacatgtccctggacgacctcatcaagcagtccaagtcccgacccaaggacagcccggcgtccttgtcggggcctgcccgccgcgcgccacaccccgcccgcgccgcgccctacccaccggccgctcccaaggcccgtgccgccgccgactcgccctacggggtctactccaagcacatcgccgcgatagcgccgcccccgctggccaaagcaaggtcgcttgagacgggaacgaagctgcacatctccaaccttgactccggcgtcaccatcgaggatgtccaggaactcttctcagaagttggggagctcaagcgttattctatgaattatgacaaggatgggagatctaaggggactgtggaagttgtctttgcaaggaaagtggatgctttggatgctatcaagagatacaatggtgttctacttgatgggaagccaatgaatctagagctcattggaaacaatgtcgaaccacctcccatgccaccagtaatacacagtcgtcctttgcagaactataatgatatccatagcagtatgcctcaatcccaaagaggtggtcagcgaagagtaccccaaggcaacggtcggggtggacgcagtagtcaaagcagtggtggccggggacaggggaaaggccgaggccaggaccggaatcgcaccaccatttctgctgcagatcttgacgccgaacttgacaagtaccatgcagcggcagtgaaggaggaatgaggctctggcgttctgtttactaaacagctggtaaggcgccgggacagtgtggccttctgctttagaagcatgaagtttgctatcttagtcctagtgttttatgctagaaattttttttggcccatgtacaaccgcgtctctgcgtcaagattcctggtgttttatgtgtagcatgaagttgtggtcctactttgcaggaactatcaatcatatttacagctctgcgggcacgattgagaacaattggaaactaaggggtgtttggtttgaagagtcaatccattctagatgagttggtgaaatcaaaataaaaaaaaaaaaattacttacaaaaaaaatggataccagttattagttcactcgtgaaaaaaaaaaaaaaaaaagcggccc

SEQ ID NO: 16919 - DNA, 1467 bp, Zea mays
  misc_feature (24)..(24): n is a, c, g, or t
  misc_feature (478)..(478): n is a, c, g, or t
ccggccgggacacaaaccctattntatgtgacgtgaacccctttcgctcgctccgagtgcggaggaaggggagctcgacgcacccaagtcgcccgcccacggaacgcgccgccgccgccgccgccatcacatcacagaggcctcgccgtcgtctcggatattccccgccgtaggaccagtttccctccagctgccggagaccatgtcgggcggcctggacatgtccctggacgacctcatcaagcagtccaagtcccgacccaaggacagcccggcgtccttgtcggggcctgcccgccgcgcgccacaccccgaccgcgccgcgccctacccaccggccgctcccaaggtacaccgcgtgcgccctgcgtcctccttgccccgggttccctccaccagaaaaccctaacgccgccgccgccggcctgtgcccgctcgtccctcccaggcccgtgccgccgccgactcgccctacggngtctactccaagcacatcgccgcgatagcgccgccgctgccggccaagcaggtcgctcgagacgggaatgaagctgcacatctccaatcttgactccggcgtcacggtcgaagatgtccaggaactcttctcagaagttggggagctcaagcgttattcaatgaactatgacaaggatgggagatccaaggggactgcggaagttgtttttgcaaggaaagtggatgctttggatgctatcaagagatacaatggtgttctacttgatgggaagccaatgaatttagagctcattggaaacaatgtcgaaccacctcccttgccaccattaatacacaatcgtcctttgcagaactataacgatatccacagcagtgtgcttcaatcccaaagaaatggtcagcgaagagcacctcaagtcaacggtcggggtggacgcagtagtcaaaccagcggtggccgcggacaggggagaggccgagggcaggaccggaaccgcacgcccatttctgcttcagatcttgacgccgaactcgacaagtaccatgcagcggcagcgaaggaggaatgaggctctggcgttctcttctactaatctatttacacaggtggaaaggcgttctcttctgggggcgttcagaagcatgaagtttactatcttagccctagtgttctacgctagaattcttttcgaccaggattctgttttgtgtgtaggatgaacttgtggttctactttgcaggatcttatttgctgctttgtgggcacgaatattgagaacaactggaaaccgactttgttattgtgtccgccctggtcctgggtctgttctgttgtattttaagtagttttgggttgcctaccgaagacatcaggcaaacatattccggagcccaagagtctctgtgttctgtcttgatgttttacaattgtgccttgagtctttctgcggtcctctacttgctttatttttaaattgcaaaaaaaa

SEQ ID NO: 16920 - DNA, 2867 bp, Zea mays
ggccggccgggccgggataaacctcttcgtccctactcccctgcagagtgccggccgcggtcggccgaggagccgcgacagagaagcagtgaagggaacccgcgcgctttctcccgacgtgcaccggaaatggtggtcgtggacgcgtcggagttcggggcggagggcttcgacccgaagcggtggatcaacgcggcgctggacgcgcggcacccgtcggagcctctcgatcgcttcctcgccgacgccgaggagcgcctgcgttccgcggccgacgacgccgcggccgcgctcgagagggatagcggcgacgccctccgccgcgtcccgttggcatgccgcgacgcgctgcgcctccgcgacgacgccgtcgccctacgctcccacctcgcctccgtcctccagtccctctccctggctgagggctcatccgcagaatcaatagctgcactagcgcgtattgacactgtgaaacagcgcatggaagccgcatacacaacattgcaggatgctgctgggttagctcagttgagccagagtgttgaggatgtgttttctagtggcaatcttccaaaagctgcagaaaccctggcaactatgagacattgcttgtcagcagttggagaggttgccgagtttgcaaacgtcagaaaacaacttgaagtattggaagaaaggctagatgaaatggtgcagcctcgattagtagatgcactttctaatcgcaaggttgatgccgtgcaagatcttcgtggtatactgatccgtatcaataggttcaagtcactggaagtgcaatacactaagatccatgttaagcctctaaagaaactctgggatgattttgagctaaagcaaagatccagcaaggtagacatggagaaactcagtggtgaaagcattagtggcctctcattctctagttggctgcctaatttctatgatgagacactgctttaccttgaacaagagtggaagtggtgcttgactgctttccctgacgaatacaaatcacttgtaccaaaagtacttactgagaccatgagtgagttgaattcaagctttgtctctcgtataaatatagcaaccggggatgttattcctgaaaccagatctattgccaaaggtatattggatgttctatcaggtgacttaccaaaaagcaccaaattgcagaataagcatcttcaagcgctaattgaactgcacaatatgactggcacttttgctaggaacattcagtacttattttcagaatcagatcttgcagttgtgctgaatactttgaaagctatttattctccatatgaaacctttaaagcaaggtatgggcagatggagcgtgctatactctctgctgagatgacaagtatcgacatccgtggggccgtccctcgtggtgttggtgcacagggtatagagctgagcgaaactgtccgcagaatggaggaatccatcccagaaatgatagtactccttgaggcagctgtggagagatgcattagtctgactggtggttcagaagcagatgaactggtactggctcttgatgacgtcatgctgcagtacatatctaatctccaagaaacattgaagtccctgaggataatctgtggactggatagtgatgccttgaaaaaagatgcaggtttagagaaaaaggaagtacaacgattggtggatgtttctgaagaggaagaatggtctattgtccaaggtgctttgcaaattcttacagttgctgattgcctaactagcagaacctcagtctttgaagcttctttaagagctacacttgccaggattggaacaaacttttctgtttctggatttggctcaagcctggataaatcacctgcagcaactgctgatgagaatgcagacttgtcttttgctgggagggctgcgctggacattgcagctattcgcttaagtgatctgccagataagtctaagaagttcttaactgtgctagaacagtcaaaagatccaagattccatgctcttcctctcacatcacaaagagttgcagccttctcagacacagtaaatgaactcgtctatgatgtgctcatatctaaggttcggcagcgtctcagtgaggtcgcacgccttccaatctggtcatccgtggaggaacagggtggtcttcctcttccaagcttcagtgcctacccgcaagcatacgtgaccagcgttggggagtatctcctcactttaccacagcagctggagccactcgcggaaggtatctcaggcaatgaggctggcaacgatgaggcccagttctttgccaccgagtggatttttaaggtcgccgaaggtgccactgctttgttcatggagcagctccgaggaatccactacatcaccgaccgaggttcacagcagctcgctgctgacattgagtacctaaacaatgtcctctctgcgctctcgatgccaatccctccattcctgtctaccttccacgcctgcgtctccaccccgagggaccaggtccgtgatctgatcaaatctgatggtgcaagccagctcgacctccctactacccatctggtctgcaagatccggcggatcacattagattagtgaaatcgtcctaacttctccccctttccatgaggtttacctctgtaaaagcatgcattaccgcacgcttctgcgatcgtatgtttggcatgcgggcttgtagcttgttgcttcaccttttttttcttgccttgtaaccgtactgctggcacatagtgagaataatcctatatagaataattcattacttggagcctaaaaaaaaaaaaaaaaaaaaaaaaaaaaaaaaaaaataaaaaaaaaaaaaaaaaaaaaaaaaaaaagcggacgcgtgg

SEQ ID NO: 16921 - DNA, 2033 bp, Zea mays
aatgcccggccttgtgcttgtgcaccatcgacctatccaaagttagctgcccgaaagaaacctgctcgcgtctctcgtcgtcatcaaccggcggcagcgcgccgcatgcgcacgtcaccggcccggccgcatgcgatgcgcggcaacatgtcgttgacgccagccgtggcggctttaaatccgcgggacgcctcctcctcttggctcttgttcgccagccgtacgtcgtcgtcagtgtcgtgtactcgttttcccttccaaggcacccgttgcgagggcggaggcgccgatggccggggcgggggcgggtgcgggagcgggggcgctggccgggctcgcagcgtgcgcgacgctggcgtgcaacgtcgcaggcgccgtgctcttcctcctcagccaagacgacgagcggctgcggcgcgggtgtgcggcgaggttgggcgctggcggcgtcgcgtcgcagccggtggaggagtgcggggatgaagaggcgctcgcgccggacgccgtcctcaacctcgagctcggcgacccgacgatgtaccgggcgttctggcgggaggttggggactgcggcgccaccgtgatccgcgggtgccaggggatgagctacttctccgacgacgacgccgtgctctgctggttcctcgagccggagctggagcgcgaggtgcgccgactccaccgcatcgttggaaacgcagtcgtcgacggctaccacctcgtggtcggcaccggcgccacccagctctaccaggccgccatgtacgcgctcagttcgccggcgcgccgggaccagcccgtacccgtcgtctcgccggcgccgtactactcttcctatccgccgcagacagacctcctgctgtcggacttctaccgctgggccggcgatgccaacacgttcaccggcgatgaatgcatcgagctggtctgctcgccgaacaaccccgacggcgccatccgcgaggccgtcgtgaggtccgccggcgccaaggcgatccatgacctggtgtactactggccacagtacacgcccatcaccggggccgccgcccacgacatcatgctcttcagcgtgtccaagctcaccggccatgccggcacgaggctcgggtgggcgctggtgaaggaccgcgaagtggccaggaatatggtctacttcgtcgaccgcagcaccaccggcgtatgcaaggagtcgcagatgcgcgccaccaagatcctcggggtcgtctccgacgcctacgaggtcgtcccgccggccagggccagggccagcggcgcggtgccccgcctcttcgacttcgcgctgcggcgcctggaggagcgctggcgcatcctgcgcgccaccgtggctgccaccggcgccttcagcctgccggaggagacctccggctactgcaacttcgccaagcaaaccgtgacagcttgccctgcgttcgcgtggctgcggtgtgagaaggagggcgtcgaggactgcgccgagttgctcgccggccacaatatcgtgggtagcggcggggagcagttcggaggagacgcgcggtgcgtcaggatcaacatgctggacagggacaacgtgttcgacatgctcgtccagcgcctctcctctataaactgaacggagtgaatgcatggagtggcacagcagcctgcattgccacaaataaaatgaacccagaaggatttggtgtcgttttcttttgtcagtttggtatcttgggtcctggtagagaaactttgtttcggtttgcttttgatgctttgggctgaactgtgtgtcaaatcagtagactgttatggattcaggaataaaaataagagtgagaacggtttctgtgcaaaaaaaaaaaaaaaaaactattcagctatggcttcattgatggattgaaagaaatctggattagcaccagtggagcagattccaaaatgggctgtcactggtttagtccaactaaccggcacatcaagtgttcacgtgccggggtcaccggacacaggaaggaggccgcctgctgccgtcgctgcaggcatgcaag

SEQ ID NO: 16922 - DNA, 3457 bp, Zea mays
gctcgccaatttagccgtattattcagaatttgaatcacaaactcaacaatatccctccaacatgaataaatagacatcttttatacgtagagggcctaaaattaaaatttttgtatagccgcgtgagagaatatatgcgcagcgcatgcagggccagacctacagtcacaccccatacacagacacagtagtctcatcattcacctgcagtgtttgtgcccgcgcgtcctaggataactctatataagttaacccagcgtacgtactaccgaaccaacagccacaccatatacgagctctctagcacaccataccgacacacacagctggtgcccgcccggtcgaaccacgctagctgtacactagctagacgatcaccacgccagttagttagcgcagcgccatggccggcggcggtactcagcatctgctgcaggtcgcggccgtgctcgcggcggcggtggtgctcatggcaacggcgtcggagggcttcatctccaagaagacgtggagcgccatccggcgggcggaccgcgacgggcccttcgtggggctggtggtgcccaacgcctacgagatggtccccgtcctcaactcgccggacttcaaacccagcagcaacatacccatcctagacgtccaagggcgacgattccgcttcggaactattggaagccaaaacgttgtcatggtcatgaccgggctcagcatggtataaattcatcttttccacactacgtatacatgcgaaattttatttgacgggtttttttataaaaaaatgagtctgactagatcgtctgtggcgtgcgttgcagctgaacgccgggctcacgacccagctgctgctgagcctgttcagagtggacggcatcgtgcactggggcatcgctggcaacgccaacgaggacctccagatcggcgacgtgaccatccctgagtcctgggcccacctgtccctgtggaactggcagaggcacggcgacgggcctgagaacgagctgccgctagagaacgccggcgactacacgagggagtacggcttcctcaacttctccgactacacggtggggcaggacgccggcaacccggagctggcggcgaacacgctgaacagcgtgtggtaccagccggaggagatcttccccatctccggcacgccggaggagcggcagcacgcgttctgggtgcccgtgaacaagcgctactacgcgctcgccgggaagctggaggggctggagctgccggcgtgcgtgaacgcgacgacgtgcctgccccgcgcgccccgggtgacgcgggtgcccaggggctgcagcgccaacatctacaccgacaacgccagctaccgccagttcatccgctcccacttcgggtgcacccccgtggagatggagagcgccgccgtggccctcgtcgcgcaccagcacggcgtccccttcatcaccatccgctccctctccgacctcgccggcggcggctcctccatcagcaacgaggccgccacgttcctcgacatcgcggcgcagaacgccgtggacgtcatgctcaagttcgtgcccctcatcgcgcgccgcggtggcgaacaggagcacgccgccgacatgtaatgtaaggcgggatcggatacagatccacgaccacgacgctgagacgaagtgcacctgcatgcgtgccaccgacacaacacaatgcgtgttttcgtcctccaagtttttacttaattttccacgagcccacgatcgatcgaataaatatagcatgtatcgctatactatcttgcaaattaacctatcttgggtggaataaatgaaattggtcatcgtggccaagttatataaactgacatcatgttgcaaactcgcgctcaattcaattattacattatctagctatgcacatttaattttaaagcagccaataaaaataagatcatttttttggtaaattccaacatcacgctataacagaaacagaaagtatggtcttcaaacattataaaacaaaataaaattgcatataggtataataattgcaagcaaatggccatgctgtataactgtggaacgagcacttgcatatatacatgccaaacagccccattggtggcgttggaaacttggagcggatggtccaatagactgcaatcatgaacagggatccgttcagaacttatttgtttgggattataatttagctagattatatatctaacttattttaaactaacactgactatataatctgaacaaacactccctaagggcccgttcgcttgtaccggattacacccagaattcattccagctaatcaaagtttatataaattagagaagtaatccggctaggaatcaatccggggctccaattcctataaaccgaacagggcccgaggaagttcatgaaccctggaagttctgctcatcggtcgggcgataatgcccgctgtgagtgaggccacacagcctgaaacgaccacatctctgacgtgagcgaaaaaagaaaccagtgtactgtacagatatctatgccacgcctagggctgacaatgggctataaaacggccacaccttgagaatcccatcttccacaaccagtcttcctgcagcagacgtggctccccctgcaaggaagcttgagtgctggaacacgcccttctgcttctgcaaacatgtcaaagtttcagcctcacttctgaattgctctcggtgttcagaagaattatgtccgaacttgtccgggaattaatcattcacctggcctatgtaaagtgtcttgcatgtactgagcacgaatatccacttggtccccttgacgcttctggtcgtgtcgactatctgacggctcagcttgtacatcagcctcttgtcctcgactaccacctcataggtttccctttctttctgcgcgagcacccagacgacgtgttttgttaatgcgataatatgaaatctgcaccgagcagattgttactgcctggatgtttgtcttttcacttgcaatcagaggaggaagaaacagtggaacttacagggccaaggtacttgatacattgcttgtgtaacttgaatctagggcaatgctcctctaagttgacatctttcccttctcctacatccaacctgtccaaagaacgacagagccgtcagtactcgatcagtaactatgttgttcattggttcagacacatgactagtgcacttttgctctctatctctctctctgtaccaatagaagaatggctgcttgctctggcagtggagccagcggtggtagtagaagtgcaggttgtggccataccgatgccgagggtcaatctgacaatcagaaatggatcaaaatgcagtttttgattgctcagcggcataataatctgcattatattacatttggagacacttaaattcttggtacataacataacataccgcctcgagccagtgctgcaggcatgcaagc

SEQ ID NO: 16923 - DNA, 2364 bp, Zea mays
gctcggtacccctgcatggacgtcctctcatattataatttgcacgtgttattcgtttggtgggccctttgattgaactcgaactttcagaagccatttagacctgcttgcaatttgatggttgcttgggatatcttctttttcccttcacggtccggctttagtgttgtcccaagaagaaagaagacacttttatattcctaattaccttcgagagccaaatcgagatcgagcaaaacatttccatttacatttctaacttgatggttgcttaattgggagatcttgtcttttctttctctttcgtcacaggctatacatagtcatgtctgttatgaatcgacataaaaatagatcaaacacagagaagacatagatttaacatggaaaacacctccaaagcgaagggaaaaaaaccacaggagtaggccagcaacaatatcaatatttttgagtagttatagatcgcaggagatttgtaatgaggtgacgatctcctgcagattacaactgtatttatagaggcgaaaccctaaggtgaataggaaacgatacatactgcaggggtggagccctcgcaccctaggtgtccctacgctcggggccaagcatgccgataacgggcctctgcttcgctcgctaacttagccgccttctttaaaatttggatcacaaactaaacaatatccctacaagaaaaataaatacacaccttttatatgtagagggcctaaaattaaaatgtctgtatagctgcgtgagagaatatatgcgcagcgcatgcagggccagacctacagccacacccgagtccagacacagacacagacacaggggtagtactgtagacacagacacagacactgtttgtgcccgcgccgtactaccgaaccaacagcaacaccatattcgggccctcgagcccgccataccgacacacacagctggtgcccgcccggtcgaaccacgctagctgtacactagctagacgatcaccacgccagttagttagcgcagcgccatggccggcggccgtactcagcatctgctgcaggtcgcggccgtgctcgcggcggcggtggtgctcatggcaacggcgtcggagggcttcatctccaagaagacgtggagcgccatccggcgggcggaccgcgacgggcccttcgtggggctggtggtgcccaacgcctacgagatggtccccgtcctcaactcgccggacttcaaacccagcagcaacatacccatcctagacgtccaagggcgacgattccgcttcggaactattggaagccaaaacgttgtcatggtcatgaccgggctcagcatgctgaacgccgggctcacgacccagctgctgctgagcctgttcagagtgaaaggcatcgtgcactggggcatcgctggcaacgccaacgaggacctccagatcggcgacgtgaccatccctgagtcctgggcccacctgtccctgtggaactggcagaggcacggcgacgggcctgagaacgagctgccgctagagaacgccggcgactacacgagggagtacggcttcctcaacttctccgactacacggtggggcaggacgccggcaacccggagctggcggcgaacacgctgaacagcgtgtggtaccagccggaggagatcttccccatctccggcacgccggaggagcggcagcacgcgttctgggtgcccgtgaacaagcgctactacgcgctcgccgggaagctggaggggctggagctgccggcgtgcgtgaacgcgacgacgtgcctgccccgcgcgccccgggtgacgcgggtgcccaggggctgcagcgccaacatctacaccgacaacgccagctaccgccagttcatccgctcccacttcgggtgcacccccgtggagatggagagcgccgccgtggccctcgtcgcgcaccagcacggcgtccccttcatcaccatccgctccctctccgacctcgccggcggcggctcctccatcagcaacgaggccgccacgttcctcgacatcgcggcgcagaacgccgtggacgtcatgctcaagttcgtgcccctcatcgcgcgccgcggtggcgaacaggagcacgccgccgacatgtaatgtaaggcgggatcggatacagatccacgaccacgacgctgagacgaagtgcacctgcatgcgtgccaccgacacaacacaatgcgtgttttcgtcctccaagtttttacttaattttccacgagcccacgatcgatcgaataaatatagcatgtatcgctatactatcttgcaaattaacctatcttgggtggaataaatgaaattggtcatcgtggccaagttatacaaaaaaaaaaaaaaaa

SEQ ID NO: 16924 - DNA, 1191 bp, Zea mays
  misc_feature (1066)..(1066): n is a, c, g, or t
gaaccggataacactccggcgccggccggccgggccttcaaaaacccaacgcggcaaacggcttcctcatccccctcccctcgccatggccgtccccacctccacctcctccccgctccccctcctcttcctccatcgctgcaccgcaaactctagcccctcggttctctccttcccgtcctccctccgcggcgcgtccctccgctcccgggccgcggccgcaccgcccgcagagaccctctctgccgacggcatccccgacgcgccaccggaaggggcgggaacgggaattccgttgccatcgtcgattggggatgatggggagcagcttgcacccaagcagaagatcagaatcaagctgcggtcctactgggtgccgttgatagaggactcgtgcaagaagataaccgaagctgccaaaacaaccaacgcaaagaccatgggtcccgttcctctgcccactaagaggagagtctattgtgtgcttaactctcctcacgtgcacaaggactcacggttccatttcgagatccggacgcatcagcggctgattgatatcatgtatccaactgcccaaacaattgattcgttgatgcaactccagctccctgccggtgtggatgttgaggttaagctatgattctgttggagctgaacttttcgaagtttgatgtaatgaggtattcattttctgcagcttttctctgggactgaaagaaatgtagtgcctgtactaggaaagaagatgttcagaattgaatgtacttgatttgaagtatatcagatgatatggttcatgccagcgctatacttgtattactgtattggtggcactaaaatttcttctagcaagtctgaagcagacgaaggattggccaaatttgtaagcttctgaaggatcgtttgagtcgtctggataagcaaaatactctttcttgctggttgcactgattctgctcaacagactgacggtgctttgtaaaaaaaaaaaaaaaaaaaaaaaaaaaaaaaaaaaaaaaaaaaaaaaaaaaaaaaaaaaaaaaaaaaaaaaaaaaaaaaaaaaaantccccctcctggaccaaaaatgcccgccaaaataagaagatttaaacgggccccacccctgccaaaattttttttgggggcctctccagggttccacccttggttcctttcaaaaaacttttggg

SEQ ID NO: 16925 - DNA, 4291 bp, Zea mays
  misc_feature (1126)..(1126): n is a, c, g, or t
  misc_feature (3858)..(3858): n is a, c, g, or t
atggccgtccacaccaccacctcctcctcacatcccctcctcttcctctatcgcggcaccgcaaacctagcccgcggttatctccttgccttcttctctccgtggcgtgtctctccgctcccgggccaccgccgcaccgcccgcagagaccctctctgacgacggcatccctgacgcgccaccggaaggggagggaacgggaattccgttgccatcgtcgattggggatgatggggagcagttgttgtatgggattgctggaaaagaaattgttacaaggccttgtgcacagttggtctcctctcatagtgattctttagatgtatcacaagagaaaatagtgataataaacagatatggagagagacttgttggtgttttgcatgaaactggatctaaggagcttgtagtgttgtgccacggatttaggtcatcaaaggaaggcagaactatagtgagtcttgctgatgcattaacatcagaaaatgtcagcatatgtgttttgattattctggtaatggagaaagcgaaggtacttttggataaggctactataacaaagtggacgttttatgtgatgcgatcctgcatttcaaaaacacaaacgtgacacccatgctattgctggccacagtaaaggagaaaatgtggttatcctctatacatccatgtatcacgaattcacggtatatctaaagttattaacctttctggaaggtttaagctggaacgtagaattggagatcgttccgtgaatgattacatggaaaggattaatcagcatggtttcattgatgtggaagacaaaataggagtatcatctaccgtgtgaccagacaaagtctgatggatggtcttaagacagataggcactctgcaatctgcatgcatgtctattgacccaaactgcagggtgctgacggtacatggtgctaatgacgatgttgtgccgtcagaggatgctctagcgtttgataagtatataagcaaccatgaatggcatgatattatcgaaagagctgatcatagatgtgcgactcatcagcttgaattagctgcaaccgtactgaaaatttattaaactggatgagggtaggcagaaacaaacgcagccatgtgacatacnctttttgccccaatatttttgatatattaattttagtgaagaactgttttattgaacatttatgtttttcataatattacaatatttggcctgcatcacatcagcttgaattagctgcaattgtactgaaatttactaaatctggatgatggtaggtggaaacaaacatagccacgacatagcctattttgctggaggactgttttattgagcatgtttattttccagaacattacaatatccctcctctccgcccaacacacacgcaatatatatagtgcaaaagcatgcgcttgccttcacaaattgaccttaattgacttgataacatcaaggtgtcttgattcctagcaactacatgtttgtcgtacaggtaattgaagtgttgtacaggtaattgaagtgttataaggtttattttgccttttggaaacatatttaaacattatatgacccttaccctaaatcaaacacatgcttttatttcttcactgttcagtttgcatgcagaagttgctatctttcaacgacttccgtcccttcgtcggtggggttgctgggcgcagcttgcacccaagcagaagatcagaatcaagctgcggtcctactgggtgccgttgatagaggactcgtgcaagaagataatcgaagctgccaaaacaaccaacgcaaagaccatgggtcccgttcctctgcccactaagaggagagtctattgtgtgcttaactctcctcacgtgcacaaggactcacggttccatttcgagatccggacgcatcagcggctgattgatatcatgtatccaactgcccaaacaattgattcgttgatgcaactccagctccctgccggtgtggatgttgaggttaagctatgattctgttggagctgaacttttcgaagtttgatgtaatgaggtattcattttctgcagcttttctctgggactgaaagaaatgtagtgcctgtactaggaaagaagatgttcagaattgaatgtacttgatttgaagtatatcagatgatatggttcatgctagctgtatacttgtattactgtattggtggcactaaaatttcttctagcaagtctgaagcagacgaaggattggccaaatttgtaagcttctgaaggatcgtttgagtcgtctggataagcaaaatactctttcttgctggttgcactgattctgctcaacagactgacggtgctttctaactaaaaaaaaaaaaaaaaaaaaaattttctttgatagtttggaaacttaaatccgctccgggaattcatgattctcggagaggatttaaatttccaaactattccttagggcttgtttagtagcaaagatactggagaggattagaggggctaaaatcctacgagaatggtagtttctttctttctcttttcaaaaaaaagtacactttcagttggctaggtgtgctgttctatttttaatagatcaagtgatattcgttttttctgaagaaaaggaaggcataaagttggtctttagcagccccccgactcctgcctcaatagtcctcgtttctacatcctccgcgagtaataaaatccacaaagtaagcttggggttctgaatggcccatagcccatatgatttcagtgctttggccatccttttcttaatctatatcgtctgcttggtcactagaggaaacatatgctaaaagtacatcccaatatctgattagggcactgaaattgcatatgctagtcttcaagagtacagtacgctacattcacacccaagagtgcgcaacaccacacgtccgcaccctcctatcagtattagctatcacacttctacgatcaaaagcacctgcgtgtgtgagccatgcatggtttcttgttggaaacaaaaaggtcagtgacagacagggcaacttgagcaagctactcttcaaatggaaacaccaagcaaaatcggcaacgtactgaaagaaatgtagagcctgtaataggaaagaagatatgaattgtctttgcatctcaagagtacagtatatttgaaagagatggtctacattggttgcactcataaactagcactactaatttccctaaggaagtagaatagtatggtcgattaagaggactgaatcagtcaacaaattgggcagcatccgatatactggctgtctagtttattcgtctagatataagcaaacactttattcccgctggctgcacttattctgggattcaaaagactgacgaagctttctaattcgtaatgcggacttctttcttttctcccagactgtcttttcgactgagcccaactgcccatatcaatcttattgctgagtcaattttgtagataactactaaaatcagcaagtatttgtccttaaatgaacttagttatcgactaagaaatacaagatacatgaagacaaacgcaaaaaaaaaaaaaatcagtatgataagctatttcgttgggcagaaacataaatttcaaatctcttacgagacccatgggtatcgagaggaaaataagctaatttactactcaattcccttaatcttggaggtgatttaagtttctacactagctcataaagattatattttttttgataaggtaaaatttatagtatcaagataatcatgagtcacaattcttttaacaactaaaacccgacttctatatcgcggtagatgcacagtctaaaaagaagactaacaacccaaacactctagtantaatcaatcctaaaactagatcgtcacctacctgggtaaaaactccctcactatttgctgcaaacgttggcatgtagctaaaaccaactccttagacattatatacaaaaatcagtattgctctagcttgtgaactttttgaaactgttgcaaaaagaaattaagctagctctctttgcagcgaacaacaatctatccaaaattttcatttcaagtaaccggttgtgcttctttttttacggatcaagtgctagtcgttttcttgaggggaaggtagatatgaagttggtccttcgcagccctcagtaagcagccccaaccactgacctgccacaatccatgatagtgccaaatagcccttctttattccggttcgaatacgatccaatacattgcggagactcgcgactagtgttggccggcgattaaatcc

SEQ ID NO: 16926 - DNA, 874 bp, Zea mays
cattgggaccctcgaggccggccgggaaaacccatcgcggcaaacggctaatgctccttcctgtcaccatggccgtccacaccaccacctcctcctcacatcccctcctcttcctctatcgcggcaccgcaaaccctagccccgcggttatctccttgccttcttctctccgtggcgtgtctctccgctcccgggccaccgccgcaccgcccgcagagaccctctctgacgacggcatccctgacgcgccaccggaaggggagggaacgggaattccgttgccatcgtcgattggggatgatggggagcagctcgcacccaagcagaagatcagaatcaagctgcggtcctactgggtgccgttgatagaggactcctgcaagaagataattgaagctgccaaaacaaccaacgcaaagaccatgggtcctgttcctctgcccactaagcggagagtctattgtgtgctcaactcgcctcacgtgcacaaggattcacggttccattttgagatccggacgcatcagcggctgatcgatatcatgtatccaactgcccaaacaattgattcactgatgcaactccagctccctgccggtgtggatgttgaggttaagctatgattctgttggagctgaacttttccaagtttgatgtaatgtggtactcattttctgcagcttttctccttgatccttttgttgtctgggacagaaagaaatgtagagcctgcactaggaaagatgttcagatttggattctcctgcatttgaaggatattgaataatatcgctcacattgtagttgtatacttgtattactgtactgacaccactaaaatttcttcaagcaaagtcgaattttaatggccaaa

SEQ ID NO: 16927 - DNA, 911 bp, Zea mays
cattgggtaccccggccccgaaaacccaacgcggcaaacggctaatgctccttcctgtcaccatggccgtccacaccaccacctcctcctcacatcccctcctcttcctctatcgcggcaccgcaaaccctagccccgcggttctctccttgccttcttctctccgtggcgtgtctctccgctcccgggccaccgccgcaccgcccgcagagaccctctctgacgacggcatccctgacgcgccaccggaaggggagggaacgggaattccgttgccatcgtcgattggggatgatggggagcagctcgcacccaagcagaagatcagaatcaagctgcggtcctactgggtgccgttgatagaggactcatgcaagaagataattgaagctgccaaaacaaccaacgcaaagaccatgggtcctgttcctctgcccactaagcggagagtctattgtgtgctcaactctcctcacgtgcacaaggattcacggttccattttgagatccggacgcatcagcggctgattgatatcatgtatccaactgcccaaacaattgattcattgatgcaactccagctccctgccggtgtggatgttgaggttaagctatgattctgttggagctaaacttttccaagtttgatgtaatgtggtactcattttctgcagcttttcttcttgatccttttgttgtctggatgggcaaaacactttttcatgctggttgcactgattctgggacaagactaacgaagctttctaacttgcagactactttcataaaaaccggcagagacttgcggcccgcgctcaactggtcatatcaaactattatttggtcaattttatatgtatccaagtaaacaacatttgggtaatcattattagggatactacatagccaaa

SEQ ID NO: 16928 - DNA, 1518 bp, Zea mays
tcgcgatgggtggcggcagggaacacagcccacggtttttgctggctccccgcctcgtccccgtcacccccctcctccgctccgcctcctgtttatagtcgcctgctgtcgcggcccctttttccttccaccacccaccggccaccaccctccgcggttgcctagttgccttgactgcctgcctcgtcttaccaccaagctaagctagcgcgttccttcgttcgttcgttcgttccttcctccctcgcttcctgttgctcggtccatggaggtggcggcggccgcggcggcgggcgcgggggttgtggagctgcagctggacctcctcgaggcggcggcgccgacggagcgagaggccaagaggcgccgggtgcacccggttccagcgggcccaccggccggggcagcagcggcggcagcagcgccggggcgccgcagccgcaggcgccgcgccgtgcagcgtctcttccaggcctgccgccacgtcttccggggccccggcaccgtgcccagtcccggcgaggtccagctgctccgccacatgctcgacaggatgcggccggaggacgtgggcctgagcccggacctgagcttcttcagagctcgagacgccacacgtggcggtggcaccccgaccataacgcacacgacgatatacaaatgcccgaatttctcgatggtcatcctcttcctgccgcgaaacgcggtgatcccgctccacaaccaccctgggatgacggtgttcagcaagctgctcctggggtcgatgcacgtcaagtcgtacgactggctcaacactgctgaccccgacccttcttccgccacgagcaccaccagctcttcgtcctccgatggcccatgcctgaggctggcgaaactggtggttgacgacgtcttcacggcgccctgcgacacctccgtgctgtacccgacggcgggagggaacatgcaccggttcaccgccatggcgccctgcgcgatcctcgacgtcctcgggcccccctactccatagaggaggacagggactgcacgtactacgcggaattaccgtacgcaaaccactcgctggtggctgcgggcgacgacgtggagcggggccagggccaaggccatctggcgtggcttgaggagatcgacatgccgagagagctcaagatgtgcagcgtccactatggcggaccgccgatctccgacgagtgacgtcgccggccgtcgtctccctcactggttgtactatgtctaactgatcgcggcacggcagagccgtgccgccgtctgacgttgtgtatagcaggcagcagcaagccataggctgtagttacacaaagtcccgatcgagtacaatgcttctcgcttgcctgcatcgttgttctctagatgccctttctttcttgttatttttgtttctactactacaagtagacgatgttttgtcctgacgatggatgatacagataagtcatatatatccacatatttcatttttgtcgttaaaaaaaataaaaaaaaaaaaaaaa

SEQ ID NO: 16929 - DNA, 3111 bp, Zea mays
  misc_feature (2251)..(2251): n is a, c, g, or t
ccttccaccacccaccggccaccaccctccgcgcttgcctagttgccttgactgcctgcctcgtcttaccaccaagctaagctagcgcgttccttccttttttcctccctcgcttcctgttgctcggtccatggaggtggcggcggccgcgacggcgggcgcgggggttgtggagctgcagctcgacctactcgaggcggcggcgccgacggagcgagaggccaagaggcgccgggtgcacccggttccagcgggcccaccggccggggcagcagcgccgggacgccgcagctgcagccgcaggcgccgcgccgtgcagcgtctcttccaggcctgccgccacgtcttccggggccccggcaccgtgcccagtcccggcgaggtccagctgctccgccacatgctcggtgagccatgcacgacccgactcaaaaaaaactagaacatttcgtaattttcagcgatcgatctggaacgaactggttgtcatggaccggcatggcctccgcgtactctgttcaatttcactagcactagcacttagctgctctgcttatactgaatctgaattcctgtacagaatagtatgcatccatcaatcatgcacctgtttcgtgcatgcgtttactgaaaaacctcaactccttctcctaccaaaatgcagacaggatgcggccggaggacgtgggcctgagcccggacctgagcttcttcagggctcgagacgccacacgtggcggtggcaccccgaccataacgcacacgacgatatacaaatgcccgaatttctcggtaggcagaattatttcgatagtgtgtgtgtactacagcaatgctgaaaaagctcgtgttttctaaccttccccttgtctatggcagatggtcatcctcttcctgccgcgaaacgcggtgatcccgctccacaaccaccctgggatgacggtgttcagcaagctgctcctggggtcgatgcacgtcaagtcgtacgactggctcaacactgctgaccccgatccttcttccgccacgagcaccaccagctcttcgtcctccgatggcccatgccgtaagcttctgccactcactgtcgccgctcgccggcttgatcgtctgtttctgttgttaacccctctgcactgcagctccaccggctctgcgcgcctccggtgcccccgccctgaggctggcggaactgggtggtggacgacgtcttcacggcgccctgcgacacctccgtgctgtacccgacggcgggagggaacatgcaccggttcaccgccatggcgccctgcgcgatcctcgacgtcctcgggcccccctactccatagaggaggacagggactgcacgtactacgcggaattaccgtacgcacaccactcgcgtaagtggccgcatctttcacctcatgagttcttgccgttgcactagagtagtgactcacgtatgggagaccggttcgtgtctttgctctgcagtggtggctgcgggcgaggacgtggagcggggccagggccaaggccatctggcgtggcttgaggagatcgacatgccgagagagctcaagatgtgcagcgtccactatggtggaccgccgatctccgacgagtgacgtcgccggccgtctccctcactggttgtactatgtctaactgatcgcggcagagccgtgccgccgccgttgtgtatagcaggcagcagcaagccataggctgtagttacacgaagtcccgatcgattacaatgtttcttgctggcctgcatcgttgttctctagatgccctttctttcttgttatttttgtttctactactactacaagtagacgatgttttgtcctgatgatgaatgatacagataagtcatatatatccacatatttcattttaaaaaagggggatattctgggcttagtttgtgcgtgttgcgccattttgtccaaatattttcatattatatctaatgtaggtaattcttatggatttcgtagcaacgtgggcacgcacttattgtggtgactatactcatcagcaaatatagcaagtctaatttatcaaaaacaaggtacaaagcctaaacaccaattaatatattcatacaacatttgatgtatatattttatatatgtatctaggtttatcttcataaaaatcaagagctaaaacgactaatatttttgatacggagggagtacttgatatgtatagcctactcatccaatatcatccaataatatgagagttgaatatgcnactgttacaaattgtgtgcgtttggttcatgataaatgagggctacttcatcaaaactggatgacatatacctatgcttgatcaacgctaaaggtgattatatatactgttaccaatatgcctatatgcccatccaaaatgctactatgcattactgggtgtgcttctcttataaagaaattttgatgcaggagatatagactttgaaatattgaaggaaaccaaaacacctgccaatccacctatcttgtcatggtagagctgtgggagatggatatcctcggatccacacaagggcgaaaacttcgctcggggccacgtgacagttgcccctctcaagcgtcccatcatgggccagacgaacaaagacaatgaaagcaggccaatctagaggcgaaagaggcccacgtccaagctagtcgcggcatagacgtggatatgtcgggtctgtttgttcccgtgcccgacatcctaactaaaacgacggggatatctcggcatgaaaacgccggattttcctcgagatagtaaaagatgtttgctactaattagaagataagtaggaagactgcgatcgatacttgtgcgggaagacgcccatggttgtgtatataaggccaagggggaccccatctatttttatctcattagcatcccctcagtccagtaatcaccgactgtaatctcatccatatacaaagtcatcctaggaaggagggtattacgctcttcaaagtggcccgaacctgctgaaatccgtttctctctctcttgccagagcgtgaaccatcgagttacgatctgcgacaccgacctacccaaaagcaccacgagggtaaccccgggtgtgcggttgacac

SEQ ID NO: 16930 - DNA, 587 bp, Zea mays
atccaaaatgctactatgcattactgggtgtgcttctcttatgaagaaattttgatgctctgaaatattgaaggaaaccaaaacacctgtcaatccacctattttgtcatggtagagctgtgggagatggatatccctcagatccacacaagggcgaaaacttcgcttggggccacgttacagtttcccctctgaagcgtcccatcatgggccagacgaacaaagacaatgaaagcaggccaatctagaggcgaaagaggcccacgtccaagctagccgcgacatagacgtggatatgtcgggtctgtttgttcccgcgcccgacatcctaactaaaacgacggggatagctcgacatgaaaacaccggattctactcgagatagtaaaagatgtttgctactaattaggagataagtaggaagactgcgatcgatacttgtgcgggaagacgcccatggttgtgtatataaggctaaggaggaccccatctatttttgtctcattaaaaaaaaatcaggtcagtagtcaccgactgtaatctcatccgtatacaaagtcatcctaggaagtagtgtattacgctcc

SEQ ID NO: 16931 - DNA, 5287 bp, Zea mays
  misc_feature (1548)..(1548): n is a, c, g, or t
  misc_feature (1589)..(1589): n is a, c, g, or t
gattatgcatggactagaggaaactaaactgcgcattttataaggctgatgatggacggcaaacaagaaaaggggcaataaactaaattaaactaaggacattaaggatatgtttagtttctttagagcatctccaacaatgcctcaaactagtgcctcaaattgaaatatacgggctctacacaggaaaaatcactccaacagtgccttaattcaacaaattttgtcaaaaaactatagggcactctctcaagtgcctcaaatatactacatcgtagtggactgtcctataatctagatttggggctttactgttggagcgggctgttttgttggtgccctaaattctataaaatttacttatttttaaattataaggcatttttataggtcacgttgtcggagatgctcttagtccagggactcaagttcagttagaggactaaaatttagtcgctactttatttggctctagagacaaaaaaaatattcaggacacattaaatagatcataagaggaccaaaatacctcttagcatcctcccaacattaatacaactaaaataaagaatactcaaaaggtagaattaatatggtttagtcccttttagtcattcttgaaggactaacgactaaaacaatttaattcccattttaattctacagtttgataatttagggactaaataagattaaaacatccctcaaaacaaatggagcctattttagtctctaaattgttaaataaagaaactaaaactctattttagtttctataattagtaatttaagaaactaaaataaaataagacgaggaactaaaaattagtctttaaacccaaacactatataaatccgacgtttggtcggcaaaacgacagcgatgcgtcgtccgtcccctctgaagcgggaaccaacgtgcaccatacccgtaatacaaaaagagaccacgctgaacaaaaataaacatttccaggtctccgcagaaactccacgtggctcgaggacccaccgcggtgtgtgtggatggtccagcctccgtgcgtgcgatgtcaccgccagccaggtccccggcctgtgggcccatccggcgtggcccacatgtggccgcccatttcgttccaggttgcttgcgcctagagtgttcgaatctgctactgtattgtaccaaccaactttgaggtaattctaccagcgtcatgttggcgtactggcgtaggatactgcgagaattgtttggtctcaggaatcatttcatctaagaaaaagtgatgtatcgtacgtttatttttcaagtttagtgagataatcttatttcttatgttaacattaactaattatagaaaataaggtgacgatggattaactcattatatttcataaacaaacaaaaaataagaagtgaaaaaatgatgaactaatttattttttaaaccaaacactttatatattctggttttgatttccggataatcttgtataccataatagcaatgagccattatttgtacaacacgcacggaatagtaacgtgttgaccccacaatnttttccccccctctgcatagccacataggagtaattaacgngatcctaatcgtttcaactctaccatcccaatttatttctcgcaggctctgctcggacattgcgtaatccaagagaccgtcaaggcaaggcaaagccaacaccagacgagtcgagaacaccgcagcagagcgcggcgtccaatggacatggacggcaactccccgcggcggcctccccgccggcctgagcgggaggggagctacggctacgacatcgagagcatggacggctccggggccgggggcccgccgccgtggagcgcgcaccacaacggctcctccgaggccctgctccgctacgacgacggcggcgccgaccgcgggagcacgcaacagccgctgctgcggaagcgcaccgtgaacacgacctcgcagatcgctatcgtcggtgccaacgtctgcccccgcgactgcttggactacgagtaggcattctagtttctccttttcccccttgactatttctctccatgcttgcaagtttatgggttttctccagcctatcctgaagatgggaagcatagtctcccgttcttctttgttgctacctaccccggttgatcttcttccgtgggttagaatttagagcgatcgttgctttttagttcacttggcacaaggaatcagcaactgtggttgtggttctggttcctgtagctgttcttcatggttcgaccgttgcgagaagcaaccgtcacagttccgggttataggacatagtatcttactgcctccttcatcagttcatgctcgcatattccttattcatgccaactccataatgattactacttgctgcgtagaattttagtatgccaagttatgtttatgtccaatcttcctttcttctctaagtaaaatggcaagtagatgggtacacaacaatactagttcctataatataaatattcccagatattgttctgtgaagatgaactatgaaatggagcggtgccagcatcctatatggcagctcgtgtaatgacctccaagagtaatttaatggttgctgaatcgcaaaaataaagaaaatgttcatgcacactttggtcctttccttacacccttcaatatcctgcatatttcagagtcgtggagaatgaccttttcaagcaggactggcgatcaagaaagaagaagcagatatttcagtacatcgtactcaagtggagcttggtgctccttattggcctattaactggatttgtcggcttcttcaacaatcttgcagttgagaacattgctggattcaaattgctgctcacgagcgatcttatgctcaaggggaggtatattagagcattttttgtgtatggaggttgcaatttagttttggcagcagctgcagcagcaatctgtgcttatattgcacctgctgctgctgggtctggtattcctgaagtcaaagcttatcttaatggggttgatgcctattctatattagctcctagcacactctttgttaagatttttggttcaatacttggagtttcagctggattcgtgctaggaaaggaagggcccatggtacatacaggggcatgcattgccaacttgcttggtcagggtggatcacgcaagtatcatcttacttgtaactggctacgctactttaagaatgacagagacaggagagatttgatcacatgtggatctgcagctggtgtggcggctgccttccgtgcacctgttggcggtgttctgtttgctcttgaagaagcagcatcatggtggcgaagtgctcttttgtggagaacattctttacaactgctgttgttgcggtggtattgagggggctgattgagttctgtcgtagtggaaaatgtggtctctttgggcaaggtggattgatcatgtttgatctcagttcaactgttgcagtctacagtactccagatctaattgcaattatagtccttgggataattggtggaatctttggaggcctcttcaactatctgttggacaagatcctccgagtttatagtattatcaacgagagaggtgctccattcaagatccttctcactataacaatatcaataatcacatcaatgggttcctatggtcttccttggcttgctgcatgcactccatgccctgttgatgctgtgggagcagtgtcccactgttggccgctccggaaattataagaacttccaatgcccaccaggacattacaatggtcttgcatcactcttcttcaacacaaatgatgatgccatccgcaatctcttcagcaacggcacatcgactgagttccaaatgtcatctcttttcatcttcttcactgctatttactgccttggactagtgacttacggtattgctgtcccatctggtctctttatccctgttattcttgctggagccacgtatgggcgcatagtgggaactcttcttggatccatatctgatcttgatcctggcctttttgccctacttggcgcagcatcttttcttggtgggacaatgagaatgactgtgtcagtctgtgtgatccttctagagctcaccaacgatctccccatgctccctttagtcatgcttgttcttctcatatccaagaccatagcagatagctttaacaagggagtttatgatcagatagtggtgatgaaaggcttgccgtacatggaggctcatgctgaaccatacatgaggcacttggttgctggtgatgtggtgtctggcccactaatcaccttttctggggttgagaaggtggggaacattgttcatgcattaaggttaacgggccacaatggtttccctgtgcttgatgagccacccataacggaaaccccggaactggttgggcttgtgactaggtctcatttattagttttgctgaacagcaagaatttcatgaagggacgggttaaaactagtggtagcttcgttctgcgaagatttggtgcatttgactttgcgaaaccaggttcaggtaaaggtttgaaaattgaggacctggatttcactgatgaggagatggacatgtatgtggatctccacccgatcacaaatacatcaccttacacagtggttgagacgatgtcactggcaaaagcagcaatccttttccgggaacttggtttgaggcaccttttggttgtgccaaagacaccagacaggcctcccatagtcgggattctcacaaggcatgacttcatgcctgagcacattcacagtctgttcccaaacctcaatcctcacaagtaccattcagcatcaatggcaggttgacaaggagactctttctgcttctcatctatttggcattattcgggtgctggctgtatgtaaattgcaaaggtgtatgcgtatctggttttcaattggatccatctcatcttctctacatagttttgtttgtgtggattttgtagcatatgctctttttgcaataaaaaaaatgtggcagttgtttggctggtgactgcctattatgagcctgcggcaataaatgttcagcaaattgcggagtaaacattgagagctccagaacatggagagaaagtgtgtattgtatatttgcgttgttcctgtaaagcatgtttagtcaaactcgaatattgtctataacacggagtaaatctcaggcggaaacatgggcgagctttctaagtacagattacttgctattgtaagtacttgaattgagattcgtaacatttctgctctgctctgctctgct

SEQ ID NO: 16932 - DNA, 1819 bp, Zea mays
ttttttttttttttttattacaactatcaatcattaatgttgtgaagcaaatagcatccaagcagtttacatgtctcgagtcaacgtcgagacagatatgtccatgagttcgtccgcaaaaaatcgtactacaaatcatggcaaaacacagctggcatcaccaacaaatctatgtacagtctaatggcagaacgctccgaaacaatcgaggtgtccatgtgcgaaaatcagaggaagcttccgaggtcctgtagtctgtggctgtgggagccaatggagccctgtcagaaggaagagaatcgggtggaagcaaagacccgcctggctttctcaagatcccggccgctatgcaacctccccatcaccggcactaccgtggatccattgggcgtcgcggcgacggcgtccccggccacgtctatccgcacctcctccgacagcgccccgccctcggctggcacgatagcgcccggcgccacgacgacgacgtcggcgcggcagagcgggcacgtggcgttcccccggaaccaggcgccaatgcactcgatgtggaagcggtggccgcaccgcggcagcgcgcgggccttctccccgggctcgagctccgcgaggcagaccgcgcagtccccgccccccgcatccgcgcccgcttcgatcagcacgaccggtatcgcggcgagcacagcggaatcgaggccgcgatgggggggaggcgctccctctccgtcaccgtcgcggcggtcctcgtcgccaccggcgatggccaggctccggaacagccgccgctggttgccgccgaggcgccgccgccgtgtgctgttgtagaggtgcagcgcgacgagcgccaggagcacgcccgcgaacgcccccgccgcggcgagcaggatcttgccagtcatggcgtagttcgtcgggtcggtcacctgcggtgggctggggacgtgcggcttggagaacggcaacctatactcgggactcccttcgcacgagaccgcctcctcgctcgccttggggccgttgccgttgccgtcgccgtcgctgacgcccatgtctgatggtcgagcgctgcgctcaccgaactgagctgtggtttcgcggatgatttgggtgtggtgagttcggtgagcaagttacttatagtgcgcgatttcatgactgaagtgcccttggtaatgctcggaacattgggatggaaatcaaaggggtagcctcgggttttcagcattggctggacgtctagagtagcacagcaagtcagcaacagtccgtctccgttccccgggccggggctcactggctgaccgcccgtacgccgtgtgaggacaggcgaacggccgtgatacgttcaccgggcggttctaggcgcacggtcaagagagttgactttgattaggagcatcaaccaaccaggtccagtccaggtggtagtgggtgttcgtctcctctgctctttccacaatggatgtcctctctttaactactactcccactgggacatggaagccctcccttgccgtgatttggacccgggcaaaatttctcagggactggggagcagacggcgacaggcagcgcgggggcgtggtcggccctgaccgatcgacctgcgaagcttcgcggaagcgaggcgtccgccagccacgtcacagcttctgtcctcgcctgcttcagcgagaagaggaaagtgaccttgcccctcttgccggaccccatcgagggcccacggccgtctttagaaatatacaggccccgtaacgacatcaacgggcccctatatatatatatatatatatatataaatttatatgtatattattat

SEQ ID NO: 16933 - DNA, 1041 bp, Zea mays
gactcgccgggtgcatgcacagcaccaggccatgcccgctgctatgtaagtgcttcgagccagtagcatcgtaaggccttgttcggttacatcggattgcacccggaatcgttccggttaatcaaagtttatataaattagagaagcaatccggctcggaatcattccgacccaccaatccgacacaaacgaacaaggcctaactcggtttgttaccgctcgagctcgagccagttcgagagtagccatttcaaatgaagtctgcgcttgtgtgttataagctaaaaaaaaaaaaaaaaaaaaaaaaaaaaaaaaaaaaaaaaaaaaaaaaaaaaaaaaaaacacgcggggctcacatgcaccaaataaccatggcggcatctaacaagattgcagcggcacatgtcgtcttcgtcctcgccttgctccttgtggcctatcgtgcggaggcaactgtctgcatgaggcataacaatttctatcacggcccatgcatgagcaacaaggactgtgccaactcgtgcgttcaacataacctcggtgtcggcgggtattgcaggggcaagatcccattcaacaaagaatgcatgtgtacatttgaatgcccatgagtcaaaagccactatatctgacgggcgcaacttgttatatatctagggatgggatgtcgtttggcatgtcctccattttgaaagtgtccaagtgagactttatacatatatgcagttgagagatggaattaataataagagcaaacaattatgttgttgtgcgtgttttaagaaaagaaaaaaaaaaaaaaaaaaaaaaaaaaaaaagcaaaaaaaaaaaaaaaaaaaaaaaaaaaaaaaaaaaaaaaaaaaaaaaaggaagagagaccctaaagaaaaaaaactaacataacacccgtatgaaaaagaaaaacctcttccataataaagccaaacatgaataaaactggaaaaaacaataaaacctaatggggggggacccctctgaaggatacccaattatgccccttgcagcccatccccttttctt

SEQ ID NO: 16934 - DNA, 1674 bp, Zea mays
  misc_feature (1438)..(1438): n is a, c, g, or t
  misc_feature (1536)..(1536): n is a, c, g, or t
  misc_feature (1598)..(1598): n is a, c, g, or t
tgcctgcagtcaaacgaattagttccaaaagtaattttcgacgatgttatattcagaaataccccttccgtttctttttagttgtcgctgtatagtttaattttacactatctagcgacaactaaaacgaaatggagggagtattattaaaaagtacggaaaacgcaagaacagtggtcggcgcgcgctccacacgggacggcaccaaaagaatatccaacgcatcaaacgacctctcggaacatgtaacaggaatattcgctgtcgctgcggatcgaaaatcaggtagtagtacgtaacctgacgaaagtcaggtaaagaaaaaaaaagaaacatgagaaggacggcagtatccaaagcacagcagggagcaagtagacagagagaggctactactagtactgattcttgctgccagtctacaccaatccagtgccatcccaaatgaaagcaaggttcgcatccttttactgattcttgctgccagagaatatgccatcgccgctccatcccgacagatgggcccgacccgcggccggccggcatggtccgtcgccctcgaacggttccgcgcatggcgatcccctgttcgtccccccgccgccaggctccgtagtctactcctcttcatcagaaatcgacgagtgatgtacgtaactgatccagccaccccggtcgagtgccacccactccacggcgccgaaccgcagataatgtagagtgcgccgcgccgtgacggcgtggatgagaaagcctccaaacctctctgtttcgggctctccgtccccaggttgtgtgccacaccccacactcaactatatacgaaaaccgccggcgcctggcccctaggccctagtcacagacccttgttctttcttcgacgcgcccccgggcatggcgaaccgcagtgttgccatgggcgtggccctcgcgttcgtggccatgaccgcgctctgttgcgcgccgggcgccgcggagttgccccggctggaccacccggccaggagcgacggatcgctgaagctgctcgtcgtcggggactggggacgcaaggggactcacaaccagtcccgggtcgccgaccagatgggaagggtcggggagaagctcgatatcgactttgttatatccaccggggacaacttctacaagaacggcctcaagggcgtgcgcgaccaggcatttgaagaatcgttcatggatatctacacagctcaaagcttacagaagccatggtactcagttctaggaaatcatgattacaggggcaatgcgctcgcacagcttagcccagtcttgaggaagatcgacgaccgattcatttgcatgagatcgttcatcgttaacgcagaacttgtggacttcttctttgtcgacaccactccgttcccaactggagtattggactcacccgggcaagcatcgttatgacctgggnagaggggtggcgcctcgaggcaagtacattgccaatttgctgaaggatctggatgtggctatgaagaaatcaactgcaaggtggaaagatgtggttgngcatcacaccatgaggagtgtgagtgagcacggggacaccgaggagcttctgggaatactancttcagtccctcagggacatggcgtcgacttctttcatcatgggcacgatcactgcctgggacacattagcagcat

SEQ ID NO: 16935 - DNA, 4192 bp, Zea mays
  misc_feature (3896)..(3896): n is a, c, g, or t
atttatattttaattttttggagatgttttagtgggactcaataagattgggagcggtaggagacctcgagcttacatttaatcccgatgtggcaccagacatggtgacacgacaagtgaagtcacgtcaccgtttaatgcattgtttagcggtggcaaaagagattggtgcagtcaaacgaattagttccaaaagtaattttcggcgatgctatattcagaaatattattaaaaagtaaggaaaacgcaagcacagtggtcggcgcgcgctcccacacggcacggcaccaaaagaatatccaacgcatcaagcgacccctcggaacatgtaacaggaatattcgctgtcgctgcggatcgaaaatcaggtagtagtacgtaacctgacgaaagtcaggtaaagaaaaagaaagaaacatgagaaggacggcagtatccaaagcagggagcaagtagacaaagagaggctactgtactattgattcttggtgccagtctacaccaatccagtgccatcccaaatgaaagcaaggttcgcatccttttactgattcttgctgccagagaatatgccatcgccgctccatcccgacagatgggcccgacctactacaatcatgcatggtccgtactccgtcgccctcgaacggttccgcgcatggcgatccctgttcgttcccccgccgccaggctccgtagtctactcctcttcatcagaaatcgacgagtgatgtacgtaactgatccagccaccccggtcgagtgccacccactccacggcgccgaatcgcagataatgtagagtgcgccgcgccgtgacggcgcggatgagaaagcctccaaacctctctgtttcgggcgctccgtccccggcgtccaacacccatactctccccaggttgtgtgccacacccacactcaactatatacgaaaaccgccggcgcctggcccctaggccctagtcacagacccttgttctttcttcgacgcgcccccgggcatggcgaaccgcagtgttgccatgggcgtggccctcgcgttcgtggccatgaccgcgctctgttgcgcgccgggcgccgcggagttgccccggctggaccacccggccaggagcgacggatcgctgaagctgctcgtcgtcggggactggggacgcaaggggactcacaaccagtcccgggtcgccgaccaggtaacggccgcgccatcttatacattcctagttccgaacttccgattactgcaagttagtgcgtacttcaaacaccttggccttcaacgccgttactgttcatcgaagtagaacatctgttcggcttcggcatatgccgattcatctttgtttagcacctgaaacgcccgtctgccgagattgttctgatgttctccgtcatctctgcgtgcgtcgatatgtacgatggatcaggctagtattctagcgacaatgcagagtccggtcagtttgcacataattaaaccaattttgactattcatgttaaaaaaattggcagctcgacactcacttgacaaacacatgctgcctccaaactaatcagcagtcaaatattccgttcattttttttcacatgccatatcttaccttcatatttctatctttgaccaaccactttaaaaacagatcatatgggctgacaacatgaggtttaaggttttagatacagtgtgagaaatactttcataatatatattttacatgttgggaaattatatagattttttttaaaaaaaacaatgttgaagttcagaatatttgacttaggatctaactaatatgtttggcctgagaaatttgcaatcgattcttatgtagatgggaagggtcggggagaagctcgatatcgactttgttatatccaccggggacaacttctacaagaacggcctcaagggcgtgcgcgaccaggcatttgaagaatcgttcgtggatatctacacagctcaaagcttacagaagccatggtactcaggtataatctcccacgttcttccaccacgcgttcgcccttggttattaccatttggcgtgaacagccggtgacgaaatctgtgcgaactaaggctgcagctatcccttttcagttctaggaaatcatgattacaggggcaatgcgctcgcacagcttagcccagtcttgaggaagatcgacgaccgattcatttgcatgagatcgttcatcgttaacgcaggtatataacagaaaaacgtaattcatttgaacctggagaggattactgatctcctaaattaaactgcaacaaggcaagcaaggctgaaatgtgtgtggcattttcgttcctaatctttgccagaacttgtggacttcttctttgtcgacaccactccgttccccctggagtattggactcaccctggcaagcatcgttatgactggagaggggtggcgcctcgaggcaattacttagccaatttgctgaaggtgcgcactccgaacacagccatgtcagtgcgggtgaaaggaagctcgttttatagaacctttttttgttgttgttgttctgcgatgcaggatctggatgtggctatgaagaaatcaactgcaaggtggaagattgtggttgggcatcacaccatgaggagtgtgagtgagcacggggacaccgaggagcttctggaattactacttccagtcctcaaggttacatttcagaagctatctcaaactcaatcggtttcatctttcagaaaggtccataataataacactgtttctgtggaaaaaaattcacaccgttcaggacaatggcgtcgacttctacatcaatggacacgatcactgcctggagcacattagcagcagagacaggtacaagcaccatacgatacagagatgaattcaagtaactttcagtccgtttccaagctacgaaccttgtgaaatttcttcttctgtttcagtccactccagtatttcacgagcggaggcggttccaaggcatggagaggagtcttccatccaaacaaggacaagctccggttcttctacgatgggcaagggttcatgtccctccagctgcaccaagaccaggcccacttcatcttttacgacgttttcgggaacatattgtaccgatggagctcgagacatccccagtcctccatgtatctcgatgaggaatagattggattgattttgccccattgatatgtacaaaacaccgcctgccaactgtcatgtatgtgaaatgatgagtgttggacgcaaagaaggttatacaccagttagggttaaatcatctggttcagtggttcatgatggatccaagaatgcgacgattatatcatagacacgtagtgaagaacggaaagacttatgaacaaacctcaaagtctaaccaattatgcttaggcgacaaaaaaatgtctagtttccacgtaaactagccaatcaaccgtcgaagttctcaatcaaagggactatgtgcaaagcgagcccctatgtataaagcgagttttaattagtctacaaaataacaatagatattaaataattctatagacaatcgacttgtttattagatttttttatgatgaatgtatgacaatccataatttaaattacttataatattgaataatgattttatattctacatttatatatttaaattttactttacaatataaaattatttgtcaatgtgtggctcccgagctgagtcaagctaagccagctcgcatgccaactttaagttgaatcgagccaagccttcgcatgccaacttcaagctgagtagagacttattttgagctcgtacaatggtccagccgagtcgagcttgacttgactcatttccaaaccttataagcacaagaacccctcataagaatgatcaaagcatgtgacaatctngaatagtcgctcaacaatcccaataatcgcaggccattaggtgacgacattcatcaaaagtaattggtgttgaatcattgcagacatgcagccttagtcgtgtgcaatcgtatgggcgagctcttagaaacacctactaaaaatgtgcaacatagtactaattgctactctttttacaaatgcacaacagtgtgctgcttgtgctgctggagacagtcctatagaacctaactacacaattgacatactctctaagttccttatccaatgcatatcggatgccatgatgcatggct

SEQ ID NO: 16936 - DNA, 1596 bp, Zea mays
aatcagaaatcgacgagtgatgtacgtaactgatccagccaccccggtcgagtgccacccactccacggcgccgaatcgcagataatgtagagtgcgccgcgccgtgacggcgcggatgagaaagcctccaaacctctctgtttcgggctctccgtccccggcgtccaacacccatactctccccaggttgtgtgccacacccacactcaactatatacgaaaaccgccggcgcctggcccctaggccctagtcacagacccttgttctttcttcgacgcgcccccgggcatggcgaaccgcagtgttgccatgggcgtggccctcgcgttcgtggccatgaccgcgctctgttgcgcgccgggcgccgcggagttgcccaggctggaccacccggccaggagcgacggatcgctgaagctgctcgtcgtcggggactggggacgcaaggggactcacaaccagtcccgggtcgccgaccagatgggaagggtcggggagaagctcgatatcgactttgttatatccaccggggacaacttctacaaggacggcctcaagggcgtgcgcgaccaggcatttgaagaatcgttcgtggatatctacacagctcaaagcttacagaagccatggtactcagttctaggaaatcatgattacaggggcaatgcgctcgcacagcttagcccagtcttgaggaagatcgacgaccgattcatttgcatgagatcgttcatcgttaacgcagaacttgtggacttcttctttgtcgacaccactccgttccaactggagtattggactcaccctggcaaggatcgttatgactggagaggggtggcgcctcgaggcaagtacatagccaatttgctgaaggatctggatgtggctatgaagaaatcaactgcaaggtggaagattgtggctgggcatcacaccatgaggagtgtgagtgagcacggggacactaaggagcttctggaattactacttccagtcctcaaggacaatggcgtcgacttctacatcaatggacacgatcactgcctggagcacattagcagcagagacagtccactccagtatttcacgagcggaggcggttccaaggcatggagaggagtcttccatccaaacaaggacaaactccggttcttctacgacgggcaagggttcatgtccctccagctgaaccaagaccaggcgcacttcatcttttacgacgttttcgggaacatactgtaccgatggagctcgagacatccccagccctccacctatctcgatgaggaataaattggattgattttgcgccattgatatgtacaaaacaccgcctgccaactgtcatgtatgtgaaatgatgagtgttagacgcaaagaaggttatacaccagttagggttaaatcatctggttcagtggttcatgatggatccaagaatgtgacgattatatcatagacacgtagtgaagaacggaaagacttatgagcaaacctcaaagtctaaccaattatgcttaggcgacaaaaaaatgtctagtttccacgtaaactagccaatcaaccgtcgaagttctcaatcaaagggactatg

SEQ ID NO: 16937 - DNA, 1575 bp, Zea mays
cattggtacctcgaggcggcgggcggtgatatgctgcaacctctctgtttcgggctctccggccccgccctctctgtttcgggctctccgtccccaggttgtgtgccacaccccacactcaactatatacgaaaaccgccggcgcctggcccctaggccctagtcacagacccttgttctttcttcgacgcgcccccgggcatggcgaaccgcagtgttgccatgggcgtggccgtcgcgttcgtggccatgaccgcgctctgttgcgcgccgggcgccgcggagttgcccaggctggaccacccggccaggagtgacggatcgctgaagctgctcgtcgtcggggactggggacgcaaggggactcacaaccagtcccgggtcgccgaccagatgggaagggtcggggagaagctcgatatcgactttgttatatccaccggggacaacttctacaagaacggcctcaagggcgtgcgcgaccaggcatttgaagaatcgttcatggatatctacacagctcaaagcttacagaagccatggtactcagttctaggaaatcatgattacaggggcaatgcgctcgcacagcttagcccagtcttgaggaagatcgacgaccgattcatttgcatgagatcgttcatcgttaacgcagaacttgtggacttcttctttgtcgacaccactccgttccaactggagtattggactcacccgggcaagcatcgttatgactggagaggggtggcgcctcgaggcaagtacattgccaatttgctgaaggatctggatgtggctatgaagaaatcaactgcaaggtggaagattgtggttgggcatcacaccatgaggagtgtgagtgagcacggggacaccgaggagcttctggaattactacttccagtcctcaaggacaatggcgtcgacttctacatcaatggacacgatcactgcctggagcacattagcagcagagacagtccactccagtatttcacgagcggaggcggttccaaggcatggagaggagtcttccatccaaacaaggacaagctccggttcttctacgatgggcaagggttcatgtccctccagctgcaccaagaccaggcccacttcatcttttacgacgttttcgggaacatattgtaccgatggagctcgagacatccccagtcctccatgtatctcgatgaggaatagattagattgattttgcaccattgatatgtacaaaacaccgcatgtcaactgtcatgtatgtgaaatgatgagtgttggacgcaaagaaggttatacaccagttagggttaaatcatctggttcggtggtttatgatggatcgaagaatgcgacgattatatcatagatacgtagcgaagaacggaaagatttatgagcaaacctcagtctaaccatcaaagttctcaatcaaagggactatgtgcaaagcgagccgagccaagtctatttctcgagctcattggagtagtgttcaggctcgtgagccgcctcgcaagtgtgccaaattagttagtctacaaaataacaatggatattgaatatatctat

SEQ ID NO: 16938 - DNA, 1786 bp, Zea mays
catacattaactttatgagggactcatttaggagggagggctttagtcttaatggacaaacagagggtaatgtggaaaacagaactgcagagcctgaatcagcttctgtgcttgggcttcataatgcatcattgctagcggtaaattgcactctactaggcaaattattgttgaacaggctggtgcattgctgtctcaactctcaactcagctgggagatctagagaatgtaactgattctgcaatacgaagggacattcaaagtagtgcagttcgcacgggttctctatttcagaaccttggttctttgcttctggaacttgggcgcaccacaatgctcctgcgtataaatccgtcatcttcagaagcggttgtaaactctggaccagctctttatatatctccatcagggccaaatcctcttatggttcaacctgttccatttccaggaaggtctgtccaaatgggtactttgttttctagtctgggttcacaaggatctgttctacatccgagagatgttgatatccatgtccgcacaagtgggtccgtgcctggagccagtactaacccaagtgattcagctggtgcgcaagcgcatcaaaatgtgaataggccaggagatgcttcgcatgcaaatattggtgaagcgttttcaggggttgcaggtggcactcctttttcagttgagtccggagttagactattgccacttagaacagtggttgccatgcctgctggcatcagtcgtgctccatcagggtcgtctagtggtgggcttggtattatctatccatttctcactagggttcgacaaagggcaaacactaatggtaatgatgaaaggaatggtcaatctccaaatgaatcggctcgtagtagcacccatcttaatcagcaatcaattccgcagtcatctcaaactcatgaagcaggtaatctgagatctccagttgatgtcaatgttggagatggctctgagacctcacctgggcagcagaatggtctggtcactctctctcagataatggacttttttggatcaatgctcccaggcgaaaatgttcgaggaaatacttcaagccagcaaccaccaatggcttccaccgagcagggagagggtagaaatcttgcaacaccagaagtgtcaggagccagtgaggaggccctacgctttgctggcatggtcagacaaattatgccatttatctcccaagttgaaacacagaatcaaagtgccccaccagacagcagcagcacacctgcacaggctgcatctgggagtgcagacagagctagggatgtcccaaatgattctacgagttcccgtcaacataaccgcgaccaaattgatgagcctaattctaaaaggcaaagaactagtgactgattggaatctacttgtgagctgagaatcttgccagttcttgatttaccccagcggatgatcaaaataaggacttgagacaaatggtggcagtattgagacaaaaatggattagctgtggtatatacttggcactgagggcactagacgaggcacctatgccttttttttttgagggggcgcatcttataagctgttatttttttagtgcaacgagcatacatgctgctggcatccaatccccaatatgtacaagttttaattcaggttgtgatcatttacgcaacgaatcaaagcctccgctctggtcattgccgtagcatacggaggactgacgcaatcaatcatattgttacgagaatgtatagcttcaaaaaaaaaaaaaaaaaacccgcggcc

SEQ ID NO: 16939 - DNA, 2298 bp, Zea mays
  misc_feature (27)..(27): n is a, c, g, or t
cccccccccccccccacacacacacantatattcgtatacccgctttgataattgctgtatttctatgttgctgaaatgatattgatgcgtagcaatcagccacacgttttgttactcctttgtctgaaaaataagatgacatactgaagcactttctcaagtctgacgtttttgttcatcgttttgttccaggcggtatttcgggagtacgagaatgagagctacaagaagctgattgcagacattgaagcccagccaagcattgcggttcagaaagtgctgaaatccttcttgcacaagatctacaagaggcagaagtagggtgctcttggataaacgagctcaggagtcgttactccttcgcatgcttgacataaccggacttcctcacctggttgctctagtatgatgtggagcgtctagttaaaaaaaatcgatgtagtatgaagcaccttgctgctctgaatattaacaggcaattaaggcaaggtgctgtttcggtttggtggaccgcatgttgcagataataaattagttgttttgtcatttgcgtctctatcgactttgctagtttgcttcttttggccaccgcccaactagtcgctttcaagagaatttctagcgtgtcacttctttgcttctctctctctctggccacccctactagtcgctttcaagttttttgcttttctctgaaaatgctcgcatcctctatgacttcgtggtacaatcttttgggaacaaaagtgccaagacatgatagaagaatattccaaaacctaaatttcaggagcttgagtaacaagggttgtttattcactctacgcaacaaaatgattctccaacatgtccatattaaatcagtggtttccagaagttacaagcgcctgtttttcgaagcacaagtccagagtaaatcaccaaaaaaacctttatgagtgctaacacaacaatttaaccggtatctgcctggaactatgccattgcctccgtaaatggtaatgaagtgatttcatacatggcatctatcttttggagaaaacaacagagcataaacatttgccaagttaacatatatgaaattccaccccttgtttttccagagcacctgatcctaattcgatcggttgggaatccagaaagttagggcagttgatgcggttgcaaacatggctcgacgtggggcccacttcaatgctgtaataggaccaatgcgactgttccaacaagcaacctgcaaaaaaaaaatctgacactaagactctagcaacctaacaacacatgttaaaagcctgattaaagaaaatcacctcttgtactgtattgatgtcccaagcgtgcagtgttccatcacctgatcctgcaaaaacaaacatattaggtagctctcctaggaaaaaccatttacattcaagtttccaaggtttattcataggagcgagcatatatgtggactcttagatgcgccagaatgatgcaattgcaaaatactaccatatggtacaacgatcatcactgcgttttttttattaggtgttaacacttgaggcagtgtaggttcctaaatatacatggttggtcaatggcaaaagtgaagctgaagcaagtaacataatgaagtcctgttacttgtcagatctatcgacaaaagcgatgcaacgaaaaggcagaagttgggatacttaaaaaaaggaccttattagccttaagtgtagagggaaaatagtgggcaattttccatatgaaccagaatatgcaattacctgaaattacatattgaccatctggagtgaaagcagcttcatttgttacattgggagatggctctaaactaaaaccacacctctgcaattagattggaatattagcaaaaggatgtaagtgtaaatgacaagatcagaaaatgtgcaccacaaggatcggtatctgaagcaaagacaaagggaagataatataactcaacttatccccaacatatgcatccagaacatatatatgggtgttagttgttgtcaaaagcatagacttgccatcattgctaaatttgatgtcagaaacttcagctgtatctccaccaaccaagaaagtgtcgaatggaccctgaaattggattggttcacaggataaatatttcacacaccttccacaaatatatggttgttctgtattatattcactacataccttgtcataagatcgggaatcaaataaattaatagcaccaccttccattgctacagcaaaaacaagtccctgttgatcatatgcaacagaaggtctaccacgcagccttagta

SEQ ID NO: 16940 - DNA, 1735 bp, Zea mays
agatctggatccaaacggcggctctgtttcgtgcgctgtcccgtctccctccgtctcgtcagcttcgtgccgtgcccgtgcgagccgctgccaacccgctccagctttgcccgttgccttggccgtcccgtccggcagtccctagaaaaggccgcgtcccacgttgccttggttcccccaccctgctgtctccctccctccttccttccttccccgccactgcgcagcgcgagtgcggcgacagccagtcacacactcacactccctcgaccgctctcggccccgtccgcgtcgccgcagggcgaggaggcaatggcggcgggcgggaatggcgccggcggggacaccagggcggccttcgcgcggatctacaagacgctcaaggaggagctgctcaccgacccggccttcgagttcaccgaggagtcacgccagtggatcgaccgcatggttgactacaatgtactcggaggcaagtgtaaccgtgggctctctgtggtcgacagctacaagctgctcaagggcgctgatgctctgggcgaggaggaaacgttccttgcttgcaccctcggctggtgcattgaatggcttcaggctttctttcttgtgcttgatgatatcatggatgactctcacactcgtcgcggccagccttgctggttcagggtgcctcaggttggcttaattgctgcgaatgacgggatcatccttcgcaaccatatctcacggatccttcggcgccactttaagggcaaaccttactatgctgatctccttgatttgttcaatgaggttgagttcaagacagcttcaggtcagctgctggaccttatcactacccatgagggagaaaaagatctaacaaagtataacataacagttcacggtcgaattgttcaatacaagacagcctattattcattttatctgccggttgcatgtgccctgctgctctctggcgagaatttggacaattatggtgatgtagagaacatccttgttgaaatgggaacatactttcaagtccaggatgactatctggattgttatggtgatcctgaatttatcggcaagattggaacggacattgaagattacaagtgctcatggctagttgtgcaagcccttgagcgtgctgatgagagccaaaagcgcattctatttgaaaattatggcaagaaagatccagcctgtgtggcaaaagtgaagaacctctacaaagaacttgacctagaggcggtatttcaggagtacgagaatgagagctacaagaagctgattgcagacattgaagcccagccaagcattgcggttcagaaagtgctgaaatccttcttgcacaagatctacaagaggcagaagtagggtgctcttggataaacgagctcaggagtcgttactccttcgcatgcttgacataaccggacttcctcacctggttgctctagtatgatgtggagcgtctagttaaaaaaaatcgatgtagtatgaagcaccttgctgctctgaatattaacaggcaattaaggcaaggtgctgtttcggtttggtggaccgcatgttgcagataataaattagttgttttgtcaaaaaaaaaaaaaaaaaaaaaaaaaaaaaaaaaagaaaaaaaaaacagaaaaaaaaaaaaaaaaaaaaaaaaaaaaaaaaaaaaaaaaaaaaaaaaaaaaaaaaaaagggggggcgggtcgaagggatcaaggtttccgacctcgg

SEQ ID NO: 16941 - DNA, 1447 bp, Zea mays
gatgcaccacctcgttttggatggtttaatttctcaaaccaaataccccctagtctttcaagaacacgataatttgccgggcaagtgtacataaaataaaataaggaaggaggcactacaagtatctgcctggaactatgttacaacaatttaacaggcaggcgtattagtacagtacatataaataagggagcactacaagtatctgcctggaaacatgtcaatgtttccgcagatggtaatgaagtgatttcatacatggcatctatcttttggacaaaagaacatgatatgaacatttgctacgttagcatacatgaagtcacatcccttctttctccaggcacctgatcctaattcgattgattgggaatccagaaagttagggcagttgatgcagttgcaaacatcgctcgacgaggggcccacttcaatgctgtaatcggaccaatgtgactgttccaacaagcaatctcttgtactgtattgatgttccaagcgtgcagggttccatcacctgatcctgaaattacatattgaccatctggagtgaaagcagcttcatttgttacattgggagatggctctaaactaaagccacacctcttatcccctccatatgcatccagaacatatatatggttgttagttgttgtcaaaagcatagacttgccatcgttgctaaatttgatgtcagaaacttcagctgtatctccaccaaccaagaaagtgtcaaatggacccttgtcatatgaccgggaatcaaataacttaatagcacctccttccattgctacagcaaaaacaagtccctgctgatcatatgcgacagaaggtctaccacgcagccttagtatgccctgacaagcatttacgcgaagatcccatattctgacactgtgatcaagtgatcctgacataaagctatcattgacaggcgacatacataatgaaacgaccctgtctttgtgtcctttgaagtatcttaagcaacggttgtcatacaatgacagataacgaagtgattctgcagactctaggttgtatcgtgaagagcataagatagaacttggatgatgactaaaacagacacggtcagcaccatgtttcctgtgatatgtagtctttaacaacgtcgcgctggtgatgttgtacatgcggatggagtcgtcctcgctggaagtgacgaggagatcttccttgcggtggaagtcgaggcagtttatcttcccggcatagtcggtgaagacagcgccgatggccatgccgcggacgatctcgtcgtccagctgcgacaacgccgccgccatcttgttcccggcggctgctgctacaatcgagtccgccgccgtccagattttcgatataatcgtcaatttggtgatggaggaggatgtgcttattttctgtttttcttttttatttaaccccggcaggccggagggta

SEQ ID NO: 16942 - DNA, 2834 bp, Zea mays
  misc_feature (1754)..(1754): n is a, c, g, or t
tgactttgtggaagtttgcttacttttcagaaaatcacaggcagcactctcccaattcaagggtcaggagagcaatataaatgtagataaagtgaacagggcagcctgcaaaatgcagcctgttcaagtacttctgatgcttatacagcatggagcaaacggtcttaatctactagaggcacagcatgttattctagtggagccattactaaatcctgctgctgaggcacaagctatcagcaggatccatagagttggacaagacaaaagtacatttgttcaccgttttatagtaagtgatacattctcctcttttttttcttctttctattatattcttggaaacggttttcaatgcattattatttactttcaggtgaagaaaacaatagaagagagcatctacaaattgaacaggagcagagctgtctgctctactataaaccgtaaatccaaaaacttcaaagatgagcctgttttgacgctgaaggatgtggagtcgctattcccgatggcaggacctgatgaacccctagaacaggcagatcaaaattacggcgatagcttgaggagtttgcctccatctgttgccgctgggttagctgctgaaagaaggcgactaatggagcaataagttaatggagtttgcctccatctgttgccgctgggttagctgctgaaagaaggcgactaatcaagggacctccatccatcgttgtggcagttgtgctaattttacttgatcagaatttctcttcgcagcacagtaacgacagtaggagaatgatgctccttagttatgaagcacccccatcatgagaatcaggctatttacgttgtaactttaggattttttttttatgtacctgtaggccttttagactcttgtacataagcttctagttttagttcgtttatacggcccatcctgtagttttgatgtagcagctctcagctctgccactgctacaccaacttatggcatgtataagtgtactaatacatggtcatcagcatgatacattctttagatgcttggtcaattttttagatgcttggtggtggcagagccagtagtcattatggaagaaaattgtcggttgtcctatgctgtctgcaggcgtgccggatggtcagtcaggaagatgcagcaaggctttctgatagcttctgcatccgggcccctgctgtgccaggctcgacggcgggcgtcggcgcacgacatccgagtgcgggtccacgagcagagcatggccatgaccgccggccgccgccaccaccacgtactggtactgcccaacgcgcggcatggctcacccgcatgcgccacggtccggtcatgcatgcatgtctgagggcaaaagaccagtcagcgcgcctagatgtacaagaagttttcattcataagaaaattgactgcgatcagagaagatgctctccccctcgctgggatcatttgtttcataatattgtatggcgctgacacccactagttcttagttctcggtcctctgtttgccgtatacttagtccgttcttttttatttgtcgcgttttagtttaaaaataaactaacgggtgacggatattcgagaacagagatagtaatttactctagattctaccgcatggtaaggagtgtttctatattaagggtctgtttgatttgctacataacttgccacgtaacccacactttgactaatgttttctatttaaggtagttttttaattcagacgactaaccttagacnaagtatgacacagttagccacgaatcaaacatacatttgttattgcatttgcttgttgacatatggtgttcttcaacaggtagaagttcactccactatcttcagcagcttacccatcactatcttactgtaatctgcatacagtacactacattgcaaaactgtgtttgataactgctggacacgacagtgtgactgtgtgagggctgagccatcagtcatggatgacatcacagtggcgcatcacttggatgacgacatgctgccgccgccagcttcagttcgttccccttgtcctcgccttgctcttggcacagtctcagtctcatcagtctcagtctccttccggccagggcctggggaggtgggggacccgcatactatgcctgcatggtcttccacgccacttcctctttcgccatcccgcgcgccctcctctacttttcctcccaacttccccaccgcggccaggccaccaataaaaacaagcctcgcctgcagccgacgaccgccccggccctatcgctcccagccacgaccgggcaggcaggtggacaagcataaacttacatcgtcgctggtttggtagctagtgagcgatcgagcatatgcatggcgtcttccgctggcggcggcctgcgttcaccggctgctacggcggcgccacgggtggtgatggacagcctgatcgaggtgcgcgagggcgcgaccaggctccagaccatgctgctggaggagtcgcccacgccttcgatcgctgcggcggcggcggcggcgggggccaccagtgaggtcagacagacgcttgacgggatgatgagcagcctgtcaagcgccatgtcggctctggacaccaccggcggcggcggcggcggtcagggacagcagggccggaggaggaagcgaggcggcgcggcggcggccaggtctgggccgctgcggcggagcagcaacaggagaaggtaaaaatgaagggtgataaaaacccttacttttttaacctacttcgccggtgcatgcattattgggatatattgcaatttgaaggatacccaagctagctagtttgtatgagtctag

SEQ ID NO: 16943 - DNA, 2125 bp, Zea mays
gttgactgtactgtaatataggatgggcaatcttttcgggccttgtacgtcggagaatcgactacgatctcctaggtcaactgtaatactgtatggtgctctgctgtagttttctctcgtcgtttgcgacttcaattcgcgtggccaagtttactgcatcgctgaaaagaaaatgcctacagtgcctagcatcagcagcaggcgttgatctcgacgacaccgcgtagggtagtcgctgtcgcagcgcgacaatcgaaccgcggagtaagtacaagtcaaacgctgagccgcgcgctttactggtttaataactgaatggtagctaggtcagagcacgatcagtgaaggagtgaaggctcgagcgttgctgtgctcgatcaaacagcacctacgagaagcaagtataagcagaacgaagcagctcacaacccaagcagcaaacgccggatcaaattaaatgttgccatgttctagtgtagagagtttgccacatgatgtgattattgttatcttaaggttcaaaattgatgaagaagaattgtactagtagcacagtagtgacctctaggagccaacgattgatgtttaagggtcatgtgtcttgttacttatcgtgaatctgaagtcgaacagtgatggagtaatgtccatatgaagtatcactgttgtcgatgcatgggaatctctggctctgttaatttcgacagaaaccaaggcaacagctagggctaattaattccagagactttctatagtacgccctgcgtcaatcaattggcgtcagaactaaattagaatctcaagaaatcgcatctcagttctcagagaaaaagatgctttatcgattacagaattctctgctgatcggatctcatcgcacatgcacagcacacccatcatctgccaacccaacgcggaaacccggaaagatcgcgtcgatggctgcacgaccccccacgcctgtccattcccttgcactgccgcggcgcatcatccacctcggctcactccactcactgcaccgagctcactggcaatggctaccagcaccaagctcgtggcccttggctttgccgtcctcctgagcatcggcttctccgatgcagcgagggtagttaggcttggtagccatgcgtctgcgggaggtggaggtggcggcgggggaggcggctccgggtcgactgggggtggctttggcggtgggtcgggcggtggcggtggttacggcataggtaagggtggcggggactggtggaacaatttcgtctctagtatagcaggtggtggaggaggaggacaaggcggaggcggtggcaccaatggtgggtccgggtccggcggtgggtccggttatggttctggcagcagctcgactgcagcctctggccccagcagtggcaactacgccgacgctgagggcaagggcgccggtggaggcatgggcggtggtgccaatggtgcatatggttctggtgctggtggaggcgttggcaagggcgagggtgtgagtggtgtggcactcgcaccatcgtccaacggctactacaatggcggtgccgccgatgctaccggtggcggttccggcgccggcggtggacatggtggtggcgcagccggagctccaagctatggaaccggaggcggcctcggcggaggcaagggtgaggccggcagcgatggatcgtgggggtcaggttatgctcagggaatcggtgctggcacaggcggcggtggcggcggcggatcccaaggcggctctggtggcggtggaggctctgggtccggatccggcagcggtggaatccactgagcttgcacttcagtagctagagcctagagccccgcattagtgtcagtccattctgtggttttttgctgtctttgttacgagaattaatcaggaataaagcgtaatgggcttcgtgattgtagttcgagtaggtagcaaagcatgcaactgatatgaatgcatgtaatggctatctacgagtgtgtgcccctagctgtaatctgtttctcatcgatcgttaaggtcgttgcatccggttttatttatcttctgaaaccaaaatacattggaactcttatagtcaaaaaaaactgttctcgagggggggcccggtac

SEQ ID NO: 16944 - DNA, 1200 bp, Zea mays
gcacgaggttcattcattattagtacggtaccgggtcgctcgaggccatgaaaaggcgaccctccactcgcaccgccacactttagctccccactgctataggcagcccacatgcgcgcacactcctaagctagctatagcagcaaggcagccagctgagctcagagctcccagtccagcgccggcgccaccaccgcagctgctcgctggtcaccatgagcaaggagaagcaccaccgcgactggatcctccggcgctgctgcggctccatcgccgcctgcatcctgacgctggccgtcgtcgtaggcttcatcgtgctcgtcatctacctggcgctgcgcccctccaagccgtccttctacctgcaggacgtgcagctgcgctccatcgacctcagcgacccggcgctctccctcgacctccaggtgacgatcgcgtcgcggaacccgaacgagcgggtgggcgtgtactacaagacgctggacgcgttcaccacgtaccgcgacgaggcggtgacggtacccgtgtcgatgccggcgatctaccagggccacaaggacgtgtcggtgtggtcgccggtcatgtcgggcgacgcggtccccgtggcgcagtacgtggcggacgccatgaagcaggacatcgaggcgggatacgtgctgctccacgtcagggtggacggccgcgtcaagtggaaggtcggcagctgggtctcgggcagctaccacctcttcgtcaactgccccgcgctgctcgccaccagcggcagcgccggcgccgccgccggcggaggcgtcttcgccgccagcgccgcgtccggggtagtccccgccggcgtcaacaccaccgtctccctcaagttcacgcacccggccgactgcaccgtcgacgtgtgagtcgtcgctgcgccacgagcccacgacgacgaccggcgcgcgcttcgttcgttcgttttcgttcgtactggctagtgcggcgcgggggatcaacatcgccccctcgctcgcgcggttatcgagcaattagtttttcttttgtagcaaatgttcgttctcatatattttcccttccgaagctgtgcagaaataagttaataagctatacatacatatacatgtgtactagatttgctatatattattaccccatatatatttaatatgaaaaaaaaaaaaaaaaaatcaaaaaaaaggccaagcggcc

SEQ ID NO: 16945 - DNA, 973 bp, Zea mays
ctcgagccggcaggattttctgggccctccttccactcgcaccacactttagcttctcccacactgcccacatgcgcgcacgtcgcacagtcctacgctagtagcaacaaggcagccagctgagctcccactcccagtccagtcgagcgccgcagcaggggcaggtcaggcagctcggtctcgccatgagcaaggagaagcaccaccgcgactggatcctccgccgctgctgcggctccgtcgccgcctgcatcctcacgctcgccgccgtcgtcggcttcatcgtgctggtcatctacctcgcgctgcgcccctccaagccgtccttctacctccaggacgtgcagctccgctccatcgacctcagcgacccggcgctctccctcgacctccaggtcacgatcgcttcgcggaacccgaacgagcgggtgggcgtgtactacaagaccctggacgcgttcaccacgtaccgcgacgaggcggtgacggtgccggtgtcgatgccggcggtgtaccagggccacagggacgcgtcggtgtggtcgccggtgatgtcgggcgacgcggtgcccctgccgcagtacgcggcggatgccatgaggcaggacatcgccgcgggctacgtgctgctccacgtcagggtggacggccgtgtcaagtggaaggtcggcagctgggtctccggcagctaccgcctcttcgtcaactgccccgcgctgctcgccaccagcgggagcgccggcgccggcggcgcctttgccgccagcgccgcgtcgttggggtcgggcatccccgccggcgtcaacaccaccgtctcgctcaagttcacgcaccccgccgactgcacggtcgacgtgtgactttgtgacgacggcgggcgttcgagttttcttgtagcaaatgttctcatatattttcccttccgaacctgtgcagaataagttaggccccgtttctaaaaaaaaaaaaaaaa

SEQ ID NO: 16946 - DNA, 1185 bp, Zea mays
gccggccttcccgggacctcttcttcttcttctaccagtagttcattcattattagtacggtaccgggttggagtaattaaagggccggcccctcgaggccggccgggactttagctctccccactgctataggcagcccacatgcgcgcacactcccaagtcctaagctagccagctgagctcgctcccagtccaagcgccggccccaccaccgcagctcgatcacaccatgagcaaggagaagcaccaccgcgactggatcctccggcgctgctgcggctccatcgccgcctgcatcctgacgctggccgccgtcgtcggcttcatcgtgctcgtcatcttcctggcgctgcgcccctccaagccgtccttctacctgcaggacgtgcagctgcgctccatcgacctcagcgacccggcgctctccctcgacctccaggtgacgatcgcgtcgcggaacccgaacgagcgggtgggcgtgtactacaagacgctggacgcgttcaccacgtaccgcgacgaggcggtgacggtccccgtgtcgatgccggcgatctaccagggccacaaggacgtgtcggtgtggtcgccggtcatgtcgggcgacgcggtccccgtggcgcagtacgtggcggacgccatgaagcaggacatcgaggcgggatacgtgctgctccacgtcagggtggacggccgcgtcaagtggaaggtcggcagctgggtctcgggcagctaccacctcttcgtcaactgccccgcgctgctcgccaccagcggcagcgcggccgtcgccgccggcggaggcgtcttcgccgccagcgccgcgtccggggtcgtccccgccggcgtcaacaccaccgtctccctcaagttcacgcacccggcggactgcaccgtcgacgtgtgagtcgtcgctgcgccacgagcccacgacgacgaccggcgcgcgcttcgttcgttcgttttcgttcgtactggctagtgcagtgcgggggatcaacgtcgccccctcgctcgcgcggttatcgagcagttagtttttcttgtagcaaatgttcgttcccatatattttcccttccgaagctgtgcagaaataagttaataagctatacatacatatacatgtgtactagatttgctatatattattaccatatttaatatgaacctcacagtttgaatt

SEQ ID NO: 16947 - DNA, 1104 bp, Zea mays
cctcgaggccggccgggactttcgctctccccactgctataggcagcccacatgcgcgcacactcccaagtcctaagctagccagctgagctcgctcccagtccaagcgccggcgccaccaccgcagctcgatcacaccatgagcaaggagaagcaccaccgcgactggatcctccggcgctgctgcggctccatcgccgcctgcatcctgacgctggccgccgtcgtcggcttcatcgtgctcgtcatcttcctggcgctgcgcccctccaagccgtccttctacctgcaggacgtgcagctgcgctccatcgacctcagcgacccggcgctctccctcgacctccaggtgacgatcgcgtcgcggaacccgaacgagcgggtgggcgtgtactacaagacgctggacgcgttcaccacgtaccgcgacgaggcggtgacggtccccgtgtcgatgccggcgatctaccagggccacaaggacgtgtcggtgtggtcgccggtcatgtcgggcgacgcggtccccgtggcgcagtacgtggcggacgccatgaagcaggacatcgaggcgggatacgtgctgctccacgtcagggtggacggccgcgtcaagtggaaggtcggcagctgggtctccggcagctaccacctcttcgtcaactgccccgcgctgctcgccaccagcggcagcgctgccgtcgccgccggcggcggcgtcttcgccgccagcgccgcgtccggggtcgtccccgccggcgtcaacaccaccgtctccctcaagttcacgcacccggcggactgcaccgtcgacgtgtgagtcgtcgctgcgctacgacgacgaccggcgcgcgcttcgttcgttcgttttcgttcgtactggctagtgcagtgcgggggatcaacgtcgccccctcgctcgcgcggttatcgagcagttagtttttcttgtagcaaatgttcgttcccatatattttcccttccgaagctgtgcagaaataagttaataagctatacatacatatacatgtgtactagatttgctatatattattaccatatttaatatgaacctcacagtttgaattagaaaaaaaaaaaaaaaa

SEQ ID NO: 16948 - DNA, 1153 bp, Zea mays
tgcattgggtacctcgaggccggccgggactttagctccccactgctataggcagcccacatgcgcgcacactcctaagctagctatagcagcaaggcagccagctgagctcagagctcccagtccagcgccggcgccaccaccgcagctgctcgctggtcaccatgagcaaggagaagcaccaccgcgactggatcctccggcgctgctgcggctccatcgccgcctgcatcctgacgctggccgtcgtcgtaggcttcatcgtgctcgtcatctacctggcgctgcgcccctccaagccgtccttctacctgcaggacgtgcagctgcgctccatcgacctcagcgacccggcgctctccctcgacctccaggtgacgatcgcgtcgcggaacccgaacgagcgggtgggcgtgtactacaagacgctggacgcgttcaccacgtaccgcgacgaggcggtgacggtacccgtgtcgatgccggcgatctaccagggccacaaggacgtgtcggtgtggtcgccggtcatgtcgggcgacgcggtccccgtggcgcagtacgtggcggacgccatgaagcaggacatcgaggcgggctacgtgctgctccacgtcagggtggacggccgcgtcaagtggaaggtcggcagctgggtctcgggcagctaccacctcttcgtcaactgccccgcgctgctcgccaccagcggcagcgccggcgccgccggcggaggcgtcttcgccgccagcgccgcgtccggggtccccgccggagtcaacaccaccgtcgtctccctcaagttcacgcacccggccgactgcaccgtcgacgtgtgagtcgtcgctgcgccacgagcccacgacgacgaccggcgcgcgcttccgttcgctcgttttcgttcgtactggctagtgcggcgcgggggatcaacatcgccccctcgctcgcgcggttatcgagcaattagtttttcttttgtagcaaatgttcgttctcatatattttcccttccgaagctgtgcagaaataagttaataagctatacatacatatacatgtgtactagatttgctatatattattaccccatatatatttaatatgaaaacctcccagtttgaatcaaaaaaaaaaaaaaaaaagcggccaa

SEQ ID NO: 16949 - DNA, 899 bp, Zea mays
tgggtacctcgaggcccgccgggggctcttcttcttcttctaccagtagttcattcattattagtacggtaccgggttggagtaattaaaaggccaccctccactcgcaccaccacactttagctctccccactgctataggcagcccacatgcgcgcacactcccaagtcctaagctagccagctgagctcgctcccagtccaagcgccggccccaccaccgcagctcgatcacaccatgagcaaggagaagcaccaccgcgactggatcctccggcgctgctgcggctccatcgccgcctgcatcctgacgctggccgccgtcgtcggcttcatcgtgctcgtcatctacctggcgctgcgcccctccaagccgtccttctacctgcaggacgtgcagctgcgctccatcgacctcagcgacccggcgctctccctcgacctccaggtgacgatcgcgtcgcggaacccgaacgagcgggtgggcgtgtactacaagacgctggacgcgttcaccacgtaccgcgacgaggcggtgacggtccccgtgtcgatgccggcgatctaccagggccacaaggacgtgtcggtgtggtcgccggtcatgcggggcgacgcggtccccgtggcgcagtacgtggcggacgccatgaagcaggacatcgaggcgggatacgtgctgctccacgtcagggtggacggccgcgtcaagtggaaggtcggcagctgggtctcgggcagctaccacctcttcgtcaactgccccgcgctgctcgccaccagcggcagcgctgccgtcgccgcccggcgggcggcgtcttcgccgccagcgccgcggttccggggtcagtccccgccggcgtcaaacacaccgtcgtctccctcaagttcacgcaccc

SEQ ID NO: 16950 - DNA, 911 bp, Zea mays
gtacccttcggggccccggaccgggccgctcttctcttctaccagtagttcattcattattagtacggtaccgggttggagtaattaaaaggccaccctccactcgcaccaccacactttagctccccactgctataggcagcccacatgcgcgcacactcctaagctagctatagcagcaaggcagccagctgagctcagagctcccagtccagcgccggcgccaccaccgcagctgctcgctggtcaccatgagcaaggagaagcaccaccgcgactggatcctccggcgctgctgcggctccatcgccgcctgcatcctgacgctggccgtcgtcgtaggcttcatcgtgctcgtcatctacctggcgctgcgcccctccaagccgtccttctacctgcaggacgtgcagctgcgctccatcgacctcagcgacccggcgctctccctcgacctccaggtgacgatcgcgtcgcggaacccgaacgagcgggtgggcgtgtactacaagacgctggacgcgttcaccacgtaccgcgacgaggcggtgacggtacccgtgtcgatgccggcgatctaccagggccacaaggacgtgtcggtgtggtcgccggtcatgtcgggcgacgcggtccccgtggcgcagtacgtggcggacgccatgaagcaggacatcgaggcgggatacgtgctgctccacgtcagggtggacggccgcgtcaagtggaaggtcggcagctgggtctcgggcagctaccacctcttcgtcaactgccccgcgctgctcgccaccagcggcagcgccggcgccgccgcccgtcggaggcgtcttcgccgtcagcgccgcggtacgaagtagtcccccgtcggcgtcaacaccacgatctccctcaagttcacgcacccggcg

SEQ ID NO: 16951 - DNA, 1282 bp, Zea mays
ctcgaggccggccgggcccttttttaaacacgctcccctcgggccctgcacctcttcttcttctaccagtagttcattcattattagtacggtaccgggttggagtaattaaaaggccacccccgcgcgcccggccgggactttagctcctcccactgctataggcagcccacatgcgcgcgcactcccaagtcccaagtcctaagctagccagctgagctcgctcccagtccaagcgccggcgccaccaccgcagctgctcgctggtcaccatgagcaaggagaagcaccaccgcgactggatcctccggcgctgctgtggctccctcgccgcctgcatcctgacgctggccgccgtcgtcggcttcatcgtgctcgtcatcttcctggcgctgcgcccctccaagccgtccttctacctgcaggacgtgcagctgcgctccatcgacctcagcgacccggcgctctccctcgacctccaggtgacgatcgcgtcgcggaacccgaacgagcgggtgggcgtgtactacaagacgctggacgcgttcaccacgtaccgcgacgaggcggtgacggtacccgtgtcgatgccggcgatctaccagggccacaaggacgtgtcggtgtggtcgccggtcatgtcgggcgacgcggtccccgtggcgcagtacgtggcggacgccatgaagcaggacatcgaggcgggctacgtgctgctccacgtcagggtggacggccgcgtcaagtggaaggtcggcagctgggtctcgggcagctaccacctcttcgtcaactgccccgcgctgctcgccaccagcggcagcgccggcgccgccgccggcggaggcgtcttcgccgccagcgccgcgtccggggtcgtccccgccggcgtcaacaccaccgtctccctcaagttcacgcacccggccggactgcaccgtcgacgtgtgagtcgtcgctgcgctacgacgacgaccggcgcgcgcttcgttcgttcgttttcgttcgtactggctagtgcagtgcgggggatcaacgtcgccccctcgctcgcgcggttatcgagcagttagtttttcttgtagcaaatgttcgttcccatatattttcccttccgaagctgtgcagaaataagttaataagctatacatacatatacatgtgtactagatttgctatatattattaccatatttaatatgaacctcacagtttgaattaaaaaaaaaaaaaaaaaagagggcccatttccagtagtaaaaaaaaaaaaaaaaaagcggcc

SEQ ID NO: 16952 - DNA, 1241 bp, Zea mays
ggaccctcccggatatatatttagtgacccatatagaagcccattagttcagcacagcacatcttcctcgcagcgccggcgctccatcttccgctccctcccccaccttcgatcggcacgcaggctcggcgtcgtcgtcagcggttcctcctcccgcctctcgccagtagcctcgcgccctcgccgactggcgaccctgccttgaaggggctggcaagatgatcggcgtagggaaggcgaagcagtacgccaacgtccttgacaagcccctcagccgtggcaggcaggaggtcagtttgagtgcatttgcattcttgttctctgagttggttcagtacaaccagactcaagttgacaacattactgagctggaacggaggctggaggatgctggttatgctgttggtgcaagggtgcttgaactactctgtcacagggagaagggaaatagacgagagacacgacttctgggcattttatcattcatccacagtactgtttggaaagtgttgtttggaaaggtggctgactcacttgaaaagggaacagaacacgaggatgaatacatgatcagtgaaaaggagcttcttgttaaccgtttcatttctgtgccaaaagacatgggagcattcaactgtggagcttttgttgcgggcattgtaaagggtgtattagataatgccggctttcctgccgtagttactgcacattttgtgccaattgaaggccagcaaaggccaagaacgacaatcctgataaagtttgctgaagaggtattacacagagaagcaagactgggctgagtttttatgtatgtacacaaaacctttgactagcctatttgtaaggtgaatcgttactggagtttggtgatttcttgtatttgagtagttcggtgatttcttgtatttgagttatgtaatagcagtgtgactgagaataaaagttatgtaggtgagatcgcaggtgcttcatcagtcttattgaaatccgaccgaaactgctgtattaatgcttttccttgcattcaccttgtattaaaggaatccttcatcttttgatttttcgaaaaaaaaaaaaaaaaaaactcgtattttctttttagtttttgaagctgttacattgttactacctctatttttctttataagggatacacacatcaaggttcaaacttcaaaatcgttggtggtcttgtggcatcttgaggcattggaccttggtgctgcctttgtttgtcc

SEQ ID NO: 16953 - DNA, 5757 bp, Zea mays
aattcggcacgaggccccttacccagtcaccgtccctcagctgcaaccctcaccctgtagctgccttagagggagggaggaggggaggtcgcgcgccaggagccaacaggggacctcgccggcgcaggggaggaggcaccgtcgccaggagccaagagccagcagccaggaaccagagccgccaccacttctagagctcaatcgatcagcggctcagttgcattggttaatgttagtttattgacaaatatggctgataatggtgatgccaaagggggatctggcgcctatgcaattaatatagagaattttagtaagcggctgaaggtattctatgaccattggaaggagcacaagtctgatctttggggctcgtctgatgctattgcaattgctaccccacctccttctgatgatctccgttatttgaaatcatcagccctggatatttggttacttggatatgaatttccagaaacaataattgttttcatgcacaagcaaatacatgttttaagcagtcagaagaaaggaaatcttattgggaccctcaagaaggctgcaaacgaggctgttggtgttgacattgtgttgcatgtgaaaaccaagaatagtgatggtgctgacttgatggatgacatagtgcatgctgctcgtaatcaatcaaaatcagataagccagttgttggacacatagccaaagaggcacctgagggtaagcttcttgaaacatggataaaaaaattatctggatcaggcctacgactcgttgatgtaacaaacggcttctctgagctctttgctgtgaaggacaccacagagatcacatgtgtgaagaaggctgcttacttaacttcatccgttctgaaaaattttgtgattcctaagttggagaaggttatcgatgaggagaaggaagtctcacactcatcgttgatggatgacgcagagaaggctattctggacccactaaaggtcaaggtgaaattgaagcctgataatgttgatatatgctaccctccagtctttcaaagtgggggtaagtttgatctaaagcctggtgcgtctagcaatgacgagtacctgtattatgattcagcaagtattatcatctgtgcaattggttccaaatacagtagctattgctcaaatgttgctcggacatatcttatcgacgctacccctacacagaataaagcatatgagacccttaggaaagctcatgaagctgctattcaacaagtgaaaccaggcaatcagatgagtgcagtttatcaagctgcagtggctgtgattgagagggatgcacctgaacttcttcctaatctaacaaagtcagctggaactggaataggccttgaattccgagaatctggcttaaatctgaatgccaagaatgatcgtaggataaaaaagggaatggtttttaatgtatcccttggtttgcataacatccaggcagaaacaaccagtgagaagacaaagcagttttcactattattagctgatacagttttagtcaatgaaagaggacatgagatcttaacagcaccctgctccaaggcattcaaagatgttgcttattcgttcaacgaagatgatgatgctgttgctgctgaggttaagataaagtcgaagaccatagatgttatgccaaccaaggcaactctcaggtcagacaaccaggagatgtcgaaggaagagctcaggagacagcaccaggctgaacttgctcgccagaagaatgaagagactgctagaaggcttgctggggttggtactggatctggtgacggacgtggtcctgtccccccccccccccagcttgttgcatataagaatgttaatgatgtaccatttgtaagagatttggtgatccaagtagatcagaagaatgaagctgtcctcttacctatttatggtagtatggttcctttccatgtttctactgtcaagagtgtgacaagtcaccaggacaaccgcacctgcactatccgtatcttcttcaatgtgcctggcatgccattctcaaatgatagcaagtttaattctcaaggtgctatctatctgaaagaaattacattccgctcaaaagatccacggcatagcagtgaagttgttcagcagatcaaaacattgaggaggcaagtggcatcaagggagtcagagagagctgaaagggcaactcttgttacccaggagaaacttcagattggaagcaacagaatgaagatgatgaggctttctgatgtgtggatacgacctgcatttggtggtcgtgggaggaagctcacaggaaatcttgaggctcatttcaatggtttcagatattctacttcaaggtctgatgagcgtgtggacatcatgtttggaaatataaagcatgcctttttccagcctgcagagaaagaaatgattactctccttcacttccatttgcacaaccatatcatggttggaaacaagaagacaaaggatgttcagttctatgttgaagttatggatgttgtacagacgcttgggggcagtagaagatcggcacttgatcctgatgagattgaagaagagcagcgtgagagggataggaagaacagaataaacatggatttccagaactttgtgaacaaggttaacgaccactggtcgcaaccacagttcaaggggcttgacctggagtttgatgtcccccttagagagcttgggttccatggtgtcccatataaagcttctgctttcattattccaacttctacatgtttggttgagctgattgagacccccttccttgtggtgagcctgagcgagatagagattgttaacctggagagggtgggctttgggacaaagaacttcgacatggctatcgtgttcaaggatttcaagaaagacgttctccgcattgactccatcccttcagcatcgcttgacgcgataaaggaatggctggacacaactgacctcaagtactatgagagcaggctgaatctgaactggcgccctatcctgaaaactataatcgatgatcctcagaagttcattgacgatggcggctgggagttcctgaacatggaggcgagtgactcagagactgaggacacagaggaatcagaccaaggctatgtgccttcagacgctgagcccgaatccgagtcagaagatgatgactctgacagtgagtccttggtggaatctgatgatgacgatgaggagtcagacgaggactcagaggaggagaagggcaagacctgggaggagctggagcgtgaggcaagcaacgcggaccgtgagcacggtgcggagtcggacagcgaggaggagaggaggcgccgcaaggcaaagaccttcggcaagtcgcgtgcgccggagcgcagcagcttcaagggagcgccgccctccaagaagccaaagttcaggtgaatgctgccttcggcaattcgctcgtgccaaagtgcagcagcttcaagggagcaccacctccaagaaggcagctctggttaatgggactccttgaagctttggcccccggagtagacgtgtctgtaggagtgtggtttgttatatctagattatctgcagtagcttagtccatctaaatgaaatgtgacagctgaactttggaagtcgcatcattggggaaacgaaatttaagtcgattgatttgttaatgccctcgttgatgtaatatttcccttgttcggtggatttccggtctgtataatatttatgcacgcttgcactttatccatggtatttgtatacccgtataaggcagcatggaggatgtttcttgcatgtggacgcattgattgatatatatatatatttaaggttcttttttttttctttttgttgcatctggttgtcgttgtaacagtgtacagccgcaatttgtttgccactaagggtctgtttactgattaacttgtctcattttacctaacttttctatctaagattagttcttcgatccgaaaaagtaactttatataatatgtggcgtaattaactcactttgcctaacttttcaatctaagattagtttttcgatccgaatgagtaactttatgcaagatatggcgtaattagccatcaaccaaacagtccgtaaaagacttgttcctcgaatgttttggtgatggcatctgcctatgatttgaagcccgctccgctgcgtttacagctgggtgtgagtttcctggccgcatgaagcatgaaaagatgggattcacagcggaactttcgttaggaatttgatggcaatcaagtttagttaaatttaattttcaaggctaggattctatgtgcacagccctgatatgcaccggatatcatcccgaatttatattgttatacatatacgaaaagcagtgaactctgctctgcaatcgtctgcatcgtcgtccttgctctctgttgcggcgacacgcacaggccagagcccgtcgggatggaaggcggcggctccggtgggcgggccgctgccgtcgtccccgcgcgtatgaccaccttgtcccggcactacttcggcggcagcgcgtctgagcgccaccacgacctccgcgtggacatcgtcgaggtacgcgcacgcatccgtgccagccagctcctacctccccactgcacgctcgcgtaggattgaaccactgctctactcatacgctggttgctacgacccgggtccgggcgtttcgccggggcagtcgttgcagcgtctttgaaacatctggcgcgtcaaggcggaagttgccatgctgctgcctgatggaacgccgaggaagtgcttgatagattgccgccaaggcgtttgctacgtcgtggtgcggtgctacatgaagcacgagccagtggtttggattttcgccctcatggctctgctgctgtgctcttgtttcctgattttcttttggttgggtttacattctacatagcacagaacatccaggaggactacggcatgtttgtctggccatgcagtgtcatccttgccgagtatgtgtggcagcacagatcacggttctctgcttccagagttgttgaggtactactcgttctcatatttgtgttcgttcaatttctcatccaccaatcaccaatgtggtacacttgctactgtggccacttgaatatgccagttcaccgaacaaccttcggtcaacaggagtgcttgctcgtgtgtcctaaggccttggtatcattctccatgtccgaggaggccggaaatcatctctttgtggaatcctgcattcctctgcacgcacattattgtttcacaggacaatgctacagttacactcttatctaatttgcatgtatcattttttgcagcttggtgctgggacctcactgccaggattagtagctgcaaaggttggggcagatgtaacactaacagacattgcgcagaatgcagaagtgagttccaatccgtctttggaatccttatcgtttgatcgttgtcagagattttcagtatggttgatttccttcttgtttttactgactgtaggtactgaacaacatcagaagcatatgtgctctcaatgacgccaattgtactgtatggttttgatttcacgtacagagctttacatgttgcatcctattgaattcagagagcttaggattatcccataactgcgcaggtttcgggacttacatggggagactgggatgaatcggtatttgatttacatcctgacattattcttggagctgatgtactttacgactcagcaagtgagctaccattctactata

SEQ ID NO: 16954 - DNA, 869 bp, Zea mays
  misc_feature (2)..(2): n is a, c, g, or t
  misc_feature (869)..(869): n is a, c, g, or t
cncgtgcttcccccccccggctggcccccccccccccccccaactctcaggtcagacaaccaggagatgtcgaaggaagagctcaggagacagcaccaggctgaacttgctcgccagaagaatgaagagactgctagaaggcttgctggggttggtactggatctggtgacggacgtggtcctgcgagggcttcaaatgagcttgttgcatataagaatgttaatgatgtaccatttgtaagagatttggtgatccaagtagatcagaagaatgaagctgtcctcttacctatttatggtagtatggttcctttccatgtttctactgtcaagagtgtgacaagtcaccaggacaaccgcacctgcactatccgtatcttcttcaatgtgcctggcatgccattctcaaatgatagcaagtttaattctcaaggtgctatctatctgaaagaaattacattccgctcaaaagatccacggcatagcagtgaagttgttcagcagatcaaaacattgaggaggcaagtggcatcaagggagtcagagagagcttaaagggcgctttcttgttacccaggagaaacttcagattggaagcaaccgaatgaagatgatgaggctttctgatgtgtggatacgaccctgcatttggcggcccctgggaggaacctcacaggaacatcttgaggctcatttcaatcggtttcagatattctacttcaagggtctgatgaaacgtgtcgcacatcctggtttggaaatataaaagcatgccctttttttccgccctgccagagaacagaaaaggacttactctcctttccctttcccattttggacacaccattattcctgggcttgagaaaacn

SEQ ID NO: 16955 - DNA, 3241 bp, Zea mays
tatgaaatcatacttaatactatatctaactatactcattgtatgttatacatattaatatttcgtataagaaactctagaatttaatctaagataaatccgggagttagttttaaattaaaaaagaattgagtagggagtaacatttagcagtggtacacaccagactcataccacccctcatgcatttctgcaacacatgttagttagttatgtgaatttttactgaatcttcatttgcgtgttcaaatcacaaattcaccatcgaatctcacatgtagtatatagcctgttcagaaaattgttcgtttctcctgacgtatactttccgatacatacaaacttcggaagttagaacacacccggagggccagaacgggacgacggagcggcgtatcccggcaacgccgccgccgccgccgtccgtcacctcttcgccggcagcctgccgtcacctcctctcttgtctgcggtcgtagtcgtcggctccatctgcacaacccgctcgagcacctcgacgacgtccctcatcgccggccgctccttggggttcttgccgaggcaacggtcggcgagcctggccacctcgcgcgcggcggccagcgggtaccgcccgcccagccgcgggtccatgatggcccggaacccggcgccgtccggcgggtgctgccgcacccaccccagcagcttctgctcctccgcggggcggctgcgctccagcgagcgtcgccccgtcaggatctcgtacagcaccacgccgaagctccacacgtcgctcttcaccgtcaggtgccccgtctcgatgtagtccggcgccgcgtacccgtgcgtccccaccaccgcggtggagacatgtgtcttcccttctgttggaccctctcttgcgaggccgaaatcccacagcttcggcttgaattcagcgtccagaaggacgttggatgccttgaaatccctgtagatcacctgaacttctggcactccttcatggaggtaatccaggccccgcgcagcgcccagcacgacctgcagcctcagtctccatgaaagcggagggtgagctcggttgaacaggtggtcgtccaagctcttgttgggcatgaactcgtagaccagcagcctgtgcttgctggcttctgaatccacggcgcagtagcctatcagctttacgaggttcgggtgctcaagaacacccaggaactggacttcagccaaccactgcttgtgcccctgaaaccagatcatttaaaaggaactcatgaactgttacattccttaaaaaaaacaaataagtgtatctagtgaactgctatttgttcctttaacgtaaatataagcactacacttattaaggaacacaggtcagcacttgagatttgcgtggaattctttttcatatacttgcatctaataattataacgatcaggaaactgtctccgtgtccttgtatctaattattggtgtgatcagactaacaggcgtggcgctgatcacaggttgacttatgatgccatctatcttgactaatactcacatggcccagtctctacgattcccattgagactgacatgagtggctgtccttggccagttggttggaccaatattcccattgaagccatccaggcaactattttatgcgtttgagattgtcatggagctcaagctatcctatctattggcttcagtgcaagctaacaatcttctgagttagaatttaggtctcgatccaagccagaagtaactattttagtaagatattggcacccaccaaaaaaataatgattccaagtccacggagtttggccatcttttggacaagaggttgcaaaaaaaaatggagggtgagaaaaatcggaggtgcaaattactctgtaaatctgtaggggttccaccaaattgctggtctgctaactgtgattaagaaccccgatgaatcctcagaaaagggaaaacaaaacaaactttggcgtggcatgagaaatctaagcacaaataatgcagaattgcagagagagagagagaggagatggcaggtagcaagcggacctggaggctgcgctggttgaggcgcttgacggcgagcacgacgcgggcgccggcggcggagcggaagaaggcgcggtagacggagccgaagccgccctcgccgagcttgagcgcgcggctgaagccgttggtggcgctgccgagctcgtcgaggtcgaacacgcggaggcgctgggcgccccgctcctccgacagctcctggatggtgcgcgtgggcgtggccgacgacgccgccgcgggcgccgaggccgccgccgccttggtgttgctctgcgcgccggcgccggcgccggaggaggaggaggacgacgacgtggacgccggggccgacttggccggcggcgtccgggcgcccgggcgcgggtgctgctgcggcctggaggacgtgctgctgctgctgccgctcttgccgccgctcctgaacgcgaagcaccccatcggacgacgagcgctgcagcccggcctggcgagcgaggacttggtggaaggagaagtggcaggcgcgtcgctgtagtgtacccgggtccgggtggggttggaatcggttggggaattgaagagccctctcctcctcggaagcgccgggaggggcaggggaaggaggagggttggaccagacgggaagaaacaagaaagaggccccgcgtgcttgacgaaggcagagccgggcacccggcagctgcaacccggcagctgcaaggaaatgagcacgcacgtggcggcactgctgctggtggattagggcgacggcgacggcagcgcgcgctgtgatgtcgtggagggagagaacggactccacatttctacacactggctgaaaggacggtgggctgcctgagaacttgtgctgcttccgtcccaattccgagacgcgacgcgaaaagtgaagtgaaaaggccacacacgaacgacttgtggaaggcgttctctcaccgtcctgcttgtccctcccagcagaagcaggaatgtccaatccaactatccaagccaatcacacgacacgacgaggtgtgggggttccataccatcatcatggtgccatgctgccgctggccagacgcactccggccggccggcgctcctcccattcaattcaacagacacagagggaccgacagggtcactgtccaccggagacgaccatcgagaagcggtgcgacgaccgacgaccacgactgaaaagcttgcctgaca

SEQ ID NO: 16956 - DNA, 1722 bp, Zea mays
ttgggtacctcctggccggccggcgtaaagttgacgttgacgtgtcgtcctgtcttcctcgtctctcgttactcgcgccgtcgcgcgtggtctccgaacgtctcattcggcagcgaggagaccaaggcggggggacttccgatctggtgtagggtacactggtttggcgcgagaccatggagggatccctggaggcgcggcccggtgtcctactcgtcggcgccccgggcgtcggcaagcggaccatcctctcccagtttcttggagcagaaatacctgacgtgcatgacttatcatccggtgtgctttgtcaggggtggacaattgaaacaaagtattattcagctgatctttccatctggacagcaaatcttggtgaagaattttctcttggttccctccctcatttagaccgggtggctgccctcgttatggtcttcgatatgagtgatgaatccaccttgcttactctgcaaagctgggctgccagtgttgatatccagaggtttgagatcttgttatgcgttggaaataaagcagatcttgtacctgatcatagcgtgcatgtagaatataggaggcgtatgcaaaagcttggggagtcaagttctgatccacaccctgattatttcaattttgggataaatgaaagtgagggttgtagcttgttatctgaggaagaaccatgcatagagatcagaaactcaactgcacagtggtgcattgagcagaacatagaatatattgaggcctgtgcttccaatgctgactttgataagtgtctatcagtggatggtgatagccaaggcttagagcgactccttggagctctttctgcacatatgtggcctggaatgattctgaaatctggaaacagaataactgtcccatccttggttgaaaaacaagaatccacagatgatgaatccaactatgattttgagtacgaggtcttgtctcatggatccgatgaccagtgggaatttattggagagacaagtacatccagaagatttgagagaccaaatgagcctgatggtgcacaggatcacacacatcaagttgtgaatgccggtactgactcttcagcatccaactctcccccgactaacacacccacagaaactgctgaagagaatactgtaactcagagcaacaaaaccgacaatagtgatcatgtggacaaaaccacagcatatagcactgaggatcatcaaagtgatcttcgagaggctaaccatctttttgaggacgagcattatggtctggatgacctggagaaaataatgtcggagattggcaacatgcgatcaaacttaagactcatgcctgacttccaaaggagggagatggctgcaaagctagccatgaaaatggcagccatgtttggtgatgatgatgaagaggcatttgatgatatctaaggcaattcatgtaactccaccttgctgattcccagacagggttgcagatgattgaaaaatggctttgtacaagccgacgagcctcttgccacctagggcctttctcatgataatgtcttcttccttagtgaaaatttttgtggctgttgagcgttctatatgccttgtaagatgtattattatgaactttaactccttcaatcatccaggtggaaattttgtggaccatggtgcaattgagcaaaaaaaaaaaaaaaaagaaccaaagacaaaaaaaaaaaagataacaagtttgcat

SEQ ID NO: 16957 - DNA, 1932 bp, Zea mays
  misc_feature (1804)..(1804): n is a, c, g, or t
gaaaattggttagaatatactacatactgatagaaggccaggcctagtgcagtgttaatatcattgggaggaagacttgtgtctgtttatctcttccccagatcctcttcatgttggagccttcggtattaggtctatccttttttttaatgaagttcgacacactgaagtatgtgaacaatgtctaagttggacactaaaacctgaaaccagggaagctttttgcacaagtttctagtgtgcagatttttcatatgctactcttgaaattatagagaccagaccatctgtgggttccaacatggaaaggaaatgcagagagaaataattcctggatcccagaatagaactacatttctagtacagtcactaaatgcaactgtctgttggtttagcattgctctattaccaaagacaaatggacgacactaaaggtgtcagaggtgtttcaaaatactatgaacattgaaccctcctagataccagctaatgaaatgcttggaaagtgaccctcttgacatcaaaagtagtccctttatgttttggtatgctggccatacgtcgcaaaaacctgctacacaaacactggaatagttgttcgagctcgtgtttttaattaattgcataataataataatatagatacatttggctactgtccactacctgatcatcttatttggcaccaactaccctatattgataaatataaattatcagcatgcatatagctgaagttagtttccaagttccaaccaagaatgccattgaacatcacttgcaaattcaatacttttattgaggagcacaactttctaaggcttataaatagcccaaaaaattctcctcttctgctgtatcagacattcagagtttcagactcacaatatgcacccttccattcagatatacgccgttgtcctctgcatcgtacccagcttcttcagctgcaatgcagaagatgccagaccaccccagacccagagcagcctggttcttggccttagccatgtcagatccctgtacaccccatcactgacactagtgaactccacaggatacgacttcttggacatcgttgagccagtgacagcatacacagacggctacctgctgtccctgaacctcggcacgcccccgcaggtgttccaggtgtacctggacacggggagcgacctcacctgggttccctgtggcagcagcggctaccagtgcacggagtgtggcgggtcctcatccgtgacgccgccgccgaccacgacgttcctgccgtccgagtcctcgtcgaacgcgagggacctctgcgggagccgcttctgcgtggacgtccacagcgccgacaacaggttcgacccgtgcgcggctgcggggtgcgccatcccggccttcaccggcggcctgtgccccaggccctgccctcccttctcctacacgtacggcggcggcgcgctggtcctcggctccctctccagggactcggtgacgctgcacgggagcagcggcgccggcggccctctccccgtggccttccccggcctctgcttcggctgcgtgggcagctccgtcagggagccgatcggcatcgccgggttcggcaggggcgccctgtccctgccgtcccagctcgggttcctgggcaagggcttctcgcactgcttcctcggcttccggttcgcgcggaaccccaacttcaccagcccgctggtgatgggcgacctcgcgctggcgtcgtcggcgacggacggcttcgtcttcaccccgatgctgacgagcgccacgtacccgaacttctactacgtgggcntggagggcgtcgatctaggaggcggcggcgtcgacgcgcagggcaacggcggggtgctggtggacaccgggacgacgtacacgcacctcccggacccgttctacgcgtcggtgctgtcgtccgtcggc

SEQ ID NO: 16958 - DNA, 2134 bp, Zea mays
tcggttttcgttcctggccatttcttttattttttttgcctaaaattcaaaaacttgataaaaaactactccctttgtccaaattccaaaatatagttttttctaactttttttatgtccacattcaaataataatgaatatagatatacatataaactacaattatatgttaattaataaatatatatttagtctaaaataaattatattttaggatagagggagtgtattttttatgagtagtatgatatattccatatttaattttttaaattaatcagaattttctgtaaaaagcaacgaatttcgtccggaaaaagacggtcatttcgaatttctggaccggcttgcaaatttaacatttatttttctcgagaaaaaaaataaatttaccgaaaaaaaacgagaacggacctggaaacacggcttgtcagccgagattatcagtttcaccatttttttgaatttgaaatttaaaacaagtttttttttttttttttcggcaaaaaccggtcaattcctcttttttcgctggtgaccgaaaaatcaaaccaaaacggtttgttctgatcggaccccagatccagattactgctaaataaaaagcatgtgaaggccttcctccccctcccagtcgcccttcaacttgccagccgatcccttcgcgtttgtctccgcggttccgacgctccgcactccgctcccctctcccaagcaaacacagccgagtccacgcacgcctcccatcattcctcaaccgcctcgccggagcaaggggagtagcggaggatggagattgaccaggcggtgcgcgggtgcagcgaccgccgcatgcgcaccaagtacagcaacgccgtctacgtcgtccagcgggccttcgcgctctacccgtaagcttcccctccttcacatcctgagacgggggcgcgcggattgggttagtggcgccatcggaggtgtgtggttccgcgatgatccagtagggagggagttcgagattcagggtgcggggggcgctcgccgtgcgtgcgatcgggccggttctgggtgccgcgcgccggtgttgaacgcccgctgctccgtggtttggattggtgtgccggttgatccggcggagggataggcgcgggttcggatttgtggagggaggcggcgggggatggactgacggtaacatcgagttgtcgcgtactcacgaagtagatctcaaactgattggagctgcagccgatgggttccaacgcgcagcctgtctctatcactgtttgcctgcgcttcctcccctgcagcaacgacatattggtactcgtatatattgggccttgggggtggaggtttgcagttttgcacaattgttgtctccgtgcttgctcaccaaacatttactggggactgctagcagataattgcaaacaattggcctttggcttcggtcataaacttctaatctagatgactagttctggtgggcaggttccagtcggagtcctgaaacagcagaaagtagctacattgcttttttgttgcagttcactcagttttttctgactgttcttaggtcacttccaatgataaaagtgtttaggaattattttagagggcattatgctcttaacagtttttatctagttaccaattaggttaataacaagaggaataataatcagctccatatgcacccttaggaggtatacccatgttgcaagtcaatgatttaatcttaacctgaaactgttatttttgtgtacagtgctcttaaaatattgcatctaattggatctatactatctatgggtaatcgattctgcaatgcaaacagggtacaagttagatgtgctcgaaatattaccataaattttcaaactattactatactttgaacccccccccccccttatcatttctgtcttaacactctaacctcacttgtttcactttacagatttgaggaagttgccttcagctttaatggtgggaaggattcaactgtaaatatctttatgttctctttttctcatcatgttattatatgatcagtgtcaattagtatctttgtaagtttgacatgatgcacatgttatgtattgataggtgctcctgcatttgattcgagctggttactacctttacaag

SEQ ID NO: 16959 - DNA, 2157 bp, Zea mays
tttttttttttttcggcaaaaaccggtcaattcctcttttttcgctggtgaccgaaaaatcaaaccaaaacggtttgttctgatcggaccccagatccagattactgctaaataaaaagcatgtgaaggccttccgccggccgggagtcgcccttcaacttgccagccgatcccttcgcgtttgtctccgcggttccgacgctccgcactccgctcccctctcccaagcaaacacagccgagtccacgcacgcctcccatcattcctcaaccgcctcgccggagcaaggggagtagcggaggatggagattgaccaggcggtgcgcgggtgcagcgaccgccgcatgcgcaccaagtacagcaacgccgtctacgtcgtccagcgggccttcgcgctctacccatttgaggaagttgccttcagctttaatggtgggaaggattcaactgtgctcctgcatttgattcgagctggttactacctttacaagaaggactctggtgatgtagcccaaacagatgctgttaaaaactgtccactgcgtactatctatttcgaaagcccttgtgctttccctgaaatcaattcattcacttatgagattgtctcaacttatgggttacctctggaaaccatccattcagatttcaagtctggtctagaaggccttctgaaggagaagcccaccaaagcaattttcattggcacaagaattggtgatccaaatgcggttggtcaagaacagttctctcctagttcacctggctggcctccttttatgagggtgaatccaatcttggattggtcatacagggatgtttggtcttttctaataacatgtaaggtcaaatactgcagcctttatgatcaagggtatacttccattgggagcatacacgatactgttccaaatgcactccttagtgattcatcatctgagaaaagttttagaccagcatacatgctaactgatggaaggcttgaaagagctggtagaacaaaaaagattaatcctaaagtagaaatgaattctgctgcaagcaatggcatcaacgatactgagggaggacggatgatctcacgggcggcatcaatcattgtagtcggtgatgaaattttgtttggtacaactgaggataacttaggagcagccttgtgcaagaagcttcatgcaattggctggcgggtttctcatgtagcagttgttcgcaatgagattgattctgttgctgaagaagttgaacgttgtaaatctactgatgacatggtgtttatttttggtggactcgggccgctacattcagacgtttctttggctggtgtcgcgaaagcatttggagttcgtctggctcctgatgaagaatttgaagattaccttagtcaactcatgggaaacaattacactggtgaccgaaatgagatggcacagttgccagaaggtattacagaattactgcatcacaaaacgctaccattgcctttgatcaaatgtagaaatgtcattgctcttgctgcaaccaatatggatgaactagacaccgagtgggattgtcttctaggtacccaggagagtggtctaatgccatcaaaaccttttgtgtcaaagcatctcagcactacactttcagatgttcaaattgcttcagtccttgcaaaactgtgcttagagttttctgatgtttacatagggtgtcatcggatatcaagagctggtcctttggttgtgaatcttactggaaaggataaccagagggtagatgcggctgccgagaagctgacaagcagctttgaaggacaattttcccaacttaacagttgcaaataagctgtcagagacacccctctatttttgccaaattctttccgcctgaagctctgagattgtgcaggactgatgatggtgctcaactgctctaaaccgacgaccaaaataaaccacggagctggtactactttgaagctacaaattttatttagggaacataggaattttgtactaggaattggtaactgggttctagcataatgtagctttgcagctaatattttgacataattatacgttccaaattatttcatttatactataatttatagcataactttactgctcaaaaaaaaaaaaaaaaaaaaaagacgcgaggcccggcccggta

SEQ ID NO: 16960 - DNA, 4134 bp, Zea mays
aattcaaattgtgattcatgttgctgaggtacgtgtacgtctaacttgacgtcaatgtggtcatgctcgtgcacatatgtgtttgatttgtcaccaacatgagcatcttgaagtgtttctagaagatatagttgtagacgtttagtctccattatttaatttttaacctttttaaaatatattcttattcctacacacttaaattcatattcatattgtgactcaagtgttgaggtgcttgatgtgacgtgtaagagacatactctctatttttcctagttaatataaatagagggtttttaaaaaaataaatacgctccaacaacttatttaaatggttatcaaatatagatgtcttatattccaggttttctaactagccaaagatagaaagcacaatgactctttacagtataaacaagatatagaatgcttgttggagattggaaagatataaaaagtggttttatttaaataactctccaaactataatttagagagtgaaatttagaagaagaaaaaaacccttggaggtactctaacctggcgctgtgcacaatgtgtttcgtttgttcccggtacacaactcgttggtgcctaaataaatcgcaacatatcatgcgcaatcgctacattccgtgcaaacatttgttgtggagcgtccatctgtatcgcgtggttgtccgttaacgtgagaaaattttgtaaaaaacgctcgcgggtccatactgttttgcatgtaagtggggttaagtgcaaaacagtataggtcgttgggcgttattttttgcaaaattttctcacgttcacgtacatctacacgatatggatgcacacagcacactccatatagcaaacgttttcatggttacaccgaatgaagcgtgtatgcacacgatttgttgcctaaataaatagccagtgttaaaccgcaagatgtagcagtcaatttcatggttaccgaatttacagacaacaacaattcgaacgtgttttatttatactcgtgaaaggaacggatcggaggcgctagcgctagcgtggccggtttcctcggcgcatgccaacggccaaagcgaagcagccagccacacacaaataccgcatgccgttgccgcaattcacgggcgcagcgacctctcgtctcctctccatctagacaccactttcttctctccgcctcaggcggcgcgcgcgcggctagcttcccggcctcccagcaacatcccgccaccacttcctcctcctcctccgctctctccggccgcgcgcgccgacgtttttttttccaacggaggccgccgcgcgctgcctttagtttcggacccatccatccatacatagccaacatcacctatagcaggcggagggacggaggaccgtccgtctcgttcactccgcgccgcgcgtggcccgatccagcccggccctcggatggtcgccgctggcacgtacagcgacgacaccagcggcggcgggtgcgggtccatggagttctggccggagttcctggcctccagcggcgggcgcgagttcgtggccggcggggtgggcggcatggcgggcgtgctggcgggccacccgctcgacacgctccgcatccgcctccagcagccgcccgccgcgggcgcaccacgccgccgcgacgcgcacccctcagccccgcgcctcctacgcggcatcctccgcgccgagggcccctgcgcgctctaccgcggcatggccgcgccgctcgcctccgtcgccttccaggtcagtcggcccttcttccacgtcgccgcgcttctgttccttctcacgcggtcacgccgcgtgcgatccggacgggcgggtcacggatcccagggcctcggacggacgccgtggatcctttcgatacgtcttccttttcccctttgtctccaaggattgcttactttttagtaaaaggcgatcgctttcaaagatgacatttttatttgctccacaaaagcacatgcgctacaccactcgctaccgatcgagtttagccatcgggcgacggcactaccttttcttgccttgtctgtctctttgtgcactcgcgaacacaagcagccagcaagctccagagatagatagctagacgtgtcgaaatggtcatctcattttcggccgagtgggttaccagacgaacagcaggaaatacctgcatctggcagaatcagtgggcagtgtgggcacgacacatgtttgggttgaatctctggcgaaatgctgcggcgctgcaggcgctcacatggcatgcttcggcttcacatggcctcctttcgccgtgctctctcaccagtctgccacgcgcgctatggtggtgtcaattgtcatgtcccatgctagctaacgaaaatgctcgctgttgctgtctgtgtttgcagaacgcgatggtgttccaggtgtatgcggtcctgtcgcggtcgctgggccccgccacctccgagccgccgtcctacgcgagcgtggcgctggccggcgtcagcacgggggcgctgcagacgctgatcctgtccccggtggagctggtcaagatccggctgcagctggaggcggcgtcggggcacggccccgtggagatggtccgtgacatcctccggcgcgagggcctgcccggcgtgtaccgcgggctggcggtgaccgcgctccgcgacgcgccgccgcacggcgtctacttctggacgtacgagcgcgcccgggagcgcctgcacccggggtgccgccgcagcagcagcagccaggaccaagacggggacgagggcctgggcaccatgctcgtggccggcggcctggccggggtcgccagctgggtgtgctgctacccgctggacgtggtcaagtcgcggctccaggcgcagggcgcggcgtcggcgtcggcgcccaggtaccgcggcgtcgtcgactgcttccagaggagcgtccgggaggaaggcctccccgtgctgtggcgcggcctcggcaccgccgtcgcccgcgcgttcgtcgtcaacggcgccatcttctccgcctacgagcttgccctgcgcttcattgccagcggcggcggccccaggctggtcatggaggacaagtgagtcagactggaccgtgttgtacataggctagtataagtatccattccagtggttggtggagagtatccatgccactgccagcgcagtgagctgagattcgtggactggagtagcgtaccgtagctgcaagcttcatacaaatcgaagcatgcgtcttgatgatggcgatcgattcaccctggtaatttggggaaatacactgtgcagtgcattgtgcattacattggtgtgctgctattccatatagtatagtactctgcatgaacatcagtgatcaatcaactgaccaattgacattacagtatgtatggataaaccattcatggtaaacatcagaattctgctagttagttgcttgctctcagagtaagcaagaggctgtggttagtcattaagttttttctcttttagaaaaaaaatcagaaaaaaaagttagttgctttcaatcagcagctacccggctgcatcagtggtcagtggaagatgcaaaatggactagtttttcttgcatcaactgtggacatgaaattttagggcgtttaaatacttgcgcgctgccgtcctgcgccgctattgctggcaagactagccagcggcccgaccaagcaggggtcaatggaaatatttgtctgggaatctcactttgtatgcgtcgtgggcgaagctaaggtgagcaactaagagattagctaaaaagactagtaaaatttactgattagctactctttaaaatagattttagagaaaaagtgtaggctaatccaacagacttggtaaacctacagattgaatagagagtgaaacagactatctaaaattggagagcgaagatggagaaatagagagccactaaattttaagagtcgtttagagagtctattggatacaatttttttaatattagctaaatttacctttacaaaaccatatatctagtcttttggagttgctcttactcgcagtaaatgcaaatgcatacccatagaatgcaaatcctatatatttagttaaaatttcatctctaggaaagagtcgtatgcactcataaag

SEQ ID NO: 16961 - DNA, 1173 bp, Zea mays
  misc_feature (1129)..(1136): n is a, c, g, or t
  misc_feature (1141)..(1141): n is a, c, g, or t
  misc_feature (1166)..(1166): n is a, c, g, or t
cattgggtacccttaggccagtccgcaccgaaggcccgcccaccaccttcgtatccgacggcccaccccgctcgtctatatccgcctctaaaccctagctcttccattcttccccctccggcgccgcctcccccagacacttcgccgccggcaagatgggccgcgtgattcgcgctcagcgcaagggtgcggggtccgtgttcaagtcccatacccatcaccgcaagggccctgcccggttccggtccctcgacttcggcgagcgcaacgggtacctgaagggcgtggtcaccgacgtcatccacgacccgggccgcggcgcgccgctggccaaggtcaccttccgccatccattccggtacaagcaccagaaggagctgttcgtggctgctgagggcatgtacactggccagttcgtttactgcggacgccgtgctacactctccattggcaacgtcctgccgctcagggggatccctgagggtgccgttgtctgcaacgttgagcaccacgtcggggatcgcggtgtcttcgccagggcgtctggggactacgcgatcgttatcagccataacccagacaacggcacatcgaggatcaagctcccctctggtgctaagaagattgtcccaagtagctgccgtgccatgattgggcaggtcgctggtggtggcaggactgagaagccaatgctgaaggctggcaatgcctaccacaagtaccgcgtcaagaggaacagctggcctaaggtgcgtggtgtggccatgaaccctgttgagcatcctcatggaggaggtaaccaccagcacattggtcatgcctccactgtccgccgtgatgctcctcctggccagaaggttggtcttattgccgcaaggagaactggtcgtcttaggggccaagctgctgctactgctgccaaggctgacaaggcctaaatttgcgttacgcagcattagccatcttatatagattaaaaatatttttcctgcatggatcttaattttgtatcattctgatagcgatgaactgatgatactatggaccttccagtttttgttgcaagctattgatgatattttttcttctttaaaaaaaaaaaaaaaaaaaaaaaaaaaaaaaaacaaannnnnnnncccanaaaaaaaaaaaaaaaaaaaaaaaanggtccct

SEQ ID NO: 16962 - DNA, 1055 bp, Zea mays
ctggccgcatccgacggcccggatcgtcgcgtcccttcttttatccccgtcccggtcccccgccggcacgccaccccgcgcacggcatacccaccactcgatccaccacacgagagaaccacttccatggccggcgcctcatcgtgagctcctcgcagcatcgctaccgcgcccttgcgttagctctgtcttcctgtcgcacgtacgttttgtttattccttttcttggagcgggatcggaggttccaaccggcaaaagagagatgatggtagggaagagggagcgggactgcaagaacccgatgcggcggacgacgagcatgacggagttcgcgccgcccgacgcgctcgcggcggtgatggaggacgaggagggcccccagctgtccgacgacagcagccgtgacggcgggcagcaggactggctgtccgcgctcggcggcggcggcggcggcgtcgggggcgccgcggcgcaggaggactggctcgcggcgtaccacgcccgcgcggcgccggcgcgggcggggctccgccggaactcggccgactactccgccgtcgagaccgccgcgttcctgcgcgcctgcgggctctgccggcgccgcctcgggcccggccgagacaccttcatgtacaagggcgaggcggcgttctgcagcctggagtgcagggagcggcacatgacgcaggaggagtggaaggacaagtgcgcggtgacgtcgatcaaggacgctgccgcgggctcggccaaggtcaagggccgccgcgccggctccggcaaggctgggggcacggtggccgcagcatgacgacgatgctgatttgctgaacctacacctagctacctagctaccaccagcttctcctcaactagccagctgcaagctccgattattcacccgtgcaaccatctatatactaaccatgcatcatatatgatatatccccagctagctcaatcgattattaattatttgttatccggatccatcgctcatcgctgcatgcaagccatactgatagatataatactataccattagcttgattccatc

SEQ ID NO: 16963 - DNA, 1303 bp, Zea mays
gattaaagccaagcaaacatgtttttttttaaactttataattttgatacaaatgttgcctttgtttaatataatatcaacaagttataaaattatgacacaaaacagctaattagtacttttttttttttttttaaaataaacttcactcgggatgaattatgacgaacaatgttctgcattcccaatggtttggtcgccagtacagccaccacaagacgccaattaataagacgaacattggagctttatttggagtaggtgccatgtctcactcagccgacgtagtacatggggtcgggcaccttgaaggtgcggtcgccctccggcgcgccgatgaggtcgctccactggtcgcccatgttgcccacgatgcggtacccggcgtccacaagcttctgccgctcgccggacttgtacggcaccaccgacgaacccagggacgacggcttgagcacaagcttatcccaggtgtggtagccggcgctgcggaggttcttgatggtgggctccttctcgtagtcgtgcctgccggtgatgaacaccaccttgatgcccagcgacagcagcgtctcgtatagctgcagcacctccggcagcggcggcgccgtcgcgttcgctacgtactcgtcgaagtaggtggcgttgtacggctcagccccgaatccggtgtcggcgtagtaggggaggttgctgagggtggtgtcgtcgacgtcaaacacccacacctctttcccgtcgccgccgagctcgagcccctctgcgtaggcggcggcctcacgtgccaccaccgcgcagtcctgcctgaacaggtcgccgtacatgtagtcgcggacgtagccccggcactccgcggggatgctgtaccagtcccggatgttgttggtctccaccccgagtcgccagctcgcacacgacggcacggcgcgcgccgtcgcggcggaggtggtcaccatctccaggtgcaagtcgcgcgcgcgcgccgcgctggccgcgtgaaccagcagcagcagcagcacgagcagcgacaccagcccatggcggaggggctcgagcgccatgacgtacaactgttgcttcgttggaactactactagctagataggaacaggaaacgtttgagtgagcgtatcttcaccccaggtctttttttctactggcgtataggttgtgctaatactatgatcctacggataaaagggaattgatggtagcggtgccgcgaggagagggatagatggtggcacgagtgaggaggagaggatgacgttgggaggagagggtgggacgacggagtgggagt

SEQ ID NO: 16964 - DNA, 781 bp, Zea mays
  misc_feature (9)..(9): n is a, c, g, or t
  misc_feature (12)..(12): n is a, c, g, or t
ggtaccctncgnagtctctggccgggcaagcccccgcctccacacggccagacgcacagccgccagagacagacgctgccgccgtcggccgtcctccgccctccagtccgctgctcgcccgaccggagtgaggcggcgcggcgatggagcacgggtcgttgacagactcgacgtcgtcgactttctccatcatggacgaggaccacaccctcgccaactccgccagattcgtcctcaaccaggacccaagggtagcattttgtggatataccatccctcatccttctgagaagaaagtgaacataagacttcagacgacaggagatgcagcaaaggatgtactgaaagatgccttgcagaatctgatgattatgtgccagcatgtcagagggacaatggacaccgcggtggttaaccatagagcaaaaaatgctgcagaagaaatggatgttgatcagaactagaatgaacgcagtgtttgttgagaccaaacacaatatcattacagcttttagtactggtcagaagctcggagagctcagtcattgttccagttgtttgtaggagtaacggtcgtattcattggcttccacttctgcaatactgaaacttcttcagtttactgcataattgcttttagcaacatctatactactgcttatgtctttaaaaaaaaaaattattatgatgacccaaacaatattgaattatggtgaattaaatttttgaaaaagggtatatatagactaagcacatactggaatgggcatattgatgctcc

SEQ ID NO: 16965 - DNA, 3372 bp, Zea mays
aattcggcaccgagggaccacaccactctgcctgcgcttgcccccgccccgccgcgagcccttgcttggagccttggaccttgtccttgactcgccccggcgcgaacgcggccgcgatgcgcgaggaggtgcggagctcggcggcggcggcggcccccgacccgccgcccgggaggtcggcctcgccaccgcccacacccgtcgccagttctgccggtgcctcgtcaccccctgcacaaactaatgtagctagcatagactggctagacagtgaccaagtgtccaaagcaggatcctctcatattgctccgccgacgtctcggcccgcgcttagtactaatgctaatggagctgccatggactgccttcaatcatcatgcagaccatgggaacgaggcgacttgcttcgtcggctggctacttttaagcctttgacttgggcttctaagccgaaggctgctagttcactggcttgtgctcgaagaggctgggtgaacattgacatggacaagattgagtgtgaatcatgtggtgcacatcttatatttactgcattgacatcctggtcccctgctgaagttataagtgctggggaagcttttgctgagcagcttgatgcttcacaccagaataattgtccctggagaggaaatagctgtgctgatagcttggtccagttccacctgaccccgtcagctcttgttggtggttttaaagatcgctgtgatggattgttgcagttcacgtctcttcctgctattgccttatctgcaattgagagtatgaagctcactagaagcgttcaaattgatcgagtcttctcccagtcagtcacagttttgtctggggagctgggctacagaacagacagtacaactggaattgatatcgcccaacaagatgaaacctgctgttactctcaagcacagaagcttattagcgtttgtggatgggagcctagatggcttcctaatgtccaagattgggaagagaattcgacacgctctgccagaaatgcaggctcagctgaaccagatggccaattccattcccaatttcctgagcatcatcaaaattcaaactctgtgtcaattaagaaagacaaggggaaaggtaaaatgcatgtcaaagattctggatgcagcatgaggtcacctttgctggattgcaacctgtgtggagctacagtgagaatctgggacttcagatctgtgccacgcccttctcattttagtctgaataacatcgacatgcctgatacaggaaggaagcctgtgttggtccgcggtattagtgcgacaagtgggatcaatggactggtcactgaaggagcagagagagaaaatgttgagggacgtgatgaggcaggtattgttgagggtaagtctctgtcaaatgctcaagtcgacttaaatctgacaatggcaggaggtttgccgtcaaacaattctgcattgcccccgatgcctggacatcttaactatggtggaatgggaagagatctaattattgggcaacccactggaagtgagcttggtggccgtgcagcctcaattgaatctcggggccctagttcgagaaaacgtaacctggaggaaggtgggagcacagctgacaaaccaataagcaggcttcagcctgctgacagcattgagggaaccgtcattgaccgtgattgtgatgaagttgatgacgccgcacaagattctggtgctaggagcaaaaggtctcgttgttttaatctttttgatattaatcgcccatcttcttcaggagctggtcccagcagaaatttaagttttgacctggatatagatgttaataggttagatacatctaatgctgaggttccatccgcccttcgcaacccatttccaagggactctatgagggcatcttctgttattgcaatggatacagttcacggcatggaagaaaattcaatggagagtgttgaataccatccatgtgatgttgatgatgttaataagccttctagtgcactcaggagtggtgtaatgagtgatatgttggatccgaattatagcaaccaagcacagcaaagcagttttgtacagcctgctgctgaaactgaaagcaatgcaagagagataggagggagtagtatgaatggaggggaagaagtcctcaatgctgaaacaacccctgcatttgctagagatcaacttagcctgggagttagcggggggagtgtcgggatgggtgctagtcatgaagctgaaattcatgggactgatgtttctgagcataaaactggtagcgttgttggagatgctgatccaattcctgagctcatcgagactatgggccacactggtgagtcagctcctggacctgcattgatggatgagtttgtccctgaagaagttggtcgagaaggtcctaatggtgatagccaagatatggcatctcggttagcggttcgtgctgacagtggttctaaaatttgtggttcaactaaagctgattcagttgagagtggagagaagacgagccgtgagaatagcgcacatccttctctttcttgcaatgcaagagttttttctggcattgatgcatcaaaagacgaagtgactggtataatgctaactaatgatgactatgatccaggaagtggtctaggagcaacaaatggaggaaacgattatgaaacaggtcttccagacttcgatccaataaggcaccacaacgattactgtccttgggtgaatggaaatgttgctgctgcatgctgtattagtaccggttcgagcacagctctttcaggctggcagctcacggtagatgccatcgagactctgcagtctcttggtcaggcccaaaatcagacgatgcagtcagactctgcggcttcattatataaggacgatcacgtcccgcctagccggaagctgctgaaaagtgcgaaccacagcaagagctgagctctggagcaagattcttcaatgctcatagaaaagttgtcttgtcgaggccctaacctgagcaggggcgatggcttgcgtttctgtgaaatttggtcttagtgtggtcgtgctgcatttaccggaagagcttagaaaccatggacacgcgtgataagagataattcttaggccgtgatgtgtgcaggtgacatggcttgtcccccgccatcttgcaaaattgtttatgtcaggttgattgtatctatctacatacatgttatgttatttcagtctcctggagtctgtaacatgtaacgtgccatttcgttgatggtttgtcctactgaataatattgacacagacgaccacatttatgtattttgtgcgaaaacttgcaaggccctcaaaaaaaaaaaaaaaagcggccaaaaaaaaaaaaaaaaa

SEQ ID NO: 16966 - DNA, 1113 bp, Zea mays
caagaactgaaactacattgtttggagatagttcatcggaaatccttgatgagcctcagatggtgatgtctgctgaacctttccatgcacctgcttatttgaaccgttgggcttagaattatggatattgctagcactgaagctggaaacattgattcatatagcatcttcacacctacatgccatgcatcttttgcctcctcaaagaacaaagtgatgaaaaggctacattctgctggaaaaatgggagaacagtatgatccatgcactgagaagcattcaactgtatacttcaatctagctgaggttcagaaggcacttcatgttaatacagtcattggaaaatcaaaatgggagacttgcagtgaagctgttaatactcattggggggattgcgaaagatctgtgctgcatatctatcatgaacttatacagtatggcctccgtatatgggtgttcagtggagatacagatgcagtgattccagtgacttcaactagatacagcatcgatgctctcaagcttccaacaataactccatggcatgcttggtacgacgatgacggtgaggtcggtggatggacccaagggtacaggggactcaattttgtgaccgtgaggggagcaggtcacgaagtccctcttcatcgacccaaacaggccctcacgctaatcaaatcgttcttgactgggagcccaatgcctgtgcaatccagcacacacagcaacatgtaatccgtgttgttgcaactgattcacgagatgaatgaacatcccgaagcacccaagtcagccagttgtccaacccggcttgttctgcaacttgctgtagttgtttatgtatcagagctaccggtgccggttaccgcagcagccgtgcttttgtcggccctgttggtgcttgttgcagtaccagttatcccctaaggcaggggacagaaactgcggaatagtttttgtttgcattgacgtgacagcactgtaatcttaaacatcgtaccatagtcctttctatgacaaaggtgtggtttctgatgtctgcaataaatgatctggacttggggggtcaaaatgaaatacttctggggtacagtaaaaaaaaaaaaagcggcc

SEQ ID NO: 16967 - DNA, 1288 bp, Zea mays
gccacggattcattggcattcttactgaagtggcttgaacgctttcctcaatacaaggaacgcgaattttatttgacaggggagagttatgctggtcactatgttcctcaactggctcaagccataaaaaggcaccatgaggctactggtgacaaatcaattaatctaaagggctatatggtagggaatgctctcactgatgatttccatgaccactatggaatatttcaattcatgtggactactggcctgatctctgatcaaacatacaagctgctgaatgttttctgtgactacgagtccttcgtgcattcgtctccacagtgtgataagattatggatattgctagcactgaagctggaaacattgattcatatagcatcttcacacctacatgccatgcatcttttgcctcctcaaagaacaaagtgatgaaaaggctacattctgctggaaaaatgggagaacagtatgatccatgcactgagaagcattcaactgtatacttcaatctagctgaggttcagaaggcacttcatgttaatacagtcattggaaaatcaaaatgggagacttgcagtgaagctgttaatactcattggggagattgcgaaagatctgtgctgcatatctatcatgaacttatacagtatggcctccgtatatgggtgttcagtggagatacagatgcagtgattccagtgacttcaactagatacagcatcgatgctctcaagcttccaacaataactccatggcatgcttggtacgacgatgacggtgaggtcggtggatggacccaagggtacaggggactcaattttgtgaccgtgaggggagcaggtcacgaagtccctcttcatcgacccaaacaggccctcacgctaatcaaatcgttcttgactgggagcccaatgcctgtgcaatccagcacacacagcaacatgtaatccgtgttgttgcaactgattcacgagatgaatgaacatcccgaagcacccaagtcagccagttgtccaacccggcttgttctgcaacttgctgtagttgtttatgtatcagagctaccggtgccggttaccgcagcagccgtgcttttgtcggccctgttggtgcttgttgcagtaccagttatcccctaaggcaggggacagaaactgcggaatagtttttgtttgcattgacgtgacagcactgtaatcttaaacatcgtaccatagtcctttctatgacaaaggtgtggtttctgatgtctgcaaaaaaaaaaaaaaaaaaagggggtgccgc

SEQ ID NO: 16968 - DNA, 3390 bp, Zea mays
  misc_feature (2461)..(2461): n is a, c, g, or t
  misc_feature (2573)..(2573): n is a, c, g, or t
aaagaatctgtttcaaaacaaaggagtatgtagtagctgttgattctatcggtgattgaccatgacgatgcagccgctctacatgatctctgatggaacgggtactttgaaaagagtaatttcaaactaaaaagttaaaagtatatggtaagataatgttaagttgatctctctcgagtaaggcccaacggcctgctcgaacccttgattgtgtccttttgaggacgctaaggctatccgcactcatggaaccctaaatttctactctaaaaggaatatttcatcctggtcggcgagattctctactctatcctataatactccgcgttcatattcaccctaaatatctactttataccaactatcacatattctattatttatttttcacctctctcctatccatacccagctgccagccaacgaggagaggagagagattataaaggttggtgcttacagtcaccagctttgcgagtgcgctagatttagggtcgcagagttggagagagacaatagagtaacgtatagggtgatccactgcagccctccacttcactgtaaaattttagcgcagcctttccagctctccactgcgggcagcctaacggactcctggtcggtgggcccctatcgcacaacccaataaagagaaggtggggaccacgatgcggcgatccgagggcgatttcgtgcgctcctccccttaccggcgagctcgtcggtctggccccgctctggtgaccgctgcggccatcgaagatgcggtggattgcggctcctcatctgtgagcgggacgggtgtgtggaagagggctcccgccggcgagaaggtcccctcccttctcaatttggcaccgcttaggggtcaagttctgggttgtggcgatgaagcggtggcggcgacgcggcagcagacatggtggttccggccctccatccgccttgacggcgcgtgctccggtgccagcgaggggccagtaaagcttggtttgagcgatttgggagcaaccatcctcaacctcgacgacgacgcatctgacctcggtggcagcgatgtctactggtacagtctcttccccttctctggcgcttgctggtttgtagaggagactcgaccccggtggcggcaactgacggcgacgacggaggtggcggcggttgttgaggattggagattcatcctgaagggtcttgtagttcttagtttatctagggttggtaggtttcgtcctagcgggtctagggttaggtttctggctggcttggtgctggttcggccggatctagggtttgccgggggatgccagtcctcagcggcttgcttttcctggcgtcatcggcgaggctgaggtggcgatggtgcagaggaataacatcttccgacctcttcctcgcccctgtgacgttctgctctggcatcaacggagaggttgcggagatcctcttaggagtcttcggctggcggctcatcgtcttgacaggagtcttctggccatttgctcgacgattgtgcgacatttgcgatgtagtggtagtggtttgtgttggaaggtatgtggatctagcgttcccttttgtcgtttacaggcgatgtgctcagatccaagactaagacagagtggggtgcgtccccagccgttgtgttccattggttgtttcaaggccttggcgccatggtgcttgtcttggtatgcggtggccaactatctttggatggcagttcaggaggatgcagagccccatagggtcctctgtgtcagtttggtgtcacctccttgttgtatgcatcggttgtacatctagatgtacgtttttccttacaatctagatgtaaaaaaacacagatcaggagtaaaatggtttttttacctgtcactcatatttgacggaaggacagggaaggaaaaaaacaaaaacaggtctgatagggaacttcagattctggaggtcaatgaagaaagcgacgtttcttttgagggcagaattttcttgaattggaatcggggaaccaataccgtggaatcaacatacacctaaaataggtgtaaaaacatcatttttttctattgttcaatcgattgaaagcattgtaacattcagtcaattcctttatcgactccgcaacgtctaatgggtttagtccaaacccggttttgaccatcaagactgtgtaactgttaacagatctgtggttgtgtgttaatgggttttaacagttttggtttgatttatatgattttgtagtttaaaaatctgtagaattatgtgcttttgtataatatacgttaaaaaattatctcatgtattttctatggaaaaaatatttttgatatttattggtactcattataagactttaacgggtctgtttcatcagttaggttgtctccaacggatggcctattcggccacccatactcaaaatcggtactcaaatctgaaaaacatcctccaacanggtctgtttagttcgtggctagctgtaccacactttgcctaagtttagtcatccaaattgaaaaactaactttaaacaaaaaagttagacaaagtgtgacaagttagacagnaaaccaaacatacccgaaaaaagttagaaaactgatgctaagagcatctccgagagactcctaaatttgggtctaaaaaacaaaatacgagctgatttaaattatttaggacctacaaattcgttgcactcccaacagtaactcctataatcacgttatttggttaattctagtctttctgtcgtttttggcggcaacgtcctctcattttccgctgggcagcagtcggctcttcctgattatttgccaagcttgatgtccgacaaaataaagaattaaatgataagtatacatcagcatcttggcatttgctcctccttattatttgtcaagcttgttgtctgacaaaataaaggattaaatgtcaaatatatgtgctcatcagcatcttggcatttgctctcatgtgacaagccaacttcagtaatagcagcatatagaataagccttcacttatcttgccctcttgtaaaacatgttccaaagaaatccttcttttctactgacgaagaaagagtgatacacgaaacgtccatgctgcacagagtggtgggtgggaaccggaaggaaggcgcttcgtcggggagcgctggatgtggagtaggcgacatatctccactagtgactataaatataacatgatcggcctccttgagaggtacgaagcttccataattctttcatgataatcagagccacttcttccatataaatctagtttcgttagaattgtttgatggcgggcttctctacttcgtcgacgatgctgccggcgcttggacctctggtttcagagaaacttacgagggatacttcc

SEQ ID NO: 16969 - DNA, 1632 bp, Zea mays
cattggggacctcgaggccggccgggaacaaaaaaccctagaactccaaaccttcagccccacgctatggccctcgcactgcgcctccgtcgggtcctcgcggcggcctccaccgcggcacccctgctccgcccgtccacctcggtcgcccggccttgcccgctcgttcccctcgcctccccggtcgcgccgctcccgctgccgccgtggcgattcctgcccggcggcggcgccgggttcaggtccacggcggcggcggctgcgcggggcgggaccgactatgggacggacgacagcaagatctcccccgacgagatcctcttcgagggctgcgactacaaccactggctcatcaccatggacttcccggaccccaagccgtcgcgcgaagagatgatcgagacatacctccagactctcgccaaggtcgtcgggagttatgaggaggccaagaagaggatgtatgcttttagtacgacgacttatgttggttttcaggctgtaatgaccgaggaaatgtcagaaaaatttcgcggtttgcctggagtagttttcattttgcctgattcatatctatatccagaaacaaaggagtacggaggagacaaatatgacaatggtgtcatcactccaagaccaccacctgttcattatagcagaccatcaagaactgacaggaaccgtaactaccgaggaaactaccaggatggccctccacagcaaggaaattaccagaacaaccgtcctccaccagaaggtggttaccagaacaacccgccgcagcaaggaaactaccagacataccgctcgcagcaagatggaagaggctatgccccacagcagaattatgcacaaggtggtcaggatggtagaggttttggaaggaatgattacacagaccgttcaggctacaatggaccacctgattttcgaagtcaaactcagtaccaagggcatgtaaatccagctgggcaaggtcaaggttacaacaacccccaagagcgtagcaacttctcgcaagggcagggaggaggttttaggcctggtggtccttcagcacctgggtcttatggccaaccatcagcacctggatcttatggtcaacctaatacacttggtaactatgggcaggtacctccatcagtgaatcctggtggtaacagagttcctggtgtgaatcctagttatggtggggatggcagacagggggctggaccagcatatggtggagataactggcaaagaggttctggtcagtatcctagcccaggtgaaggacaaggaaactggcagggaaggcagtaagagctgacgtgttccactgaagacaagaatggcacttgagatttagaaatctccatctgtaaaataaacgactgtgatgcattactcttttttttttcttgcatttgaactctaaacttatgggcatgcgttattaccaaacctacggatgcaaattcattttagttttttgggccaaatgttggcatttttaaatggcgcagaatgtggaactcccctttgtcttcgtgtattgtttgcaggtatgctgtcactgtaaaacacgtgctaattactatagtattttggtgtagtttctcgttttgtctcaaaaaaaaacccaataaa

SEQ ID NO: 16970 - DNA, 1948 bp, Zea mays
cattgggtacctcgaggccggccgggacgccatcgtaagcctaaaccctactggccccccgcactgggcaccgcccggccaaaaacaaaaaaaccctagaactccaaaaccttcagccccacgctatggccctcgcactgcgcctccgtcgggtcctcgcggcggcctccaccgcggcacccctgctccgcccgtccacctcggtcgcccggccttgcccgctcgttcccctcgcctccccggtcgcgccgctcccgctgccgccgtggcgattcctgcccggcggcggcgccgggttcaggtccacggcggcggcggctgcgcggggcgggaccgactatgggacggacgacagcaagatctcccccgacgagatcctcttcgagggctgcgactacaaccactggctcatcaccatggacttcccggaccccaagccgtcgcgcgaagagatgatcgagacatacctccagactctcgccaaggtcgtcgggagttatgaggaggccaagaagaggatgtatgcttttagtacgacgacttatgttggttttcaggctgtaatgaccgaggaaatgtcagaaaaatttcgcggtttgcctggagtagttttcattttgcctgattcatatctatatccagaaacaaaggagtacggaggagacaaatatgacaatggtgtcatcactccaagaccaccacctgttcattatagcagaccatcaagaactgacaggaaccgtaactaccgaggaaactaccaggatggccctccacagcaaggaaattaccagaacaaccgtcctccaccagaaggtggttaccagaacaacccgccgcagcaaggaaactaccagacataccgctcgcagcaagatggaagaggctatgccccacagcagaattatgcacaaggtggtcaggatggtagaggtttggaaggaatgattacacagaccgttcaggctacaatggaccacctgattttcgaagtcaaactcagtaccaagggcatgtaaatccagctgggcaaggtcaaggttacaacaacccccaagagcgtagcaacttctcgcaagggcagggaggaggttttaggcctggtggtccttcagcacctgggtcttatggccaaccatcagcacctggatcttatggtcaacctaatacacttggtaactatgggcaggtacctccatcagtgaatcctggtggtaacagagttcctggtgtgaatcctagttatggtggggatggcagacagggggctggaccagcatatggtggagataactggcaaagaggttctggtcagtatcctagcccaggtgaaggacaaggaaactggcaggtatgagagcatttgatatacacatttcacttttaaaatgccgttactgtttgaattgaaatacagcagtttaaagttaaaccgggacatcctttgtttgaccagttctagattgaattcgtaaactgtgtgccgagtttcagatgtacgactacagtttttctccctgttaaatgttttttagatttatgagctaatttgttcattttttaattcccacaccactctatttgtttaaattggattcagtagaggactacaatagaggtgcaggaatacatcagagctagttttaagaaaacgtgcttataactgattccatagcaacctttcttaagtggaacatgctcatattaaggccctatatacagccacatcagtttggcatttacatgtccacattggtagataggatcatagtaatcggaataacattgatcagatccaaagtaatgtaatgtgtgattaagacacaaagcagtaatgacaatttcgtaagcagtggagccaataaaattctagaccaactataggttgtttataaacatagaggactcttaacagaccaggctcttgaggaccttacaatgtacctga

SEQ ID NO: 16971 - DNA, 487 bp, Zea mays
aacaaaaaaaccctagaactccaaaaccttcagccccacgctatggccctcgcactgcgcctccgtcgggtcctcgcggcggcctccaccgcgggcacccctgctccgcccgtccacctcggtcgcccggccttgcccgctcgttcccctcgcctccccggcggcggctgcgcggggcgggaccgactatgggacggacgacagcaagatctcccccgacgagatcctcttcgagggctgcgactacaaccactggctcatcaccatggacttcccggaccccaagccgtcgcgcgaagagatgatcgagacatacctccagactctcgccaaggtcgtcgggagttatgaggaggccaagaagaggatgtatgcttttagtacgacgacttatgttggttttcaggctgtaatgaccgaggaaatgtcagaaaaatttcgcggtttgcctggagtagttttcattttgcctgattcatatctatat

SEQ ID NO: 16972 - DNA, 1624 bp, Zea mays
cattgggtacctcgagggccggccgggattctattctgttcgggcacctcgaggccgattcctactccgagtcgccacctgcatttgtctatcggtcaggagcatggaggggagacggctttcacgccagcagttgcgctcgctaccggacgccgcgtccttctcgccggaagtcgcggccagcccggggctcgtcggctccggccagttgggtctcggtctctcggcggcgttcgagactctgccgccgattttggtagaagtgaatggctttacaaggacactgattttgaataggccaaagcagttaaatgcactctcctcgaccatgattatgggactcttgaggtgtttcactgcttatgagaaagacgatggagttaaattgttgattatgaagggtaaaggaagagcattttgtgctggaggtgatgttgctgcagttgttcgatctatacataaagacagctggaaatatggtgctgatttcttccgaaatgaatttttgttgaattacataattgcaacttataccaaacctcaggtttctcttcttagtggaatcgtcatgggtggaggtgctggcgtttctttacatggaaggtttagagttgccaccgataacacggtttttgcaatgccagaaacagctctgggtctctttccagatataggggcctcatattttctgtctcggcttcctggattctatggagagtatgttggtcttgctggtgccagattggatggtggggaaatgcttgcatgtggtctggcaactcattttgtccagtcaaatagtctgctatcgctggaagaatcacttaaaaaggtggatacttccaatgcttttgcagtgtgtggtatcatcgatcaatttgctcaacaaccatcactgaaagaaagcagctctttgaataggttggaaatcatcaacaaatgcttttccaaaaggacagtcgaagaaattatatccgctcttgaagtagaggcctcaaattcggcagatgaatgggttgctacaacaatccagtccttgaagaaggcttctcctaccagtctgaaaatctctctgagatcgataagagaagggaggacacaaactgttggggagtgcttgcagcgggaatatagaatggtctgccatgtcatgcgtggtgacttcagcagagacttctttgagggatgcagggctatattgctagataaagatcgaaacccaaagtggatgcctccaaggttggaacaagtgcatgatgaggctgttgaacagtatttctccagaattgatgatccacagtgggaagacttgaacctacctgctagacgctcccacggaagaaatatcgagtccaagctttgatcgaaggtcatgggagaaaggtggaactctggaacggagcctcggtagtggtcagaataacacattattgcacatcatctcaagtttgaagagtctgcagactattgataaaataaaaacatgaatgtgccatataggtcaacttgtatcacagaaagaaactctttgctgtttatacgtggagactggagtcatatgcatttttaaataattataagtaataaaatcgaaaaagaaatcgttggaaaaaaaaaaaaaaaa

SEQ ID NO: 16973 - DNA, 1024 bp, Zea mays
ccgggatgtattatgttcctatgcagcagaacgcacatcaggcatatggcgtgcctcctggtgcacaagtcactttgccacctccgacccttgttgataccacgccaaagccaaccgtgccaattcctcagatggcagtaaggcctgaattgcaacaacctggtgtctaccgaacaacagctgcggctacccctgctccagcgcctaatgcagcacctggatatgctgggatggcctaccaccatgtcatccaatcccaccaccaccaccaccctgcgccgcagcctgtagcaaacatggctggcaactacgggtatgagtttgctgatcctacgcgcccgcaagtctactactcacaggcagctgcacctccaacattgccacagtatccgcccattgtctctcctgatgctggccaggctgaaaaacattaagcagactgagcattggtgaattcagagtgaagatgttgctattaggcaactgtgcatttgcattgggatcaaaacaagcatgcatcatccaaggataggttcaacataaggtttttattggatggttcttgtgttggtgagagacagaagggtgccggattagtttgggggagtgaagtgttggatccctgttccaaattggtctctttttttttccctttcttcttattttgaataaaatatagtgtccaaaagaacctggtggtaacgaagaactcatcatcatcatcatcatttgtgtagccctctgtatatttgatctcatggatgtcattcaggttgaggtgcagataagtgtgttattagcttgcttgtagaaaccttatgcgagttaaatatatatatacatcggtcccgtattgtacttcgaaaaaaaaaaaaaaaaaaaaaacaacaaaccaaaaaaaaaaaaaaaaaaaaaaaaaaaaaaaaaaaaaaaaaaaaaaaaaaaaaatggcgggggtggcaccccatggcaaaaaaacgggggggttgggctccattaccaaaaaaaggaattggccccaacg

SEQ ID NO: 16974 - DNA, 1562 bp, Zea mays
tgttgacatgaccatttttacgtacataatgttagacttcgattatccactacctgagacactgcttgagttaggatctcgcccacgcgtcccgccggttgttgatcccaccaatagagccgtgtactataatgatagatctcctccggctgaattgaagcgagacatgccggtgggaactgaagctgccagctaccgcctccccgtttcagctccggacgctgctgcggcagctgcagccaccgccgcgacacaggcccctcctggatatgtgcttgcccagatgcatgcgcctccgccaccgcagcaacctccaccacagcagcaaccacaacagccagctcctcagcagattgttgctgctgggaatcaacatttcatccacaaccctgccactggcacctttattccaatccaatcctattaccaccatcctgtccatcagcaggcaccccagaccatgcaaaggcagcaacaggcacctacgttcgacccaaatacagggatgtattatgttcctatgcagcagaacgcacatcaggcatatggcgtgcctcctggtgcacaagtcactttgccacctccgacccttgttgacacaacgccaaagccaaccgtgccaattcctcagatggcagtaaggcctgaattgcaacaacctggtgtctaccgaacaacagctgcggctacccctgctccagcgcctaatgcagcacctggatatgctgggatggcctaccaccatgtcatccaatcccaccaccaccaccaccctgcgccgcagcctgtagcaaacatggctggcaactacgggtatgagtttgctgatcctacgcgcccgcaagtctactactcacaggcagctgcacctccaacattgccacagtatccgcccattgtctctcctgatgctggccaggctgaaaaacattaagcagactgaggattggtgaattcaggtatgcctcaaattctagaggccttgttatccgtctgttacttatcattatcgttgctaccgcatgttacatgaatccgcggcaaagagtgaagatgttgctattaggcaactgtgcatttgcattgggatcaaaacaagcatgcatcatccaaggataggttcaacataaggtttttattggatggttcttgtgttggtgagacagaagggtgccggattagtttgggggagtgaagtgttggatccctgttccaaattggtcttttttttttccctttcttcttattttgaataaaatatagtgtccaaaagaacctggtggtaacgaagaactcatcatcatcatcatcattttgtgtagccctctgtatatttgatctcatggatgtcattcaggttgaggtgcagataagtgtgttattagcttgcttgtagaaaccttatgcgagttaaatatatatatacatcggtcccgtattgtactttgatattgatgttggtatgtttctttttgttgaatacattgacttcgatttttcttgctgctttagtcgttctggttccgtctacctcccaaatttcatcgcagcacacatagcat

SEQ ID NO: 16975 - DNA, 782 bp, Zea mays
  misc_feature (21)..(21): n is a, c, g, or t
  misc_feature (30)..(30): n is a, c, g, or t
  misc_feature (82)..(82): n is a, c, g, or t
  misc_feature (103)..(103): n is a, c, g, or t
cagtcactttgccacctccgncccttgttngataccacgccaaagccaaccgtgccaattcctcagatggcagtaaggcctngattgcaacaacctggtgtcntaccgaacaacagccccggcgtcccctgttccagcgcctaatgcagcacctggatatgctgggatggcctaccaccatgtcatccaatcccaccaccaccaccctgcgccgcagcctgtagcaaacatggctggcaactacgggtatgagtttgctgatcctacgcgcccgcaagtctactactcacaggcagctgcacctccaacattgccacagtatccgcccattgtctctcctgatgctggccaggctgaaaaacattaagcagaccgaggattggtgaattcagggtgaagatgttgctattaggcaaccgtgcatttgcactgggatcaaaacaagcatgcatcatccaaggataggttcagcataaggtttttattggatggttcttgtgttggtgagacagaagggtgccggattagttggggggagtgaagtgttgggtccctgttccaaatgggtctttttttctttcctttcttattttgaataaaatatagtgtccaaaagaacctggtggaaacgaagaactcatcatcatttgtgtagccctctgtatatttgatctcatggatgtcattcaggttgaggtgcagataagtgtgttattagcttgcttgtagaaaccttatgcgagttaaatatatatatacatcggtccctgtattgtactttg

SEQ ID NO: 16976 - DNA, 1376 bp, Zea mays
cattgggtacctcgaggccggccgggcagtaggccccccgccgcgggaccgctccccttctcctcccttctgaacagcttttccgcccgtctccactgttcactctccagttgcgacttgcgagtcttcctgcaactagcgcgcacaccgaattgttggcaagagagaaacccttcctcgtcccgttcaaccggcgccgccgactcgcgtgttcctccccgcgtcctcgttctccttgctgctggacccgctagtggggatcgacctgatttctcctgtgctgtcaattggatattacccaggctttcaaggtagaaaagaagctttttgttccatcatggccttatcaactccagcgtctattttggttgacgagaaccaacagataaatagaggtaagagggccgatggaccaagggccaaagggctgaagccatccgagaatcctggcaatcaagggaggagagctcttaaggatttgtccaacttctctaaaggcactggtttgaaggacacttccaccctgaaagagaagtcccagcagaagcctcgtagtaatgtggccaacactattaaaggcaatgctttgaaggacaagcccatcctgaaagagaagtccacccaggaacagaggtcaaaagctcttaagaacccaatgaaaattttagttgatgaagagatcaaaatgtgccatgagtgggctaaggatggggtggagggatttcactcaacacaaaataattctcaaaagttggataaggatctgctagacaaacgtgtcaagaagaaagtggcggcagtaaactcagccttgtgtggttggccagatacagtatttgattctctaatgtatccatctatggaggttgctgagcttttttatgaacaaaacgtgctggaggtggaacctgagattctcccggacatcagttggcgtctctctagttcagtagatggtaaagcaaagattgatgaagaccgtcttaccgatgctgagcttgaccagtaccattctttggagaacaatccaattatttttgagctgagagacgagccagcgatcccgcagctgggagtgtattgaagaatctgtgccagcaggacagaaagctctgtttgcttgctgcttgctctggagtctggagttgtctagtctagaattctagtaggtcttgaacctggtgttttccccagctatgttctagtgggatgttggtgatgtaggatttcagtttgagtactggtaccagttccagctgaagcgacagccttatggctgctgatgggtgatggttgtggaacaacgggcgatataattctaatattttcagcaaaataaaaaaaaaaaaaaaaaaaaaaaaaaaactcgctcgtgc

SEQ ID NO: 16977 - DNA, 456 bp, Zea mays
gaagaatttgacgatgcagggcacagcgggagtgccaaggatctaatgcaggactacttcattggggaggtggacttggacccaactcctgacattcctgagatggaggttttcaggaaggagcaggacacgggatttgccagcaagcttaaggacaacgtggtgcagtactgggcaatcccagcagctgtaattgggatatcagctgttgttgctatattgtatgcgcgaaggaagtgaaagttaatgtgccatgcttgggcagatgatccttttaggctttgttcgtctcaatccccatgggtttgataaaaacgaacagggcattagagggatcaacccatggtgcatggatgggtatatgtactcctgtcccaaattacactatgatgttcgattcttagacacacttagggcaaacatttgcctgattaatgacactattttatcgatatg

SEQ ID NO: 16978 - DNA, 2295 bp, Zea mays
cttccgccaacccttccgcgaaccctcgcccccgcccgcgcaggagctgcactgcacgctcctcaaattcccacgccgcatcgccacccagtgccctgctcaccgccgaacggtttcaatggccgcaagcacagcggcgccatgctacgacgcgcccgagggcgtggacgtccgcgggcggtacgaccgggagttcgcgggcatcctcacccgcgacgcgctggacttcgtggccggcctgcagcgcgagttccgcgccgccgtccgctacgccatggagcagcggcgggaggcccagcgccggtacgacgccggcgagctgccgcggttcgacccggccacgacgctcgtgcgcgagggggactggacgtgcgcgcccgtgccgccggccgtcgcggaccgcaccgtggagatcacgggccccgccgagccgcggaagatggtcatcaacgcgctcaactccggcgccaaggtcttcatggctggcaagcgcgcgcgcaaacgtggctgccgtattctctctctctctctctctctctctctctctctctctttttcccgttctgagctgagaccgcgagagagagaaaaacgtggcaggctgacttcgaggacgcgctgtcgccgacgtgggagaacctgatgcacgggcaggtgaacctgcgggacgccgtggctggcaccatcagcttccgcgacgcggcgcgcgggcggacgtacgagctcaacgaccgaaccgccaagctcttcgtccggccccgcggctggcacctccccgaggcacacatcctcatcgacggcgagccggccattggctgcctcgtcgacttcggcctctacttcttccacaaccacgctgccttccgcgcaggccagggcgccggcttcgggccgttcttttacctgcccaagatggagcactccagggaagcgaggatatggaacggggtgttccagagagcggagaaagctgctgggatcgagctcgggagcatccgggcaacggtgctggtggagacgttgccagcggtgttccaaatgaacgagatcctgcacgagctgcgcgagcactcggcggggctcaactgcggccgctgggactacatcttcagctacgtcaagacgttccgcgcccacccggaccgcctcctccccgaccgcgccctcgtcggcatggcccagcacttcatgcgctcctactcccacctcctcatccacacctgccaccgtcgcggagtccacgccatgggcggcatggcggctcagatcccgatcaaggacgatgcggcggcgaacgaggcggcactggagctggtgcgcaaggacaagctgagggaggtgcgcgcgggccacgacggcacgtgggcggcgcacccggggctcatcccggcgatacgggaggtcttcgagggccacctcggcgggaggccgaaccagatcggcgacgccgcagggcacgagggtgccagcgtgaaggaggaggacctcatccagccgccgcggggcgcgcgcactgtggacggtctgcggctcaacgtccgcgtgggcgtgcagtacctcgcggcgtggctggccggctccggctccgtcccgctgtacaacctgatggaggacgcggctacggcggagatcagccgcgtccagaactggcagtggctgcgccacggagcggcgctggacgccggcggcgtggaggtgcgcgcgacgccagagctactcgcacgcgtcgtcgaggaggagatggcgagggtcgaggctgaggtcggccccgacaggttccgaaaggggcggtacgcggaggcgggcaggatcttcagccggcagtgcaccgcgccggagctggacgacttcctcacgctggacgcgtacaacctcatcgtggcgcaccatccaggtgcgtcaccgtgcaagctctgaatacatgcatgccttttgtggcagtggagtcagctttcaaaaataacacatcgctgtccaatgcagccatcgaaataaggacggatgaccaacaaacatgatagacatgaacagccttgtaaagcgcactgcatattctctgctctgggacttttagtcgtgcttatgatagtacagggtggtctatgtaataaactgagcttctgttgaactctcgggaaggacaactgcacaaccctgtatgagtgtaccgagactatcttttcaccctcagaactaccgctctacaacgtgtatctttctaattttataaatcaaacttatttaactttaaaaaaaaaaaaaaaaaaaaaaaaaaaaaaaaaaaaaaaaaaaaaa

SEQ ID NO: 16979 - DNA, 2011 bp, Zea mays
gccggccgggtcgggacgcgcacttcgagttgtacaggagctgcactgcacgctcctcaaattcccacgccgcatcgccacccagtggccctgctcaccgccgaacggtttcaatggccgcaagcaccgcggcgccatgctacgacgcgcccgagggcgtggacgtccgcgggcggtacgaccgggagttcgcgggcatcctcacccgcgacgcgctggacttcgtggccggcctgcagcgcgagttccgcgccgccgtccgctacgccatggagcagcggcgggaggcccagcgccggtacgacgccggcgagctgccgcggttcgacccggccacgacgctcgtgcgcgagggggactggacgtgcgcgcccgtgccgccggccgtcgccgaccgcaccgtggagatcacgggccccgccgagccgcggaagatggtcatcaacgcgctcaactccggcgccaaggtcttcatggctgacttcgaggacgcgctgtcgccgacgtgggagaacctgatgcacgggcaggtgaacctgcgggacgccgtggctggcaccatcagcttccgcgacgcggcgcgcgggcggacgtacgagctcaacgaccgaaccgccaagctcttcgtccggccccgcggctggcacctccccgaggcgcacatcctcatcgacggcgagccggccattggctgcctcgtcgacttcggcctctacttcttccacaaccacgctgccttccgcgcaggccagggcgccggcttcgggccgttcttttacctgcccaagatggagcactccagggaagcgaggatatggaacggggtgttccagagagcggagaaagctgctgggatcgagctcgggagcatccgggcaacggtgctggtggagacgttgccagcggtgttccaaatgaacgagatcctgcacgagctgcgcgagcactcggcggggctcaactgcggccgctgggactacatcttcagctacgtcaagacgttccgcgcccacccggaccgcctcctccccgaccgcgccctcgtcggcatggcccagcacttcatgcgctcctactcccacctcctcatccacacctgccaccgtcgcggagtccacgccatgggcggcatggcggctcagatcccgatcaaggacgatgcggcggcgaacgaggcggcactggagctggtgcgcaaggacaagctgagggaggtgcgcgcgggccacgacggcacgtgggcggcgcacccggggctcatcccggcgatacgggaggtcttcgagggccacctcggcgggaggccgaaccagatcggcgacgccgcagggcacgagggcgccagcgtcaaggaggaggacctcatccagccgccgcggggcgcgcgcacggtggacggtctgcggctcaacgtccgcgtgggcgtgcagtacctcgcggcgtggctggccggctccggctccgtcccgctgtacaacctgatggaggacgcggctacggcggagatcagccgcgtccagaactggcagtggctgcgccacggagcggcgctggacgccggcggcgtggaggtgcgcgcgacgccagagctactcgcacgcgtcgtcgaggaggagatggcgagggtcgaggcagaggtcggccccgacaggttccgaaaggggcggtacgcggaggcgggcaggatcttcagccggcagtgcactgcgccggagctggacgacttcctcacgctggacgcgtacaacctcatcgtggcgcaccatccaggtgcgtcaccgtgcaagctctgaatacatgcatgccttttgtcggcagtggagtcagctttcaaaaataacacatcgctgtccaatgcagccatcgaaataaggacggatgaccaacaaacatgatagacacgaacagccttgtaatttgtaaagcacactgcattttctctgctctgggggcttttagtcgtgcttatgatagtacagggtggtctatgtaataaactgagcttctgttg

SEQ ID NO: 16980 - DNA, 3136 bp, Zea mays
ggccgcgggaattcgattgtcacagaacagttggctgctcacaatggggacactttcaatgtccgacgccagccctatccctgccaagaactgggatgcttcccctgtcaagctcgaggctcaaggtggtgacgccatcctcggcatgaaggaggaagagcgactactggagctcgtgaaggatgagcaggctgatggaatcttggattcattaccaattgacctggaggccaagaatggcgatgcatcactcataactgaagccatgaaaaaggaggaggagcagcttgaagacacccggatcaaggtgcaggaagaagaggaagccaggaagagggaagaggctgctagacttgcttttgatcctgagacacagtataacaagttagatgagctgctgacaaagacacaactcttttcggagtttctacttgagaacatggatcggattgccgatgaaagtgttgaaactcaagctgaacagccacaggtagaagagaagaagaaagggcgcggccggaagaggaaagcaaagccacagtacaatgataagaaggctaagacggcagtggctgccatgctcacaagatctcgcgaagaacgtcttgcggaagattctactctctcagaagaagaaaggtgggaaaaggagcaggctaatcttgtgccgttattgactggtggaaagttgaagtcatatcagataaagggtgtcaagtggcttatatcattgtggcagaatgggctgaatggaatactggctgatcaaatgggccttgggaaaaccatccagacaattggatttcttgctcatctgaaagggaaaggcatgcatggtccatacttaataatcgctcctctgtccactctctcaaactgggtgaatgaaatctcaaggtttactccatctctggttagtatcatataccatggaggtaaggctgcccgggcagagatccgaaggaaatttatgcccacaaatgttggccctgattttccgatagtagtgacttcatatgagatggccatgtttgatgctaaatttcttgctgcctataagtggaagtatgttgttgtggatgaggggcatcgtctgaaaaatgctaagtgtctattattgaagcagctgaagcgcataccaatggataataagctccttttgactggaacacccttgcagaataatcttgcagagctctggtcactattgaacttcattttgcctgatatattctcgtcacatcaagagtttgagtcatggtttgatttttctggtggaaatgaagaaactgatgagaagaaaaggctgcatgttgtttcaaagcttcacgctatcttgcgtccattccttctaaggcgtatgaaggaggatgtggaacagatgcttccacgaaagaaagagataatcatatatgccaacatgactgagcaacagaagcaaatccagcatcacctgatcgaaaaaacatttgacaactacttgcacgaggaatcagatattatattgaaaagacctggcattagggcaaggttgcataatctaatgattcagctgaggaagaattgcaaccatcctgatcttttggaatctccagttgattcaactggtttatatccacctgttgagaagctcctggaacagtgtggtaaattccaactttttgacaggttgctaaatttcctgatggcgcaaaagcacaaggttcttgtattctcgcagtggacaaaggtgctggacattattgaatattaccttgattcaaaaggccatgctgtttgccgaatcgatggtaatgtgaaactggaagaaaggaggaggcagatagcagaattcaatgacgtgaatagcagcatgcgtatcttcctcctgagcacaagggctggtgggcttggcatcaaccttactgctgctgacacctgtatcctctacgacagcgactggaaccctcagatggatttgcaggccatggaccgatgccaccggatcggccaaacacgcccagtgcatgtgtataggctggctacgtcacactccgttgaggggcggatgatcaagagagcctttgggaagctgaagctggagcacgtggtgatcggcaagggacagttcgagcaagacagagctaagccgagcgccttagatgaaggtgagctgctggcgcttctcaaggacgagcagaccgaggaggacaggatcgtccagaccgacatcagcaacgaggacctccagaggctgatggaccggagcgacctgatgggcccgccgcctggcgctggcggcgcaaacgcggcctcgcctcttgtaccgctgaaagggccgggctgggaggtggtggtgccggccaagagtggcggcggcatgctgtcgtcgctcaccagctgagccgtcgtggctgcggggatctgttgtgcttttggttggtcgcacgcactcagttttggtttgcccccccactggtgctggtggttttggtggcagccgttgcgctgctcaggcgatggctgttgaactggggcgttgcccctgcagaagtagcttttagtttaggatcagcaacaaaacaagcaggactctaggccatgtgtggtcgactcttcgtacggtggccgttgcgttagattacgtgggtgggtgatgggacggttggttgaaccagacccgacggcagcatggacacacgccggttgctttgtaaagttagtatcgcgtcgtccgtgatacaatgcggtcctccgtctacatgggtgctgacgctctcttgttcggctgtcttgtgatgttgcaaacgcccgcgccgtgacaaaagccggttcgcccgtgccgtgacaaatgccggttctggtcttgtacacgcgacaaaaaaggcgaacgcttgaacaaggttggttcctgtatactatactcttgtcagtggcatgtgatcgtacaccaagtacgaaggaaagatataaactgtacaatcatcactcgggtctaaaataatggatggatccctcccaaaccacgcgcacgtactcagcctcattttgttatactagtctggtacacggtctgaacattctgctgctgggaacgcacgcacgcgtccgtcaaatcatgcagaacaggagggatgaacgcactgcaggcatgcaa

SEQ ID NO: 16981 - DNA, 1472 bp, Zea mays
gacagatggactgattgggtagctgttggcaagctagttacccattattcttccactccacctcgcccgtggcccgtacccgtcgtcgtcgtccacacagccacaagctgctgctgctgctgcgcgtgcttcctcttcagttcagctgaggtagcggcgcctcacccatcccccccgctacatacacatatctccttcttcgaagaactcggtcctttgggagcgagcaggagcaggagcaggacaggaccaggaagatcattatcaggagaagctaggcggggatatggcgaacgctggcggcggggcggccggggaaggggagtggctcaaggtcgcccagctcagggccctcgtccaggaggaccaccgcgccaaggaggtggacaacctgacgctgcgtcggttcctgcgcgcgcgcggccacaacgtggacaaggcggccgccatgctgctcaagttcctcaggtggcgggcggaggcggcgcccggcggcggcaccgtgcgggaggagcaggtgcgcggggagctggagcaggacaagatctacatgggcggcgtcgacaggaccggccgccccatcatcgtcggcttgctcgccaagcactactccgccaaccgcgacatggcggagttcaagagttttgtggtctacttcttcgacaagatctgtgccaggatccccagagggcaggagaagttcctcgccatcatggatctcaagggctggggctacgcaaactgcgacgtccgggcctacatcgcggccattgagatcatgcagaactactacccggagcggctgggcaaggcgctgatgatcaacgtgccctacatcttcctcaaggtgtggaagacgatgatctaccccttcatcgacgccaacaccagggacaagttcgtgttcgtggatgacaagagcctgcgggagacgctgcggcgggagatcgacgagagccagctcccggagttccttggcgggaagatgcctctcgtctccctcaaggactacgcccagcagcctcagcccgtttgcgagtgagtctgtcgtagcgatggtggccggccggtgacgtgagcgacccaaagccgaaagctgattcgatctagactaagctaatacagcctacaagagggaggaagagaggccctacccgtggaattaagtcattagtttgtggtccaattcaataagaaagtaaatgtggtgtgtgaagatggtatggcattatcagtctttaatcccatattatacatttagatagaagaaaatcaacttatatgtggtagtgttccctactttttatatgagataaataaagggatacggagaatgctgcacgccaaaaaaaaaaaaaaaaacaggcttccctagttaaatataaataaaaaaaaaaataaatatataataatttatttaatttaattataaaaaataaaataaaaaggggggccgttttaaaggaaccaag

SEQ ID NO: 16982 - DNA, 3553 bp, Zea mays
aaaaagctgcttcctggatccagccctttggttggctttgactttagggggcaaagcccaaaagccaaaagtcaaaccaaacacacccttagaccattagcatgctaccattactggtatgttggaaggcatgtcatatgacaactgtaggcaaaaataagaaatatatttatgttttacatggactggaagcatgtccaataaaaagtgtatcaccattctaagtggaaataagccaaacttaataaaaagaatacaacgagaaattatttgacataccttggcagatgacagcaaagctgcctccagaagccctgatctcaaggaatgccattcttcaaaaaaagctctccagctcaggccatgatcttgttgctactatagaacacattatttagctaacacttgatcctgaaattatccttggcaaaagtttatgttctaccaatgttttaacaacacccacattaaaggatcataatgaagcacctccacttagcagcaaggctgttctaccaaaggcatgtcttgtctcatgcataaatgcgagtttctcttcaagaggcaactcgtctgaatcagaatcacagaccattttcagttgagtagatacttcctcaacgtattcctttatgagtctaggcacctggcgagcaagaacattacaaaaaaagttcattactaacatagtgctacaatagtgttacaagctctaacacctgaacactgggtggaacaaaagaacaacttcaaagtgcaaacacaacatcctgacaaaaagatgtgccaaagatgcaatacattcataatgcaattgtcattgtcacttgtagaaattgtaggctaaaggttttgcagatctcaattgatataatatgtgattacttattataactcaaaaggtcaaaaggaacaggatagataactactgttaatttttctacttttcgatcctattccatattccacacatgtttcataagattaattaatctatatctatatcactaaaagagtgaaactgaattcctaaaagagtgcttccaaattatgaaactgaattcttaaaatagtgcttccaagagaaatgcatctgttcctaaatatcatccctctattcctctctttctaaaacaggccaatgtagcctcggttgggccttggtggatgccaaggccgatgcctgtactggcaccctatgaaggcgtccacaacactgcaccaccgtaataataacgattctatattttgttcatcctaatactaaaaaaatataacacagaagcaaacatagtgctattttatgctttcctaatattacgtactccctccatcccaaaatataattaattttaggttaaatatatattcattaattaatctatgaatgtagtatgtatatatgtctatatacattattattatttgaatgtggacgaaaaaaaagagggctaaaaagaatatattttgggacggagggagtagatcctatctttatgcaactaaattaagtcagttttggcaatttagttagtgcgatacagttggcatgcataaacatactgaaataaagacgtaccacttacatgagaaacatcacattggtaagctctgggacgattgtagatgccaaactaatcattcttgaaccaaaattggatcaccacaagttgtgtcttcgttgcactctttttgtgcttccgaaatagtaagttgcaccatttgttgcatttcaatcgactgatggagcaccacatcgttggagacaaatgtctgaactgttccacctacctctatccaactacaaccaggaaccttgctgccacacctatgtctcatcacacttcttacttctgcaagctcgttccaagctcctgcagcagcaaatgcgttagacataagcagataatttactgcctcacttggttccaggcataaaagcctatcggcagcccactttgccaactcaattttgccccgcagcttacaggcaccaaggaaagctccaacgatatcagcattgttctcgcaagaaagcttgataacaatgttgtaagcatcttgaatcctaccagctctccccaagagatcaaccagacaagcaaggtgctgtgaatttggatcgatgttgtagcccctcgccatcataaggaaatagtgcaggccttcttcaacgagcccagcatggctgcaggcagaaagaaccccaaggaaggcgacgctgtcaggctgtacgccttgttggagcattctctcaaacacatgaactgcatccttgcatagtccaaggtacgccaaagacgaaaccatacaggaccacgtaactacatctgggtcgcagatcatagcaaacatttgccccgcctctcgagcaaaaccggtcttgccgtacgctgtgataacagcattgcccgcctgcagaaacctgtgaaaccccctctttatggcataagcatgaacctgagtagcctcgtttgctgccgccacgctggcgcacgagcttagcacactggcaagcgtgagctcatccgggcagcagctcccgtctctcagcatccaccggaacagctcaacagcgtccttgcctccaccaacccgaccatagcagactacgatcgcgttccatgagacgacgttcctgaccgccatagcgtcgaacacccagcgcgcctcgtcaacccggccgcacttggcgtacatgtcgagcagcgcggtggcaaccaccacgtctgcgaggagacccagcctgagcacgaggctgtgcgccagggctcccatcctgagcagcagcccgtcatcgacggcgccggcggttgggtggcggccacggcgcggcggcggacggagcagggcgctgaaggtgaacccgtcgggggcgatcccggagcgccgcgcggcggcaaagagcgcccaggcctcgcgcgcgaggccgtgggaggcgtagcaggagaccatggcgttgtagaggaccaggtccctgcgcggcgcttcgtcgaacacgcggcgtgcgtgcgcgacgaggccccaccgcgcgtacgccacggccagcgcggtcgccacgcgagcctccgtggcgcgcccggacttgagcgccagcgggtggagcgtctgtgctgcgcgagcgccgccggagacggagatggagctggcgcggagtaacagggcaacgagatcgtgccgcatctcattccagagctgacagggaagcgggagatggcctcatcggtcatctccactgccccctgctgcaggacaaagacgtggagccgcccgagctggcgagcgaggccagaacggcgtgcagacgagagcaatgcgctccattctatcatcacacagcgcccaagccgccgatcaacatgataatcgacaggtgacgaggggcctttttatgctgggtgcagaatctctaacttcagcggcaccctacaatcgtagaggttatcccttaaatttgaaggtaggtccttctgtttctaaataaagtgttctcttttttttcgtctaatttttttatacactaagcttcgaatgaacacagaattaacatgta

SEQ ID NO: 16983 - DNA, 2959 bp, Zea mays
tgtttttgtctctatagattgcagctgcatcagaccaaacaactgactttaatctgaatcaaacagctagtgttgatacacccacaaaaacattaaaaaccactattatatctacaagagaagcacattaccctctaatttcttatagcttcgcttctgcacgagagagatgtacactttctgttaatttaggttatgatgtcacattgatctgttaaacatttctcactagctatccggtccgtgatggaagcattcggctgtaggtgcttgtgccacctcactgctcacgggcgtcacggctcacctgcacaactataataaacgtgtttgaggtcttcaatactgcgcaggattttctctgctctcttgtgtaagacatcagtctacatgtacaattcgttacacggttttaattcggtcaaaaccccttataatgactatacttcaaattttctaggatttgaaattcagtgttatagtttttatcgttgatcttgggttgatggtatatcattatggatgaaatctttctgggccgaactggcactgtaggcttaagtgggcttaatgcgtatgggtgccccggcgcgcgcctccagccgcgatctacatccatccagcacaccataccctagttcttccttcccgaaccctcgcgccgccaccgccgccgtctagcattttcctacacccaatctgatctgaccaagccctctgaacaccaccgcccatcctcctcctcctccgccgccgccgcccaagatgggcttcgacgtgggcctcgtcccctacaaccccgacgggtggggtccacctgaagttgccgccgcgccgccttccctcggtggtggctcctcgtctgtccccttcgctcccttctcccgctccgacaagctgggccgcatcgccgactggacgcgcaacccgccgggccccggggctttcgccgcagctcgcgacgccgtcttcgatttcgcggggctcgaggactccatcgggctcgcgtccgcggacgactcgtccttccgcctcgtcgatggcaaaccgccgccgcggcacccgcggtttggacctcgctggcgcttccagcagcggccccaactcccgcagcgccgcgacgaagaggtcgaggctcggcgtcgcgaggccgagaaggagcgcgcccgccgcgaccgccactggcagcagaaccgccgcacgcaccaccagttcaaccgcggcgggccctcctcgtcgtctgccaaaccgtccgttgacatccagcccgagtggtcggtgaaggagcagatccctttctcatccttctccaagctctccttcgccgtcgccgaccagcccgaggatctcctcgtctgtggcgcagtcgagtactacgaccggacctacgatcgcgtcacccccagggccgagcgtcgcctcgagcgcttcaagtcgcggaacttcttcaaggtcaccactaccgacgaccccgtcatccgccgtcttgctgagaatgacacggccacggtcttcgccaatgacaccatcctggccgcactcatgtgtgcgccccgtagcgtccagtcctgggatatcgtaattcagcgtgttggcaacaagttgttcttcgacaagcgtgatggctctcagcttgatcttctcaccgtcaacgaaaccgcccaggaggcactccctgaggccaaggaagacatcaactccgcgcattcgctggcggttgaagccacatacgtcaatcagaacttctcgcagcaggtgctgctccgcaatggtgagaaggtcacgttcgacgagcctaacccgtttgccactgaaggggaggaagctgcttccgttgcttaccgctaccgccgctggaagcttgatgaggagacaagcttggttgctcggtgcgaggttcatgccgtgagcgttgatctacgcggcgagcgccagttccttacactcaacgccctcaacgagttcgatcccaaggtcactggtgttgactggaggaagaagcttgagacccagcggggtgctgtgcttgccactgagctcaagaacaatgccaacaagcttgcacgctggactgcccaggcgctgcttgccggcgcagacatgatgaagttgggttatgtgtcacggctgcacccacgcgaccagtacaaccattccattctcagtgtgatcgggtacaagccaagggatttcgctgcacagatcaatctcaacaccgcaaatatgtgggggatcgtgaagtctattgtggatgtctgcatgaagcttggagaggggaagtatgtgcttgtgaaggacccagtgaaaccacaggtccggctttatgaagtgccaaatgatgcattcgagaatgactacgttgaggaaccactccctgaggaagagcaagtgcgtcccttctccgaggatgttgatgccagcgcgaaggaaatggatgctgccgcagaagcggaggctactggaacaactgcaggcgctgagaagagtggtgatgtcgctgctgtgtgaaggcggtggctacaacctgaagaggtctttttcggaccttgaataaggttaccttggctagctatctactacaatcatgggcatctggatacaggtttgatgtttctaccatcgaaggttatgctattattgttcgctgaatcttgagttgtgttccctttatgtgtccttatggctggacttaaatggaatcctcaaactatattgcactttccaagactcacatgttgtggattgccagttctgtttactgtgatttgagttgtggtgattgcatttgcatttacttggccatattagtaccttcagtttgttggatgaatacatgatgccatgtgaatattgccatttgtgcaaaaaaaaaaaaaaaaaaaaaaaaaagaaaaaaaaaaaaaaaaaaggcccctagggccaaaattattttatatttaaaaaatattcaaattttaca

SEQ ID NO: 16984 - DNA, 886 bp, Zea mays
cattgggtacctcgaggccggccgggggctggtctacgtctcctggcggcacccgaaccctcgcgccgccaccgccgccgtctagcattttcctacacccaatctgatccgaccaagccctctgaacaccaccgcccatcctcctcctcctccgccgccgccgccgcccaagatgggcttcgacgtgggcctcgtcccctacaaccccgacgggtggggtccacctgaagttgccgccgcgccgccttccctcggtggtggctcctcgtctgtccccttcgctcccttctcccgctccgacaagctgggccgcatcgccgactggacgcgcaacccgccgggccccggggctttcgccgcagctcgcgacgccgtcttcgatttcgcggggctcgaggactccatcgggctcgcgtccgcggacgactcgtccttccgcctcgtcgatggcaagccgccgccgcggcacccgcggtttggacctcgctggcgcttccagcagcggccccaacttccgcagcgccgcgacgaagaggtcgaggctcggcgtcgcgaggcccgagaaggagcgcgcccgccgcgaccgccactggcagcagaaccgccgcacgcaccaccagttcaaaccgcggcgggcccctcctcgtcgtctgccaaaccgtccgttgacatccagcccgagtggtcggtgaaggagcagatccctttctcatccttctccaagctctccttcgccgtcgccgaccagcccgaggatctcctcgtctggtggcgcagtccgagttctacgaccgggcctacgatcgcgtcaccccccagggccgagcggcgccttgggcgcttcaagtgccggtactttttcaggggccccccccccggcgacccc

SEQ ID NO: 16985 - DNA, 838 bp, Zea mays
  misc_feature (787)..(787): n is a, c, g, or t
ctttctttgcgttaaatgcacgtgcgtgtccgcgccgctactcgaccgcccagtgcatgcacgcccgatactgctagccaaggccaagccagtgcaggcgcggtggtgtgtgttgttctcgtcgcgcactcgccggcagcgatggagccccgccgctccgtgctggtcctggccctcgccgtcgccgccgcgctctccgtcgcagtggcttacgacccgttggacccgaacgggaacattaccatcaagtgggacatcatgtcatggacgcccgacggctatgtcgcggtggtgaccatcaacaacttccagacgtaccggcagatcacggcgccggggtggacggtggggtggacgtgggcgaagcgggaggtgatctggtccatggtgggcgcgcaggccacggagcagggcgactgctcccgcttcaaggccaacatcccgcactgctgcaagcgcaccccggccgtcgtcgacctcctccccggcgtgccctacaaccagcagatcgccaactgctgccgcggcggcgtcgtcagcgcctacggccaggacccggccaccgccgtcgccgcgttccaggtcagcgtcggccaggccggcaccaccaaccgcaccgtcaaggtgcccaagaacttctcgctgcgggggcccggggccaggtatacacctgcggcccccggcaaggtcgtcccctccaccgtcttcctcacgcccgaccgccgacgcaagacacaagccctcatgacgtgggacgtgacgtgcacctactcgcagcacctggcgntcaagtacccctcctgctgcgtctccttctcctcctctacacgacaccatc

SEQ ID NO: 16986 - DNA, 2065 bp, Zea mays
tttcgtgcttgggttgtagcctcagccgtagtgctggctcggcccgacatgattatatattttttattttacaaaaaaatgtatatacatatatacaatttatgtttaatattaaaaacatttgaacatgatgttatactggttagatagcttcatacagtgtctcccgctcttctttcatcagagcatgggtcaaaccccacctcgtacactatttttttttaatattttattttacaaaaaacgtatatgtgaacatttgagcatgatgttctactggttatacagcttcacccagtgtctcacgcccttctttcatcacaaggcatgagtttaaatcccacctcatgcactatttttttaatattttacgccgatttaatcaaataggtcgacgggctggcccgacacagtcaggccggcatgacatgcatgagccagagttgtggcccgcgggcgtctggcccacgtcgggccgccgtttagccatatataacatgcaacagattaatttgaaatagttgtgaggagttatttgtaaaaagatgacgcgggacgaccttgaaactgatgttttaagtatagtatatataatagtatagatatagaggacgtgtttctccctccgtcatctataaatatttttatacttttaagaattaagtaaaaaatatgtaaaaacgttttaggatatatagtatgtaaattacaaaaaatcaatatataaaatagagaccgtggaagagaaataagagaattctttagagaaatacagtctataatatagaagaggaatataaataatacggttagttgtttcacacggacgcgcatttgtcgcgatcgacgatcgagaaaatcctagggttttcctctctcgccgccgccgacttaaagaggacagaggagtaggcgaagtagcgccgggagaggaacatggggacgccggagacgtcgcgggagccgtgcccggaccggatcctggacgacgtcggcggcgcgttcgggatgggcgccgttggcggctccgcctatcacttcatcaagggcatctacaactccccaaacgggatgcgcctgtccggaggcgcgcagaccgtgcgcatgaacgcgccgcgcgtggggggcagcttcgccgtttggggcggcctcttctccaccttcgactgcgccatggtgtacgcgcgccagaaggaggacccttggaactccatcgttgcgggcgcagccacgggcgggttcctctctatgcgccagggcatgggggccgcgggccggtccgcgctcatgggcggcatcctgctggccctcatcgagggcgccggactcatgctcaatcgcgtcctcgccaacccgccgctgcccgccgacgatcccaaccttacagcggccatgggcggcaaccctttcccgggcctgccgcaggcgccgccggtcgtggcacctccggaagcggcgacctccagcggcgtgggtggcttgttcgggggactgtttggcaggaaggaggaggataagaaacccagcgcagtcgggggcaagtcggagatcttggagagcttcgacacgcccagcagtccgataccatcgttcgagtacaagtgaggaaaaggttggctgacgccactgttgcttgcttggtgttgcaatgtggtggtggtggtctggaattggtgaattgcatgtcagcgatacaataacacagacaggacaggagatggattgtttgatgaatttattcctgcgccgctctgcctcgacggctcatatctatacgcccgcttgtgtatgtataagccctttttcaaaacgtggcagattggctactttttgatgagatgtagtagtatctgtaggagcaacagctgtagtattatatgcattcgtgtttgtgcaatgcaatgcacatcaaaacccttgtgcggttgtgcctggccatctgaagggacgacttatttgttcatgtcgctggtcttcgttttgctggcccagtggcctacgaggctgtgctgtgttaaggattggacatctgaagggttcttttgcacaaaaaaaaaaaaaaaaa

SEQ ID NO: 16987 - DNA, 3446 bp, Zea mays
  misc_feature (2336)..(2336): n is a, c, g, or t
cattggctcccgcccggccgggccgggagcacccgcggcgagctaagcaatttctccacgctttgcaccgcgcatcgcatctcccccttcctcggttcctcccctttcgccctacttgcttcccacgccagggcccgagctccgagctagggtttcctctctcgccgccgccgccgccgccgccgccgacggagaagaggagtaggtgaagccgagttattagcgccaggggaggaacatggggacgccggagacgtcgcgggagccatgcccggaccggatcctggacgacgtcggcggcgcgttcgggatgggcgccgtcggcggctcggccttccacttcatcaagggcatctacaactcccccaacgggatgcgcatgtccgggggcgcgcaggccgtgcgcatgaacgcgccgcgcgtggggggcagcttcgccgtctggggcggcctcttctcaaccttcgactgcgccatggtctatgcgcgccagaaggaggatccctggaactccattatcgcgggcgccgccacgggtgggtttctctctatgcgccagggcatgggggcggcgggccggtccgcgctcatgggcggtgtcctcctggccctcatcgagggcgccggccttatgctcaaccgcgtcctcgccaacccgccgctgcccgcagaggatcccaaccttaccgcggccatgggcgacaaccctttcccgggcctgccacaggcgccgccggtcgtggcacctccggaagtggcgagctccagcggcgcgggtgggtggtttgggggactgattggcaggaaggatgaagagaagaaatccagcgcgggcaagtcggagatcttggagagcttcgacacgcccagcagtccgataccatcgttcgagtacaagtgaggaaaaggttggctgatgccactgttgcctgcacggccttgcagatgctgtgatggggtctggaattggtgattcatgtcagcaatacaataaccgacaggacaaaagagatggtatgcggcttaagccttttccgaaacgtggcagcttggctacttctcgagatgacgtagtatttgtagaagcaacagcagtagtacactgcccaatattatagcattcgtgttgtgcaatgtaatgcacgtgagaacgcttgtgtggttgtgcctctggctggcctctaaacggacgtcttttttgtggtcttattagtcgagtcgttcaactgcgccaagtcttgctgcagtttttttgttttgttgccactgtgtctgagcctcgggtggcctggtgtacctgcgaggctgctgttaagcagggtcttgtcagtcagggcagggacctttgttgccgcaattagtacggtacgtaaactgcccatctcggtgggtaagctaatcgaccaaggactagtgctgtggtaacggatcctgattcaaatgtttatttataatttgttagggctctaaataatttttagtttgaaaataattagaattagagattgatccttaaattttatagtgtaaaatttaaagctcgtcctcatccctagacccccaaaagtttgtagttcagctgagagcaaaccgcgcttcagtcctagtgtcgctgcaaggcgaacaagaagaaaccgaacagtcaaactcttggtaaatcgtcgtacttgacggaaacatgagcttcacattgccgacgtatatatagccgaatacaataccaccgatcacgagaagtcgcgcggcgacagcggccgcgcaccggactcgggcaaacaaagaaggcacaggtgtttgggcgtccccatccgcagacctgaacgcggccgttgcgacggccatcgctccctgcccttttcctttttccctcctgctcccactacaactgaactcctcctcgggggcacgggacacgagcgcagtatgtatcgtgtatggtcaccaacccaaccacgttgcttcggcagggagaaactacggcgcaagcaaccccaactggtacgagcgaggcagccaccggtagacacactggagaggcacgcccgcgcccggggtttggtcgatgagttaccgagaaggaacccaacccaaccaacggtggcaggacaggaggcagaggttggtggcgccttaccatcgcggccggcgccgccgttggctatcaagcaagcaagcaagcgtgctgctgctctgcggaagcggaaccggcccgtgccctttctttgcgttaaaggcccgtgcgtgtccgcgccgctactcgaccgcccagtgcatgcacgcccgatactgctagccaaggccaagccagtgcaggcgcggtggtgtgtgttgttctngtcgcgcactcgccggcagcgatggagccccgccgctccgtgctgctcctggccctcgccgtcgccgccgcgctctccgtcgcaggtcggtcggttcctacttcctgggcgtcatcctgtctccaatggttcagttcgtgtgcgtgcgtgcgtgcgtgctgtccgttgatgaatgaatctaacgagctcaaggcgtctgccggttgttcgttctacgcagtggcttacgacccgttggacccgaacgggaacattaccatcaagtgggacatcatgtcgtggacgcccgacggctatgtcgtgagtgctcccaccgcgagcctgccccctagctcttcttctctattcctgctgcccatgcttgctcctatgtgccatcgtcatcatgctaaaaccagacgtatatgcaatgcaggcggtggtgaccatcaacaacttccagacgtaccggcagatcacggcgccggggtggacggtggggtggacgtgggcgaagcgggaggtgatctggtccatggtgggcgcgcaggccacggagcagggcgactgctcccgcttcaaggccaacatcccgcactgctgcaagcgcaccccggccgtcgtcgacctgctccccggcgtgccctacaaccagcagatcgccaactgctgccgcggcggcgtcgtcagcgcctacggccaggacccggccaccgccgtcgccgcgttccaggtcagcgtcggccaggccggcaccaccaaccgcaccgtcaaggtgcccaagaacttcacgctgctggggccggggccaggatacacctgcggccccggcaaggtcgtcccctccaccgtcttcctcacgcccgaccgccgacgcaagacacaagccctcagtgcgttcgagttcgcgttctactatagtcctatatggttttcactatctatcttcaactccagcctgtgacgatatgcttgcatgcagtgacgtggaacgtgacgtgcacctactcgcagcacctggcgtccaagtacccctcctgctgcgtctccttctcctccttctacaacgacaccatcgtgccctgcgccaagtgcgcctgcggctgcgagcacaagacctgcgtccagtac

SEQ ID NO: 16988 - DNA, 1599 bp, Zea mays
  misc_feature (1364)..(1364): n is a, c, g, or t
  misc_feature (1549)..(1549): n is a, c, g, or t
gtatctgctgcagccgatgcaggaggcgagcacgaggagcagcaggaagcagggcacggggaggaaggcgacggcagtcccaagcaggcagtcaaccttggggaagacgagaagacggaatctggccccgtcacagctccacccattgttgctcgtggattccaagaaagtggcgtgggcgtggagaacatcttgcctgacagccccttcgcatccaccaccaacaaggagtcctcagctccaacggctcagaacgggagcatcagcaatggcagccctcaccatgtggcttcttcgtccctcttcccacctgcacccgccattgagctgcccccgtacaactcctgcttctttcaggcgcccaggttttctcctggacatgaagccattgggctgtgaatacagagcaaataggggtctcctttcctctaatctgggagggctatcgatgaccccatcaagtggaggaaaggagtagaaagctttgattaacaaatactaggtgtatcttcagagagggacagcaacagcagcagcaacaacaaaaaaaaagggagggagagagagaaacaagtctaggttgttttagctctaggcctaagtatatgatagtagtcctataatataaataataatagtcttttagtagctcctgccggtatcaagattcaagtgattaaaaccgtagatggcgtagtactagtaaaaactagacagctagtcttggcagccagttgtagtgaagtgacatggctgcatacagacatccaaaggaaacagacttggtgctgctgcagctgcagtgctgctgcacaaggaaaagtgatgagaccgagacgagaggggtgtactctgctgggaccagagcactcacgggtgcagagagactccacttcacctcatgactggccgcggcgccgcacgctacggcgcgcgctcgcttgcatgccggctacagcgcacgcgctatcgcccgcagcgcagcgcgctatcgcgcactccaccgcgctggactcttctctctcccctcagctgcagcgcgcgctctccccctaccactgttcctgtgggcccgccttcaattaatagtagaagaaaaattgatagtagatgaaaagtaggtatagaaaatgatattttatattgtagtggggtataaggggagtatttaggggaaaccactgcgggagatgaaaaagtaggggatacactattgatgatgtgatccagaaaagtgatatagggagaaaaatttagagggaaccgctgcggatagcctaaggcctcactacgtgggccaacattgctccatgaatccatgatagcgcgccatgcggtcacggcgtcacgcgcacgaactactngttcctttctagacgtggcctggctcgcaccggcaaagcgagttgccaatgccccaggctttacatctgcaacagcagttacgcgcgtactcatgcagacaggctatgaatgcgagagctgtttggttgtccactaccaacagctttagctatcagtctatcacatggcatacatccgcgcgtcnttctgcacggagcgtttaattttccgcacgccgagagcctggcctgagga

SEQ ID NO: 16989 - DNA, 688 bp, Zea mays
  misc_feature (41)..(41): n is a, c, g, or t
cggggggttcaccggggtcagggaatcgccaggggcccttncctggaacatcctaatcgaaaaacaaatactaggtgtatcttcagagagggacaacaacagcagcaacaaaaaaaaagaagagagagagaaacaagtctaggttgttttagctctaggccctaagtatatgatagtagtcctataatataaataataatagtcttttagtagctcctgcctgtatcaagattcaggtgattaaaaccatagatggcgtagtactagtaaaaactagacaactagtcttggcagccagttgtagtgaagtgacatggctgcatacagacatccaaaggaaacggacttggtaggtgccgtggacaaaagccttggccggacagacttggtgctgctgcagctgcagtgctgctgcacaaggaaaagtgatgagaccgagacgagaggggtgtactctgctgggaccagagcactcacgggtgcagagagactccgcttcacctcatgagcaattctgcagggcccccctctgaatcgtaggagcatgcgccaagcactccttgtccctggtctttcaccttttgctcatcttttcacccttgtagaaaacagcaggaggtagcagacagaggaatggaaaaagtatttattagccaaaaaaaaaaaaaaaaaagcttatcgataccgt

SEQ ID NO: 16990 - DNA, 1865 bp, Zea mays
caatgtggagtggtatcttcttcaccagcaacgactccgtttctctctctctcttccatccgtccgcctggcctcgctctccctctgctgccctctcctcacaagttttcaatgctcctactagatgcagcgtggcatcatgtatgtagagataagatcatgaagactgtaggcttctgatgagctgctgccagcataaagaaaaaaggaatagccagcgctagttttgttgtttcacagtcaatctctactagtaccaccggtagtactagctacatctgttcgattcatgtgtgacacttgataacggggcacggttaataaatttgagaatttatctataaattcgtaataaaaaaaagcattcatagcactacgcttttacacaggacgtcctttttttttctctttccacctgagggctgaggccagccaacagaacaataaaaagggagaacttgatccattccggcctccacggctccacctatcagttcacgaacctccgggaaatgacgtatcaatgcataagattactcctttttttttgaatcaaattcgtggagcttgtcatgacgtatgtacatttatgcatagccgtccaaagtcaatgcacgtcgcatcggtctcccatgtttcagtgccacttctagtagtagttggtcataaaagagaggctgatcctcctacttctactctggagtaccacatccccatgagtagtagtcaatccggcacgcctccccatggggagcaaagcgagaagcaattgcctctggcttaggaaacagactcccaaggaagatggtcaaccgaactcgttttaaaaaaaaaaatacagtctctataggctcgagatttcagaatcttttggaagcacctgaacccttcatgccgtgggttggtggtgcacccaatgacgaactgctctgccatgcacgcgtgcagtgctaggagagtattgtgcgccaaatcggggtgtcatgaggccatggaagtgccaacatgccggtttgcatatggatccaagcccaccagcttagcccaaccccgtagaatgaattcttcagtttggtcttttggttatcgatcccgatatatataccattatcgcatgtgccccacattcaccaaggatttaatgccggttcgtctctttccattccagggttgcgttgcagtgctgcgccggatctgggcgggcagaaatccggcccgtttgtaacaaggcaaggcgcaggaaacggaaccggcggcgttgcgtgacgttttttttttctttattgtgtttgattttacatgccattataaaaatcttgttgacacttgatagagattgatccagccatgtatcatcaagggctaacaacacggcctaggttacaattaacctgtcacacacatagcaagcaactctaagggtcgatgaaaggcgatgtaaagaccgattagaacgatccattctgttattgtacttggttgaggtcctaaatttctggcaaagaatctggttccgcacgttagcaccatcatcatatatactcccgtagtctggtatatgaacgcaacacagagctgacagcctaacagccgtagccagcacaaaaatactagtgctgtgaagcgccatacgcaaacagtagaagcgtgctagaactagaattgaacttgcctgcttgcgggtggcaggaaaactcaaccgggcctctatatatgactccagctgttccccagtattcccacccaaacccaagaaaggcagctaggcctgcacaaaataaaccgaaatcaaatcggaaccgaaatggaattgatcattagtaatttgggttccatgttttaaaaaaaccgaaataactaaatta

SEQ ID NO: 16991 - DNA, 1633 bp, Zea mays
ttttttttttttttttggcaaggtaccataatcctatatgcataatatataacatcaccactgcctcacaaatgtattcacctatatatgatattaattaaacaggaaaacagtgataaataaagagagatgggagaaataattaagtaataatagaaagaagaagaaaaaaaacatactactcaactccaaaatctagctatactcgtatatatgattcactccgtgcatgatcctaatctcgatcgaactcaaattggaacatctcatccaatggatcacctcgcatatccgagctgcttgttaatttgatcaatttgttcaacacgaggcattgcattgcccacaacatatacgtcggcgccggccgacgtgctgttggatccgtggctcaccgtgtatgacgaatgggaagaatcgtacgtattcgacttgttcactggaagcaggtgtggtgtccgtcggcccacgaccagaacggcggctgctcgtcgacagcggcgccgcacagcaggctgccaaaggtgcctccgccgccaccggccgtggcgggggggctgccgggggcgagctccatcttaggcggcgccgccgcggctggggacggctggccgccgctgtgcaggagctggtggtggatgtcggcgcgggcggcagcggaggcgtagaacgggaggccgccgcgatagctgttcatggcggggctctcgccggcggccggatcaggcctggagacgtcgaggccgttgatctcggagctgttattctcgctgcaggacgcctccgtctctctgacgttgaggttgatgagctccgacgccgcctcctgcctccctccgccgcctccgcctcccttgagcgccatgatctctgcctgtagcttcttgttgtgggagaggagggcgtcgttctcggcgcgggcggcgtcgagctggcggcgcagcgcgtcgtagtccttctccagctgcttggtcttccacctggcgcggcggttctggaaccagatggccacctggcggggctgcagccccagcgcgcgggccagctgcgccttgcgctcgggctccagcttgttggccacctcgaagctgcgctccagggtgcgcacctggtccacgctcagccgccgcttccgctcgccgccgcccaccgcggcggacccctcctcctcgtcgtccgacgcctgctgctcctgctgctgctggggctccgcgtgcaggtggtggctgtcgtcgccggccatcccgccgacgtctggatacatgcgcttgccgccgaagccgccggccagcattggcggcggcggcgcggccgccatggcgccgccgaagtcgtggaggaaagggctgacgagggccgcgggagggggagccaggagatggtgcgccgcctcgtggtcctcgtcgtcgtggccttcatggtgctgctcctgctgctggtagtggtgaggcagggcttgctgcatttggaggaggaagttggccgggtagaaggaaggggccatgccattggtggccattggcttcatcacaggagcgagaggagcatgggggagctggggagtatatcaaccttccttccaaacagagagagagagttttcgattaggatgttctaggtaatggtctcgtgc

SEQ ID NO: 16992 - DNA, 1349 bp, Zea mays
gaactcagaccaaaatctacctaattaaattacaccgcctctccacttattccccatttacaaccccttcccagttcccaccatgcatgaccagctaggcaggcagctacccgcctaccccgccaatatggaccagatatcacacacgagtacacgaccttttttttctctcctcccttgctgcatgcactcgccagaattgtccaaataaattcctttcctccgatatttctactcactacagtgtcgatcgccatcgtttgtgatggacgatgatcgatcaatggaagtggtggtggtcggcccacggccagaacggcggcgtctcgtcgacgccacacaggaggttgccgaagctgccggcggtctccgcggcctggacggcgacggcgcagccgtcaccgtgttgctccagcttcggggtggaggcgtgcaggagttggtccatacccacgccggcggcaatactatgtcggccgccgacggaagggtagaaagggatcaagccgccgccggcggcgtggtgcggcggcggcggcggcggatggtccatggggcccgcggacgccggcggcgtgcgcgagatgtcgaggttgatctcggagctgtcctcgctgcggttgctgcaggacgcctccgtctcctggttcaggttgatcagctccgacgacccccctgctgcctccctgcccttcagtgccagtatctcggcttggagcttcttgttgtgggagaggagggcgtcgttgtcggccttgacggcgtcgagctggcgcctcagcgcgtcgtagtccttctccagctgcttcgtcttccaccgcgcgcgccggttctggaaccagatggccacctgccgcggctgcaggcccagcgcgcgcgccagctgcagcttgcgctccgcctccagcttgttcccgagctcgaagttcttctccagcgtccgcacctgctccacgttcagccgccgcttcttctccccgggcccgccggcctgcagggagccgtcgtccgacacctcgtcctcgttcgtcgcgccgcagttcgcctcctcgcctccgacgccgacgtcgtccgcgccgcagtacatcgtcgggcgcttccgcagcattggcgccatacctcggaagtcttgcagggaggggcattgagaggaggggaggaaggggttgtggtgaagatgaaggggaggagcaggaaggtggtggtgttcttgggggtcatgatcggagggcgtctgctgcatttggaggaggaagtttggagggaagaagggcgagggtgaggacgccatgccattgctggccattggcctcatcagaggatcccggccggcctcgagggacccaatg

SEQ ID NO: 16993 - DNA, 1832 bp, Zea mays
ggtgatgctgcacggcttgcacgacgacagtctgtctgtccaagctgtctctttcgtaggctcgcagacgagacccacatgccaaacaccaaccgcacagcacagtactcctggtaccccatccatgcatgacgctcccaccatatattgcaaaaaataaagaagattaaacatgtattaatgtccatgcatttcgatcacggtagatccacgacgacaccaccgcgcgcacacacgatgcaagtaaaaaggaagaaaagaagaaagaatttgcaggattcaagggcgaatgacaaggtaccataatcctataggccgcttttttttcttctcctctgcctcacaaatgtattcacctatatatgatattaattaaacaggaaaacagtgataaataaagagagatgggagaaataattaagtaataatagaaagaagaagaaaaaaaacatactactcaactccaaaatctagctatagtcgtatatatgattcactccgtgcatgatcctaatctcgatcgaactcaaattggaacatctcatccaatggatcacctcgcatatccgagctgcttctttgatcaatttgttcaacacgtacgaggcatttgcattgcccacaacatatacgtcggcggcggccgacgacgtgctgttggatccgtggctcaccgtgtatgacgaatgggaagaatcgtacgtatttgacttgttcactggaagcaggtgtggtgtccgtcggcccacgaccagaacggcggcggctcgtcgacagcggcgccgcacagcaggctgccaaaggtgcctccgccgccaccggccgtggcggggggactgccgggggcgagctccatcttaggcggcgccgccgcggctggggacggctggccgccgctgtgcaggagctggtggtggatgtcggcgcgggcggcagcggaggcgtagaacgggaggccgccgcggtagctgttcatggcggggctctcgccggcggccggatcaggcctggagacgtcgaggccgttgatctcggagctgttattctcgctcgctgcaggacgcctccgtctctctgacgttgaggttgatgagctccgacgccgcctcctgcctccctccgccgcctccgcctcccttgagcgccatgatctgcatgcgaagcaccagctcacgcacatcacatgacgacacggactgcagaatgcatgggccggggtgtggggttcacaaagacagacgtacggtacgtgattggtagatggatcgagtggctaatcatgctgcatgcaccacatcacaaaggaatgcatgcatgtatgggtggccgacagcaggcgcaggcgttcatatggccggcaccgatcccgacacgcgcaccactttctgcagacgacgctcctgaatgaaacccaccacatggatcctattcctatctatctatctatctatctatctatctatctatctatctctagcttttctatgcatgctatggtagtatattagtagatctgtatctacaccaaacatccatccctaatcatgcatgcatgagttctgacgatagccaagaacgaacaaatgacaaagagatccattccaatcaagaacatcatatatactctatatagaatagaataatactaattgcagctgacactgtcacggccggctgatcatcaagagatgtgagagtcagaagaagaagaaggaacgctactagccagtagatctcgaattctacatacgagatccagatgcgtgcatttagatggcagtattggttcttacctctgcctgtagcttcttgttgtgggagaggagggcgtc

SEQ ID NO: 16994 - DNA, 2599 bp, Zea mays
  misc_feature (1553)..(1553): n is a, c, g, or t
  misc_feature (2082)..(2082): n is a, c, g, or t
cttcattcgttcttttttatttgtcgtgttttagttcaaaactgaactagaacgacaaatattcgagaacgaagatagttaaacagatgtccaagaagaaggcaagaaggatggagataatagaaaaagccagagagagacttactgctcaactcctcaatctaccttgactgacatatccatcatctccgtacgtcctgattggatcgtctcaccacctcacatatcccagctgcttctttgatcaacaacgcatcggcaacgtacgtcgtcggcggcgatctcgcgatctggcgcatagcttgatgcgatgccaagaggaaatgaccggccggagaggcatgtcggtcggtcgacgtgctgttggatccatggaacaaaatctgcgtcgcccgatgcgaggtcatagcaggcagcgtagtgcaccgtacgagacgaattgaaggattaatttgttcactggaaggcgtggtggccgtcggcccacggccagaacggaggctgctcgtcggcggcggcaccgcacagcaggcttccaaaggtgccgcctccgcctccgccaccgcccgcagtagcggcggcgccgtggccgggctccatcttgggcgccggggacgggtggccgccgctgtgcaggagctggagctggtcgacgtcgtcggcgcgggcgcaggcgtagaacgggatgccgcggtagctgtccatggcggcggggctctcgtcggcggcccgaggcggcctggagatgtcgaggttgatctcggagctgttctcgtcgctgctgcggttgctgcaggacgcctccgtctccttgacgttgaggttgatgagctccgacgccgcctcctgcctccctcctccgcctcccttgagcgccatgatctgcacgcgatggacaggatcgacgggaccggtgattattggtagatcgagtggttaatcatgctgcatggcaccggcaccggcacggcggcaccaccaccacatcacagacgatgagacgagagaaaaggagagaggccatgcatgcatgggtggccgacagcaggcgcaggccggcacccatcccgacatgcgcactttatgcagagtcgacgcccatggatggatcctattcctatctacgatcctctagcttgctatgctatggtataacttgaattctccgatccagatgcatggattttagttgtggcctgggtcgtagtcgtagatcctgatgcgcatggcgatggcattgttactcgttactgctacatcatagtacacacctctgtctggagcttcttgttgtgggagaggagggcgtcgttctcggcgcgggcggcgtccagctggcggcgcagcgcgtcgtagtccttctccagctgcttggtcttccaccgggcgcggcggttctggaaccagatggccacctggccgggctgcagcccccagcgcgcgggcccagctgcgccttgcgctccggctccaggcttgttggccaccctcggaagctgcgctcccagcgtgcgcacctgctccacgctcagccgcacgcttccgctcgccgncacgccgccgcggcggacccctcctcgtcgtccgacgcgccgccgccgcagtcctgctggtgctgcttgggctccgcgtgcaggtggccgctgccgtcgtcacacatgccgtcagggtacatgcgcttaatgccggtggccagcattggaggcggcggcgcggtcatggcgccgccgaagtcgtggaggaaggggctgacgagcgccgggggagggggagccaggaggtggtcgtggccctcatggtgctggtgctggtggtgcgcctgctgctcctgctgcatttggaggaggaagttggcggcgaagaaggagggggccatgccattggttgccattggcttcatcgcaggagcgagaggaacatggggagggagtatatcgatcttccttcccacaccacagattgacacggggaaagagagagagaggggatggagctgctagaggttggttgggacttgggagctagcgagagtcttgtgtgtgtgtgacagagaggcagagctggaagaaactgaaagagtcncgggagctgctaatataatgcaaattagcaacattatatatatttattgaacagatatttttgtggagtggaagaaaagaacactagacacagggagatggaaagggaattggagagtgaaggccgttcaaattacaaccggctaatgttaccggaatctgctaaaggaacctttgtaccaaccacgtactaccactgttgttgcatatatactgtaccacgaacatttccagcactcaacgctagctgcgcgcgtacagagaattgaaactgcctactgtgtgtgtctatatatatatatatatatatatatatatatatatatatatatatatatatataattgagttacttcacaacgacaacactactttgcatggcagcattatttatacataaagtcaaaaacaagactcaaaccataaaaaccggttgtttgactattgcagatataatttatagagacaaaaatattatagaagcagcagaaactgatacaaattaaagtcagacgaac

SEQ ID NO: 16995 - DNA, 1901 bp, Zea mays
aattcggcacgagggggatgtggagaatgaatcatctcagcgtgatgtttctgataagttaaagcagaaattagctaaagacacatccctggctagttggcatacgggatttcatgtatcattggacatgttgcctgagtatatccacatgcgaattgcagagtccattctcttcgctggcaaagcaataagggtgcttcgaaatccaagtcctagtgctacattgcaggatcctgtaatcagaactgtaggatctcatggaatgcaaagctctgtaggaggttctggtgtaccaaaagaactggcaaacttctctaacatcagagcagaagaactactgccacaagcagaagctgataaaattgattctatgctcaaggagctaaagcattcttctgaatttcacaaacgaccttttgagtctgctgtcggctcaatacgtacaattgcagctaatcatctctggcagctttttggtaaaagctagtggtggtacgtgctgatctcaacggtcatttgaaggcattgaaagattattttcttttagcaaaaggtgactttctccagtgttttcttgaggaaagccgccaattaatgcggttaccacctcgtcaatctacagccgaagcagatctcatgattccatttcagctggctgcactgaagactatcggtgaggaaggccagtactttaccagagtctcattaaggggatgctatcatatggtatgaaaagtagcacgtctcagaaagatctccaaaagcctaatgcttcagagcttccttcacaaggaaaagctgcatcagaattgacacttgatgggtgggatagtattgctctggaatattctattgactggcctctgcagctcttcttcactcctgatgttctgtccaagtatcgcaaggtttttcagtatctcatccgattgaagaggacacaaatggaacttgagaaatcctgggcagctgtaatgcataaagaccatgctgatttttctgattattgcaaggatcggaaaaataactctgcaacacaactgcgtcgacaacggtctaagcctttgtggcgagtaagggagcatatggcattcttgatcagaaacctacaattttacatccaggttgatgtaattgagtcacagtggaatgttttacaatctcacgtgcaagattcacatgattttacagagctagtgagctttcatcaagaatatttgtcagcgctggtttcccaatccttcttggacatcggatcagtctctaggatactggatagcataatgaagctttgcttgcagttctgctggagcatagagcaatatgaaactcggccaaatatttctgagattgatcacataactgaggagttcaacaagaagtccaattcgctgtacactatcttgaggagtagtcgcctcgcgggtagtcagagagcacctttcctgaggcaatttctgatgaggctaaattttaactctttctttgagaccaccgcaaggggagtgatgaattcaggaaggctgcgaccaatcactgcaggtgctcagctgtaacggtgatggtatgtttgggggtagtgctgcagcaagagacaagggaggagtttctgtagtttatgtaaattatgatcggatggtggttgtctgtcatggaaaaatcgattgcaggtgattcatgcttgtgccgttggtattgtgtttttctgtgcttccgtttgttaatgctatccagttcctgtggcctgaactgtaccttcgcaaattatacgctcgttcaccgtggggatctggctgacagatagtgaactgctgccactcttttttttttttactaaggccgctgccacttctgagctgtgagatgccatgtctatcaataataacggtaaggagtattct

SEQ ID NO: 16996 - DNA, 2678 bp, Zea mays
atgggtacctcgagccggccgggaaaccccatccaaccggtctcgagtctcgacagatcggcgtcgatgaccctaccactcgctggccctcccacgccttccccggcatggccgagcccaccccaccgtccctcccctcgtccgactgcgcagacgtgctcgtgggatcctccgccccctccttcccctacatccgcggctggtcattcccctccgactcgggcgctgccatgggttctgtagaggaacatctccagcccaaggtgtgcgtgcagacgagcacctccgcggggcttgagcagatcctgccctggctcttctatcacaaggtcgtcggcgtcgcgcagttcctgctcttcgtggagggcaaggcggcgaaacccaatgtcgcgggagtcctcgagtcaattcctggggtaaaagtggtgtacagaactaaggatcttgaggagcggcaggcacggaggtcagcttcgttttctcagtcccctgtttccgataacagtttttcttgtgtgtcatttgatcatttccacataaacaccatataaaaaaataactgcatcttgtttcaactttcaaagtgagaaccaaaagcatagggttgctggtgtagccagacaaaactaagtcagaccgcatccaaccattgacaattatggataaagggagaaattttctatgcctagttgcctactattaacccacttctaggacatgtcgaagattgtttaatagggaatatacgtggaatttagacaggtttgagccctcgatgtgagataataccctacatcatgtttgaggtggttctgttgttgtattgtatgttctaatctgatgattctatgatctgatgctctcaggcggttccctgtccctcttttaatattctaaggagtgacggaagttacatgataggcaccgagtcggctatcaagttcatgatggaaccgagtcggtacaaagtcatacgtgaattgaattctatgtcttcgagtttatctcttattctgttgagatcttactatatctgcgcttctagaatcctcctggttgtaggctcccctggtcctattgccgagtccttcggcttgtggccgagcccatgagctcttttgctcaggctcttctttacgaagcttggatagatgtcctagtatatattattgataggacatagcatgtcataatgtctggcttggcatgttctttgatagagtttttatcactcatctctgtcaccttcctgatgtattttattgcctcgcctccggtcgaatctggaatgagacttggctttcaggatttttctacaaaccttgcaactatgaactctttgtgaagcaatccctcaacatggagatggctattgtaatggctcgggatggtggcatggattggatcatacatttagacactgatgagttactttatcctggcggagctgctgagtattctgttagacgtttgttagctgaggtccctcgtgatgtcgacatggttatttttccaaactatgaaagcagtgttgagcatgataatataaaagatccattcagcgaagtatctatgttcaagaggaattatgatcatcttcctaaagatacttactttggcatgtataaggaagcgacacgaggaaatccaaattattttctcacctatggtaatggaaaatctgctgcacgaattcaagaccatctccgtcctaatggcgcgcacaggtggcataattatgcaaagagcccaaatgagatcaagttggaggaggctgcagttctgcattatacatacactaaattttcagatttgacatctagacgtgatcgctgtggatgcaagcctacaaaagaagatgttaagagatgtttcatgttagattttgacagagcagcttttataattgcatcaactgctagtgaagaagaaatgcttcgctggtacaatgaacgagtcgtgtggaccgataagcagctgaacttaaagcttctgaggaaaggagtgctgactcgcatatacaccccaatgacaattgttcagagtctgcgcgaatccggtgtcttcacttccgccattacagctggccaacctgctgtgaatgccaaactctcacccaaggaaaccaatgcgcagagccaaaatgttaccgcacctgggaacatgacaagagtggtcagatctactgattcaaaggcatcaggcagaaagatactgcaagccgttgatcttgccttcagcgatactaatgtaactgctgttccaccgttgtcgccgcccagtttggacgaacacaggcatcatagtgaataataatgtcatacgtatgatatatatattttttgctcggcgtataagctcctaagaaaaggaagaaaagaaagttactgacatcttcgttaagagaagtgctaacatcagcttggatggtcaatttttatgcaatctgcggcagcgaaattctggcaggcgtcttttttcgcgatcgaagtgagatgcgggtgcgggcaacattgatagatagtgttttactggaaacaaaacatatttttagcaattttgtacaaaatctttatgaagttattaaccatatatggactttacttttcgaggggaactgttccacggcaagaatctgttaatgggtggagtagggtggtctttttaatgggcttgcc

SEQ ID NO: 16997 - DNA, 1560 bp, Zea mays
actaggtgcacttcatctgaaaacttagagaatgagatttttagcatttttacaactcaccggcgacagcagctttgagcctacgcgtcttctcctctagttgggagcccatagctgtcgctgggccttcccgtgaacaatcgtggggcagacatcttctagagtccctagtgaatgtcgagagctatcaaccccaccgatgcctatatgttcagaggtctcaacttccatgcagagcagagcaatagtagtactaaacaggccagcctctagcacggaggcggatggcccgggaggccatggctctcagggtgtctcgtgctgtggacacggcgtcgcgtggctgcctctcctgctcaggctcctcaaaggcattcacgaactcctcctgttgcaacctgtacgccaacgccgcggcatcttcagattgctctaatcttgtcaacagcagctgcgaggcagggacgaagcccctcctgctgttactgcttcttgcgctgccatatgtgctgacgatgaagttcgcactggcgccgggttcgatgaagctgcttcttgtcctaccctcgctgctgatgaagccgctgccgctgctcctgctcctagttctcataccggggccaccttgtgagaacctattagctctcacatcgtccttgtcgcatggtgaaggtgatgagctcgaaccctttcttgcctcaacctcactgggaaataagagctgaatggtgttccagagcacagtgttgatggtgcacgatttcgagctgctgatgaactgcctgcatttgggacaccgtttcccgcacttggctgcagcgtgtcttaagcatctcatgcagaagctgtgtccacaaggcgtagtggtcggctcaaagcagatgtccaggcaaatcgcgcaagagagctcctcccggagccgatccatgcacggcatgtttgccgcggccactgctttctcgccagaaccggacgcctccttgtcgcccacaaggacaggcttctcttcctccttggcggccttcacttccgatttgctatctgccgcagtgtccgacttttcgtcgtcgagcgcgaaaaccaccggcgggatcttggccggagacagcctgcgcggcctcctcttcctggtgctggatccggcgctgccgccgacggaggaggtggaggcccgcctcttgcgacgggagtcgcggactggggtgtcgtcgacgaccatcgcggcaaggaggacggactcctcgtcccagccggccagcgcggcagccgaccggaaccgtgggctgagcaggtcggcgccattcttgggcgccgccggcccatggcgacgcggcgctgatttggggctgctggccgcgtctctggacgccatcgttagctctctctctctctctctcttctctctctctctctctctctgaagtggcgaggctgaggggaaagaaagcaacggtcggcgatcgggagtttcgaaatggcggcggcggcttgctgcgcactgctgaagtggagtcgcattgttccgacaaatctcgtcgaaatttcaaaataatcttgtag

SEQ ID NO: 16998 - DNA, 1739 bp, Zea mays
aaaccccaccacaaccggtctcgagtctcgacagatcggcgtcttcgatgccgccggcgcaggcgccctccagcggcggcgccgcgtggcgccagctgctcctgctcctgacagtcctcccgctcacgctcgctgcgctggctttcgtgctccagtggcgcggcggcggcggcgtcgatgaccctaccactcgctggccctcccacgccttccccggcatggccgagcccaccccaccgtccctcccctcgtccgactgcgcagacgtgctcgtgggatcctccgccccctccttcccctacatccgcggctggtcattcccctccgactcgggcgctgccatgggttctgtagaggaacatctccagcccaaggtgtgcgtgcagacgagcacctccgcggggcttgagcagatcctgccctggctcttctatcacaaggtcgtcggcgtcgcgcagttcctgctcttcgtggagggcaaggcggcgaaacccaatgtcgcgggagtcctcgagtcaattcctggggtaaaagtggtgtacagaactaaggatcttgaggagcggcaggcacggagtcgaatctggaatgagacttggctttcaggatttttctacaaaccttgcaactatgaactctttgtgaagcaatccctcaacatggagatggctattgtaatggctcgggatggtggcatggattggatcatacatttagacactgatgagttactttatcctggcggagctgctgagtattctgttagacgtttgttagctgaggtccctcgtgatgtcgacatggttatttttccaaactatgaaagcagtgttgagcatgataatataaaagatccattcagcgaagtatctatgttcaagaggaattatgatcatcttcctaaagatacttactttggcatgtataaggaagcgacacgaggaaatccaaattattttctcacctatggtaatggaaaatctgctgcacgaattcaagaccatctccgtcctaatggcgcgcacaggtggcataattatgcaaagagcccaaatgagatcaagttggaggaggctgcagttctgcattatacatacactaaattttcagatttgacatctagacgtgatcgctgtggatgcaagcctacaaaagaagatgttaagagatgtttcatgttagattttgacagagcagcttttataattgcatcaactgctagtgaagaagaaatgcttcgctggtacaatgaacgagtcgtgtggaccgataagcagctgaacttaaagcttctgaggaaaggagtgctgactcgcatatacaccccaatgacaattgttcagagtctgcgcgaatccggtgtcttcacttccgccattgcagctggccaacctgctgtgaatgccaaactctcacccaaggaaaccaatgcgcagagccaaaatgttaccgcatctgggaacatgacaagagtggtcagatctactgattcaaaggcatcaggcagaaagatactgcaagccgttgatcttgccttcagcgatactaatgtaactgctgttccaccgttgtcgccgcccagtttggacgaacacaggcatcatagtgaataataatgtcatacgtatgatatatatattttttgctcggcgtataagctcctaagaaaaggaagaaaagaaagttacaaaaaaaaaaaaaaaaaaaaaaaaaagaaaaaaaaaaaaaaaaaagcggcc

SEQ ID NO: 16999 - DNA, 1589 bp, Zea mays
cattgggtacctcgaggccggccgggaaacggaagtttaagttattcccaaattgaacggcccaaagggaaaccccaccacaaccggtctcgagtctcgacagatcggcgtcgatgaccctaccactcgctggccctcccacgccttccccggcatggccgagcccaccccaccgtccctcccctcgtccgactgcgcagacgtgctcgtgggatcctccgccccctccttcccctacatccgcggctggtcattcacctccgactcgggcgctgctatgggttctgtagaggaacatctccaacccaaggtgtgcgtgcagacgagcacctccgcggggcttgagcagatcctgccctggctcttctatcacaaggtcgtcggcgtcgcgcagttcctgctcttcgtggagggcaaggcggcgaaacccaatgtcgcgggagtcctcgagtcaattcctggggtaaaagtggtgtacagaactaaggatcttgaggagcggcaggcacggagtcgaatctggaatgagacttggctttcaggatttttctacaaaccttgcaactatgaactctttgtgaagcaatccctcaacatggagatggctattgtaatggctcgggatggtggcatggattggatcatacatttagacactgatgagttactttatcctggcggagctgctgagtattctgttagacgtttgttagctgaggtccctcgtgatgtcgacatggttatttttccaaactatgaaagcagtgttgagcatgataatataaaagatccattcagcgaagtatctatgttcaagaggaattatgatcatcttcctaaagatacttactttggcatgtataaggaagcgacacgaggaaatccaaattattttctcacctatggtaatggaaaatctgctgcacgaattcaagaccatctccgtcctaatggcgcgcacaggtggcataattatgcaaagagcccaaatgagatcaagttggaggaggctgcagttctgcattatacatacactaaattttcagatttgacatctagacgtgatcgctgtggatgcaagcctacaaaagaagatgttaagagatgtttcatgttagattttgacagagcagcttttataattgcatcaactgctagtgaagaagaaatgcttcgctggtacaatgaacgagtcgtgtggaccgataagcagctgaacttaaagcttctgaggaaaggagtgctgactcgcatatacaccccaatgacaattgttcagagtctgcgcgaatccggtgtcttcacttccgccattgcagctggccaacctgctgtgaatgccaaactctcacccaaggaaaccaatgcgcagagccaaaatgttaccgcatctgggaacatgacaagagtggtcagatctactgattcaaaggcatcaggcagaaagatactgcaagccgttgatcttgccttcagcgatactaatgtaactgctgttccaccgttgtcgccgcccagtttggacgaacacaggcatcatagtgaataataatgtcatacgtatgatatatatattttttgctcggcgt

SEQ ID NO: 17000 - DNA, 3655 bp, Zea mays
  misc_feature (3131)..(3131): n is a, c, g, or t
tgcatggttagttatctagtcatataataaagaaaagagcgaaaatagaggatgtggtgtatgggcaacaaatcatgatgctcagaggtggagctagagggaatgtgaggggatgcacttgccttgtgggtgcatagaattttatcgtatgggtgagtatatgttttttcgtggctgcacccgcacccccacatgatgcatagatccacccctaatgttgtcctagcatgcccaaaaacaatagcagatcaagagattctgatgagatcacacattttcgtctatattataagatatttttggttaccgcttttagcaaggctagtatctcatgtactgcaccagttgcaacttactaacttacatcaactaccgtagtaggcgggcagtagcactgaataatgatcttatcacaactttttttttgcatggcaatgccttaccaggtatctatgttcaagaggacttatgatcatcttcctaaagatacttactttggcatgtataaggaagcgacacgaggaaatccaaattattttctcacctatggtaatggaaaatctgctgcacgaattcaagaccatctccgtcctaatggcgcgcacaggtggcataattatgcaaagagcccaaatgagatcaagttggaggaggctgcagttctgcattatacatacactaaattttcagatttgacatctagacgtgatcgctgtggatgcaagcctacaaaagaagatgttaagagatgtttcatgttagattttgacagagcagcttttataattgcatcaactgctagtgaagaagaaatgcttcgctggtaatttcctaaattttctttgcttattaatattttttgtaatgctttagagacgctgcagctctgctaggttcagaatgtcactttattgattggaacaaggaagttagatatactaaaagttttcttaaatggattattttttataagagatttatgctgtgttggactgaacttccttaactttagagattgcttcttaaaggtttattcaagtaaaaatgtcctaaaaaatggaccacactgtaccatattctttaattccatctcatgtcttcttcctcagttatggtttatgtctacctatactagtacagtcctcatttggcatggtagttactcattcatgaacatgaaataactttctaactgaaagcacatggtaacaagtggatgcataactgaaataactttctaactgttaagcacatgccccaagtctaggctctggaccagcttgagaaggcgtggctcaaaactccaaaggctgaaagtcttgttaggttttttcaatagatactgtttttttttcatgacataatttatgaaacgtaattgtttggttcagcttttttctgaccagcttttttgagaatctggctttgtagagaatctgagtatcattaggattacgtgcggaggaagataaatgtgtccataaggcttaggatctagaagatggcggattcctactattgcaacgactcagccgattatgggtttatgttgattttgaatggtttttacccaagcgaattttatagaagctggctgaaaagctgagctttcgacagtccgtagcagcttttggtggccagaagctgcaaaaagccgaaacaaacaggggcaatgtattgcttcaagatgaaccagactgggaatagatacattggctgaaagcttaaaccgcagcctgccctgaatctggaataatcagactacactgtactatttcatggaaagatctaatatttacaaacacttttccagctgcctcttggtgccagttgcatgcattaaaattgtgtcggtccatttttttttctccacagagaaatggattttagtgttcggttcgctaatcttttttcttgtaatgtttcttgtttctttttggctaggtacaatgaacgagtcgtgtggaccgataagcagctgaacttaaagcttctgaggaaaggagtgctgactcgcatatacaccccaatggtgggtaacaatgctgccgtttgaagtcactaatcattttctgtgctatttaatgcttcacgatacttctcttttctttcccagacaattgttcagagtctgcgcgatccggtgtcttcacttccgccattacagctggccaacctgctgtgaatgccaaactctcacccaaggaaaccaatgcgcagagccaaaatgttaccgcacctgggaacatgacaagagtggtcagatctactgattcaaaggcatctggcagaaagatactgcaagccgttgatcttgccttcagcgatactaatgtaactgctgttccaccgttgtcgccgcccagtttggacgaacacaggcatcatagtgaataataatgtcatacgtatcatatatatattttttgctcggcgtataagttcctaagaaaaggaggaaaagaaagttactgacatcttcgttaagagaagtgctaacatcagcttggatggtcaatttttatgcaatcgagctttatttgtttcattttttaaactaaaattaattaatatctcgaacgaattttgaagaaacatttggattgtggtatatttcgtcctctccttgtactcgatgcatgtatatggtaaaaaccaacccagaccagaaggatgttgctctgacggtttggaacatgtggtttctttggcttttagggctagttcggtgataaagtaatcggagagaattaagggctggtttggtgggaaggggattgaggtgctatttaaagcaagagaggaagaaatacattagtatttaaaattaaataataagggatttcctttcctctcaacccctttgtcaccaaactatcccccaccgtctcgagttgtgagtgtacccggcaagccgataaatcgactcgccccaaaaactccctcaccctcgtctcatccttgtctaattgtaacatcccaaaatcctaacttgggaatttcataaaagtttgtccaaaatatttgagttaaagtttggatctgggattcaacttaaaacgagaaaacaaatgaataagaattttattagcttagtaaatatttcttggaaataaataagtggcaatatnatatatttttattttatcaaagatagatttgactctcaaaaccaaaagtcaaagttgaaaaatcttttaataaacataaagaatcctaatctcggatgagtgaattattctttggtctctctcatgaattaggcatcgatattattcaaataataaaataaataataaaatatcatcacatcttgctgggattattttgttttttttaactaagaattgaatttatttgaagttcaaattcaaaagaataaagaataggaaagaaaacaggaaaaaaatataaaaagggggaacaagacctatttgggccgaatctaccgtggcccatctccacctgaacggcttcatcgcgcgtacaccacccacgggtggctccctggcgtgtgggtcccacaccggcttcacactcacgccgcgccgcgggcactcgctgccatgtgggcctgtgtccttgtcgcctcgctgtgtcgctgttgcgtgggcccggttgccagaagcgtctccctcgcaccggactcgaaggg

SEQ ID NO: 17001 - DNA, 1764 bp, Zea mays
  misc_feature (1649)..(1649): n is a, c, g, or t
tgaacccataataaagcaaatcgacacgccaacacaatttagacaacacatacccactctatatcaataagggacccaccacaccagagagggtggtctgtccacatcatagagcgggtctatcgaccaccatggtgcacccactagccaagaacaacttcagtcttgtgttcgtgtttgaatattcttgtttttctttgggaaaacatacatgatggttgatctaagggttcacgtgacaagcatatggatctacctgtatccatgtataaatagaggctcacacacttccctctccattcacgtctcaagcttcaagcgaagagtagaataatttgtattgtatccttcgtagtgtaggatagcttagttcgggaatcttcatttttttgaacgaaagtgataggagctctgcctatcaattaagaagaagggagttaggatatgaacaaacggcgtgtctcgccaaagggtggcaacctaggagagaaaaaagactagggggttcacacacaggaactgctcccgccaggagcgtcccaacaccacccaggaattatagctgcaacctgggccacatcaaggaaacaaccctttcattgagttttttaaatggaatatcatcctttcgtttgaattttgaagaaaaggtgaacccccatgcatacgtctccattcacagacagccgcaatctagtcccatttcattccgcgtctatttcaagttgactctaaggtcggggctagctgttacgtgacatgatatgatccagagaaaaaggtccatcttccaaacgcaatctagtttccgccatgtgaatttcatcatcccgcaatggcgcctaccgttatatactccgtttcaggtctccagggcaggttctccgattcagcacctcgctggtgacttgcttcccgtgcatatcatcacttcctggcatctgccattagaagtctcattcattgagattcagacatggacagagggaaaccgacgccaccatccaacgtttgccatagctcggtccaagccatatacttaacgaattcatcccctttgaattaatgattctgccaagtaaacatatacccgttggtttttacagtaacaagtcaacaagaagaccaaaactttttttaagtcatcgagacaaagactaggatgtgcaaaatttcttctgtagtttcaagggtgtgcaaaattattgatcagtatctacgctactacactctcctttccttcaattacagggactacaccaagtttaccggagcagcttcagatccagccaagacataagcttagacgatggtccaaaacctgacacgggcgaaactggagcctgctccatggcaaaactggtattgttatccttgactgaaatggacactgtccatgaaaaagcctgtcgtgtcttgactgttgggcactctgatcttccaacttacacctagccctgtcagagtaactagcctaccatgccttcacaaaatgggagggcttccatcttatcaacaaaactaggtcatgaggtgtgcctttgatgaagagcgtacttgacaacctcgtagaaggaaatgaccataccaaccgatggaccagcgcgtgcaacacgtgggccaacgccggcgaacagacctttcatgcntccagacctgccagagaacaatataagcaagcaacaaatcacaattatgggtacattatagatgccccttaccaaaccaattactaaagtagaactaagggaggaatatgaggca

SEQ ID NO: 17002 - DNA, 871 bp, Zea mays
gtcataccagcgaagtttgatgccgggattttctgtagagagcttgggatagtccctgacagctggttgtcagcaacattgaactcctgtaaccgagcaagggcgctgaactgccctggaatttcaccactcaactggttatgctgaagattaagggtgtttaggtacgtgatgttataaatgagcactgggattccgcctgagaaaccgttgtaggagaggtccagagatgccaagaacggcacttgctgctggatgtctgaaggaatggcacctgtgaagctgttactcgacaggtccagcgtagtcatactggtacagttcttgagacctttagggaatgggccctgaaggccaaagttgctgagacgcaatgcgagaactcggttctcgtcagggtgccagcattccacaccaggaaatttgcatatgaaacccacagaggtattatcgaaaacccatgaggattttagtatgccagtaggatcggtcactgattgcttaacgtctctcaggcattggacatcaaggtcggaactgaaacagctgctacttagcagcaaaagaagaagagcgcctagacctagagcgaaatgatctgtcatcgagcactctggcggaacaatccaacttctccctggtgatgttaccacgccacttctcgattcaagctgcaacagaagctgcttcctgcagccctggaggaaacctgtagcccggcgcaccaggggagagagcgcagacgggaagagaggaggtgacgtcgaagctgcaggttgagggaggtgaggggagaggaagaggactcgaggtctggagtcggaggactagagcgagccaccgcgagcgccccgccgcgccctagaactag

SEQ ID NO: 17003 - DNA, 4040 bp, Zea mays
ttttaagtccaatatgatcatatcagtttaatatgaaatgactttacctgtaacaaacttacaagtaacatgtgtctcgtccccaaattggttacatgaaaattatcctttacagctactatcatctccaaagggcgggtaccaactaccaaccacgctacaacaactatacagcgggatgctactaattggaacatacatcttataagccatcttactcacttcatcattactataactctcttggaggggggaaaaagaagacgttcagtcttgttttgtcttctgctacataagtatgattttgcaattacttggcaacaatgagctcgtccagtgtcacaccgtcactgtccgtgctaagaggtggcagcaccaggtcatcatcggcagtgaaatggtacctttcgccaatggctctgaggagctggtaaacctcaaacatggttggcctctccttcggggtggcgagcgtgcaggaacacgcaactttcaggaactgcatcagctcaccatcagcgtccttcgccaccagcgacttgtcgatagcatcttggaggagtgcgttgttggacagatgactgatccattccactaggcttcctctgaaattctccggggctgaggagacgtgggtgggcctctcaccggtgacgagctcaaggagaaccacgccaaagctgtagacatcgcccttgggagtagccaccagagtacgcgcgtactccggcgccacgtagccgaggtctccgaactccccgttgacaaaggtgctgagatgggtgtctattgggttcatgagcctagcgagaccgaagtccgatatctttggttcgtagtcctcgtccaggaggatgcacttggagctgatgttgcggtggagaactcgagggttgcaggtatggtggagatacgcaagccctttcgctgcaccgatgccgatccgtagcctcagcgcccagtccatcttgctaccttcctctttgtttagctggtcgtagagcgagcccaagggcatgtgcttgtacaccagcaacctctccttcttggcgacgcagaatcccaagagcggaaccaagttccggtgcctcacctggccaagtgtcttcatctccgatgcgaactgtgattcggaatgttgcgagtcctgtagccttttcacggctaggaaggagccgtcaggcagcaccgccctgtacatagtccctgtcctcccagtaccaatgatgttctctttactgaactcgtctgtggctttcatgagatcactcagtttcatctttgaaactggattctcaaacatagatacctggataataatagaaatgatcattatgtcaccgagaagttcctggttactttttgtgagaaaggttacttagaaaaaaagaaaataaaaattcaaatgataagttaacaacttgccttgatagtttttgttcctttgatactcttcgcccacttattatcatcctcatcctttgccgccttcttggccggtaccctccgcagacaaaagaacacaactattgcaccgataatgacgacgactaccacgccaacaacagccccgatgatcgatgcagtgctcttgctcttcgctgaggcttggcattcacctaatggaggcccacacagtccgtcattaccagcgaagtttgatgccgggaatttctgtagagagcttgggatagtccctgacagctggttgtcagcaacattgaactcctgtaaccgagcaagggcgctgaactgccctggaatgtcaccactcaactggttatgctgaagattaagggtgtttaggtacgtgatgttatagatgagcactgggattccgcctgagaaaccgttgtaggagaggtccagagatgctaagaacggcacttgctgctggatgtctgaaggaatggcacctgtgaagctgttactcgacaggtccagcgtagtcatactggtacagttcttgagacctttagggaatgggccctgaaggccaaagttgctgagacgcaatgcgagaactcggttctcatcagggtgccagcattccacaccaggaaatttgcatatgaaacccacagaggtattatcgaaaacccatgaggattttagtatgccagtaggatcggtcactgattgcttaacgtctctcaggcattggacatcaaggtcggaactgaaacagctgctacttagcagcaaaagaagaagagcacctagacctagagcgaaatgatctgtcatcgagcactctggcggaacaatccaacttctccctggtgatgttaccacgccacttctcgattcaagctgcaactacacaaaatcaaattcgaagccacggaattagagacgctggttttttttccaaataataaatactagtaaaataaactagagagatatgtactaatttttaaatggtgactgcagccagtatggggacacgtccgttgccttgctacttctgtctttcactgcctaaaatgcgaaaattcaattcaaacttggtattatcgacaatgccaattattgttgaactacacacaagcaacgtcagcaaagaaccgatccccattccccactagagacaatcaaataagacgagttggcagcttttgttacgttttttcttcttcgacgaagaataagtgcggccagatggatggaaagcaaccaaaaaaaaacgagaggcagatgcagatcatgaacaaatcgacggttctatgtaaaagctgtcgacaagctttctaattagtctcttgatctctcatgctccctccaaccgcaaaaaaggcgcaaaacttttagaagaaaaaatctgaggaaaaagatctcccgaaagcgggcaccatagagcagcacatgctcctccgcctttctctatgatttcacacgccgtgtcgttctttttaaaaacagcaccttttgattgtcgcagacccttccttcctgaggacaccaacccgctagaacgaacgcaacacacagggtttctcccccaaattccagcacagtactatgcgaaaacgcaaaattgagcgcttcgttcccttgccatgactgacggacagctcctctcgaattcaagagccatcgatcggccagaccagagcatgcgatatcgaaccggaccgcggcaaattttggaagaacaataataattgacccacaagaaaggtagtttaagcaaacaggtgagaggacgagacaagtgagggagggaccggttccatgggtgctcaccagaagctgcttcctgcagccctggaggaaacctgtagcccggcgcaccaggggagagagcgcagacgggaagagaggaggtgacgtcgaagctgcaggttgagggaggtgaggggagaggaagaggactcgaggtcttggagtcggaggactagagcgagcgagcgagcagagctgggccggtgtggaattagaaagcgagacgagagttttcaaagcgtgtgggggccagcggggcccgcgagagaggtggtggtgtgctgactgctgagtgcctgagtgagggtgagcgaggccgggagcccgggacgcgcaaacaaacgactttcccgtcaactgtcccagtcccagtcagtccaccccgccggcctttccttttctctctcatctgtcactgtgtgtctgtgtgtgtgatcgaacggaccagaatgacagcggataggctgtggagtaaatattcgcctcatagaaattgtttatcagtacccatatccatatgctgtttgtggcctctaaattttccctatatgccttactatacacccacatcatctagattacactctctattttttccttcctgcgccggttccctcaaaattctctccctaaaccctaatataaccttaaaatattattttcaatacttattcattatccaacattattttttgttcagctaacaaataatgatgtgcacaaacttcgagacaaggaggcttcacagtgcactccttgttctggagtgatatcatgcgcagcaggagaagtggaggaagtagcgctgcacc

SEQ ID NO: 17004 - DNA, 3019 bp, Zea mays
tgcagcacagcggacgccccaccgcactatacaccgggtccatgcagccttcagatcgtccacctcctgctccgatcggggaggcggagcgtcgctgcggcgcctactgagagtctgagaccgatccccgacctagccgcggtaaataaatacccgacttcgccggcgtccgcgagcttcgagaatacatccttccccgcgttttaccctaacaacctaactagctgcggttctccactatcactcgctgctactgcacctacttcctttccgctctggtactgttgctggcttgctgctgctcttggtggtggtggtggtggcaccgaaaccctagcccttgccctcatgtcgcagcaggaggctgtggacccgccttcggcgacggacgagcggctgggaggtctaccgcggagcggctccaccagccgcctcaacgcgcaggcgccggagttcgtgccgcgcgctgccgcggttccccctccccctccgcagcagaaggtggtgcgtttgttcgcgccgcctccccacgcggcgttcttcgtcgcggcaccccggcccccaccgcccccgttcgagtactatgcggcggttgccaccggtgggggtggcaggttcggatccccccgccgctgctgcagagcaggaggccgaggctgagcagccgccgagggacgggagctttgatgaccccgtgcccaagatcagaaagcaggtggagtattatttcagtgatataaacctggccaccactgaacatttgatgaggtttatttcaaaggatcctgaaggatatgtgccaatatcagttgttgctggctttaagaaaattaaggctttggttcaaagtaactccatgcttgcttctgctcttcggacttcatcaaagcttgtggtcagtgacgatggtgcaagagtaaaacgtgagcaaccatttacagaattggatttagaagaactccaggcccgaattgttgttgcagaaaatctcccagatgatcattgttaccagaacctgatgaggctcttttcagttgttggcagtgtcaggacaattagaacttgctatcctcagaccccaaatggcactggtccagctactaacagatctgcaaagctagaatatgctttttgccaacaaacttcatgcttttgttgagtatgatactattgaagatgcggctagagcgattgtagaacttaatgatgagaggaactggagaagtgggcttagagttcgattgttgagcacttgcatggtaaccttccattgaacttcattaattgccgatgagatggcttattggtgttcaaccgcttgtacatacatattacaaggaatattccaaaaatcctctggggcctcggaacagctatacaggaatcatattacaaagccctggatgaactctgcagaaatacatttattttgaatctactttttagtgaagcagataccacccaatgaccgaccagatccatagggggtgatggggataacttcttttggaaacttgaaagctctcttgaactgctgtgctatagcattataacacagttttttcttaaaaaatcagggagaagtctatggccatccaacgttcatatttggtgattcagctattttgatgggtggttttggtgacgtggatgacaagtggcagtcagccccgcttgtcatcattgttcaattttttagaatggctcaaaatggagaaatgaccaaaaccaaagttgttatagttgagatctactttgcacttgacttgttcatttgaaattatttacattctcaaaactctgtttgacgttctcatattttgaaatccaaaattttcgaactgttcaaattaacttggatggggaaatgacccaaacagaagatgtagatctcatcgatgagatctacaactttgtagctggcaactttttttagtgaaaatcatttatggtccccaaattttgtttgaagtcaaattttgaagttcaaaattttcaaacctccttggatggagaaacggccagaaacaaagatttacttctccaccagatggagggggaagaagataatgctgacatgtgggcttgctctttccctaatttgtttttgtgtcacaaaacaattttctaatttatttgctgcctgctctttgcaattgagacaaagggaggtaaagggaaaaagggtgggcatgaatctgatgggtatggtgacgaggagaatgtctctacttctgatcaaccatatgataaatatttagaagaaacacctcagatgtcagatgtgcctggagaacacatgactgaggatagcgctggagatatgggacgaggacgtgtccgggggcgtggtcgtggtggcaggggccgggggcgtggttaccatcaacagaacaacaatcaacaccaccagcactaccaaaacagtagccaccacagtaacagtagtagtacccgtccagtgggaaccccaccgccatctggccacccagtcatgattgagcagcagcaacagcagcaggcagctcaaccacagcccctcacagcggctaacaaacagcctccaggtcctcgcatgccggatggctcacggggattcagcatgggcagagggaagccgcaaacattgacgcccagagtatccgagtctgaacctgaacaatgaattcgaacctcgcagagagactaatgggttccggtttgccatgttgatacatatgctgagagacttgccttttagaagtctgtcctcgaggtcgctttctaatttatgggaccatatacatttctgcatgtgctgtgtgtgtacttccaaagccagcagacactggttcgcgaatagtacggttgcggccattctgtaattccatttttgccccccttatgcagttttgggtgcaatactgaaaatcaaaaactcatgctaaaaaggttgaaaagaatcgagtcgttgtaaaataagattgtttcttcgctgtttgcgggggactgatcaaaaaaaaaaaaaaaaaaaaaaaat

SEQ ID NO: 17005 - DNA, 1165 bp, Zea mays
caccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagccgtccgcggcgaagaagccggcggcgcaccctccctacgctgagatgattgtagaggcgatcgctgccctcaaggagaggaaggggtcgagctcggtggccatcagcaagtacgtcgaggggaagcacggcggcaagctccccaccaacttccgcaagcagctcaccgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaagcccaaggccaaggccaaggccaaggccaaggccaagcctgtcgctcctgccgccgcgtcgcccaagccccgcgggcgccctcccaaggtcgccaagacctccgccaaggcctcccccgccaaggcagccaagaaggcggctgctcctgccaagaaggggaaggcagcggcggctcctaagaaggtggcaaccccgaagaaggctgctgctgccgctccggccaggaagggcgtggccaggaaggccaagaagtaggctgcctgccttgtcgctggcgagatcccccctcaattccgcctatagattcccctcttgcctggattttgatccaatcgtaatattgtcagtagctctagattcgtcggtagctccagcatgagtgtcggtggtagttctgtgcctgtaaaaacttgggatggttgatcgcgtgtgatcagccgtcatgctcctccagtctctatgaacaagctaagctataatagtattttgcttcctaaaaaaactacctgaaaaggcgcccgaccgccgctctcttttattttgtatctactactactactcatttgcgagtgagagatggtctgggcacaccattcaatt

SEQ ID NO: 17006 - DNA, 820 bp, Zea mays
  misc_feature (23)..(23): n is a, c, g, or t
  misc_feature (52)..(52): n is a, c, g, or t
  misc_feature (61)..(62): n is a, c, g, or t
  misc_feature (113)..(113): n is a, c, g, or t
  misc_feature (141)..(141): n is a, c, g, or t
  misc_feature (152)..(152): n is a, c, g, or t
  misc_feature (188)..(188): n is a, c, g, or t
tgcctcaagagagaagggtcgantcggtgccatcagaagtactcgagggaanatgcggcanntcccaccacttccgcaacagctcactgtcagctgaaaagctcctccgccgnaagctgacgaggtgaagactccttcaantgccgccaccncgccaacccaagccgccaacccaagcacccaagccncgcccaagcccaagcccctcgccgaaggcgaaggccaagaccgctgcgaagcccaaggcggcgtcgcccaaacccaaggccaaggccaaggccaagcctgtcgctcctgccgccgcgtcgcccaagccccgcgggcgccctcccaaggtcgccaagacctccgccaaggcctcccccgccaaggcagccaagaaggcggctgctcctgccaagaagggaaaggcagcggcggctcctaagaaggtggcaaccccgaagaaggctgctgctgctgccgccccggccaggaagggcgtggccaggaaggccaagaagtagtctgcctgccttgtcgctggcgagatccccccctcaattccgcctatagattcccctctttcatggattttgatccaatcgtaatattgtcagtagctctagattcgtcggtagctccagcatgagtgtcggtggtagttctgtgcctgtaaaaacttgggatagttgatcgcgtgtgatcagccgtcatgctcctccagtctctatgaacaagctaagctataatagtattttgctatcctatgatccccgggttgttggcttaaaaaaaaaaaaaaaaaaaaaaaaaagaattctaaaaaaactcgagagtc

SEQ ID NO: 17007 - DNA, 4725 bp, Zea mays
  misc_feature (1431)..(1431): n is a, c, g, or t
  misc_feature (1748)..(1748): n is a, c, g, or t
  misc_feature (1935)..(1935): n is a, c, g, or t
  misc_feature (2167)..(2167): n is a, c, g, or t
aaggctgggagcgtgtttgttctctgatcccttgttgctcgggtgtctaggtacgtttagggatgtagtctgttgaaagtctcctagagggggtgaataggcaagcgaaaattttcaatttgttcctaatgcaaagtattttatggtctcaaatattatttttaaaaatgttagaacattaattgagttctaaatttataattacataacatacaaatgattcaagataagattattgcgcccattagatatgtgctaggaatcttatgccctttatttggtataaacttaattgtggccgatcacatgtttagccttcctcttatgcggtagggcccacaccttaacatattaactcttcacggtatcaccgacgcgctttctctcagatccaggttctctctccctttcaactccggtggcggcgagagcaagtagcacaaacttatgtgaaagcgactccaaactacgatggatccccaggcaagtcaacctctcagctttggtgacactcaacccgttaactcttcatagggtcacgtcgtgcgctctcttggatccaaagtcttctctttctcagattcagtgacaaagagggtaagtagtatggactctggttgcagtgacggcgccagatccctaggcaagtcggcctcttagattctatgacgccttgacctattaactcttcatagggtcattattatgcttcttctcagatccaaattctctctctttttcagatctggtgacggcgagggaaagtaacatagacttcagtggcagtggctctagactacaacgcaccccgagcggatcaaccacatagattgattgtgcactgacatattattcataggaccactaatgcgtatcctctcagatccaaactctctcacccttttcagatctagtgacattgagggcaagtagcaagagtttggcagcagtcgtggactacgacggatccaaacaagtcaacctctcagatctggtgattccttaacctattaacttttcaaaggatcaccaacgcgcttcctctcagatccaaactcttttccccttttagatctggtgactacaaggtcaagcagcacaaactttggtggtagcagcttcagactacgaaaggtcgccaagcaagtcactcttctcgccccctctttttatttccctctcactcacaactcgaggcatggtggtttggggttgaagaagttggaccttgcgatgtaaggttgaagaagcggctttggacctagggtctctttaaatagagttgaagaaggaaccataaatttagtgttggagggtttgggggttggagattagtttttgataggacattaatcttaaagagaatggctaagttagggtgggtagctagtccaggtgtcggcgacgtcttatgacttaaggtggagaatntttggcagggaagaccaacgatgggagcgagcggttgtctcgttcagtagggggcatgaagaacaatgatagcacgagcgagcggtgtggctcaacatctggggtgttgtgagcctattgaaagtggatgagatcaacagtggggaatgacaagaattgaattgcaattttttttcttttttcccctctctatagctatgtgtggtcggtctaactacatctttcctccctcacacaataatctatatggaaacaacacaactttctcagatcatctccccatgtcactctagcctgctttaaaaagcagcaaaaanttttgttaatatgaatataatatgaaaaaaggaacaaattttttgaatgtgtttcctaggacacctacatgaatgcctaaacttttttatatggtgtcagtgctcactatctttcggcattggcattttgaaatagtattgactcctattttgacgagcactacatacttcatcagaacctaacatncttgtatagcaatttaaaaaggtctttcgacattctatatccatgtgcccggttaatcactcactcgactcgagcattctagaaaggaatatggatgcttttctttatttctttttcttttttacatctgaacattactttgatctcgcattaacaaagtatatacttgtgtgccgatgccacattcgttgttgctaaatgctaattaggtgaaaattctcgtctttggcangagtaataagcaggattcaaagatgatggttacacgagagcatccaatgaggagcagggaatgccagctttgccatgaaaacccgctctcttcgccaagcatgaccaaagtaagaaactctttttgaacgaagttcttgtaatcttcattctgcatttgcaccagttttcgatttaaattcacgctgccattatccatttatgattggggaaaaaagggggggatctagctaggtgaaatccaatgcttcacagaacccaatcactattctgccttcgtgctgaatgcacaagccactagtatcccacttctttgatcctgacaacggtgtctagatgctatacgtgacaggcctcgatctaccctttttttttggttagctgtgcataactgaacccaccacactctatgtgctgcggtacacggcaaaaacgagcccgttgcacactgacgctgtaccgtgacagccgcaccggaccagccaccactcgatcggcaatctctcgctcgattccgaaccaaatcgaacgcgaccactcccgttcgaaagacagtttcggggtccatgcccgcaccaaatttcgcccgaaacggctggccgtgccgggagaactggcgccccaaagtcggaggagaagcacacctgcacggagattcccccgaagcagacctgccctcaccgaactcccgatttctccctgaattctcgaccaaatcagacgagaccacccgcatttgaaagctagtttagtgacctacaaacgcagagagtttcaaggcgaacggtggatcacgtcgcgagagaggagctcggggatccgggggagaagcacagatgcaacaggctagtggcgtccacccaggagcagggccgcgcgccagcgcccccccccccgagccacgggcctgggcgagcgtcccccccgcccgttggatctgggcgcggcgcggcagcgatccgcgtgcgaacccgctcggccaatcgcagcgcggcgctacgtccctgagcctttccacccgcctccgctatttaaacgcccgcctcctcgcggccggccgggatcagtcttcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgaggtgaggtttagtccgttgcgatctagccgattcgttgcttcgttaggatcgtctcctcttatggaatctgttggattgattctgtcgctctgttctgttcatgtccgcgaattcgatattgaatctgagacgcaacctgttgggtctgtctggctgcagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaagcccaaggccaaggccaaggccaaggccaaggccaagcctgtcgctcctgccgccgcgtcgcccaagccccgcgggcgccctcccaaggtcgccaagacctccgccaaggcctcccccgccaaggcagccaagaaggcggctgctcctgccaagaagggaaaggcagcggcggctcctaagaaggtggcaaccccgaagaaggctgctgctgctgccgctccggccaggaagggcgtggccaggaaggccaagaagtagtctgcctgccttgtcgctggcgagatccccccctcaattccgcctatagattcccctctttcatggattttgatccaatcgtaatattgtcagtagctctagattcgtcggtagctccagcatgagtgtcggtggtagttctgtgcctgtaaaaacttgggatggttgatcgcgtgtgatcagccgtcatgctcctccagtctctatgaacaagctaagctataatagtattttgctatcctatgatccccggattgttgacttattgttgtcaatatttttttggttgcagaagggggggggggccgttaaaaaaaaaaaaaaaaaaaaaaaaaaaaaaaaaaaaaaaaaaaaaaaaatgaataaaatataaaaaaaaaaaataaaatgaaaaaaaaatgaaaattaaaaaggttagtgtttgtggaaaaaaaaaatttttattaaactgattgtgcaatagaaagaaattttcctttgagggaacgttagtttaaaacaa

SEQ ID NO: 17008 - DNA, 1775 bp, Zea mays
  misc_feature (1246)..(1246): n is a, c, g, or t
gcacgagaccattacctagaacatcctaatcgaaaagtctcatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaaacccaaggccaaggccaaggccaagcctgtcgctcctgccgccgcgtcgcccaagccccgcgggcgccctcccaaggtcgccaagacctccgccaaggcctcccccgccaaggcagccaagaaggcggctgctcctgccaagaagggaaaggcagcggcggctcctaagaaggtggcaaccccgaagaaggctgctgctgctgccgccccggccaggaagggcgtggccaggaaggccaagaagtagtctgcctgccttgtcgctggcgagatccccccctcaattccgcctatagattcccctctttcatggattttgatccaatcgtaatattgtcagtagctctagattcgtcggtagctccagcatgagtgtcggtggtagttctgtgcctgtaaaaacttgggatagttgatcgcgtgtgatcagccgtcatgctcctccagtctctatgaacaagctaagctataatagtattttgctatcctaaaaaaaaaaaaaaaaaaaacgaaaagtcgcctggtttttttggttgcatctggtttggatttctgttttttaaattgttggatcggttgattttgttggatttagaagaatcctggcattgcattaagttcggacttntggtttctgcttttcatgtgattctgtttgttcaattgttagattgattaccctggacaatgaatagcaggagactcatttcggtttcattgtcaactgcatcagagtttttaagtaaaaaattcagtagtgagattctttgctgcattcgaagtgctgagaatccatcaaccaatcatcctaaacctaaacctacgatataaagtctttcatgctctaaccattatttttcgaaatgaaaaacctgtcccttcagtattgaggtgcctatagaaacaagacatgacacatgatctgatgtctccatgcttagcgtagcaacatctgaggtcggataagaaactgtccaactagccaaatgcgaagaaccaatccaaatccaaaatgctcaagaagaggtatctactatttatcagtccatgtaaatcacctccattttagaggtagctcaaccaagctcagataactgatagcatcattgaacagagacatttcagtataatcaactccagcttgttttgatcctctg

SEQ ID NO: 17009 - DNA, 737 bp, Zea mays
ttccgggatggtgccgctgcaagcgcaaagcagcttcctttcgcctgctgacaaggactagtcgagcggcgagcgaggaggcggaggatgggccgcggccggggcgtgagctacgggggcgggcagagctcgctgagctacctcttcggcggcggcggcgacgaggccgccgcggcgcccgccaagccggccgcggcggcgcctgcgcctgcgcctgcgccggtgccggcggcagcagacggcgagaagctcaaggggatcccggccggcgtccgcggcaaccagagccagaccaacaactacttccgggcgcaggggcagaactgcggcaacttcctcacggaccgcccgtcgaccaaggtgcacgccgcgccgggcggcggctcgtcgctcggctacctcttcggcggcggacctcccgggagcaagtgatgtgatgggcaccttctccgcccagacttttcggagcaccgcctgcttgggaagcttgatttttactaagtccatcgtgacctgctggatgtgaagttaatttccatgaagaaatgtatgttcatgtgtacctctgtaatctagaaatgtttatgtgtatctctgcaatttcgttggggtcggtcgtctcatcagtgcctgtatgtgtgtgtgtcataaactgactttgtcctgcatgttgttcatcagaagttgagaacatgtgttaagttgagaacatgctaataatggtccagattctgttt

SEQ ID NO: 17010 - DNA, 691 bp, Zea mays
aattcggcgcgcgagcgcaaagcagcttcctttcgcctgctggactagtcgagcggcgagcgaggaggcggaggatgggccgcggccggggcgtgagctacgggggcgggcagagctcgctgagctacctcttcggcggcggcggcggcgacgaggccgccgcggcgcccgccaagccggctgcggcggcgcctgcgcctgcgccggtgccggcggcagcagacggcgagaagctcaaggggatcccggccggcgtccgcggcaaccagagccagaccaacaactacttccgggcgcaggggcagaactgcggcaacttcctcacggaccgcccgtcgaccaaggtgcacgccgcgccgggcggcggctcgtcgctcggctacctcttcggcggcggacctcccgggagcaagtgatgtgatgggcaccttctccgcccagacttttcggagcaccgcctgcttgggaagcttgatttttactaagtccatcgtgacctgctggatgtgaagttaatttccatgaagaaatgtatgttcatgtgtacctctgtaatctagaaatgtttatgtgtatctctgcaatttcgttggggtcggtcgtctcatcagtgcctgtatgtgtgtgtgtcatcaactgactttgtcctgcatgttgttcatcagaagttgagaacatgtgttaagttgag

SEQ ID NO: 17011 - DNA, 1228 bp, Zea mays
ttgttttatattactacatgtcccgtgcatcgcgacatcacataaatatatttttgtaaaaaaaaagcagagaataattttggcatgtcttgtagataggggtggtaatggatcataaccttaattcttgcttcacaaaccaacaaggcccttaattttgttagttcaaaattatattgttttatgatctaaccctaacttgattcgatccttaaatttgctagactaaattaaatggcccgttaccacccctacttgtagacctcattggtccgaatttagcttaggccaaatacttcgctaagcctttttgttctacaagactacaaccaaagatgcccaaaatagttttgaattaccccgcggccggcaagccctcagccctccacgtcccgtcctcgcttccaccttattctctatggccatcctccttcctccaccgccaatcccgtggcgatctctttcggccatccaccgcacccgatccttccacctcctttcccgagaggctcttcccccgcgagatttgcactaccgcgtcggtgccaccgccgccacagcacccgtggcagcagcttgccatggcgctgccggccccctccgccccgccgcaggtcaccgcaagacggcgctgcggagtgcctggggtgcgcacgggttgttttggcgaccccgagatgaagcggcggcggcgggtggcgggctacaaggcgtacgcggtggggggcaaggtgaaggcgtccctccgccggggcctcaggtggttcaagcgcaaatgctcccgcatcttgaatatctgaccaccgtgcggcggcgcgcggcggcgttctcccactcttcttggaccgcaaggccgctcttttaccgcaacaattatggcatgcactcggcggtgcattgccaatttatgcattgatcaagaattcgcgtgattgaatgtacctctctgttcggaaagatcttgtttgtgcttccaagatttttatttccagaggctgcagatttcaacggttatcaataatccttgtttccagactacatgcttcctagtattatagaatgcgtaccatttcggtcattgaagttcataattcaaacgcttgccctcattgaatttgtaatcacaatcaacagttgaagacaataatgttgtcttgtttttcccttatatatatatatattcagattcgattgatcgtgcaaaaaaaaaaaaaaaaaatttgcggcc

SEQ ID NO: 17012 - DNA, 2218 bp, Zea mays
gggaccctcgaggccggcccgggtgggttcctctcgtctcgtctcgtctcgtcccattctcccgtcctgtgtccgtcttcacctgcgttccccgggtcccgacacgccgctgtaccagtcccgcccgcctgcgcacttctcccacccccgcgccgcctccggcgccggcgagccctcccgacgctcctcgaacgatccgtccctctcgcggcccgtctctctgccgcttccagcccaaggggaggagagggagaggatgtggtcgtcgagccaggcgagcacgaggggcgtcgtggagatggggagggtggaggccgggccgtcgcatttccctaagagacccgcgcctcagaactccgccagggtcaatctgtcaaggacacacacagttaaacctacctctgctggcgaccgttcaggaatttctgttaaatgcaacttggggtggtcttctcaaccatcgcctgacttgaggcatcactttagaggatactcatcagcatcagaggcagttcttacttcccaatctgatgtgagaaaactgtttgttggcaatgaaaaaatcggtgttctcttgctgaatctggggggcccagagactcttgacgatgtgcagcctttcttgtttaatctttttgcagatccggacattatccgtcttcctaggctctttcgctttctgcagaagccacttgcaaaattcatatcggtagtgagagcaccaaaaagtaaggaagggtatgcatccataggtgggcggttctcctctacgacaaattactgatgcacaggctgaagcattgagggaggcattacatgggaaagatgttcctgccaacgtgtatgttggaatgcggtattggcatcccttcactgaagaagccatagaacaaataaaacgggatggaatcacgaaacttgttgtgttgcctctataccctcagttctccatatcaactagtggttcaagtctccgtttattggagagcatatccagagaggatgagtatctcgtgaatatgcaacatacagttataccttcctggtaccaacgtgaaggatatatcaaggctatggcaactttgattgaaaacgaattgacaaaatttcaagaaccccaaaaggttatgatatttttcagtgctcatggagttcctctggcatatgttgaagaagctggtgatccatataaagcagaaatggaagagtgtatcgatcttatcatggaagaactggaaaaaagaggaataacaaatccgtgcatacttgcttatcagagccgagttggaccagtggaatggctgaaaccgtacactgatgagacaattattgagcttgggcagaaaggggtaaagagcctgcttgctgttcccattagttttgttagcgaacacattaaaactttggaagaaatcgatgtggagtacaaagagttggctttggaatctggcatcaagcactggggacgggttccagcactaggttgcgaacccacattcatttcggatcttgctgatgctgttattgaaagcctaccttatgttggcgcaatggcagtttccaatcttgaggctcggcagtctctcgtacccctcgggagcgtggaggagctgctagcagcatacgactcgaagcgcgatgagctccctccaccggtaatcgtgtgggagtggggctggacaaagagcgcggagacctggaatggccgtgcggcgatgctggccgtgctggctctcctggtgctggaagtgaccaccggcgaagggttcctgcatcaatggggaatcctgcctctgttccgctgagccgacagttctgttcatgatggggtcataattttgctgcagccgaaggaagttttgaacttctgatgctgtatatgaatcaatttgccttaaatcgtcgaggggaaaagaggagaaaaatggtaaaatatggacagaattcgacggtatatcatgttatattgtacctacctacatgacatgggacatgaaatagggctcagacatgcgctatggaacttggaatacacacaaacctaacacgccacatgctgcacaaactcctgcctactgccactagtaccttgtctgtccataagtggatgcgcgttgcttttagagaataatcatatgagcggatgagcctctgcattgtcatgtggatgctatatcaatccagcattccagacaaaaaaaaaaaaaaaaaagcggcc

SEQ ID NO: 17013 - DNA, 798 bp, Zea mays
ccggccggggttgcgagagcggttcatttcctctcgtctcgtctcgtcccatactcccgtcctgtccgtcttcacctgcgttccccgggtcccgacacgccgctgtaccagtcccgcccgcctgcgcacttctcccacccccgcgccgcctccggcgccggcgagccctcccgacgctcctcgaacgatccgtccctctcgcggcccgtctctctgccgcttccagcccaaggggaggagagggagaggatgtggtcgtcgagccaggcgagcacgaggggcgtcgtggagatggggagggtggaggccgggccgtcgcatttccctaagagacccgcgcctcagaactccgccagggtcaatctgtcaaggacacacacagttaaacctacctctgctggcgaccgttcaggaatttctgttaaatgcaacttggggtggtcttctcaaccatcgcctgacttgaggcatcactttagaggatactcatcagcatcagaggcagttcttacttcccaatctgatgtgagaaaactgtttgctggccgtgaaaaaatcggtgttctcttgctgaatcttgggggcccagagactcttgacgatgtgcagcctttcttgtataatctttttgcagatccggacattatccgtcctcctaggctctttcgctttctgcagaagccccttgcaaaattcatatcagaagtgagagcaccaaaaagcaaggaaggttatgcatccataggtggggggcctcctctaccaccaatttccggtcgccaggcttgaaaaactgag

SEQ ID NO: 17014 - DNA, 2050 bp, Zea mays
gcggatgatttcctctcgtctcgtctctccggccgggatactcccgtcccgtgccgtcttcacctgcgttccccgggtcccgacacgccgctgtaccagtcccgcccgcctgcgcgcacttctcccacccccgcgccgcctccggcgccggcgagccctcccgacgctcctcgaacgatccgtccctctcgcggcccttctctcagccgcttccagcccaaggggaggagagggagaggatgtggtcgtcgagccaggcgagcacgaggggcgtcgtggagatggggagggtggaggccgggccgtcgcatttccctaagagacccgcgcctcagaactccgccagggtcaatctgtcaaggacacacacagttaaacctacctctgctggcgaccgttcaggaatttctgttaaatgcaacttggggtggtcttctcaaccatcgcctgacttgaggcatcactttagaggatactcatcagcatcagaggcagttcttacttcccaatctgatgtgagaaaactgtttgttggcaatgaaaaaatcggtgttctcttgctgaatcttgggggcccagagactcttgacgatgtgcagcctttcttgtttaatctttttgcagatccggacattatccgtcttcctaggctctttcgctttctgcagaagccacttgcaaaattcatatcggaagtgagagcaccaaaaagtaaggaaggttatgcatccataggtggcggttctcctctacgacaaattactgatgcacaggctgaagcactgagggaggcattacatgggaaagatgttcctgccaacgtgtatgttggaatgcggtattggcatcccttcactgaagaagccatagaacaaataaaacgggatggaatcacgaaacttgttgtgttgcctctataccctcagttctccatatcaactagtggttcaagtctccgtttattggagagcatattcagagaggatgagtatctcgtgaatatgcaacatacagttataccttcctggtaccaacgtgaaggatatatcaaggctatggcaactttgattgaaaacgaattgacaaaatttcaagaaccccaaaaggttatgatatttttcagtgctcatggagttcctctggcatatgttgaagaagctggtgatccatataaagcagaaatggaagagtgtatcgatcttatcatggaagaactggaaaaaagaggaataacaaatccgtgcatacttgcttatcagagccgagttggaccagtggaatggctgaaaccgtacactgatgagacaattattgagcttgggcagaaaggggtaaagagcctgcttgctgttcccattagttttgttagcgaacacattgaaactttggaagaaatcgatgtggagtacaaagagttggctttggaatctggcatcaagcactggggacgggttccagcactaggttgcgaacccacattcatttcggatcttgctgatgctgttattgaaagcctaccttatgttggcgcaatggcagtttccaatcttgaggctcggcagtctctcgtacccctcgggagcgtggaggagctgctagcagcatacgactcgaagcgcgatgagctccctccaccggtaatcgtgtgggagtggggctggacaaagagcgcggagacctggaatggccgtgcggcgatgctggccgtgctggctctcctggtgctggaagtgaccaccggcgaagggttcctgcatcaatggggaatcctgcctctgttccgctgagccgacaattctgttcatgatggggtcataattttgctgcagccgaaggaagttttgaacttctgatgctgtatatgaatcaatttgccttaaatcgtcgagggggaaagaggagaaaatggtaaaatatggacagaattcgacggtatatcatgttatattgtacctacctactacatgacatgggacatggaatagggctcagacatgcgctatggcttcttaaaatccccacaaacctaacacgccaaaaaaaaataatt

SEQ ID NO: 17015 - DNA, 536 bp, Zea mays
aggccggccgggcgttgtacggaacagcagcagccgccgacgccgacgtaaaagcccgagtcgctcgactcctcccagatcctttgagcacaagagctctccgtcgccgtcgccatgggtaaggttcacggatcgcttgcccgcgcggggaaggtgcgtgggcagacgcccaaggtggcgaagcaggacaagaagaagaagccccgcggccgcgcgtacaagcgcatgcagtacaaccgccgcttcgtcaccgccgtcgtcggattcggcaagaaacgcggccccaactcctcggagaagtagatatagccatgtctttgtgttttgttcccgcactagtttccttgtactgatggcaagttgctgaagacttatatgctattattatctgtatcgatgtgttactgcaacactatgaaatatggtatgcatcgttgagctaaaaaaaaaaaaaaaaaaagcgaccgctatagatcgagaacaaaaaaaaaaaaaaaaaaaaaaaaaaaaaaaaaaaaaaaaaaacctggaggggg

SEQ ID NO: 17016 - DNA, 1912 bp, Zea mays
gaaaggaaacatctaccccgttcaaccgttccatttcttctcccgttccgttcaccccccccgcgagctctatctttcgtggcgcagctcggcagctgggcggccgccccccgccggcgccacgccctaagctacgccaggttcccagttcttcgtccgtccttttgctaggtcttcgttggacacttaaacggcgacgagcaccgccagacgcgctggtgcctggatccggcgggagtgcttcaggttttgacggttcgtctctctcgttgtttccggcggggttatgaaggcggtgggatacagcccctacgacagcagcgggactgatgacgatctccctccagcacaaaatagaggactaagagggcgatctttcagtgggaatgtcgtagcatctgctggggcatttccttacatgagggcaaataatgatctggagagtgaaatacatcgggttgagcaagatgcatatactggtattcttagggcatttaaagtgcaatctgatgcaatatcctgggaaaaggagagcttgattactgaactcaggaaagaactgagggtttctgatgaggagcatagggagctattaaataaagtcaatgaagatgggaccatccgtcgaatgagggagttaagacaggcaggtggatccccaagtggtttgcatcatggcaacatggttttatatggtgcagaacctgggtccactaccaagaggcaaagggcatctcattcgattcctttgcaatcagcaggcctccagtcccctatgatgccctcccactcagtttcatctgcaaaatggggtcctttgcaagcaagaggcacgaaagcgaggacgcccattcctttggcgttaccatctgtggatccaagttcactaataaaccataaagtttatacaaggtggccagaagacaacaacttctataaggccaccataacacgatataaccctgtgacgggtgagcatggacttgtctatgacatgggcacacaagccgagagttgggaatcagttagactttgtgatatggcacctgaagatataagatggggatttgatggacacctttcaaatcgtgatgtctggagcccttctggccctatgttgatgaggcacatgaccaacaatggtgctatggcaggttcaatcaagggaagagggaggttatcaataaatgagactataaaggactatgctccacctgaaaatggcaccaataggaattttgatcatgtcgacataccaaataccggaagtgttgttatggaggtgaagagggtattgttcaacccaaatatgcctgaaatcgagaaggcaaggaaacttttgaaagatcaggagcagtcattacttgatgcaattgccagacttgatgaagcatctgatagcgataatgaagatatggccatggaaggccgaatgggttctgctggggaaaggaatggcatcactacgtagttgcttctggcatgttggaattttggtagattaacatgcatttgtgtagcacctacctcgaccgcagaacaaggaaaccacattatggcaaaactgcatgccagaaaatggtgtcctggaaacggttgacgcctgaaatgggattttttggctacacaaaattgagcgcacgagcggcagagatgcaaatgttaaagaactgtttaagcgccattgcatggtgtttcctatgtagcaaactagaggcaactaaatgttctagttgatcattagcatggagcacttagcattcctgattcagtacaggtagatgtctaacactccagcataatatccaacttggctgttcttgtactctaatgtgaaaaaggattgttgtgcacgcttttcatgtaaacctcgagtgagtaaaaaaaaaaaaaaaaaaactcgagactagtt

SEQ ID NO: 17017 - DNA, 1655 bp, Zea mays
cattgggaccctcgaggccggccggggttcgtcccccgtgctctttctccctctcgtggcgctgggcgaccgcctacgcaggccaggcgccgtcgccctaagctacgccaggttcccgggtcttggtcggtcccttcaccggcgaagagcacccaccagacgcgccggtgcctggatccggaggaagtgctgcgggtttcggcggttcgtctctctcgttgtttccggcggggttatgaaggcggtgggatacaacctctacgatagcagcgggactgatgacgatctccctccagcacaaaatagaggattgagaggacgggttttcagtgggaatggccgagcatctgctggggcatttccttacatgagggcaaataatgatttggagagtgaaatacatcgagttgagcaagatgcatatactggtgttcttagggcatttaaagtgcaatctgatgcaatatcctgggaaaaagagagcttgattactgaactcaggaaagaactgagggtttctgatgaggagcatagggagctattaaataaagtcaatgaagatgggagcatccgtcaaatgagggagttaagacaggcaggtggaatcccaagtggtctgcatcgtggcaacagggttttatatgatgcagaacctgggcccactaccaagaggcaaagggcatctcattcgattccttcgcaatctgcaggcctccagtcccctatgatgccctcccactcagtttcatctgcaaaatggggtcctttgtcagcaagaggcaagaaggcgaagatgatggcacctgaagatataagatgggaatttgatggacatctttcaaatcatgatggctggggcccttctggccctatgctgaagaggcacatgaccaacaacggtgctatggcaggttcaatcaggggaagaggaaggttatcgataaatgagcctataaaagactatgctccacctcaaaatgacatcaataggaattttgattatattgacataccaaatactgaaagtgttgttactgaggtggagagggtgttggccaatccaaatatgcctgaaatcgagaaggcaaggaaactgctgaaagatcaggagcagtcattacttgatgcaattgccagacttgatgaagcatctgatagcgatagtggtaactgaagatatggctatggaagaccgaaggggttctgctggggtcctggggaatggaacggcattgctacttagttgttggaattggaagattaacatgcatctgtgtatcacctacctcgaccacagaacaaacaaaccacattatggcaaaaaaattgacatgccagaaaatggtgcctggaaactgttgatgcctgaaatgggatttgctggctacacaaaattgagcgcacgaggagcagggatatgcaaatgtcagaactgtttgaatggtgtttcctatgtagcgtagtaaaagtagcttaaatgttctagatgattagcacggatcacttagcattcctgattcagtataggtagatgtctaactctagcataatatccaacttggttgttcttgtactctaatgtgaaaaaggacgttgttcactcttttcaaaaaaaaaaaaaaaataggactttgttgtgcaaaagccgtcgtggt

SEQ ID NO: 17018 - DNA, 1562 bp, Zea mays
ggtaaacttaccaaagtcaggttgctccagctgatggtttgctggatgttcaaagagatggagaatctaaagaaacaatataaaaaactggttgcgtgggatccgagacagcgggtacaatgttttaggactagcagctactcttggggaagcattctttcgatgcatagagggttcttctgtcacccttgctattatggagaatgtgcaagttatggagtttcggcatctgcgccaacttatccaccttgttattattccatttgttaaatattgccctgccgatttatggctgtggctagtgaaccttttgcagccgttatttgtccactgtcagcaagctcttaattattcatggtccagtcttcttcatgagggtcgggctaaggttcctgacagcattggtaatctttctgggtcagaactgaaggtagaggtaatggaagaaaagttgctacgtgacttgactcgtgaagtatgttctgtcctttgggctttatcatcaccaggcttaaataatggacttccatccttggaacaacttggaccttccaaccggatggattctgttttgaagaatctggagtcctttgcttcaagttctctaactggatttcttatgctccatattggcacagctcttcctgcattgaggatatcagttgaagtgttcacttggacagatagcgatgccgttactaaagttatccccttttgtggtgcattgatccaccttgccgttgcttcaaaccaggctgagttgaggcagtttgttgcaaaggatttgttttcctctataatacacggtttatctgttgaatcaaattcagtcattagtgctgaacttgttggactttgtcgggagatatatgtctatctgtctgatagagatcctgcacctaggcaggttcttctttccctcccacacattaagcaggaagatttactagcatttaatgactctttgagtaaaactgctagtcctaaagagcaaaagcaacatatgcgaagcttacttctgctggctacagggaacaaactaagagcccttgctgctcagaagacaactaatgtgattaccaatgttacaacacggaataggagctctactgctcaccatggatcaagtgccgaagaagatggccatattgggttggccacactatcatcgatatgacctgccaaagttttgggcgtgtaaaaaaggttgcatatcattattggcggatgccggattcttgcagcatcattatgtgaggatgaatgcatgcgtagttatacggctatacccttcctgcctgccttcatgagcaactgaccgattctttggtttaggcggtctgtttttctagaatggatgtatgtaccttccgtgtgcgtgtgggttctggtaaatggtgaaagttgggtgtgattacttgtagctcacagttacatattgagggggtactcagggcccgtttggatacatctagctaaattttttaggccccatgtttgaatactagttagaaacattaaatatagtctaaaactaattacacagttaaggacaaaaacac

SEQ ID NO: 17019 - DNA, 2398 bp, Zea mays
aaatcttccctccccacgtggagtatatcacccatacgcagacgccacacgcgcaagcacatgaaccaccaccatcccggcggctcccacttgctcttgctccccttcctctcctcgctctgatcctcctccagtgcactgctccgttccggcgacctcgctgccggcccggcgctccccggggcaggcgggctgtcatagggagtggcctgcgtgtatggtgattggtagcctggcaggccaccaataatatcttctctcctgggcttatttgcctccatttgtcatcagcttcttgaaatccacagtctggtcaaatgctgtgaagaaaattcctctagtgctgaataagttcagcatagaaccactatgggcgcctgtgtatcttcaagcaaaaagcggagatcgcaaaggtcatgctgtatatacaggcgctaccgtggcaaggttttaaccaatacacctatagtacccgtcggtgaagtggagaaccttgcttcttctggagcagcagtccatttagggacttctgcagctgctcgacggagatccgatggctcaaacgttacgttccacctcacacaattgcagtggcgtcacagtgagctggacacagagaatggaaatgttgtgtgccaagaagaagcgtggttcgactctgtcagtatcttgggatctgactcagatgaagacttcagcagtgtcaatggagacttccctgctatgtcaaattcaacaggtacacaattgatgcagtgcgaagatgcttcatctatcgctgacgccatccagaagtttgaattgatttttgatggttctagtgttgctcaagctgttgggcagtacctgaaaagagatgcaaataaaatagaagcagagaggcctagagttgcaagccccgaagcttgtgatgtctctagtggaaaggttgaggatgctaagacacgaaatgagggtataaaaaaagttagaagaggcgaggatgcatgtaataccttgaagtctttcaaagatggagagaagcctcatgaaagcatcttcaaaagtttgacaccagtgtgcacacctcgtcatgctaacaaggtccaaccattggcagtagcaagtccacggggccaaaagaagaaatcagctgttgtcaggctttctttcaagaggcagtctttcgatggagaacaaactactgaaatatgttcctctagaaggtacttgatccgcccacgagctggattattggttccacaagctggtgagaaaatttctgaaggttgttggtctgtgcttgagccttcggcattcaagctgcgaggggaaagttttttcaaggacaaaaagaagtctcctgccccagcttgttctccatacacttcatttggtgtggacatattcatgtcccctaggaaaattcaccacattgcccagcatattgagcttccatctgtaaagccaaatgataaaattccttcgctacttatcgtaaatattcagatgcctacatatcctgctgctatgttccttggtgatagtgacggtgaagggattaatctggtgctatatttcaaactgaacgataactttgagaaagaaatttctccccagtttcatgacagcatcaagagacttgtaagcgacgaaacggagaaggtcaagggtttcccattggactcaacagtccctttcagagaaagattgaagatattggcagggttagttaacccagatgacatgaacctgagttctgcggagaggaagcttgttcaggcttacaatgaaaagccagtcctctcaaggcctcagcacaacttttatgtgggatcaaattacttggagatcgaccttgatgtacaccgctttagcttcatctcgaggaaagggctcgaagcattccgagaaagattgaaacatgggatgattgatctcggtctaaccatacaggcccagaagcaggaggaacttccagagcatgtactgtgctgtgtaaggctaaacaaaattgattttgtcgataatgggcaaataccaacactactgccatgtgacgatgactaaaaagttcggccagcagcctagcaacaaattaactgaaactgatgtttcggccaagaacatgagcatgtgctcacaagtccattccccgaagaattgtgagatgaactgaagtggggatctgcgtgtatagtcatggttttttttttctttcgtattctggtgttgcgaatcaaattctgttggaacttggaagttgatttgcgagtccggaattgaacatgccggcaagacgtcttatccatgttctatttttttcttttgaaggagtattattaattactctgcttataagaaagcatataagaggtacaacagaacgggataacaaaggacaaaaaaaaaaaaaaaa

SEQ ID NO: 17020 - DNA, 967 bp, Zea mays
ccggccgggaccacccctgcgcgcgccggcctcgcagccccccttcgatgtcgcacgcccgcgcctccccgctgtggcgctgtcccctccctggcacccaccctcacaaagcatcagcctctccaatcagacgcgagccacccaccgcgcgacctcagggtgcctgtgcctgctcccgctgttccttcctcatggccaccgcctgccacctcgccgcgccgctcggcctcgccccgttgccccgcggctgcgcctctgctggcgtcgtggccgtcgtccggtgcgctcggtcgtcaggctccaagatcccgagaggcgttgctgtcagggcgacgtccggcggcgagggcgccacggaggaggtgccggagattgtgaaggctgcgcaggacgcgtgggacaaagttgaggacaagtacgccgtggccaccatcggtgtcgctgccatcgtcgcgctctggacggtagtaggtgccatcaaggccatcgacaagcttcctcttctgcctggtgtccttgagattgttggaattgggtatacagggtggttcacataccgtaacctcgtcttccagccagacagggaggctctgatcggcaaaatcaagagcacttacaaagaaatcaccgggagcagcaactgatcgaacatcatttacaagatgggttcttaagcatatggtagaattgcatccgtaagcactgaagctgccatgcaagtgaaagtgcttctggtcccgacctcagtcagagaaaaaaaactctgcagttgagcaagccgttttactttgtttcagtgtaatatttatgacgtattcccagttctttttccggactactgtttactacgaaaatcccgatctgtgtaaaaatgtgctgcaacaaattcaaaagaaaacacaaatagtacaacccaaaaaaaaaaaaaaaagtactccccttcataatcaggaagggttgatcaagt

SEQ ID NO: 17021 - DNA, 955 bp, Zea mays
  misc_feature (3)..(4): n is a, c, g, or t
ccnnggccgggccccgggaaaaaaaaaaaaaaaaggatcgcagctccccttcgatgtcgcacgcccgcgcctccccgctgtggcgctgtcccctccctggcacccaccctcacaaagcatcagcctctccaatcagacgcgagccacccaccgcgcgacctcagggtgcctgtgcctgctcccgctgttccttcctcatggccaccgcctgccacctcgccgcgccgctcggcctcgccccgttgccccgcggctgcgcctctgctggcgtcgtggccgtcgtccggtgcgctcggtcgtcaggctccaagattccgagaggcgttgctgtcagggcgacgtccggcggcgagggcgccacggaggaggtgccggagattgtgaaggctgcgcaggacgcgtgggacaaagttgaggacaagtacgccgtggccaccatcggtgtcgctgccatcgtcgcgctctggacggtagtaggtgccatcaaggccatcgacaagcttcctcttctgcctggtgtccttgagattgttggaattgggtatacagggtggttcacataccgtaacctcgtcttccagccagacagggaggctctgatcggcaaaatcaagagcacttacaaagaaatcaccgggagcagcaactgatcgaacatcatttacaagatgggttcttaagcatatggtagaattgcatccgtaagcactgaagctgccatgcaagtgaaagtgcttctggtcccctgacctcagtcagagaaaaaaaaactctgcagttgagctttactttgtttcagtgtaatatttatgacgtattcccagttctttttccggactactgtttactacgaaaatcccgatctgtgtaaaaatgtgctgcaacaaattcaaaagaaaacacaaatagtacaacctcatgattttcgtactaaaaaaaaaaaaaaaaagcggcc

SEQ ID NO: 17022 - DNA, 1437 bp, Zea mays
tttttctacaactctactgaagacatgggttagggtttccgcgtcggctagtttggacgcatggctgctgcaggagagtagagaccacagcgcgcgaggcgaggagaataagctatgggcgcgccgaagcagaaatggacgtcggaagaggaggatgcgctccgcgccggcgtgcgcaagcacggcgccggcaaatggcggaccatccagaaggaccccgagttcagcccggtcctctcctcccgctccaacatcgacctcaaggacaaatggaggaatttaagtttcagtgcaagtggactgggatcaagtaaactgcgggttccaaagataactggaccctcatcttccccatcatctagctcgcagcctctgcttctcccagcggcaaacaaatttactgaagctacactgcctgcagatgctgagaaaaagccacaggatgggaaaactctgccaaagtatggtgccatgatcatggaagctcttttggaattgaatgagccgaatggttcagatattgctgcaatcttcggcttcatagagcaaaggtatgcggtacaaccgaccttcagaagatttctagcctcaaagttacggcgacttgcagactcaaacaaaattgaaaagatcgataagtcctataggctcccagactcccttgcaacaaggactccagctccaatgaatgcttcagctccaaaacagaaggatccatcaaagccatcgaaggtgtcaaaggccataggattgttttctgcctccagccctgcactagaggctgcgatggcagctgctgtcaaggtggctgacgcggaggcaaaagcacatgatgcgcatgatcagacgatggaggcagaaaggatcttcaagatggccgaggataccgagtctctcctcataattgcagcagagatctatgatcgatgttcaaggggagagataaccacgttagttccagtggcacaaagggagatttgagatctattggagtctctcttgtgttgtttgttgtacatggataggttctggaatccagtggcccggattgctcctgttgtatgatgtaaccgtttgtgttatactgtctccgttcttcgatatttgtcttaccctagttcatttttaaaataaaatgcgacaaataaaaaagaacggagtgagtacttaggatgtgccctaggggtaacaaaataacatcagcgcaccgcctgccttcaaaattctgtaatatgtaaccccgcctttcccagcctgtcactgcaagctgcgatcgtgtatcctgatgtcagtattgtattatttttccttggcatgatgagagaatagggaagtgttctaaacagatgaagtagggtaggaaggtgatgtgttcttggtatgcgataacaataatctgtgccgcacttgtacctttcaatttgagaatgttgtgtt

SEQ ID NO: 17023 - DNA, 1375 bp, Zea mays
acctcgaggccgcccggcccgggccgcgccgggatatacgttaaataaaataaattagaaagctatctatccaggtggattagggtttttgcctcggctagcagtagtagctaatttggacgcaggagatacggagtagggcgaaccgcgaggagagcaagctatgggcgcgccgaagcagaagtggacgtcggaagaggaggatgcgctccgccgtggcgttcgcaagcacggcgccggcaaatggcggaccatccagaaggacccccagttcagcccgatcctctcctcccgctccaatatcgacctcaaggacaaatggaggaatttaagtttcagtgcaagtggactgggatcgagtaaagtacgggttccaaagataactggatcctcatcttcaccatcatctagctcacaggctctgcttctcccagcggcaaataatgttacagaagctatgctgcctgcagatgctgacaaaaagccacgggatgggaaaactccgccaaagtatggtgccatgattatggaagctctttcggaattgaatcagccgaatggttcagatattgatgcaatcttcgacttcataaagcaaaggcatgtggtgcaatcgacctttagaagatttctaccctcaaagttacggcgacttgcagactcaaacaaaattgaaaaggtcgataacttctataggctcccagattcatttgcaacaaggactccagctcaaataaaagtttcagatccaaaacagaaggatccatctaaggcgtcaaagaccataggcttgtttgctgcctccagccctgcactagaggcagcgatggcagctgctgtcaaggtgactgacgccgaggcaaaagcacatgatgcacatgatcagatgatggaggcagaaaggatgctgaagatggctgaggataccgagtctatcctcacaattgcagcagagatctatgatcgatgttcaaggggggagataaccacattagttccagtggcgcaaagggagttttgaaatctattggagactcttgtcttgtacatgggataggttttggaatccggaggcccttacttgggatatgccctagggttaataacaacagcgcaccgcctgtcttcagactttgtaatgatatgtaatcccatctttcccattcccagcctgtcactgcaagctgcggtcgtgaatcctgatggcagtaaagttttttttttgtgttgacatgacgaaagaatagagcaggaaaaagtggtttaaacagatgaggtagggtagtaggatggtaaagtgttactggtataagataatataatgtgccgcagttttttcctccaaaaaaaaaaaaaaaaaaaaaaaaaaaaaaaa

SEQ ID NO: 17024 - DNA, 1071 bp, Zea mays
  misc_feature (1055)..(1055): n is a, c, g, or t
gcacgagaccattacctagaacatccgccgcccgggaacagcttggaagcagtaagcacgcatcgccgctccccatctcccccgcaccgcgcacctctatggccgccggcgaaggcggaggtggggacatcggcgccgactcggagcggcgcctgcaaaaggctatggataagctctaccacttccccaagcccaagtcgagtagcaccggtggctccaagccctcttcgtcgacctcggctccaagctccgggagagcggtggggaaggcagcggcggaggcagcgaggaggttcggggtggtgcgcgggtcgcgactcccgcatcagatgttggccatggcagcgatctcgccgccaccgccgtgccgcccctgggaccgcgccgacctcatgcgtcgtctcgggtcattcaaagccatgacctggttcgccaagcccaaggttattagtcccgttaactgtgcaagaagaggatggactaacattgagccggatgttataacatgtgaagcttgtggggcacgactcctgttctccactccttcctcatggacaacacagcaagttgaaaaggctgctgctgttttcagcctgaagctggactctggacataaactactttgtccgtggattgataacatatgtgatgaatcacttgctttatttccaccaacacctcctcctgttttagttgggaactactatgagcttttgtcctctctgctgcgacttttagcactcccaagaatttcttgctcttctcttgagaccatgaaaaagaggagtccacagctagagcagttcctatcagaaccattctcttcatcagttgttcacaaagggggatttgagatctattggagtctctcttgtgttgttgtacatggataggttctggaatccagtggcccggattgctcctgttgtatgatgtaaccgtttgtgttgtactacctcttctcgaatatttgtctccaatatttatcgtccctagtttatttttgaaaaaaaaaaaaaaaaaaaaaaaaaaaaaaaaaaaaaaaaaaaaaaaancaaaaaaaaaaaaaaa

SEQ ID NO: 17025 - DNA, 1007 bp, Zea mays
cccacgcgtccgcggacgcgtgctggatcgggaaaaggggagcgagaggcgaagcagataaggaagccagccggcaaggggagccactccggcgtcgagaaacctagggcgagcgcctcgacgactcctatcaccccatggcggccttcgctacgggcagcaccacagcgcgcgcgacgctggcatcgccgacttcgtgccagccggccgcgcgccgggcgccggcccgatggatgccgctgcgctgctcgccgccggccctgggcctcaggggaggagcgcgttctcggcggagcgccacgctacgggtggaagctaagaagcaaactttttcttcatttgatgagttgctggagaagtctgagaagccattgttagttgacttctatgcaacttggtgtggtccatgccaatacatggttcccatacttcaagaagtgagtgagaagttaggcgacaaaattcaagttgtgaaaattgatactgagaagtacactagcattgcaagtcgttacagaattgaagcattgccaacttttatcatattcaaggatgggaaaccttgttatcgctttgagggagcattacctgttgaccagatgatcgaacagattgaaaatgctttggcagtcacaaagtagcacatatggtgatgagcagggcagaatccccccccccccccaaaaaaaaaagaaacttggtggtacctcataacgtgtgcctctacatattgaaaaatcttgattattgtctacaagatcacaacatcaagggcctaacatttgtaaggatttgttggatcttctagattcttatggggagttagatgttctcttccgatgagacatgtagatgttggtctgccattggcgtattaatggttccttgtgtcttttatcgggagcaagagccctcgcattgcctagtgttggtaataaggattattttaatcctccgatatgcatgaacgtctatcaggatgatattataaaccccccccgttctct

SEQ ID NO: 17026 - DNA, 2832 bp, Zea mays
agcgcctccccccaccactccccgtctcctctcgccgacgtccaaggaccttctcacagccgcctccttcacctcgccgccctcccccacctccgacgatcccgcctccccgctcgacgccttcgcctccgatcccgtcctctccgccttcctgtcgccgtccttctccccttctgtctcctcctccgccgcgctttcctcaggactcgctgcctcccgcgccgagcagctgcaggatgccatccgcctcctccgccgccatctccgcgtcgaggtgctgcgccgccaccccctcctcctctcccacctcctttctctccgctccgcctccgcgtctctctcctcgctcccatcccacctcaaccttctctcctctcacctctctctcctctcctcccacctctcggccccgcgctcccatctcgctcactcctcggcttccctttccagcctcttggccacagccgacctcctcctccactcccaccgcttagtgcgcctctcctcccgactcctcgcctcctcccctgcgcccgatcttgcgcgccaggctgagctctaccgcgagatccgcctcctctatgaggagaagaacctctccgggattaatgccgttgacgaggagatgcgcaaggtggatgccgctgcgtcaaagctgcgctcagaggccagcgctgtgatcgatggcggtgtctacgagtccaaccagaacgacgtgtggtgcgggctgcaggtgtactacaatctcggggaactgaagacagcagtggaggggcttgtgggaaagcacaaggcagcgggtgcaaagagtgtgtctgtcgcactggacatgaaggcgatatcaatgactgctggcgttggaggtggtcctggaggggtgcagaggagtggtacgccgcagattggtgggagtaagaaggctgcagaggcactatgggataggatgaggcagtgcatggatgagctccaccgagcagtgactgctgcttggcagttgcagactgtgctcactaagaagcgtgtgccattcacacaaatgctttttcttgaggaggtttggcaggagggtgagcctcttataacagagagagtttgggatgcaattgtcaaggcctttgcaagtcagatgaagactacctttacggcttcaagctttgtgaaagaaatatttactcttgggtatctaaaactgttttcgatggttgaaaacctccttgagaggatttcaagagatactgatgtaaagggcacccttccagctctcactcctgaaggaaaagatcatatgatttcagccattgagatgttccagacagcctttttggctctgtgtcatagtcggctatctgattatgtcaacagcatatttccaatgtcaaaccgtggaactataccttcaaaggatcagatctcaagattggtttctcgcatacaagaagaaatcgaagtagtgagaactcatgggcatttgcttgttcttgttctacgtgaaattggaaagaccttgcttcttttagcacagagagcagaatatcagatctctactggccccgaagctcgacaagttaccggcacagcgactgcagcccaactaaaaaattttgctctgtgtcttcaccttcaggaggttcacatgcgcatttctagcgtcttgtcaacactcccaaatgttgcttctgaagtcctttcaccctcccttggtgttgtttatggtgttgcttgtgattcagtgacttccctgttccaagcgatgcttgatcgtctcgagtcatgcatcctgaaaatgcatgagcaggactttgcaggtcagggaatggatgcatcaatggataacaatgcatcagcttacatggaagagcttcagaaatgtgctgtccacttccgcagcgagttcttatcgaagctgttgccttcatcatcctctcgatcagaaaccatatgtaccatcatggttagaaggatggcctcaagggtactcatattttttataaggcatgcttctcttgtcaggccactctcagaagcagggaagttgagaatggcacgggacatggctgagctggagcttgctgttggtcagaatctgtttccagtggagcagctgggggcaccataccgggcactacgggcattccgtcctgtcttgttcctggaaacatctcagcttgacaagtttccgctccttcaggacttgccgcctagtgtgatcctccaccatctgtattctcgagggcctgatgaactgcagtcgccattacagcgcaacaagctcacacctttgcagtactctctgtggcttgattcacaaggcaaggaccagatctggaagggggtcaaagcaaccctagatgactacgagatgagggtcagatctcgaggagacaaggaattcagtccggtgtatcctctcatgcttcagattggatcttcattgtctcagcccaacacctaacatgtctctggttcaatcttgcatctgtatcatcttgtaggcattgatttttgaggggtcgggtgaagcttcggcatagtctatacacatgaaataggggatttgtgtttgttcctgaaaataatggttagcgtacattgtcttgatgttctgctagtttctgtatctttttgtaactctgatccgtgaaatatttgaaaaaggtgtcgtttcacaaatacatcagcgtcgtggaaggaggtaaatatagaggttaaaaaaggcgagaagacctcttgtgaaaaaaaaaaaaaaaattcgtatcttttttgctagacatagttgcttgattcgagtaggaccatacaataaaacagaactagttagttgttagatgagtg

SEQ ID NO: 17027 - DNA, 1917 bp, Zea mays
gggtacctcgaggccggcccgcaactcttttataggcgtctaccggtctacccggccggcacgcctctacagatccaggcgctcttctgctgcagcgccgcctctcgtcctcccggcgtcatcgtcgccgccctgatctccgcaggccggcgtgtggcggagatccatccgtgcttgaactgactccttccttagctacaagtacctattatcaaccatgtttggacgcatgccaaggaagagtagtaacaataccaagtattacgaggttcttggtgtgtctaagaccgcaagtcaggatgagcttaagaaagcatacagaaaagctgccataaaaaaccatcctgataagggtggagaccctgagaagtttaaagagctgtctcaagcttatgatgttcttagtgacccggagaagagggagatctatgaccagtatggagaagatgcccttaaggaaggaatgggaggaggcagcagcagtgatttccatagccctttcgacatttttgagcaactttttccgggttctagcacctttgggggtggtagctcaagaggacgcagacaaaagcgtggtgaagatgtggtgcatactatgaaggtttccttagacgatctgtacaatgggacaaccaagaaactatctttatcgcggagtgctttgtgctccaagtgcaaggggaaaggatccaagagtggggcatcaggaacatgccatggttgtcgtggtgctggaatgagaacaatcacaagacagataggccttggcatgatccaacagatgaacactgtttgccctgaatgcaaaggatcaggtgagatcataagtgacaaggacaaatgcccaagctgtaaaggaaacaaggtagtccaggagaagaaggtgttagaggttcatgtggagaaaggaatgcaacataaccaaaagattgtattccagggtcaagctgatgaagctcctgatacggttacaggagacattgtttttgtcttgcaacttaaagaccatccaaaatttaagaggatgtacgatgacttatatgttgagcacacaatctctctcaccgaagcattgtgtggcttccagtttgttcttactcatcttgatgggcgacagcttctgatcaaatctgaccccggggaggttattaaaccaggtcaacacaaggccattaacgatgaaggtatgcctcagcatggccgtcctttcatgaagggccgtctgtttgttgaattcaacgtggagtttcccgagcctggtgcgctctcccctgcccagtgccgatcgttggagaagatccttccgccgaaaccagggagccaactgtcggacatggagctggaccagtgcgaggagaccacccttcacgatgtcaacattgaagaggagatgaggcgcaggcagcagcagaagaagcaggaagcctacgatgaagacgaggaggaggatgctcaaccaagggtgcaatgtgcccagcagtaaaatccgtgttcgttggaactgttctccaaaagtttcagcaggattttttatccatctgatcatctcgattctttttggcaaaaatataatcgttttataaactttaaactgttagttccatcctagtgtcagggaaaaaatgagagcccggaatggcatgttccttgtttgaactgcaatgcgtgattggtgttagttaagctctgctccatgttattttgttgtacccgtgaaaaaggtatcatgttcatggtgtgctactatttttgatgtgtaagaaacattgagcttgctggtagtgatgatttgtgatgcaccctggggtgctggctcaaaaaaaaaaaaaaaaaacccgcggccaaaaaaaaaaaaaaaaaaaaaaaaaaaaaaaaaaaaaaaaaaaaaaaaaaaaaaaaaaaaaaaaaaaaaaa

SEQ ID NO: 17028 - DNA, 958 bp, Zea mays
  misc_feature (941)..(943): n is a, c, g, or t
  misc_feature (945)..(945): n is a, c, g, or t
  misc_feature (949)..(949): n is a, c, g, or t
cattgggtacctcgaggccggccgggaaccaactgagctgagcaagaaggcaagcaccaatcagccagcagtccagcacaatatcatgaacaagcgtcaggtcgccgcggcggtggctgccctcctggcgctgctagccgcatcatcgacggccggcgccgtgacgttcgacgcgacgaacacggcgtccgatacccccggcgggcagcggttcgaccaggccgtcggcctcgactacgccaagcaggtcctggccgacgcgtccacgttcatctggaacaccttcgaccagcccagccccgccgaccgcaagcccgtcgacgcggtgaccctcgtcgtcgaggacatcggcggcgtggccttcacgagcgccaacgggatccacctcagcgcgcagtacgtcggcggctactccggcgacgtcaagaccgaagtcaccggcgtgctgtaccacgagacaacgcacgtgtggcagtgggacgggcagggccaggcgaacggcggcctcatcgagggcatcgccgactacgtccggctgaaggcggggtacgcgccgggccactgggtgcagccggggcagggggaccggtgggaccaggggtacgacgtcacggcgaggttcctggactactgcgactcgctcaagccgggcttcgtcgcgctgctcaacgccaagatgaaggacggctacaccgacgacttcttcgcccagatcctgggcaagaccgtgcagcagctgtggcaggactacaaggctaagtacgggggctgatgatggtgatgcaaattggtggcggtgcgaagtcaacgcgtcaatggctcaatgcgtttggtatgagatgctattatgtgctagtacgtacactctgtgtgtaaaatatatagagaaaataaaagggatcggataattaaagcaaaaaaaaaaaaaaaggggccgcgcnnnanctanaactaccca

SEQ ID NO: 17029 - DNA, 823 bp, Zea mays
  misc_feature (12)..(12): n is a, c, g, or t
  misc_feature (64)..(65): n is a, c, g, or t
  misc_feature (120)..(120): n is a, c, g, or t
  misc_feature (134)..(134): n is a, c, g, or t
  misc_feature (171)..(171): n is a, c, g, or t
accagcccagcnccgccgaccgcaaggccgtcgacgcggtgaccctcgtcgtcgaggacatcgnncggcgtggccttcacgagcgccaacgggatccaccctcagcgcgcagtacgtcgnccggctactccggncgacgtcaaaagccgaagtgtcggcggctactccggngacgtcaagaccgaagtcaccggcgtgctgtaccacgagacaacgcacgtgtggcagtgggacgggcagggccaggcgaacggcggcctcatcgagggcatcgccgactacgtccggctgaaggcggggtacgcgccgggccactgggtgcagccggggcaggggggccggtgggaccaggggtacgacgtcacggcgaggttcctggactactgcgactcgctcaagccgggcttcgtcgcgctgctcaacgccaagatgaaggacggctacaccgacgacttcttcgcccagatcctgggcaagaccgtgcagcagctgtggcaggactacaaggctaagtacgggggctgatgatggtgatgcaaatcggtggcggtgcgaagtcaacgcgtcaatggctcaatgcgtttagtatgagatgttattatgtgctagtacgtactaatcgttcaaaataatgtcatgggttgacgttcgcatagggccgtacattaaaagagaaccaatgcgaaatccgatatggagggctcttccgcacacaaatatatataattataaatataatatcgaatatttgacgtataaaaaaaaaaagtcgacgcggccgcgaattcggataaaaaaaactcgagactagttctcctcgtgc

SEQ ID NO: 17030 - DNA, 2229 bp, Zea mays
ggcgcgggacatgcgacgccccgcagcaacggaccaacgtccaacggtagtctatccggcgcggcagtggcacacggacacggcgccaagagcacaagacggagccggagcgggagcgctcctggctcctgcaacgtctacctctcccgtctgagcctgccacggcccagccccacccaactactactcgcagcgtggcccatactgtcagtgagcgtgttttccctatcccccaacggtcgagtactgacacccccgcctcttaaacctctctttcatctttccccgcaccgcatcgcaccgcgagtttcgaaaaccccaaccaatcgcgcctcagatcacgcgagggcgtgagggggaattcgctctcccagcctccgctcacccgtcgatcgatcgtccgggccaggtatccgtccgtctggtttggaatttcgattgctcgtttggattggttcggggggctgtgttctgctggcttgcttccgccctgatctctctgctcgtgccgatcctcgacgggacgacgaaacacaggggctctccggcggcaccggggccatggaggaggacccgctcatcccgctggtgcacgtctggaacaacgccgccttcgaccatgcctccgcctccgcctccgcgtggcacgcccattcccctgcgcccgcgagcgcccgcgagggggacaaggagaaccaccgccccgagcccgacgttgaggcggaggtcgacgacgttgaggccgagatttaccacatcgaggcggagatcctgcgcctgtcttcccgcctccaccacctccgcacctccaagcagacggagccgcccaagcgtggacaggtcgcgcggacgcggatgcgggggctcagtctgggccagctcgacgtcgccgctgccgtcgactccgacccgctcaccgacaagcagcagccgagcgccgcgcagggcttgaaaaagcctatcaagcaggccccggcggcgccgcgaggccggagctccagcctcgggcccctcgagatcgtcgccacgaaccctagggtcctccgctcctccgccgccgccgctgccgcaccgaagaggaagattcagggcgagggcggcgccgcgcggccgatcctcaggccgatcaaggagcctcccgtgcagcggcgccggggcgtcagcctcgggcccttggagatccaccacggcgtcggcagcaagcccggggcggcggcgcgggtcaagcacttctccaacaacaggctcggtgccgttcgagaggaggaaggccagcgttccaaggagcacgccgtccccgccagaccgtggccatccagcaatgccaggcacccactggatgccaggcaaggcaccgcagcaagcagagccaaggcgaggagcgggagcataagccccagcaggttcaggaggcagtccacttccaaggctgccgagacaagagcgggaaatgccaagcctacagctacagaggcgacgaggggagggagcgaagcggtcaatcacaccagcaatatagccacgacgaagaggccggcggggagctccaaggtcagggttgtcccgagccgctacagcatcccacctggctcctccctagcagctgtgacacaaggcaaccgatgcaagcagtctctcccaggatcggctactgagaccagagtaaatctcactgagccgccgaacgacgagttgtctcctgaagaacttgccaaggttgcagagctgctcccaaggattaggaccatgccgccttctgatgagagcccgcgtgactcgggatgtgccaagcgtgttgctgatttggtcgggaagcgatccttcttcactgctgcaggggacgatggcaatctcgttacgccctaccaggcacgggtggttgaacttgaatcacccgaggcagcagcagaagaagcagaagcttgagaagtttgtctttgatcaattccgaagtggcttgcatctgggcgtggcctctttttgcagtgtgtgctactacatagtctactgttacattcatatcatatcacatttcctattttttcccccttgagacattgcttagtacttttgtgttgccttgtgaaaagagagtggaaaggtttgcatctgctgatgctcttgtttcggattgtgtgttcctggttcgatgaagtacaggataatgctgtggtttataacaaacaaaaaaaaatggaaaatttgctaggactgatgaattgatgtccc

SEQ ID NO: 17031 - DNA, 2416 bp, Zea mays
tgcatgcctgcagtagagatatgtatggattttgcaggtgtagaatcatcttcgaatttaaaatcttcgagatggaacgacattttccgatggggttcggtagaagacgcgcactgcaactgcaacgtctgcctcccccacccgatcctcccacgtagagatggtcaaacgggccgcccggcccggccccggtgaagcccggctaaaaaccgggccgggcctgctgagcccgcgggctcaatttcttgtcaagcccggactgcagcgggcctaaacgggtcggtaagcacattttagtgtaaaaaaacgggcttaacaggcttagaggtaaatgggccgtgccggactaacccgccgtgcctagtttcctgtctaagcctggcacggcacgaaaagcaggccaggctcggaccggacccaaaaagcggacttcgtgccgggctcgcgggactcgtgcttattggctatatactcccacggtcctcctacctttaccgaggagtagtacatgcagcgtggccctactgtcagcgaatgtattttcaccttttctttctcaaaaaaaaatccactcgcaataatacaggcgcgcggcggcgctccccttccgctcccgagcccaacggtcgagtactgacaccaccggcctcttaaaccctcttcctctttccccgcaccgcaattttcgaagaaacaacgaatcccgcctcaagaccacgcgagtgcgcaaggggaagcaggaatacatccgttcccggcctccgcgagtgcgcaaggggaagcaggaatacatccgttcccggcctccgctcagccgtcgatcgatcgttcgtctggtccaggtatccgtcagtctggtttcgagtttcagttggccggtcggattcgtccgtggctctgttcctgctggttcgcttctcccctgatcttctctgcttgagccgatcctctctcgacgggaacggtacaggggcgtctcagttggccggggcgatggaggaggacccgctcatccagctggtgcacgtctggagcaacgccgcctgcgacaacgccgccgcctcatcctccgtgtgtcacgcccattccccggcgcccgcgagcgcccgcgagggcgagggggacaaggagaacctccggcccgagcccgacgttgaggcggagatcggccacatcgaggcggagatcctgcgcttgtcctcccgcctccaccacctccgcacctcccagcagctgcagccgcctaagtgcgcagaggtcgcacccgcgcccgaaacaagctggagctccccgcggtggcggccgcgggggcgcagcctgggaccgctcgacatcgtcgctgccgtcaaccccaacctgctcaccactgacaagcagcagccgccgcgcgccgcgcaggggttgaagccgatcaagcaggccccggcggcggcgcgagggaggggcttcagcctcgcgccgctcgacaccgttgccgcgaaccctagggtcccctccgccgcgccgcagaggaagattcagggcgagggcggcggcgcgtggccgaccctgaggccgatcaaggagccccccgtgcagcggcgcaggggcgtcagcctcggccctttggagatccaccacggcgtcggcagcaagcccggggcgacggtggcggcagcgcgggtcaagccactctccaacaagctcggtgccgtccgagaggaaggccagcgttccaagcagcacgccgtccccgccagaccgtggccgtccagcaatgccaagcacccactggatgccaagcaaagcaccgtagcaagcagggccaaggcgaggagcgggagcatgagtcccagcaggttaaggaggcagtccacttccaaggctaccgagacaagagcaggcaacgccaaggctacagaggcaaggggtgggaacgcgacactcggagataacaacgtggctgatgtgctcacgctcaaatgcgcggtggccgatcataacaggaatgtatctactgggaagaggccggcggggagctccaaggtcagaattgtcccgagccgctacagcctcacgcccggctcgtccctgatagctgctcctgtgacacaagggaagctatgcaagcagcccctctcaggatccgctcgtgctgcaagccacagggaggagatgggagcaaagctcactgagccgtctaacgacgagttgtctcctgaatcacttgccaaggttgcagagctgctcccaaggatcaggaccatgccgccttctgacgagagcccgcgtgactcggggtgtgctgctaggcgtgttgcagatttggccgggaagcgatccttcttcaccgccgcagccgacgatggcaatcccgttacaccctaccaggcacgggtggttgaacttgaaacacccgagacagcagcagcagcag

SEQ ID NO: 17032 - DNA, 1963 bp, Zea mays
gcacgagaccattacctagaacatcctaatcgaaaagcaattttcgaagaaacaacgaatcccgcctcaagaccacgcgagtgcgcaaggggaagcaggaatacatccgttcccggcctccgcgagtgcgcaaggggaagcaggaatacatccgttcccggcctccgctcagccgtcgatcgatcgttcgtctggtccaggggcgtctcagttggccggggcgatggaggaggacccgctcatccagctggtgcacgtctggagcaacgccgcctgcgacaacgccgccgcctcatcctccgtgtgtcacgcccattccccggcgcccgcgagcgcccgcgagggcgagggggacaaggagaacctccggcccgagcccgacgttgaggcggagatcggccacatcgaggcggagatcctgcgcttgtcctcccgcctccaccacctccgcacctcccagcagctgcagccgcctaagtgcgcagaggtcgcacccgcgcccgaaacgaaggcggcggcagcgcgcccgcggccgcgggggcgcagcctgggaccgctcgacatcgtcgctgccgtcaaccccaacctgctcaccactgacaagcagcagccgccgcgcgccgcgcaggggttgaagccgatcaagcaggccccggcggcggcgcgagggaggggcttcagcctcgcgccgctcgacaccgttgccgcgaaccctagggtcccctccgccgcgccgcagaggaagattcagggcgagggcggcggcgcgtggccgaccctgaggccgatcaaggagccccccgtgcagcggcgcaggggcgtcagcctcggccctttggagatccaccacagcgtcggcagcaagcccggggcgacggtggcggcagcgcgggtcaagccactctccaacaagctcggtgccgtccgagaggaaggccagcgttccaagcagcacgccgtccccgccagaccgtggccgtccagcaatgccaagcacccactggatgccaagcaaagcaccgtagcaagcagggccaaggcgaggagcgggagcatgagtccccaggttaaggaggcagtccacttccaaggctaccgagacaagagcaggcaacgccaaggctacagaggcaaggggtgggaacgcgacactcggagataacaacgtggctgatgtgctcacgctcaaatgcgcggtggccgatcataacaggaatgtatctactgggaagaggccggcggggagctccaaggtcagaattgtcccgagccgctacagcctcacgcccggctcgtccctgatagctgctcctgtgacacaagggaagctatgcaagcagcccctctcaggatccgctcgtgctgcaagccacagggaggagatgggagcaaagctcactgagccgtctaacgacgagttgtctcctgaatcacttgccaaggttgcagagctgctcccaaggatcaggaccatgccgccttctgacgagagcccgcgtgactcggggtgtgctgctaggcgtgttgcagatttggccgggaagcgatccttcttcaccgccgcagccgacgatggcaatcccgttacaccctaccaggcacgggtggttgaacttgaaacacccgagacagcagcagcagcagaagcatgagtgtttgaagcatggtttcgatcaaacagcttggctccccttcgtcatgagtgtttgaagtgtctgcttacttgagcttgcatctaggtgagaggccttttttgcagtgtgccactacataatctactgctacaatcgtatcatatctcatgtcctatttttttttctttccccttgagacctggctagcaattcatcttgtctgctggtgctcttgttttggattgtaagtatggtcttggtttgtgaagcacaggatcgtgatgtggtttataatatgcctcctccttttgtcaaaaaaaaaaaaaaaa

SEQ ID NO: 17033 - DNA, 2259 bp, Zea mays
gccggccgggtctggatttagaagcatcaagctttagtatcgggcctgccacacccaccgtactccgatccatggcggcaccttggaatgaaggcgtcagcaataacacggacagtacacagatcgggaggtagaactcacgagggagctggcggcaaactcccctccatggctgtatccatcggctggtgaaggtcaaaacactttgccgagaaggtagaaggatggggaggaagaactcaccggacctctctgcagtgagcaggacagggagtcggcgtccgcattgcagttgcagccacgccaacaactgggcagcggcgacatctgcatctcccacctcgtctccctcccgtatctgcaagccttgatcccgccgccagccatccatccaagggagccatgtctccatccggcgagctgctggcttccatctcctccgtcttcactgtcgccttcgtcctcctcgcctgcgtcgagctcggcgacgccgccgccgccgccgtcggcgtctaccgcctcatccagtacgacctcgccggcgctccgctcggctcccgcgccgcggtcctcaaccaccacgctgccgcgctcccgctccccgccggcgcagacctctcccgctccgccctcgtcgcgccgctccttgacctcccgctctctttcctcagagagtacctggtggagaaaaaacatctggggggattactcattctgctcccgacaaataatgacagtgtggatgacaaggggcaattcaaaggtgtactgactgagctggagaagttgcttctgcatgaacaagtttcatatccagtgtactttgctttgcatgacgacaatcctgataacctgctggcagatatccataaaattgcctccacaggtcaaccagcctctgcaacaacaggaggttacaaacttgtcgtatcctcagcagagcctagaaaagtgtcatctccaaccatttctaatatccagggatggttacctggatttaaaggagagggtgatagcgaacagcttccgactattgccatagttgcaaactatgacaccttcggtgctgtacctgcactttctgtgggaagcgacagcaatggaagtggagttgtggctcttctagagattgcgagactattttcacgtctgtattcaaatcctaagacaaggggcaagtacaatattctctttgggttaacatctggtagaccctacaattacaatggaactagcaagtggcttaggagttttgatcagcgtgtacgtgagagcattgactacgcaatttgcttgaacaatgttggttcctggggtaatgacctctggatgcatgtatcaaagcctccagaaaatccctttatcaagcaaatctttaaagaattttcagatgtttctaaagaaatgggtgtttcagttggaatcaagcacaagaagattaatgtctcaaatcccagagtagcatgggaacacgaacagttctcaaggtttagggtgactgcacttactctttcagaaatgtctacccctcctgaatttttggaaagcactggcggtcttcatgacactagagaatctacagatgctgagtcagtaatccgagctgccagattagtttctgagagtcttgcgagacgcatctatggactgaagggaaggaacatagatgtttttgcagagaatagcagtttagccattaatcctcactatatccggtcctggttggatctgttgtcacggacaccacgggttgcaccttttctgcagaaaaacgaccccttcatagcagcactggaaaaggaactgtctgcacacactactgatgtgcatgttcaaagtgacgcgcttgatggcatgttcactttctatgatgcgacgaaagcaactctaaatgtctaccaggttgcaggtgttacttttgatctgctgttccttctggtgctcggctcctacctgattgttctcttctgtttcctagtgattactacacggggtgttgatgatctcattaacatattccggcggcctccatcacgcaaactcaagggtgcataggctatgtaacacccggttttaaaggacaaagtcgggtgcatctcatacatgcgccaagaagacaacatatataataacagagtgtatagagataaatgtcataaatcatcagagtatttattacatagcggaagacttattacaaaataaaagtgtaaacataaaacgaactaaggatcgtcggcgccaaaaaaaaaaaaaaaa

SEQ ID NO: 17034 - DNA, 2271 bp, Zea mays
  misc_feature (29)..(102): n is a, c, g, or t
gcacgagcccgcgacgacggtcgaccatnnnnnnnnnnnnnnnnnnnnnnnnnnnnnnnnnnnnnnnnnnnnnnnnnnnnnnnnnnnnnnnnnnnnnnnnnnccgcccatgtccatgtcctctccgccgcccgctgcctccgcctccgcctccgcgcggtccccgcccgagcgtcgtcgcagcatcctccgcctccgcccaccccgcggtcgcggcggccggagtacgtcccgaaccgcatcgacgaccccaactacgtgcgcatcttcgacaccacgctgcgcgacggggagcagtcgccgggcgccaccatgacgagcgcccagaagctcgtcgtcgcgcgccagctggcccgcctcggcgtcgacatcatcgaggccgggttcccggcctcctcccccgacgacctcgacgccgtgcgctccatcgccatcgaggtcggcaacccggcgccaggacccgccggggaggaggacgccgtccacgtgccggtcatctgcggcctctcgcggtgcaaccggagggacatcgacgccgcgtgggaggccgtgcgccacgcgcgccggccccggatccacaccttcatcgccaccagcgacattcacatgcagcataagctcaggaagacgcccgaccaggtggtcgccattgccagggagatggtggcctacgcccgcagcctcggatgcactgacgtcgagttcagccccgaggacgccggcaggtcaaatagagagttcttgtatcatattctaggggaagtcataaaagctggagctacgactctcaatatcccggacactgtcggatacaatcttccttatgaatttggaaagttgattgctgatataaaggcaaacactcctggaattgaaaaggctatcatttccactcattgtcagaatgaccttggtcttgcgactgccaacacactagcgggcgctcgtgcaggagcacggcagttagaggttactattaatggtattggtgaaagggctggaaatgcttctttggaggaggttgtcatggcaattaaatgccgcagagaactgttagatggtctctatactggaatcgattcccgccatatcactttgacgagcaaaatggtgcaagaacatagtggacttcacgtgcagccacataaagctattgttggtgccaatgcgttcgctcatgaaagtggaattcatcaggatgggatgcttaaatataaaggaacttacgaaattatatcgcctgatgatattggtctaacacgtgcaaatgaatttggtattgttcttgggaaactcagcggaaggcatgctgtgagatctaagctagtagagcttggatatgaaatcggtgacaaggaatttgaggacttctttaaacgctacaaagaggttgcagagaagaaaaagcgcgtaactgatgaagacttagaagcgttattgtcggatgagatattccagcctaaggttatttggtcccttgctgatgtacaggcaacatgtggtacacttgctttatctacggcaacagtgaaattgatagcaccagatggagaggagaaaatagcatgttcagtcggaacaggtccagtcgatgcagcttacaaggctgttgacaaaataatccagattccaacggttctccgagaatacagtatgacatcagtcacagaaggcattgacgcaatcgcgacaactcgggttgttgtcactggagatgtgagcaacaacgccaaacatgccctgactggccagtctttcaaccgctccttcagcgggagcggggcatccatggacattgtggtgtccagtgtcagagcttacctgagcgccctgaacaagatctgcagtttcgctggcgccgtgaaagccagcagcgatgtagctgagaccgcaagcgtcccgagcacagaatgagctcccgtttggttcagagtgacatgttgttcaaaatttctgctggaaggatggtcccttgagcttaggacaggcaggaagtcttggggcctatgtagtgtacaatttctgtgtgtcatataccgtgctcgttgccagtttgtactgtaccatatataaaccatagaatctgttgccatttagaagtctggccaaggtcagctgtaatgcttcacatgcttatagcctggaaacattaaacattgaaaaacccgagcagtgaataaaggatgcccaaggtagaaactctgatgaatcatcctcttggatttggtggttttggttataaaaagaaaaaaaaaaaagggggggcgttttg

SEQ ID NO: 17035 - DNA, 1866 bp, Zea mays
tggcccgcctcggcgtcgacatcatcgaggccgggttcccggcctcctcccccgacgacctcgacgccgtgcgctccatcgccatcgaggtcggcaacccgcccactgccagcgctgggaccgtccacgtgcccgtcatctgcggcctgtcgcggtgcaacaggaaggatatcgacgccgcatgggaggccgtcaggcacgcgcggaggccccggatccacactttcatcgccaccagcgagatccacatgcagcataagctcaggaagacgcccgagcaggtcgtcgctattgccagggagatggtggcgtacgcgcgcagcctcgggtgccccgatgttgaattcagccctgaggatgccggcaggtcaaatcgagaattcctgtatcatatactggaggaagtcattaaagctggagcaaccactcttaatatcccagacactgtcggatacactcttccttatgaatttgggaaattaattgctgacataaaggcaaacacttctggaattgaaaatgctatcatttccactcattgccagaatgaccttggtcttgcgactgccaacacattagcgggtgctcgctcaggagcaagacagttagaggtgactattaatggtattggtgaaagagctggaaatgcttcattggaagaggttgtcatggcaattaaatgtcgtggggagctcttagatggtctatatacgggaattaattcccagcatattactttgacaagcaaaatggtacaagagcatagtggacttcatgtgcaaccacataaggctattgttggtgccaatgcctttgctcatgaaagtggaattcatcaggatggcatgcttaaatataaaggaacatatgaaataatatcgcctgatgatattggtttaacacgtgcaaatgaatttggtattgttcttgggaaactcagcggaaggcatgcagtgagatctaagctagtggagcttggatatgaaatcagtgacaaggaatttgaagatttctttaaacgctacaaagaggtcgcagagaagaaaaagcgtgtaactgatgaagacatagaagcgttattgtcagatgagatattccagcctaaggttatttggtcccttgctgatgtacaggcaacatgtggaacacttggcttatctacagcaacagtgaaactgatagcaccagatggagaggagagaatagcatgttcagttggaacaggtccagttgatgcagcttacaaggctattgaccaaataatccagatcccaactgttctccgagaatatggtatgacctcagtcaccgaaggcatcgacgcaatcgcaacaacccgggtggttgtcaccggagatgtgaccaacaactccaaacatgccttgactggccgcgctttcaaccgctccttcagcgggagcggggcagcaatggacatcgtcgtctccagtgtcagagcttacctgagtgccctgaacaagatgtgtagctttgctggtgccgcgaaagccagcggcgaggtacctgagagtgcaagcgtccaaagcgcagagtgagcttggcgacgatttggttctcatgtggactgggcggcgtaagagccagagcaactgttaaagagggtgacatttcgtttctgtattaggctgttcaatgttgggggttttgccttgtcagtgtggtgtgactgtactgttctttttttggaggatagcccagcttggaacgtgcaggcaattttggacctaggtagtgtacaatttgtatcttatatgaacaatacttccaataatcgaaagacttaagatgggttgctggagtcaaaaaaaaaaaaaaaaaaaaaaaaaaaaaaaagggaaaaaaaaa

SEQ ID NO: 17036 - DNA, 2365 bp, Zea mays
ttccggccctcgcggccccccccccaaaatccaaatcaccacatccccccattaatttaaggggtttttatgtccaccgccgccgccagcgccaactaaacccgcgacgacggtcgaccatggcgtcctcgctgctctcctcccccgctaaacccaccatcaccaccaccaccaaaacgaccccggccccaagacccgcccgctccgcccatgtccatgtcctctccgccgcccgctgcctccgcctccgcctccgcgcgtcgtcgcagcatcctccgcctccgcccaccccgcggtcgcggcggccggattacgtcccgaaccgcatcgacgaccccaactacgtgcgcatcttcgacaccacgctgcgcgacggggagcagtcgccgggcgccaccatgacgagcgcccagaagctcgtcgtcgcgcgccagctggcccgcctcggcgtcgacatcatcgaggccgggttcccggcctcctcccccgacgacctcgacgccgtgcgctccatcgccatcgaggtcggcaacccggcgccaggacccgccggggaggaggacgccgtccacgtgccggtcatctgcggcctctcgcggtgcaaccggaaggacatcgacgccgcgtgggaggccgtgcgccacgcgcgccgcccccggatccacaccttcatcgccaccagcgacattcacatgcagcataagctcaggaagacgcccgaccaggtggtcgccattgccagggagatggtggcctacgcccgcagcctcggatgcactgacgtcgagttcagccccgaggacgccggcaggtcaaatagagagttcttgtatcatattctaggggaagtcataaaagctggagctacgactctcaatatcccggacactgtcggatacaatcttccttatgaatttggaaagttgattgctgatataaaggcaaacactcctggaattgaaaaggctatcatttccactcattgtcagaatgaccttggtcttgcgactgccaacacactagcgggcgctcgtgcaggagcacggcagttagaggttactattaatggtattggtgaaagggctggaaatgcttctttggaggaggttgtcatggcaattaaatgccgcagagaactgttagatggtctctatactggaatcgattcccgccatatcactttgacgagcaaaatggtgcaagaacatagtggacttcacgtgcagccacataaagctattgttggtgccaatgcgttcgctcatgaaagtggaattcatcaggatgggatgcttaaatataaaggaacttacgaaattatatcgcctgatgatattggtctaacacgtgcaaatgaatttggtattgttcttgggaaactcagcggaaggcatgctgtgagatctaagctagtagagcttggatatgaaatcggtgacaaggaatttgaggacttctttaaacgctacaaagaggttgcagagaagaaaaagcgcgtaactgatgaagacttagaagcgttattgtcggatgagatattccagcctaaggttatttggtcccttgctgatgtacaggcaacatgtggtacacttgctttatctacggcaacagtgaaattgatagcaccagatggagaggagaaaatagcatgttcagtcggaacaggtccagtcgatgcagcttacaaggctgttgacaaaataatccagattccaacggttctccgagaatacagtatgacatcagtcacagaaggcattgacgcaatcgcgacaactcgggttgttgtcactggagatgtgagcaacaacgccaaacatgccctgactggccagtccttcaaccgctccttcagcgggagcggggcatccatggacattgtggtgtccagtgtcagagcttacctgagcgccctgaacaagatctgcagtttcgctggcgccgtgaaagccagcagcgatgtagctgagaccgcaagcgtcccgagcacagaatgagcttccgtttagttcacagtgacatgttcaaaatttctggaaggatcttccattgagcttaggacaggcaggaagtcttggggcctatgtagtgtacaatttatgtgtgtcatatcccgtgctcgttgccagtttgtattgtaccatatataaaccatagaatatgttgccatttagaagtctggccaaggtcagctgtaatgattcacatgcttatagcctggaaacattagacattgaaaacccgagcggtgaataaaggatgcccaaggtagaaactgtgatgaatcaaaaaaaaacagaaaaaaaaaatgaaaaaaaaaaaaaaaaaaaaagcttgaacacctgcccgggcggccgttcga

SEQ ID NO: 17037 - DNA, 868 bp, Zea mays
gctttattgtcagatgagatattccaccctaaggttggttggtccctagctgatgtagaggcaacatgtgccgcccgggcccggtctacagcaactgtgaaactgatagggccagatggagaggagagaatagcatgttcagttggaacaggtccagttgatgcagcttacaaggctgttgaccaaataatccagattccaaccgtcctccgagaatacggcatgacttcagtcacagaaggcattgacgctattgcgacgactcgagtggttgtcaccggagacgtggccaacaactccaaacacgccttgactggccactctttcaaccgctccttcagcgggagcggggcggcaatggacatcgtcgtgtccagcgtcagagcttacctgagtgccctgaacaagatgtgcagcttcgctggcgctgcgagacccagcagccccgaggtgcctgggagcgcaagtgttcaacgcgcagaatgagctcggcggcgttcgtgttagttctcgtatgggatgccaggatggactgtgctgttgaggtgacatttcgtttcagtaacaggctgctcgatattatggggtaccccttgtcagtggggtgacgacaatgctgttctttttctgggaggatagtcccttcagcttagaacatgcaggaaattttggccctgtgtagtgtacattttgtatctttaaacatcctttcaataatgaaataatattagggtccatctagccacatgggtggccatcggcaggaatacgatcgaaaataaaggccccttcggtttgtctttttttttctttgattacaaataaataggatatagaatttataatgaaaaaatatattcttattttt

SEQ ID NO: 17038 - DNA, 4919 bp, Zea mays
catcctgctgagacctttggggatattgtgattgattacccgtaagatgcaataactttctgtcgtgctgatctttacttataaaacaaactgaagaaacataaaactcattttgcaggtatgttgaatgtacatcagcagcaatccaggccctgacatcattcagaaaactataccctgggcaccgcaggaaagaggtggacagctgtatcagcaaagctgctaatttcattgagagcattcagaaaagtgacggttcatggtcagtatttggactccatgcaacaacaaaataataataataataataaacagattcgttatattggaaggtgcctccaaatagcactcctcattaccttgtatatgtttatctgtttccgacaggtatggctcttgggctgtttgtttcacgtacggcacttggtttggtgtgaagggactaattgctgctggtagaacatttgagagcagtcctgcaatcagaaaggcatgcggctttctgttatcaaaagagcttccttccggtggctggggagaaagctatttatcgtctcaagaccaggtaaatccacttctgccagttccttaaattaacagcacttaaacagtggatataccggcaatgctgtttgctgtgctatgtttatctattccagttttcatcatctgtgtgctacagtcaagattttaggggagcttgattctacttttaggtttataataacgtaccaatcccagggaaaacttgactattcagatcgcatcattttatctgaagattctgctacgagtaaatattagatgaaacgcaaacatgccattgagcaaggcagtggtgcagtgttgattctgatatgcatatggacttgttggatttgaaaaaggactctgcattaaccatctctcgacacgctcaatcaggtttacaccaatctcaaaggcaaccgagctcatgcagcgaacactggttgggccatgctggcgctgattgatgcaggacaggtctgtcatttgaccttgtagctttggatactatactaaactctgatacgatgcgcacgtgttcgttatgggtacttaaatcgcgcgtccgtgcaggcccagagagatcccgcgcctctacaccgagcagcaaaggttttgatcaacttgcagtcagaggacggagaatttccccagcaagtaagtaacaacagccggtccacagagatactacccttaatcttgcttacatcaaacacagtctcactttaaaaactttgctcaaggagcaaaagggtaaattggtcttgatatctaaacatcttattattttaggcataacagttttgtcttattagccagggttaatcgttggtcgcctggcatgttgtggtgttgcctttccattcgtaactaactaactattgtgtccgccgccccacccaagagatcataggagtgttcaacaagaactgcatgatcagttactcccagtacaggaacaccttcccgatctgggctctgggagagtaccggtgccgagtcctgggagctggcaagcggtagtgacccggcctggccccgtcaacttgactgaaaggcgctttgttgtcttggtgttcttggtgttctatcttggcacgccgagggctgtcttgccggccgcctagctgtctcatgaatcaatcagcttttttgtgagtagctagctatgtgcggtggttggaataatgcagctatgcttttttttagggttgcgctcctagttctaataatgtactacgtatattggaagcagaataaatgttagattgaactaatggtgccattaaagatgacaatagaactcttccgaagcaaccaagttattacattgcccaaatcaatagaacttcaactgccagcgtcacaaaaccgtggattattcaagcgcgcgcagctctaccggcgacctccacgagttcccatggcgacaaggccttcttcttttttattattttctgttcgttcagaacacaagcaaaatcccgctcccgcgttgcagagacgacgccacagaagccacgtctgactgatttccacgcgccaaccgggggcacggcggcgctcccgctccatctccagttctccaccacaatccacaaggaaggaagcatcagcgcatcaggtcgtagtgggacgaggagccgccgtacgatggcggcggcctggggagctggaggagctcctgcgccgtcgccatggcggcgtcgagagcctggagccgcgcgtgcgcgtggtggcccagggccgcgctgccgccgccgtcctgccacagccccggcgacgaggcctcctgcagcacggagacggagccggcggcgaggcagctgctcggggcagcgcggtggtggtgcagctcagccgccggcggcggcggcgggtggttggtgttggtgcccgccgccaccggccggactgtttgacagaagagagagagcacgctgaaggtccggggcgccgtccgggctggagacggccgcacaggcttcaacgcctgcgcctgaaaagatgcatctttttttcgatatcatctctgaatgtcatcatgttcgtcggaaaatggcgcatttttattaccttgatgatcaagggtctttggactgattcctttgaacgccgtgaccgtgaacccatcgaaatcctcctgatgggcaacatgcggaatcgagtcattccacacctgctgctgctgctgacctgacaaaggcagcagcccatcagcagcagctctcgccggcttcaaccaaggagctcctctcgtctccgcgaatttgaagcctcctcctcctgctcctgggctatcccaccaagaactcgcacagcttctcatctgaccgtagggaccttcaccaaacaggaggctcgcctggcgcctcgtgtctgttcgagaaaggcaaaggcggattcagttgctacaagaagcagaataatcaatgcttatcactagtaccatagaacatcgccgacagcctcgatgagccgaaagggagcgcttcgggctggggcttccgcctgcgcgcgttgtggtcgttgagtcgcctgcggcagctcttcttcttctggtcgaactcggccagtccatggaacctgcaaaggaactgcactttgaacatggcacgacgtttttccttcctacaatctcgcagaaggaaacggacagagaggcgagggcgaggtttagataacaagctaaagaactcaccggctgcactgctggcagaagcgccgctccaggccagcgacgaccaccttgggcgccttggaatggggctcgcagactctgtgcttgcgatgatagtctttagcagaggacagatcggtcctgcagccttcaacctggcagtacgatttctgctgctgcgcggttggagccgccgccgccgccttcgccttcttcgcaggacccggaggggtcgctgcactggcagtgcctaacgccgccgaactcttgccgctctgccctagtccacaaccatcttcgaaatacgttctcttgccaagcttcaggcctagcaccaccggctctccgctgctgagcaccgaaccagtgtccttgtcgggcgctttggcaggtgcgaaactgatgagctccatgttgttcttgttcttgttccccttggcactgggcagagaatggattgacgaggatacggaagaaggcgccggttcatgccctgtggcctcaaggcccgcgaactgaggcgcggcagcggtcgtcctgtggctctcgctcccgtttgcggctgcgggcggcaggttctcccagtcccacagcagcacggaggccttctggttccagtccatgtccatcccaaacgagcccatgccagttgccagtgccaggatccgaaatctgagctgctgctcctcgtcctacttgcctgccgaagcggctaactctgaaacaacaacaacaacaacaacaaaaaggaagagagaagcaggttaaagagcagaaagggttcgggtaagaacaagcatatctgggggctggggcactcagttatgcatcatgattaggttcgcagggtaagtacgcgaggttgcaagaacagaaccgttgaacttttaacagaggaatcgtcgatcacggcaagaacagaacatagtgtagcagcaccaagagagagaggcaagggaacataacccacacccacgagtacgccagtcaaggcgctgcagcaaaaggcaaggccaaagtacctcaccagaaaaaaaagggaacggacagggcaacctgcgtctaggtcagtccgcgtcaggtcagcacgccggctggacagccgtggctgcggctgctgcggcggcggcgcatcggcgagctcggggtgggcgcagcgtgcaagaagctcagcctcgcgcgccggggcacaggttcgccctcatggagcttcttgagatctgtgtaccctgttcctctcttcgtctcctctccgctcagcctggaaaccacagcatcgccaagtcgtcaacagcaactccgggcctccggcggcatcgtggcagcaggtaactggcaaccgccgccacgccctccgtccgcccgatcttttagcgagaatctcacctcgctgtgggtgatgacgggtcgagagaacctgtgtctcgtcgtggtgtagctcttccacggcggcgaccggcagagcgagcagtggggaaggcaaaccagcgcagcgcctctcagaaacccaaaaggcgaggcagagcggcgaggaaaggggagcagatgaggaagacaagactcccccaattatcgacacagcagtacagtacgcgcgatatggccggccttttgttttgcttttgcatccatctctcattctctctctctctctctggccatcgctctgcagtggctggctgctggctctgggctctggctgcgggcagcc

SEQ ID NO: 17039 - DNA, 2724 bp, Zea mays
gggaccgggagccacgccacgcaggcacgcacgcggaggggagcgccggccgtccgcggcggattgggatctccctcgcccgcccgtccactcgagactcgacggcacccgccgcatttgagctgagctgaggaggcgtgggggacggcgcggggatgtggcgcctgcggatcgcggaggggggcggggacccctggctccgcacgaagaacgcccacgtcggccgccaggtctgggagttcgacgcctccgccgaccccgaccccgccgtcgacgccgcgcgccgcgccttcgccggcagcaggggccacctcaagcacagcgccgacctcctcatgcgcatccagttcgccaaagaaaatcctcttgagcttgaccttccagcgatcaagctcggtgagcacgaagacgtaaccgaggaagccgtgtctactactttgagaagggcaatcagccgtctttctactctccaggcacatgatggacactggcctggggattatggtggccctatgttccttatgccaggcttgatcataacattgtatgtgactggagcactaaacactgtcttgtcatcagaacaccagaaggagatccgtcggtatctttataatcatcagaatgaagatggtggctggggcttgcacattgagggtccaagcaccatgtttggctcagcactgacctacgttactttgagattgcttggagagggaccagatagtggagatggagcaatggagaaaggccgaaactggatcttagaccatggcggagcaacatatataacatcctgggggaagttttggctctcggtacttggtgtatttgaatggtctggtaacaacccggtaccaccagaagtatggctactgccatatctcctgccatttcacccagggaggatgtggtgtcattgtcgaatggtgtatttgccaatgtgctacatctatgggaagaggtttgttggtcgaatcacaccactcgtgttggaattaagaaaggaacttttcaaagacccttacagcaagattgattgggacaaggcccgcaatctatgtgctaaggaagatctgtactatccacatccatttgttcaagatgtcttatgggccactctccataaatttgttgaaccagttatgatgagttggcctggcagtaaattgagggagaaagctctggagacagccatgcaacatgttcactatgaggatgagaacactcggtacatttgcattggtcctgtaaacaaggtattaaatatgcttgcttgctggattgaagatccaaactcagaggccttcaaactccacatcccacgagtctatgactacttgtggcttgctgaagatggcatgaagatgcagggttataatggtagccaactttgggatacagctttcatagttcaagccattgtggctaccaaccttaccgaagagtttggtcccacccttaaactagcacacaactatatcaagaaatcacaggttcttgacgactgccctggtgatctgaatgactggtaccgccacacatctaaaggcgcatggccattctccaccgcggatcatggttggcctatatctgattgcactgctgaaggactaaaggcttcattattgttatcaaagatttctcctgaaattgttggtggaccgatagaagctaatagattttatgatgctgtcagttgtctgatgtcttatatgaatgataatggtggttttgcgacttatgaactcacaagatcctatgcctggctggagctgatcaatcctgctgagacctttggggatattgtgattgattacccgtatgttgaatgtacatcagcagcaattcaggccctgacatcattcagaaaactataccctgggcaccgcaggaaagaggtggacagctgtatcagcaaagctgctaatttcattgagagcattcagaaaagtgacggttcatggtatggctcttgggctgtttgtttcacgtacggcacttggtttggtgtgaagggactaattgctgctggtagaacatttgagagcagtcctgcaatcagaaaggcatgcggctttctgttatcaaaagagcttccttccggtggctggggagaaagctatttatcgtctcaagaccaggtttacaccaatctcaaaggcaaccgagctcatgcagcgaacactggttgggccatgctggcgctgattgatgcaggacaggcccagagagatcccgcgcctctacaccgagcagcaagggttttgataaacttgcagtcagaggacggagaatttccccagcaagagatcataggagtgttcaacaagaactgcatgatcagttactcccagtacaggaacaccttcccgatctgggctctgggagagtaccggtgccgagtcctgggagctggcaagcggtagtgacccggcctggccccgtcaacttgactgaaaggcgctttgttgtcttggtgttcttggtgttctatcttggcacgccgagggctgtcttgccggccgcctagctgtctcatgaatcaatcagcttttttgtgagtagctagctatgtgcggtggttggaataatgcagctatgcttttttttagggttgcgctcctagttctaataatgtactacgtatattggaagcagaataaatgttagattgaactaaaaaaaaaaaaaaaaaacacaagagaactcttccgaagcaaa

SEQ ID NO: 17040 - DNA, 2713 bp, Zea mays
  misc_feature (2703)..(2703): n is a, c, g, or t
ctccactcaaatcccaaatcaaatcaactccccagcctgaactgtcctctcctggactaccctcgccatccatcaacgcccgccacagagggggatcccggcctcccggtgccgggagccaagccaagccacgcaccggccggccgcggcggatcggaacctcccccaccgctcgcccgccgcatttgaggagggcgatgtggcgcctgcggatcgcggaggggggcggggacccctggctacgcacgaagaacgcccacgtcggccgccaggtgtgggagttcgacgccgccgccgaccccgaccccgccgtcgacgccgcgcgccgcgccttcgtcgccaccaggggccacctcaagcacagcgccgacctcctcatgcgcatccagttcgccaaagaaaactcgattgagcttcaccttccaggcatcaagctcggtgagcatgaagatgtgaccgaggaagctgtgttgactacattgaaaagggcaatcagccgtttctctactctccaggcacatgatggacactggcctggggattatggtggtcctatgttccttatgccaggcttgatcataacattgtatgtgactggagcactaaacactgtcttgtcattggaacaccagaaggagatccgccggtatctttataatcaccagaatgaagatggcggctggggcttgcacattgagggtccaagcaccatgttcggctcagcactgacctatgttattttgagattgcttggagagggaccagatagtggagatggagccatggagaaaggtcggaactggatattagaccatggtggagcaacatatataacatcgtgggggaagttttggctttcggtactaggtgtatttgaatggtctggtaacaacccggtgccaccagaagtatggctactgccatatctcctcccatttcacccagggaggatgtggtgtcattgtcgaatggtgtatttgccaatgtgctacatttatgggaagaggtttgttggccgaatcacaccacttctgttggaattaaggaaggaacttttcaaagacccttacagcaagattgattgggacaaggcccgcaacctatgtgccaaggaagatctgtactacccacacccattcgttcaagatgtgttatgggccactctccataaattcgttgaaccagttatgatgcattggcctggcagcaaattgagggagaaagctctggaaacagtcatgcaacatgttcattatgaagatgagaacactcgttatatttgcattggtcctgtaaacaaggtattgaatatgcttgcttgctggattgaagatccaaactcggaggccttcaaacttcatatcccacgagtctatgattacttgtggcttgctgaagatggcatgaagatgcagggttataatggcagccaactttgggatacagctttcacagttcaagccattgtggctaccaaccttattgaagagtttggtcctacccttaaactagcacacaactatatcaagaattcacaggttcttgatgactgccctggtgatctgaatgactggtaccgccacacatctaaaggtgcatggccattctcaactgctgatcatggttggcctatatctgattgcactgctgaaggactaaaggcctcattattgttatcaaggatctctcccaaaattgttggtgaaccgatggaagctaatagattttatgatgctgtcagttgtctgatgtcttatatgaatgataatggcggcttcgcgacatatgaactcacaagatcttatccctggttggagctgatcaatcctgctgagacctttggggatattgtgattgattacccgtatgttgaatgtacatcagcagcaattcaggccctgacatcattcaaaaaactataccctgggcaccgcaggaaagaggtggataactgtatcagcaaagcttccaatttcatcgagagtattcagaaaagcgatggttcatggtatggctcttgggccgtttgtttcacatacggcacttggtttggtgtgaagggactaattgctgctggtagaacatttgagaacagtcctgcaattagaaaggcatgcgactttctgttgtcaaaagaacttccttccggtggttggggagaaagctatttgtcatctcaagaccaggtttacaccaatctcaaaggcaaccggcctcatgcagtgaacactagttgggccatgctggcgctgattgatgcaggccaggccgagagagatccaacgcctctacaccgagcagcaaaggttttgatcaacttgcaatcacatgatggagaatttcctcagcaagagatcataggagtgttcaacaagaactgcatgataagctactcccagtacaggaacatcttcccgatttgggctctgggtgagtaccggtgccgagtcttgggggctggcaagtcttggcggtgaacgggaggtgtgcgtgtgtgtgtgtcatggatcggcttttgtgagtagccatgtggaagttggaataatatagctacgttacgttcagggggttgcgctactagtggtcctagtaataatagtgatggtgatagcaatgtactcctcattattacaatctcaaagtggttcatgccattgccatgcacttctcataaaaactcgagaaaaaaaaaaaaaaaaaacncgaggggggg

SEQ ID NO: 17041 - DNA, 1437 bp, Zea mays
  misc_feature (611)..(611): n is a, c, g, or t
attgggacctcgagccggcgggtcgagtctttaactcccatcccacgagtctatgattacttgtggcttgctgaagatggcatgaagatgcagggctataatggtagccaactttgggatacagctttcatagttcaagccattgtggctaccaaccttaccgaagagtttggtcccacccttaaactagcacacaactatatcaagaaatcacaggttcttgacgactgccctggtgatctgaatgactggtaccgccacacatctaaaggcgcatggccattctcaaccgcggatcatggttggcctatatctgattgcactgctgaaggactaaaggcttcattattgttatcaaagatttcccccgaaattgttggtggaccgatagaagctaatagattttatgatgctgtcagttgtctgcggtcttatatgaatgataatggtggttttgcgacttatgaactcacaagatcctatgcctggctggagctgatcaatcctgctgagacctttggggatattgtgattgattacccgtatgttgaatgtacatcggcagcaatccaggccctgacatcattcagaaaactataccctgggcaccngcagcgaaagaggtggacagctgtatcagcaaagctgctaatttcattgagagcattcagaaaagtgacggttcatggtatggctctttgggctgtttgtttcacgtacggcactttgctttgctgtgaagggactaattgctgctggtagaacatttcgagactcagccctgccatcagagaaggcctgtcgcgtgtctgttatcaaaagagcttccttccggtggctggggagaaagctatttatcgtctcaagaccaggtttacaccaatctcaaaggcaaccgagctcatgcagcgaacactggttgggccatgctggcgctgattgatgcaggacaggcccagagagatcccgcgcctctacaccgagcagcaagggttttgatcaacttgcagtcagaggacggagaatttccccagcaagagatcataggagtgttcaacaagaactgcatgatcagttactcccagtacaggaacaccttcccgatctgggctctgggagagtaccggtgccgagtcctgggggctggcaagcggtagtgacctggtctggccccgtcaacttgactgaaaggcgctttgttgtcttggtgttctatcttggcacgccgagggctgtcttgccggccgcctagctgtctcatgaatcaatcagcttttttgtgagtagctagctatgcgcggtggttggaataatgcagctatgttttttttagggttgcgctcctagttctaataatgtactacgtatattggaagcagaataaatgttagattgaactaaaaaaaaaaaaaaaaaaaaaaactcgagcccgggtcg

SEQ ID NO: 17042 - DNA, 921 bp, Zea mays
tcaggccacatcagcagcaattcaggccctgacatcattcaaaaagaaagaggtggataactgtatcagcaaagcttccaatttcatcgagagtattcagaaaagcgatggttcatggtatggctcttgggccgtttgtttcacatacggcacttggtttggtgtgaagggactaattgctgctggtagaacatttgagagcagtcctgcaatcagaaaggcatgcggctttctgttatcaaaagagcttccttccggtggctggggagaaagctatttatcgtctcaagaccaggtttacaccaatctcaaaggcaaccgagctcatgcagcgaacactggttgggccatgctggcgctgattgatgcaggacaggcccagagagatcccgcgcctctacaccgagcagcaagggttttgataaacttgcagtcagaggacggagaatttccccagcaagagatcataggagtgttcaacaagaactgcatgatcagttactcccagtacaggaacaccttcccgatctgggctctgggagagtaccggtgccgagtcctgggggctgctggcaagcggtagtgacccggcctggccccgtcaacttgactgaaaggcgctttgttgtcttggcgttctatctcggcaacgccgagggctgtcttgccggccgcctagctgtctcatgaatcaatcagcttttttgtgagtagctatgcgcggtagttggaaattggaataatgcagctatgcttttttttagggttgcgctcctagttctaataatgtactacgtatattggaagcagaataaatgttagattgagctaaaagaaaatccaaaaagaaatacgaagggaaaaattaaatatggacaattaaaatgttaaaatattctggggagaagccatttgaggttg

SEQ ID NO: 17043 - DNA, 1307 bp, Zea mays
cgggaaaagtgattgttgtagtagaatccaaagcgcaagcggctgcagcctgcaggcagcgccgcgcaggcgtgggagtggccgagtgggagtgggagtgaaaaagaggaaccggccaagagaagcaagcgagaagaaggcagtgctgcggcggcgttccgtaagatggggaagtacatgcgcaagcgcaggggggccgcgggcgagggggtggccgcagtcgaggtctcgcaggtcgtcggcgtccggacgaggtccaggtccgcggcggcgaccggcggcggtgtcgcgaaggtcgctccgccgaggaggaagaaggcgctgctgcccgccgcgaacgagacggcgtcgggggagcctggtgccgtgggcggtggtggtggggacggcggaagctgctgctacatccacctgcggagccgcatgctgttcatggcagcacctcagcagcaaccgtcggcggctccgacgcccgcggaggctgctggtgcggcacagcagggcggggtggtggcgctcgcggctggcctctcgcgttgctccagcacggcgtcgtcggtggacgtcgggggccagcagcccgcgagcgggagccacgcctgccgctccgacgctgcgcctgcggaggttgacggggatcacgtcccggatgtcgtcaccgcgagcaactcggggagcgtcccggaccgcgagaggagagagacgacgccatcgtcgagccgggcgcacggcggcgagctcagcgatctggagtcggatctggtggggcggcagaagactggctgctcgtcgtcgccggcgacaacaacatcggctgcggagctgatcgtgccgccagcacaggagatccaggaattcttcgcggccgccgaggcggcccatgccaaacgctttgcttccaagtacaacttcgacttcgtccgcggcgtgcccctcgacgccggccggttcgagtggacgccaggggtcagcatctgaagcgagcgtgcggtgcaaggtgaagctactactagctagaaagtgaggagaaaaaaagaaaagatgccgccaaaaaaacataacggaaaggagaaaaggcaaaggagctttataggctagctaagctaaccaccattcaacatctgccttgcttttttctccggagtagacttgtagaatgacagcgtagttatttactgtttatccagaggttatcttgaccccccaacagatcacccgcttaaaaaaaaaaaaaaaatgtatcgtagacggaatttaatttactgtacagcacctagctggcttgcaaaaaaaaaacccaacacaat

SEQ ID NO: 17044 - DNA, 9179 bp, Zea mays
  misc_feature (568)..(568): n is a, c, g, or t
  misc_feature (7396)..(7396): n is a, c, g, or t
  misc_feature (7600)..(7600): n is a, c, g, or t
agacaaggtttgtgcttatagctttccaacaaaactatttaaacacaaccgagctcggcgccaagatctgtggcgccgagcttggtgccacgttggcgccacgacgttcgggtgtgccagcgtagcacgtacctcggcgccataggctatggcgccgagctaagggtccaaaattgctattaaaattttttagggtctaaacgtgattttttctctaaaaaagggctaaaatgtaaaaaattcggtccttccggcccatcgcatggctgctgcggggacgtagtactgctcagtcacaggacggtgcaggttccaacttccagggggggtggggaggtgaatgggtcacgatggtgtcgccagcaagtgccaaaacagaaggttcttgtgctctgctgccaccaaaggagcccaagctgagattttcgatggtgttttgctctgtgatgacatccatgcccccccccctcccccctctactgctggtttctctggcaccggtgtaattttgtcggctacagaaactcaactgccatagcgcgtagtcagtgattttattatagaagtnctgcttctgagattcctcaatgccaggaagcaggatctggtatatgctttgcaggtctggtatatttcttgggtgcaatgtccagtgtgctagtcatctgggaatggtagcaccactgcccatgttccccgggagacctcatcgatactgttactttactccaagtgtcagtctttttttttgaacctgaaaattgacttccattaaccaaagctcagtgatcttgcacttcagttatatgagctggaaaatccttcagcgccacagctcactcgagaacacagagaaaactgaccaccctcctgagctaaatgccgaggtggatgagagaggagaagcgggctatgaacgtacaaccgccttagacacaaaaaaaccaataaactttgtgagagaggcaagtgagtcttgcattaaaatctatgtatctaaaaatcataacgactttttaatttggaacgtatttgctcagtgctatatacgatatggccctgtgatggattaacgaatgtttctagtgaaaattgcatatgtttttttaaaaaaaaaacgatttagatctgatctaatattttccttttttcataatatttttataccagtatatcgaaaagcgaaaacggaaggcactggcagcggttatgataaaacgaagaataccggatcgaaacggcaccactagttccctgccctcgactcccaacattcgtactcgtagcagtaggagtacgatatctgaacgctgattgcaagaggacaagggaaacgcgtccaaacgtacgtacaccgccatgcatgcatctcccaagattctacaggcagatgtaataatgactcgtgatctaaatgttcttcaataatttaaataatttcagtttaaatattactagaaatagagatcgaccataattcgatttgatttttaaattttatagtgtagaatctagaccctatcaccacctctactaggtagatgacgcacgtgcacgccgcagcccatcgaaatggtgtcatggtctgggcgatgtggtgcccggcgccccggccccctaaattatgtctatcttttctaactgcccatctgacctgtgacgctgcattgcattgcatcgcatctaacagtttcataaaaaaaaccaatcgcgagtgtactgggaaaattatcagaagcaccgtactagagagagagagagagagagaattgcagcagagctcttccgtccgacaggctctcgtcagtcacaggcggatagaacccgcctccctgcactgttcgctggaccgggcccgtcctgccccaaccctgctgctaaacagcacgctttttcagagagaaactttcaggagttacctatcctcctccacttctctactgcgtcgcctgctccggaccacaacatcccagtttctttcgttcgtcgggtaataaggctgcacctctgcaacggagcccctgacgtccgtaacgttctgtccacgggaacaaagcctgtaacgcaagaatcgcaacgtccctctctgcgaactgtacagtacggggcgcggccggttaagcacgccaccgttccgctcctcgccgttaagattttcgaattcgaaacccctcctgggcacgggcacccaacggcatgccagccgtccgatccgccgcactgcacgtgtcaggctgagacccgcaggggctgtctggtaaaaataattacgcgtgccgtgtgccaggcgtcgaagcttcccccgctacattccgtttgtgggctgcacctgcactgcacgccgttcccacccccgtgtgccaggcgccgaggccgagcgtaccggccgcggtaggtggggccggccgcacgcgaccagcgccgtgcgggcgctcccccaacggacagatccggctaacgtcgccgtcagggaagggccgatcctggccgtcggatccggatccattcccctcggccgcggcatcttatatttgtaggcgcacccgagcgcccgacgggtgcgtgattgttgtagtagaatccaaagcgcaagcggctgcagcctgcaggcagcgccgcgcaggcgtgggagtggccgagtgggagtgggagtgaaaaagaggaaccggccaagagaagcaagcgagaagaaggcagtgctgcggcggcgttccgtaagatggggaagtacatgcgcaagcgcaggggggccgcgggcgagggggtggccgcagtcgaggtctcgcaggtcgtcggcgtccggacgaggtccaggtccgcggcggcgaccggcggcggtgtcgcgaaggtcgctccgccgaggaggaagaaggcgctgctgcccgccgcgaacgtgacgacgtcgggggagcctggtgccgtgggcgctggtggtggggacggcggaagctgctgctacatccacctgcggagccgcatgctgttcatggcagcacctcagcagcaaccgtcggcggctctgacgccggtggaggctgctggtgcggcacagcagggcggggtggtggcgctcgcggctggcctctcgcgttgctccagcacggcgtcgtcggtggacgtcgggggccacgcctgccgctccgacgctgcgcctgcggaggtgagtgagactgtgagcccgagaaaccctagaactattcgaattctaaaccggcctgcccgagatctccggcgcgcgcctcccgttgctgaatttcgcgagatctcggatgcctccctcccccgttgctgaattgtgcgggctctaactctaacaggttgacggggatcacgtcccggatgtcgtcaccgcgagcaactcggggagcgtcccggaccgcgagaggttggagaatcctctcttgtctctctccaatcctgctgaattatgcctcccaccgtgctcctgacgtcgttccgctcgtgggtttttggaaactcaggagagagacgacgccatcgtcgagccgggcgcacggcggcgagctcagcgatctggagtcggatctggtggggcggcagaagactggctgctcgtcgtcgccggcgacaacaacatcggctgcggagctgatcgtgccgccagcacaggagatccaggaattcttcgcggccgccgaggcggcccatgccaaacgctttgcttccaagtaagactcctcggcctcgccaagctatataccggcgtccagaaaacatttttttaccgcgtgttctccgtagcatgcaggaattacgcacgcaaacttctttccccgtgcttaatttcgcggcgcgcgcgtgccgtggcttaccgcggccggccggggtgtgctgaattgctaacctgacgtgcgtgcgttggcgatctaccttcgatgcgatgccaggtacaacttcgacttcgtccgcggcgtgcccctcgacgccggccggttcgagtggacgccgggggtcagcatctgaagcgagcgtgcggtgcaaggtgaagctactactagctagaaagtgaggagaaaaaaagaaaagatgccgccaaaaaaacataacggaaaggagaaaaggcaaaggagctttataggctagctaagctaaccaccattcaacatctgccttgcttttttctccggagtagacttgtagaatgacagcgtagttatttactgtttatccagaggttatcttgaccccccaacagatcacccgcttaccgtaatttgtctcctgtatcgtagacggaatttaatttactgtacagcacctagctggcttgcaaaccaaaaaaaaaatctgatttttactatccgtcccgagttattaaccaccgcatatcaacctccccgtacaacacatacaccatggtgaaaaattatagtatcaccgtacgtacgtcttgggattctacctacagtacaatttccaaaaaaaaattacagaacgagagatatcgaggcagcagcaaaaggccacggtgacgtacaccggccgcacacgaactacctagctagctaggcgaggttaattaattttatcccggcaggccacaggcgtcacctgcatgcacctgatattctgattcgatcgcagtaggagtagcagtagtagcagtactactactgtgcagcatgatccatccatgcaacggtcactgtatcccaggacaggcaaactgcagtggaggcttctatggcgtgccgtggaaagaaggttaggacgacgacgacggggggacccaagcagtcccggccggcccctatctcgctctcgctcttgccgaggcggatcaccatctctgctgcctgccaccatcagcccagtactccagttaaaacaaagggtggttaagcagtaaagcgcgattaaagtaagccgtaaagcatgatgattagcgttgtgactgccgcaattaaactagtgttgggatacacacacgcacgcaggcacgcatgttactgggaggtggagacgaggattattgggaatcacgacgcatgtgagcacatggataggcaagtgggggatgcatgaggtggcggccgggggtgcagctgatgagcgaggaatgtttactgccatcgggatctgctgggcagctggtggagttagagtacgctggtgaattgaaaactaggaaggcaaggacagagaagcgacggtgattcgatgccaaccgcgcggcgtcgcccacctgccgcttgcttgcttgttgctttgcactggaaaggatactcatactaggcgtttgttttttttaaaaaaaaaatatatgctggtccagcgtttcctgtggcctttacctttctgcccatggtctcgcggtttttctggccacttcctagtccatcccgatatggaaaatattcgctccgctcgttcttgcgcttgcgcatccacccgtgccgtgccgtgccgtgtcgtcatccaaatctaaatcgtgctagactactgctagtggaaaatgaaggtctcgtgcgaagtttttcttttgttcccgtcaatagtacgtgtggttaggtgcccaggaaacgacattgaaggccatcatagcgtttcaaattcgaaggggccaatcaaaagcccccagactatatactaccgtagacggagctacttagcagtagagaatactatatatatagcgttcaacagacgtggaagaaagtctggttattgatgattgcgggatgcatggggccggagatgggcgccatgacatggtcgtctatagctagcagttgaggagcacgtcacgttggagcgtattgatggctactaataaacaagtatagctagctaggtttagcggcgagccgagatccgtggatggtggggaggtcttgggtatccgggccgcccccgtgggtcgaccaaccagcgggggccgccgcgcgcgaaccatcagccacagccgcgggtgggggaactagcgactagcgagggccttttattgcttggaaaactggcgacaagcgtatgatatgataatcaggggtcggtacagtacactttgtaaaacgtggcttgcattggactctgcgcccatcgagaggaaggtgaggatccctaggccggtgacattccgcgaaaaccatcaagtgctggcactgaaactcttgtcctttacttttggccttttgggtcactagttttatttggctagctttgggtttgggtcaggcggttggcagggttcgttcctaagttttttttttcaatttgactattttcatgttaaaagttcttatttataccgatgagatccatatttttggttttagattcaaaaagccgacactaaaacccatagcatgcctagagaccgtgaaccatggcgacgaggtcaaaaacaacataacatgcatggcacctgaactggtaatggtcgccccggcaacatttggtgcggagctgacgagctcgacaccatgatccgtggcgtcaagactttgacaataactctgtgactagtttcaagcctgagcatcacaacatttatttctctccgctctgcccctctctctctccatcctaccatctccaatatcttgattattcaacctttaaaagttggatttgatccatatatcttcgagagctaggtatccttcacccacttctcgattcacacacacttttacttggccaatgtccagtgtattttgcaaacctagttagctaggatgctagtgtgtcaagcagatttgattttgggtggatatgtaaactgctgatttagttctgatattgatttatatacatgtacaggtaggtgcatatgtttcatgattaggttgtgatagtagtcattatcaaatagtttagtgtagctaggttttgcttaatttgtttgttagttagctagtggtaggcactgttcgatctgcggctcccatctagctgcggtgctgcctggagtaaattcgaaaagggaagcctgctgctgtgctgtgtgacagtggacctggagggaagagaagtagagaatggcagagtttacggcagagatggcgtcagttaaacgtccaaatgccggtcatcaattccatgggtcggcgtcataatctgctggcgctcgctacggatcctgtattaaagtgtggtgtctgcaaaatctggtggaggaggagaggactgcaggccaacgccgatggagccctgcgcattcgagatatgctaccatatatagcggcgaggtgtgcgagccaaccacaagctcgttttagcgccatgtcaagggtactttctgtgtgcgtacgcgccgcacgttttgtaaactttttctgttcgcattcatggctcttgctctgcatgcacattatattgcgtagctaaggcacggatcggatagtatttttgtgtacagtccgtatatatgtantcacgcctcgcgtaatggtcggctttggtctttggatccgatcagggcatttaggacaggtttattctcgacaaaaaagggcattacaaaacatctcatggataatacacagaagtaaacataattacatatataaacaaataaaattgttcaagaaaggtacacgactgattcaaaacacgaaaaccagcagtaaccccagtncaagaaaataaaatccactgtagatctctaaaagaggaaggaaaaagagaaatacaaaaaaataaatgaaacaataaaaaaatatgaaatgaaaggtaaaagtcaagagataaataaaaataaaagaaggaagaataacacattccggttctaggagtatattatgtttggtctaagatgaggagaataatactccagtgtagcggtgtaggagtagaggaaaatcggaaagaaagaaagaaagaaatataaatatgagggaaaaacgttgtactttttcaatgaaaataggtaaaataaaacgtgggggcaaaccaagaggcgaaatgatacattgggctaactggcatgcatggccgaaaagaagcccgccggcctgtgtgggacgcggtaacaagcgagcacgtgggcggtcgcgcctccttcgctcacgcagcgcggccggtggcccaaacccgtgtctcgccgcgcggatttcactgggccgcctcgaattgcgtcacgtcccacgcaggccccgctccgcggcacggaacggcattggcgtcgcaatttacgttactgtttatttttctctctctctctcttttttatggtggagcctgacaaaggaggacggatgtgtcagaagtcaacttgctaaacatgattttaacaaattcatttttggagaactgttgaagttgatataagaagacagccctgccaaagaaaaattggctcctttacgtttggcgctcgcggggccggtgcgtggtgcgtttgcagatcccaggcgagcggacggggcgtgcggggtcgcggtctgccggtgccgatgccgatcacacggtcacctcgtgtgcggcgtgcccaccgcgtctggctgcactggaacggtcgcccgagctcatgctcatccgagccgcgccctctcggcggtgacgctgacgctgacgcgtacggtcccgcccgccgcgcgcgccgtcgctttactggctcccagtcccagctgtgtaacataacgcgcacagggcacgggtcgggactgttgattgctcgcgaccgaattggcgcgttaggtcgggcggaccgtggacggacggacggcctctcaccgggacatggatcggggccggccagcatcgatcattgcgaccgggcggccatgcatgtgtacgtggtaatactgtcgcgttggccttgcattgcgtcgccgataagaccaaccggtgtgcgggtgccccgccaccggtcgatgtccacaggcctgctagctacgcgcaacgcaatgttggacgatggtctctctctctctctctctggatcgagacgcatggcctgctccataattttgttgactgacatcgcaaacaaaggtagctagctgcgaacccagccaagagctgctctcgaagcgaacaaaaagttaattgtgtgatgtgaacgtcgcatgcaaagtagcacacagtgaaactccttacgcaaaatataatcgtcttgctcatttggtcaagttccgcgttcgttgacgatctgtgcagtcgctggattgatcgcatgtttcgaatcttctaattacagccctatcaaccatcgg

SEQ ID NO: 17045 - DNA, 4772 bp, Zea mays
cgatccgccgcgctacacgtgtcaaacggagaccccgcggggcctatcagcgtgtgtgcgccaggcgccgaagcttcctccgttacgttacgttacgttcccgtctgtgggatgcacgccgttcccaccggctacactacaccccgaccggcaccatccggctaacggcggcgctgccgtcagggagagggccggtcctgaccgtcggatccgggtctccgccccgcggccgcggcatcttatatttgtacgcgcacgcgggcggcccgacccgacgggttgtgtgtctgtgtgattgtgatagaatccaaagacgcaagcggctgaaggcagcagcgccgcgcaggcgttgtggccttgtgggagaggaaaaagagaaagaggaaccggcctagacaagcaagcgagagggcagggccgcggcgttgcgtcagatggggaagtacatgcgcaagtgcaggggggccgcaggcgcggaggtcgccaccgtcgaggttacgcaggtcgtcggcgtccgcacgaggtccaggtccgcggcggcgaccggcggtgtcgcgaaggtcgtcgccccgaggaggaatagggcgccggcgggggagcctgctgcctccgtgggcgctggtggggacggcggaagctgctacatccacctgcgtagccgcatgctgttcatggcaccgcctcagccgcagccgccgtcggttccgaccccggcggaggctgctgatggcgctgcaggacagcagggcgcggcgctcgcggccgggctctcgcgttgctccagcacggcgtcgtcggtgcacgtggggggtcagcgcgggagccacacctgccgctccgacgacgctgcagaggctggcggggatcacgtcctggtggtggatgtctcggcgagcaactccgggagcggcccagaccgagagaggagagagacgacgccatcgagccgggcgcacggcgagctcagcgatctggagtcggatctggcggggcacaagactggcccgtcgctaccggcggcaacgccggctgcggagctgatcgtgccgccagcacacgagatccaggagttcttcgccgccgccgaggcggcccaggccaagcgctttgcttccaagtacaacttcgacttcgtccgtggcgtgcccctcgacgccggcggccggttcgagtgggcgccggtggtcagcatctgaagcgagcgtgcgtccggtgcaaggtgaagctagaaagagaaaagatgcccccaacaaacataacggagaagagaaaaaccaaacaattaagcagctttatagcctaagctaaccaccaccattcatctcgtccaaatgccttgcttttctctggagctagcaggagcgcgtagttatttagtactactttacttattcagaggttatcttgaccccgatagatcaatccgcttactgtgtaatttgtctcatgcatctcttagatggagtttaatcgtcttaatttactgtacagcagcttgctggcttacaaaaaaaaaaaaaaaagtctctaatccgagtcacgtttagctaccgcgcgtgtcggcgtgtacgctgcttgttggatatacatcctctcctgttgctggtcccgaaatcctctgatccttctgcatcacgccatttcttccatccatctggatctggcggtactttcgtttcgtatcaacctccccgtacgtactaatacatacatcaaagtgaattttttttaccaaacgtcttatatgtatttggtggatcgagaattcgagatatatatcgagaggtagcagcaagaaccatgcatggtgacgtacgtacaccgcatccagcgacaaataaaaagaaacggagggagtatcttattcggacgtgtcgagcgcatcattgagcacctaataaaagagaagagcaggccatcaagcccgggacggtgcatgatttgaacggccggcatgaacatgcaactcgccaataatatagtgctgcagatgcctattatagtcgtcatcatgtggacaatgtcattgctcgcataaggattcaatgtttcaatgcaacgcgcgaacgcgcggaagagaagtggtcttctcggaagggttctggagtctaggtagcaccacgaatcgaaacgcctgcatgcagggctgcggtcaatcgaggactatcatgcacacgtacttttggaacgcgacagcggaaatgttcagatgtacgtaacccctagctaaaagggtaactcgagttgaggtttgaggtgcacagttgacacaacgaactctcgtgttctcgagaaacaggcgaacttttttttccctagtttccggcgagatacagctcaagcaagcgggaaaccgtaaaccaagaatgtactccagaaacagcggtttccagcagctcatccagctgttggagagtctaactttctgcatatttgatttgaattgcaaaacaagaatactattatattttttcataaaaaaatcgataggctaagctagtgatgttacgcggacgttgcgcagatagcagaggtccgctgtcatcagccggaacccggaagcagacgcgcgcggcgtccgcttcttggcctgcccactgccgctatcatctgacctgagcggtgggcacggtggaccgagcccagcagaagacggcagctccccaggatttttttctacgggcaaatgatgaccagatgtgaccgcaattttatcagcagtggccgtacgcctaactatatagtaataccataaactcatgggggaaaaaagaagcaggaaggacctaatcacctaacgcgcgcgtgcgatcaggcggacgcaattcaaaaggtgcgctaaactcgttcccccagaccatccgccggtacagaaagcgagcgtctaattaggagtttaggaccgatcgagcttggcccgaatcatttggcgacggcaattatttgcgctgcgctgcgctgcggctgcggccggtcaatcaatcatcgcatcgcagcccatgcggtgcgcgcgcgcgcgtggctgcagcagctgtcccgaaccttaaatcggacggctccgtgctggcgcgcgcctaacccgaaaccatgcattaccgaaccggccggcccgagcaacgaaacgagcgacgggcaccggagacgcgtggtcgcgtgccgacgtgcacgccggccgccggcgcgcattgcctcgcccgctcatcagccgtggcggcggcggcgcgcgcacgaagcccacgagcgagcgcgcgcgcgcgcgcgctggcgggcaccgatcggcgcgtttactacgattggtttggtcggtcgagcgggcccccctgtttctgtgttgccaattcgtacgagactacgtgcgctgcgcccgtcattgctcgtcgtcgtcgtggcccatgccggcgaccacgaacgagtgctgcacacagtgcagcagagctcgtcgccgcatgcgccttgattccgcggtgatcggaccgaaactaaccagccgggtgcttgcatgtggcgcgtccacatccagcgtgggccgtccgccgacacgtggcgggatgccaggtgacctaccaatcagtggcggtcccaagagccattcaaattgcagggccatgcacggccaccaagctgtgctcgccgctgttcccatcacgccctcgccacctacgcgcccatggccgcctgctccctttatttcacatgtgtgcgtagtacagtaggacgtctggacggtaggagtacgcgtgcagcctctctccatagcatgcagatatacgcagctgcagcaatccgcaacgggacgtgaaatgcattgaagcgaacgtgaagaggctggctaggtacacttaagaagaattgcctacggttgccggtgtcaagctaggtcaaggccaaccgtggtgtctccatcgttcctaggccagccacactatggcaacgtctgcgttgaccgcaaacgccaggctcataccgcgcctgaaaaaggaaaggcgagcagtattttcctggtcgccgggtagcccaaagcggagcgcatatactgcgcgtctacaccagagagcgcacccgacgcacgcacacgcacgtaagcaggcaacgggaatatcttctgaacaccaggcccccagcatccaacaaataaacctttgatgagaaagagaagcagtatggtggcgccacatgattggcgatccggttccgcatgtgcggtcccttctcgccgccatctatcatggtgcttgctgggtgccggcgcggcccccagtcagtccatcattgccactcgcgcgcgtcatttggccggtgttcacaacaacactcaggccggcgtccgtagtagcggcggccgaacgaaacgaacgtgcggatctggggaacggacgaacgagtggagcgtcgccacaggcgctttcgcgcgcttttttttttttttttttttttggcttgcggccccgaaccgggcgcgcctaacacgtggcgcggcgggaccgggcgcgcgatctcgttgcgatccggtggggggccgcgaggcccgcgaggggcagagcagggcgcggctcgcgtcacgtgtccgttcgtgcggcagccggcagagcatgtggatgggtgctgtggaggcggggcagaggcagccactgcggaggtcgatccgccgctgggttggtggaaatgtggaattgtggctgtggctccggtggcgtccgttccctgctcctttggaaggaagaagtggctcccgttgtttgagtaaaaaataaataaaggaatcaatgtgataa

SEQ ID NO: 17046 - DNA, 1055 bp, Zea mays
ccccgtgccgcgccggcgctcggccggcccggccgggaggatatgtcacgactcacgacgacggaaacagtagtgctgccagtagagctctcagaactcgggaaaaaaatgtcagaggccgccgtgcgtgtgatcggcctatggccgagcccgttcgtgatccgcgtcctgatcgccctgaagctgaagggcgtcgagttcgagttcgtggaggaggtggtgggcaggaagagcgagctgctgctgaggtcgaacccggtgcacaagaagatccccgtcctgctccaccacggcaagcccatctccgagtctctgatcatcgtccagtacatcgacgaggtctggtcctccggcgcgccggccttcctccccgccgacgctcacgcccgcgccgtccagcggttctgggcgcagtacgtcgacgacaagctgccttgggcgatccgcatactgaagggaacggacgacgggggcatggagcaggcggcggggcagctgtccgcggccctgcagctcctagaggaggctttcgcgcagctcagccaggggaagcgctacttcggcggggacagcgtcgggtacctggacatcgctctggtgtcgcatgtcggctgggtgaaggcggtggagaagatcgccggggtcaccctgctggacaaggccaaggtcccgaacctggtggcgtgggctgatcgtctgtgtgcccacccggccgtggtcgacgccatccctgacgcggacaagttcgttgagttcagcgtcacctatggctccttctccaagcctatcaatgctcccgccaagtgagcaaaaagggtccgtgcatgctttcgtcattttcactttcactgcgcctgtgccggtgcgtgtcgacccagcctacactagtggctctgtattctttagtgcaaagcttactgttctgaactcagttgcagagtttcattaactttttcaaatgtgactaaagataataaagcaaactgaactgttagtaaccaaaaaaaaaaaaaacccaaaaactcaagactagttctctctctctctcctcgtgc

SEQ ID NO: 17047 - DNA, 1651 bp, Zea mays
gtgttttttgctatattttacatttgttatcttgtaaacttcaaaatagtgcataataatttttatatgtcaaatatttgataatatatgtataattatatatatgtgtggatgggtctcgatatcggatttcgcactgggcccctgaaaagtcagaaacggccctggcacgcaaaacacacggcagcttcgatgacgaaagcgctcacctcagtggctcagctggaaacgacgctcagaaaagaggcagctgtgtccggaacatgacgcacgcaacgacgtctagatagcccgcggccgtgcagagaaagagaaaagaacgagcgcgagctcgctgctttgttatataaatcatcacatacaacttctcctcaggatatgtcgcgactcacgacgacggaaacagtagtgctgccagtagagctctcagaactcgggaaaaaaatgtcagaggccgccgtgcgtgtgatcggcctatggcgagcccgttcgtgatccgcgtcctgatcgccctgaagctgaagggcgtcgagttcgagttcgtggaggaggtggtgggcaggaagagcgagctgctgctgaggtcgaacccggtgcacaagaagatccccgtcctgctccaccacggcaagcccatctccgagtctctgatcatcgtccagtacatcgacgaggtctggtcctccggcgcgccggccttcctccccgtcgacgctcacgcccgcgccgtccagcggttctgggcgcagtacgtcgacgacaaggtgaagcaaaaactaactagctagctagtcgtagtcgaccgagacctcttacgcatacgcatacgcatacgcatgcatgcagctgccttgggcgatccgcatactgaagggaacggacgacgggggcatggagcaggcggcggggcagctgtccgcggccctgcagctcctagaggaggctttcgcgcagctcagccaggggaagcgctacttcggcggggacagcgtcgggtacctggacatcgctctggtgtcgcatgtcggctgggtgaaggcggtggagaagatcgccggggtcaccctgctggacaaggccaaggtcccgaacctggtggcgtgggctgatcgtctgtgtgcccacccggccgtggtcgacgccatccctgacgcggacaagttcgttgagttcagcgtcacctatggctccttctccaagcctatcaatgctcccgccaagtgagcaaaaagggtccgtgcatgcttcgtcattttcactttcactgcgccccttccaaggggaatcgacgcatacactagtggctctgtattctttagtgcaaagcttactgttctgaactcagttgcagagtttcattaactttttcaaatgtgactaaagataataaagcaaactgaactgttagtaacctattacaagagagaaatttactcctcctgcaaggctgtggctgttagtggcttggcctagctttgcccggatatgaacatagtcttcttaatttagtactcccatcaccatcagaagaatcttccttgcttcccgctttgggcgagatcttccggtttccctcctccgttgaattcgtttctggctgaggttaaccttctgtttgttgatcacctgcatcctatatccaaccactaca

SEQ ID NO: 17048 - DNA, 1585 bp, Zea mays
aggatatgtcacgactcacgacgacggaaacagtagtgctgccagtagagagctctcagaactcgggaaaaaaatgtcagaggccgccgtgcgtgtgatcggcctatggccgagcccgttcgtgatccgcgtcctgatcgccctgaagctgaagggcgtcgagttcgagttcgtggaggaggtggtgggcaggaagagcgagctgctgctgaggtcgaacccggtgcacaagaagatccccgtcctgctccaccacggcaagcccatctccgagtctctgatcgtcgtccagtacatcgacgaggtctggtcctccggcgcgccggccttcctccccgtcgacgctcacgcccgcgccgtccagcggttctgggcgcagtacgtcgacgacaagctgccttgggcgatccgcatactgaagggaacggacgacgacgggggcaaggagcaggcggcggggcagctgtccgcggccctgcagctcctcgaggaggctttcgcgcagctcagccaggggaagcgctacttcggcggggacagcgtcgggtacctggacatcgctctggtgtcgcatgtcggctgggtgaaggcggtggagaagatcgccggggtcaccctgctggacaaggccaaggtcccgaacctggtggcgtgggctgatcgtctgtgtgcccacccggccgtggtcgacgccatccctgacgcggacaagttcgttgagttcagcgtcacctatggctccttttcgaagcctatcaatgctcccgccaagtgagcaaaaagggtccgtgcatgctttcgtcattttcactttcactgcgcgtgtgccggtgcgtgtcaaaattgcatagcaaggggattcttctcccacatagatcttcttgtgatcatagtcaccaaatcagctctgaaaatgaagattttctgcccttccaaaggaatcgacgcatacactagtggtattctttagtgcagagcttactgttctgaactcagttgcagagtttcattaactttttcaaatgtgactaaagataataaagcaactgaactggtagttacctattacaatttacaagagagaaatttactccccccgcaaggctgtggctgttagtggcttggcctagcttcagaagaatcttccttgctttgcattttgggcgagatcttccggtttccctcctctgttgaattcgtttctggctgaggttaaccttctgtttgttgatcacctgcatcctatcctatatccaaccactacaggacagtcggtcattaccataagaaaccatcgacatataattctacgcatctagattagacaaggaagtgagctccacaagcctgttcacttggctttgatccgtaccagtttctactcagtgtttttgtctctatagattacagctacagcctgtatcagtctaaacagccgactttaatctcaaacgaacatgatagaaaaaacatggtaattatccactcattccctcttcttcacacctccgctatgctcatcactcatctggatgtcctgactcaatgtaccagctaaaattattgttctttctattaactgcag

SEQ ID NO: 17049 - DNA, 1865 bp, Zea mays
  misc_feature (1858)..(1858): n is a, c, g, or t
gtcacggttcacgacggaaacagtagtgctgtcacctgtcagtagagctctcccctgggccaagaactcgatccgagcaaaaaaatgtcggaggccgccgtgcgagtgatcggcctatggccgagcccgttcgtgatccgcgtcctgatcgcgctgaagctgaagcatgtggagtacgagttcgtggaggaggtggtgggcagcaagagcgagctgctgctcgcgtcgaacccggtgcacaagaagatccccgtcctgctccaccacggcaagcccctctccgagtccctaatcatcgttcagtacatcgacgaggtctggtcctccggcgcgccggcggccatcctccccgccgacccttacgcgcgcgctgtccagcggttctgggcgcagtacgtcgacgacaagatgcacccggcgatccgcgtactgaagggaacgtacgacggggacaaggagcaggcggcggggcagctgtccgcggccctgcagctcctggaggaggctttcgcgcagctcggccaggggaagcgctacttcggcggggacagcgtcgggtacctggacatcgccctggtgtcgcacgtcggctgggtgaaggcggtggagaagatcgcgggggtcactctgctggacgaggcgaaggttcccaacctggtggcgtgggctgaccggctgtgcgcccacccggccgtggtggacgcgatccctgacgccgacaagttcgttgagttcagcgtgacctatgggtcgttctcttaatcctatcaatgctcccaaagtgagcaaaatggctccgcattgcgctttgtgattttcactgcgcatgtgccggtgcatgtcaccgtcaatagcatgtagtttgtatacatgtccttctgtgaaaataaagctttgctgcccgtcaaagggaaatcgacatataaaaaaaaaaaaaaaaaaaaaaaaaaaaaacaaccctaagcttactgttctgaactcgtacattccatttcagtttcaaggataaagtccagtttaacaaaacaacaacacgaccgggcgcatatgcctaggcttcctgctggcggcaacatcgtgcgcattctctcgctgctccagcggcgccgctcatctgccagctgcgcgccggtagcggtcgtccgcctcagcacccggcagcacaagctgacgatgctcctcgttgaactctcgcgttcctctcatctatagatgtccaaacagcgcgggccgcccgtttggctcgtgacccgacacgattttggtccggtccaagcacggtccggcacggttaataacgggttcgggtcggcacggcccgttaagcgggccgggtttggacggctacgaaggcccgcgtgctatggcccggcccggcacgagctgcaggccggcacggtggcggcccgtaagccagccacagacagcctagccctgcggttgcactcgaggttgacgacgacgccggctgttactgtcggcggcaagaagtacgtacgtacacggctgccaccttcttcgctgtcgccacgtctgaagtctaaacaaagtcgacgtacacgaccagtcgatcgagtgctctagcctgacttgatttggtggctgcgcagcagagagcacgcagcagccgtcaccaccaccgcgacctacaaattgaagagcgaggcaccatggctggctgcactgcacacctccacgaaagacagacactagctagctagtgattcgatccgagtggcacgcgggccccatgcatgcatgtcgtgctgcctcacgagatggcgacgtcgcacgccatgctctggaacggccgcgcagacgacggcggagagagggcgatgagctcgggccagcaagncgcctgc

SEQ ID NO: 17050 - DNA, 1263 bp, Zea mays
gcagaaaaagtagagtagactacgacagcgtccggcgaggaggcggaggcgaagatgaggaagaagctcggcacccgattccccgcggctcgaatcaaaaagataatgcaagcagatgaggatgttggaaagattgcactagcagttcctgttttagtttcgaggtctcttgaattgtttttacaagatttaattgaccgtacttatgaaattactcttcaaagtggagcaaagacactgaattccttccacctgtgggattcatacctggttggtccctgactatggccagctaatttgtactatataagtaaataaggtagctcactggccaggcagcctgaaatcagaagcctgggaacgctgcctgagcgaggcagcttctgtcatgagccaaccaaacagccccttaattcgaaaatggaagcaggaagcaatgtgtgaagaggtacagttcttttgatttcctaactgaagttgtcagcaaggtacctgatcttggtggcgctgattcctgtggacatgaaagaggattacctagaagaagaaagtcaaatggcagtgacccagagaatgatgaatcaagatctagtaaaatggccataagaaatgcaaacatcagccccagaggacgtgggaggggtcgaggcagaggacgaggtcggccaccaaccaagagaaaggaggttggttatgtacaatttgaagatgagagcagcatgtttgctgaacaaggtgagcccttgccaggagaggaaacagttcaagagatcaatggcaacgagaccatgcctcaaagcacgcaacctccagtagaggctccgccaacagcccttgcacaagctacaacaagttctaaggcggaagaagcgaacagtgatcatcagtcagattggcctatgccagatgccattggaagcatcggtgtcgtgccatctggttttggacatctgacagtgcaggttgaagatgaggactacgacaatgaggattagtcagggtcatcttctcattgtatgcactaacaggactgttctggtgttgtaaaatgtaaatatagtttgaaatagttgccgcagtttacctgtgattgtctgtcgttttatgcggttatgtagtcctgtgtaactttcgttctccaataattgcttggtagttgcttttttacatgattcaagtgttttgtcacatttaacacagtatttgagcagggattgcctattttaagtatttttgtcttattccaaaaaaaaaaaaaaaaaa

SEQ ID NO: 17051 - DNA, 1227 bp, Zea mays
ctcgaggccggccgggccttcgtggcttcgtgcgttcaatttgcttgtggaacgtggaagaagagcgagaacgccaaacgagaaaagaaacccaagccttcgccatcaaaaaaaaaagaaaaaaagaaaaaaaaagagcagaaaaagtagagtagactacgacagcgtccggcgaggaggcggaggcgaagatgaggaagaagctcggcacccgattccccgcggctcgaatcaaaaagataatgcaagcagatgaggatgttggaaagattgcactagcagttcctgttttagtttcgaggtctcttgaattgtttttacaagatttaattgaccgtacttatgaaattactcttcaaagtggagcaaagacactgaattccttccacctgaagcaatgtgtgaagaggtacagttcttttgatttcctaactgaagttgtcagcaaggtaccagatcttggtggcgctgattcctgtggagatgaaagaggattacctagaagaagaaagtcaaatggcagtgacccagagaatgatgaatcaagatctagtaaaatggccataagaaatgcaaacatcagccccagaggacgtgggaggggtcgaggcagaggacgaggtcggccaccaaccaagagaaaggaggttggttatgtacaatttgaagatgagagcagcatgtttgctgaacaaggtgagcccttgccaggagaggaaacagttcaagagatcaatggcaacgagaccatgcctcaaagcacgcaacctccagtagaggctccgccaacagcccttgcacaagctacaacaagttctaaggcggaagaagcgaacagtgatcatcagtcagattggcctatgccagatgccattggaagcatcggtgtcgtgccatctggttttggacatctgacagtgcaggttgaagatgaggactacgacaatgaggattagtcagggtcatcttctcattgtatgcactaacaggactgttctggtgttgtaaaatgtaaatatagtttgaaatagttgccgcagtttacctgtgattgtctgtcgttttatgcggttatgtagtcctgtgtaactttcgttctccaataattgcttggtagttgcttttttacatgattcaagtgttttgtgacatttaacacagtatatgaaaaaaaatcgccgggggcccgtacccaatcgccttaagggagccgatacaattccctgg

SEQ ID NO: 17052 - DNA, 1195 bp, Zea mays
tgcggccgtgggaccggggaggattacgacaacgcctaataacgagaaaagaaaacccaagacttcgtcgtcaccaaaaaaataaagcagaaaaaaacagagagtagtagactacgacagcgtccgtcgaaccggagggtcggaggcggaggcggaggcgaagatgaggaagaagctcggcacccggttccccgcggctcgaatcaaaaagataatgcaagcagatgaggatgttggaaagattgcattagcagtgcctgttttagtctcgagggctcttgaattgtttttacaagatttaattgaccggacttatgaaattactcttcaaagtggagcaaagacactgaattccttccacctgaagcaatgtgtgaagaggtacagttcttttgatttcctaactgaagttgtcagcaaggtaccagatcttggtggtgctgattcatgtggagatgaaagagtgttacctagaagaagaaagtcaaatggcagtgacccagagaatgatgaatcaagatctagtaaaatggctataagaaatgcaaataccagccccagaggacgtgggaggggtcgaggcagagggcgaggtcggccaccaaccaagagaaaggaagttggttacgtacaatttgaagatgagagcagcatgtttgctgaacaaggtgaaaccttaccaggagagggaacagttccagagatcaacagcggcaacgagattacgcctcaaagcacgcaacctccgctaacagcccctgcgcaagctacaaattctaaggtggaagaagcaagcaccgatcatcagtcagattggcctatgccagatgccactggaaacatcggtgttgggccatctggttttggacatctgacagtgcaggttgatgaagatgaggactacgacaatgaggactagtcagggccatcctctcactgtatgcgctaacaggactgttctggtgttgtaaaatgtaaatatagcttgaagtagctgccgcagcttagctatgattgtctgttatgaggttatgtagttgccctgtgtaacttctgtaattgctttttagttgccttttctctacatgattgactgtcaaagcgttttgtcatatttaactcaaaaaaagtgagcaggggtcgactatttctaagtattttgactttattcaactagtatttgagcagtcctgtg

SEQ ID NO: 17053 - DNA, 700 bp, Zea mays
aatctaacctaacaacctaacaaggcatcagctatcaatccagtattccagatttccagcgccgcttccttttctccgtcgtgctctcctccgcctccggtcaccattaacctagccgccactctcctcggtgcggcggagcccgcctgcccggatcccggacaccggggcgacctcaagtgttccacatgcatcatgggacacgacgctcaccgctcgctatcgctggcggactacggacgactggagctggatttctgtggagaagtggattgctgactgctgtggagaatttcggactttgaagcctgaagtgtgaagtatgaaccatctgtgaagtccaaactgtatttttcttgtggatttgtgatgcaatgcaatggcacttggcggctgtcactggcaggcaacagcagcaccgcagcaggcttaatgccttgcagccttgcacttttgtatcttttgtcgtcgtcgagcactcactacattagtactagtaggtagtacctgtcggctgtattggttcttgaattctcgctcctctacataaggtttgttatctatactagattatgatcttaagatgttctgttagtagtaattcattaatctgcgttttgttcagtgagctgttgctttctgtatatgcattttgttcttgttacaatgtgcattcagatatggaggtacttgtgctttt

SEQ ID NO: 17054 - DNA, 2169 bp, Zea mays
ccgaaataaacagtgccttaaccgttaaactaacgctatgtttttttttcaataaccatgttacaagtggcttggtgaaattctggttggacaacgcggtggtcaaaggaggagtggggtcggattgccgggaagcacgtggctattataagctcagcaacccgaaccgcgtaacaaaacaaaagcatttcggcaaacggcaggctgcacctgcaacacaagaaaagaaaaggcgcgccttttctcctctcgttccaccgacggcgacgcaggcctcacccgcaccaaccttcgttctccttccccttctcctccacgcgcgtcaatttgccatcccaggaaggcagaaccccacacctctgatctgctctgcccatcatccagcgcatccccggccctgacttaacttgctgctcacctcgccatgggaatctcccaccctctctccgacgagtacgacgccctccgcggcgccgtcctctcgccggatacgacgcctccctcatcgccgctcgcccaccgccacctcctggagcacgaggttactaggatggacacgctcgccggcatcgccatcaagtacggcgtcgaggtattcatcattcatccagcaatagtcgccttctccgctttggttggttggttggtggtggtgggtaaaagcctctacacccccccctcgcccgcgagatggaagaggagatctcatgctgttcgccaaaaactccaacttttcctcgtttcttggcaaccatatgtcaaaagaatctccagctctttgcgtcatctgttttatttcttactacataaatccgcaaacgtaaacaactgtgaaaaacttcttctttgagttgttgtgttaaagatctacttcttttattattacctgtagatatctgacatcaaaagggcaaacagtttggtaactgacagccagatgtttgcacacaaatcgctgctcatacctctaccaggaatgcccatgccatccctgaatgcttgtggtcaaagaacgataaggtacatctctctcaatcttattggagaaaccatgcccagaatctgttaacttgtgttagttttgaattagctgcagagataactggatcaactgtatattgccatatcatatcagactgggacatttatactcatttttttttctgcagaacgtgtgctccaaaccatcggcaaaagagagacgcgcccaagtctcgtcagcagggtgcgtcatctgcaatgaataccttgcagagatactatggcctaacaccacctcagaaaggaggaaataccatggatagcagcactgaactgtctgtgtaccataagggcggcggctgccagagtaacctcagcgaaacattgctcaatccttccgcagctccaggcaccgacagcagctggaattttgaagcgccaggcttttcagcgaccgagggcgatggcggggcaccgaaaccagagcaagatggttctatgcggcggcgacagaaagtggaagcagagtctaacgcccagggtgattttctagtgaaggcgatcaagagtctgttgatttccagcgtccgtctagacacgtatgcaggcagcccaggttccagccagaagagcggcttcagatctgtgactgtgaggaagtcgccgagcgcgccgagctttgcggatgctgacaatggagtctctatgtggtcaagttccaagtggacgttcagccatgactccttcacccgaccgttgcttgatggcctgcccaaaccagcgtcagctcggaggaccaaccaaaaccgcgttggactgaaactgaactgaatacacacatgtttgagcgtctcctttgatgaacgacgagctgtggcgtgactaggcgactgacttggcagcagagcatatctgtctgcagctctggtgttagcacaattgattggcttgtacaactcctacaaaagagaagagttacgatggagcctagctacatgtaatgtatacaacatgcatacatgcatgtgttgatggaatgaattgtattgtatcccatcccaggcagtgctacacacagatattctgtctgctgtgtgatggggtgaatttggtttcagttactccctaaatcaaatggaagttcttctctttttttccaaaaaaaaaaaaaaaaaaaaaaaaaaaaaa

SEQ ID NO: 17055 - DNA, 1456 bp, Zea mays
cattgggacctcgagccggccggaggctcaatccaaaacgcgtcgttctccttccccttttcctccgcgcccgccaggccgcccgcccaggaaggcagaaccccacacctctgatctgctctgcccatccccccccgcatccccggccctgacttaacttgctgctcacctcgccatgggaatctcccaccctctctccgacgagtacgacgccctccgcggcgccgtcctctcgccggatacgacgcctccctcatcgccgctcgcccaccgccacctcctggagcacgaggttactaggatggacacgctcgccggcatcgccatcaagtacggcgtcgagatatctgacatcaaaagggcaaacagtttggtaactgacagccagatgtttgcacacaaatcgctgctcatacctctaccaggaatgcccatgccatccctgaatgcttgtggtcaaagaacgataagaacgtgtgctccaaaccatcggcaaaagagagacgcgcccaagtctcgtcagcagggtgcgtcatctgcaatgaataccttgcagagatactatggcctaacaccacctcagaaaggaggaaataccatggatagcagcactgaactgtctgtgtaccataagggcggcggcttccagagtaacctcagcgaaacattgctcaatccttccgcagctccaggcaccgacagcagctggaattttgaagcgctaggcttttcagcgaccgagggcgatggcggggcaccgaaaccagagcaagatggttctatgcggcggcgacagaaagtggaagcagagtctaacgcccagggtgattttctagtgaaggcgatcaagagtctgttgatttccagcgtccgtctagacacgtatgcaggcagcccaggttccagccagaagagcggcttcagatctgtgactgtgaggaagtcgccgagcgcgccgagctttgcggatgctgacaatggagtctctatgtggtcaagttccaagtggacgttcagccatgactccttcacccgaccgttgcttgatggcctgcccaaaccagcgtcagctcggaggaccaaccaaaaccgcgttggactgaaactgaactgaatacacacatgtttgagcgtctcccttgatgaacgacgagccgtggcgtgactaggcgactgacttggcagcagagcatatctgtctgcagctctggtgttagcacaattgattggcttgtacaactcctacaaaagagaagagttacgacggagcctagctacatgtattgtatacaacatgcatacatgcatgtgttgatggaatgaattgtattgtatcccatcccaggcagatattctgtctgctgtgtgatggggtgaatttggtttcagttactccctaaatcaaatggaagttcttctctttttttccccaaaaaaaaaaaaaaaaaggccccta

SEQ ID NO: 17056 - DNA, 811 bp, Zea mays
agaccattcccaacgaaattgtaacctgttgcaaccggcctatctccttgcccgcgaagccatggcggatgcccccgcgatggcctcatcaccaccggcgtccgctgacgacggcggtccatcctcgccttccgtagccgtccctcgtgtacttccctccagattgctcctagacaccccgcctccttccagcggtaggacgcggggcccgcggggcggcagtgcggctgcggcgtcgaggcgcggcgggcgaggcggaggcacgaggagggagtccactttgccggctgcggcttcaaacggtacaggagggaggaggccggagcgggactggctcgccgaggcggttatgatgatcggggggccagtcgaggacgcgggactggcatccgccgacattcttcagctggcgatggcgaaggggcctatgttcgagtggctgagctactggccggaggaggggtacctcaaggaagatcatccctactgacgcacggtgcttttcctctgctcgggtacggcaaaatcgttgatggcttcttggggttttgcaaaggcagcagcttttatcggcgtggttagttcagtagtagtagttatcgtttttaacgaattagttcagtcgaagcctccagggacgtttatgtgtcactagattgtatgggaagaaaaatgcgcagctccaactactctgcatgcccagaatttgcaatttgacttgtttggcgaacggatcctcagtattgtatgaaccttgtaatgaaaaaaaaaatgggcggaacttgagtcctaaacaaaaaaaaaaaaaaaa

SEQ ID NO: 17057 - DNA, 1664 bp, Zea mays
tgagagtagacttcataggcagggaatatacaaggcatcagatgtaacattgtcaccttctccgccgcgcggggcaaattctgttgttggtagtgtgactagtattgcaggtcactgcaaagttttaaattcagttattggacaaggctgcaagattgggaaaaatgttctgattaacggctcatttatatgggacaatgtcataattgaagatggatgcaaagttagtaactctttagtctgtgatggtgtccatctaagagctggtgctgttgttgaacctggttgtgtactgtcatttaaggttgaagttggaaagaatgttgttgttcctgcccactcaaaagtttcattacttcctcagccttcaaatgaagatagcgatgaagaacttgagtatgctgacactaactctggaattgcagatagtccaccattttccagtatgaggagtaatggtgatcaagcaactgttccttcggaagaagatgagttgggaacatccgagactggcacctgtggtgttgtcggttacatatggacaagtgttgatactgggatcatggaagaatggagacaatcaattgcccctattcctaaagaaaagcttgaagagctgcagcatgctgtgcctgatgatgataggtcagaagatgaatccaacaatccaactctaccagataaagatgattcttcagacagtctggttgaggatgatgatcatatttctaagtttgagaaagaggtggaagagacattccaacgagctctgggtggcggcgttaatcgagataatttgatactagagattaatggcctaaggttagcctacagccttcaacatgcagattgtgctggagctgtgttctattctgtcatgaagagtgcattactggctgcacaatctagtaatgatactcttttgaagacaactgctgatgcacttggcaagtggaaggatcttttgcgcaattacaccaagacagttgatgaagagatggagatacttttaaagtttgaggaaatgtgtcaagagaccacaaaagatttttctccgctgtttccaaagatcttgccatacctctatgatacggaggtagtaagtgaagatgcaattttgagatgggcggaagagaaagaacatgctgatgagtctgataaagtttttgttaaacagtcagaggcttttattcagtggctcaaggaagctgaagaggaggatgacgaagaagaggaataaccctggagttgagctggcactcgaattctttcatgcattgtgagcgcaggatctgatttgagtgggtctctcggtgagttctcgcgagcagcaagttttgcaacctgtaattgcctgtacatcaacacaacacaattttgtccctaaccgcaactggtggagagtagcaaggagcgatttggcgtgaatgaaccaaaatgatcccagtgtagatgacatgctataactgtgctatctttgcttggttgacgcttgggcgaagtcttcgccacatttgtttaactggccatcacctgtttcttggcacccagccggcactcgcacagatctttaataaaagcttgtttagatatggctcccccttttttatcttctttctggtgagaaatgtagtgggaaagaaacaatggacgcttcctcgtgc

SEQ ID NO: 17058 - DNA, 691 bp, Zea mays
tgcgtaggcactttccactgtgagttgtgacgccgccgtccctgctgcgtgctgcggctgctgcccttgtgcagttgtgctccttccttccttgccccgtaccccgccggcgcgccctgagccaaatcgcaggttgccatagtgccatggacgaaggtgcgacgacgagcgactcgtccgctgccgagacatttgatccggacctggttcacgccatcttcaagctggtgtggaggcggcgggcggggaagggggccgccggcggcggcggcattgaggacatcgacgcggagcgtgctccagagacatcgaggagaaatcggagcacaactgccaatgcgaatgctcttaaagtcagctgcgaacttctacgaatatttgttacagaggctattcaacgctctgcttttatcgctgaagcggaggatggtgctgttattgaacccacccacctagagcgtgtgttgccgcagctgctcttggacttctgagggtaccccatggagcctccaaaagcatttatctaggcgtgtctgccatggaaggatacagatgcctggatgcatcaacagaatcttattgctgatctatgtcttgtaatctgtaaacacacgagatttctatatggctttataaaaatgcatgcatttcttggaatgtttaaaaaaaaaaaaaaaattattaagctgtg

SEQ ID NO: 17059 - DNA, 3834 bp, Zea mays
gacttgggaacaaaggtaaaaattgaaggtgacatcaatagaggtgtggcatattacaagatagctctatactacaattggcactatgctgatgccatgtataatcttggcgttgcatatggtgaaatgttgaattttgagatggcaattgtcttttacgagcttgcgctgcacttcaatcctcgctgtgcggaagcatgcaacaatttaggagtcatatacaaagacagggataaccttgacaaagctgttgaatgttatcaaatggcactgtcaattaagccacttttcgctcagtcgctaaataaccttggagttgtctatactgttcaaggtaagatggattctgctgctagcatgattgagaaggccatacatgcaacccccacgccggccggggcatataataatctaggtgttctttacagagatgctggtagtattactttagcaattcatgcttacgagagatgccttcagatcgatcctgattcacgaaatgctggccagaaccgtttgcttgcaatgaactatattgacgagggctcagatgacaagctttatgaagctcacagggagtggggaaaacgctttatgaaattgtatccacaatatacaagttgggataactcaaaagttgctgaccgcccattgatcatcggttacttgtctcctgattactttactcattccgtgtcctacttcattgaagctccccttacacaccatgattccacagtttgcaaggtggttgtctactccggtgttgtgaaggcagatgccaagacacttagattcaaggataaggtgttgaaaaagggtgggttgtggagagatatatatggtattgatgaaaagagggttgctagcttggtaagggaggataaagtggacatacttgtggaacttactggtcacacagcaaataataagttagggacaatggcatgccgacctgctcctattcaggttacctggattggctaccccaacacaacaggtttgccaacaatagactaccgaatctcagactcattgactgatccacctatgacaaaacaaaagcatgttgaggagttggtgcgccttcctgaaagctttctttgttatactccttccccagaagctggtcctgtttgtccaacgccagcaatttcaaatggtttcgtcacttttgggagctttaacaatctagcaaagattacaccgaaagtgttgcaagtttgggccagaatattatgttcagtccctaactccaggcttgtggttaagtgcaagccattctgctgtgagaacataaggcagaaatttttggccacactggaggagttgggtttggagtcattacgggttgatctgttgccactcatccatctgaatcatgatcacatgcaggcgtattctttgatggacatcagcctggatacatttccctatgctggtactacgactacatgtgaatctttatacatgggggttccatgtgttacaatggctggtgctgttcatgctcataacgttggtgtcagcttgctcagcaaagtcgggttggggaggctggttgccaaaactgaggatgagtatgtgagcatagcgttggatttggcatcagatgtgaatgccttgcaagaactgaggatgaccctgagggagctgatgatgaagtcgcccgtctgcgagggagagagattcacccggggcctggaagctgcatacatggacatgtggcgcaggtattgtgacggagacgtaccatctctcaggcgcttagcactgttagaggaacatcctgttgccaatgagccagactcggacaaaacctccgagaagcttgcagatctgaaagcgcagagagcaagcgcgactgtggaggaagataaccagcccccagcaatggcgaatggtgtgagatcgcccagttcacccgctgctgcaaaatgtgaatcaaatggtcacagcagccaatgaccaagaacggtgtcacgctccattgatgcagaccgatactgatatattgtaggtcgagtgatgttagcaacatctgtgtttagagggaggggttgttaagctccgggtgtctgatttattgacacttgcggtctgtaaggtgattaaatgtgtcttataaagttcgatttgtagggctttgcccctgtaggttcttgatatggtaacttaagttgcttcattagaaggcgcgggttcccggttgtatatgtagtagaaatatgacagtaaaacaacttgaagagtcgattaaccgacatagatgtcattatgctattttacttccttgtgcgtatcagtctcgtgattactgaccaacatgccggagcagcagccgcttctagctcaacgttgagggccagtaatttatctgtctttgggttaaaaaaaaacccgtgggccatgagcccattaccttatcgccagttgagacatggagctcaccgcatgatcggcccatatttaaacttcattctacgaatattacagtctataatataaaacagttttttgaatgaccatataatgaactgctggacacagtcttaaggttcaaaggttaagggatctatccattgacgattggagggtttaggggttaatgttgggatctgacaacaatgacccaaacaacgagatgacaaacgtgtaatagcacgctagatatggaacaatgattctcaaatgtcttattagccatcctctcacactgtctagacataggtatttatggggtaaccaagggtagccctctaaagtacagccttatccttggttacctgtcacatcttaggatgtggcaccctctaaaatacagacttgtccttggttaccagtcacatcttaagaatatcctttatagcggtgtattttaagaaccattacataccttatattacacccaattacatacccgcaccaacattaatgcacacccatttgtgactagctagaccttccttcagctacaggggcccatgctcctgttgtggcctcgatgttattcattggccccctaagtggggaagccttcaaaaccttcgtcaatgattttatgcgttgtccaagtgacaaggccaaagtctccatcgccttttaagtcactcttggatcggtgaggccttcggtagcatgcccacggcttcgatcgagccacgaatgtttgatgtagatagcagagtccacatgttaagatcttcccagcgaagtccttgccatggccttcggagtcttcgatgggccaagcagccatagactcgatcgaccgtatgacgagtctgcctcacatggggaaatcttcatggtagccctcatagccttcaatgaatccacatttattggagagaagtatgatgactgattagacagtatcgaccagacaaatgatcgggttcccgttcaactttctccccaaaagtagcccctaagggcgaggctcaacctaatgagtcgatcccgaagactagataatgattcgaacgctaccctcgatcatccgatttaggggcatttttatgacatttgttaattaattgattattattttcatcatttctggcttatataaggcaacacccggttagggttagtgttacacgatacgtttgcatcgcttcctcttcctcatatccacaagcgccgctgaactccgtcatgaggccttgcccgcactggtgtgtgagtgaagcataccgcacgacctcgtcaccagtacatgatgtcgtccacttcttcatcaagttctaccagcgactcaccacagtgcgttactaatgcgatgacgaagccaccgccacagacgtacactgtttcagcagacggttcaaa

SEQ ID NO: 17060 - DNA, 745 bp, Zea mays
gtgctgatgccatgtataatcttggcgttgcatatggtgaaatgttgaattttgagatggcaatgtcttttacgagcttgcgctgcacttcaatcctcgctgtgcggaagcatgcaacaatttaggagtcatatacaaagacagggataaccttgacaaagctgttgaatgttatcaaatggcactgtcaattaagccacttttcgctcagtcgctaaataaccttggagttgtctatactgttcaaggtaagatggattctgctgctagcatgattgagaaggccatacatgcaaatcccacatatgctgaagcatataataatctaggtgttctttacagagatgctggtagtattactttagcaattcatgcttacgagagatgccttcagatcgatcctgattcacgaaatgctggccagaaccgtttgcttgcaatgaactatattgacgagggctcagatgacaagctttatgaagctcacagggagtggggaaaacgctttatgaaattgtatccacaatatacaagttgggataactcaaaagttgctgaccgcccattgatcatcggttacttgtctcctgattactttactcattccgtgtcctacttcattgaagctccccttacacaccatgattccacagtttgcaaggtggttgtctactccggtgttgtgaaggcagatgccaagacacttagattcaaggataaggtgttgaaaaagggtgggttgtgg

SEQ ID NO: 17061 - DNA, 1906 bp, Zea mays
cattgggtacctcgaggccggccgggacgtggcctccccccagcgtacatgcgctgcggtcgtctgttgccatctcgcgttcggtggtgactccgggctccgggcgccctgcgcccctggatttcgaaccgagaaagaaagctgctgcccaccgtttcccaagtcccatcgccgcccaagaaccggagccacgccgcagatccgccaaaatcacacctcctagcccgtcctccgtcccaatctcttctcgggccagggaggcggcgggacttggtgcctgcatccgagccctagacatggatcaacctgaggaaaaccctgaattcccaagctgtgatgcctactttgaagctatccagtccaagaagaagttgccactgactttgcaagaatcactaactgctgcctttgctcagattccagtctcatccttccctgaggttccagctggtcgagtaattgaaattcctggtgatacttctgttattgatgctgtaaggactctctctgaacagaacataagggcagcaccagtactgaatccagaacctggggctcctactgattggcaggggaggtaccttggtgtcatcgattactcggcaatcatcctttgggtactagaaaatgctgagcttgctgctgttgcactctcggctgcatcggcaactgctgctggagttggcatgggtgctgttggtgctgttggggtggcagctttgggaacaactggcccagctgctgtagctggcttaactgcagctgcaattggggcttctgttgctggtggattaactgctgaaaagggtgtggcgaaggatgggctaactgctgcagatcatttaggggaggatttctacaaagttttacttcagcaggaacctttcagatcaacaacagttcgatcgattgttgagtcgtaccgctggtctccttttgtccccattacactggacacttccatgctgactgtacttctgttgctctctaagtacagattgcgaaatgtccctgtgattgagcctgaaaagcctatcatcaggaatttcattactcagactggtgttgtcaaagggctgcagcaatgtaaaggaagggactggtttgactacatttctgcacttcctctttcagacttaggacttccatttatgtccattgatgaggttatcaccgtcaacagtgatgatcttatcttagaagctttcaagtgcatgaaggataacaagattggtggtgtcccagtagtagaaggccccaaaagaaaacttgttggcagtgttagcataagggacatccgctttctgttgcttagacccaacttattttcaaatttcaggcagttgacagtcattgaattcatgaagactctaggctccactcttcctgattcagagagcaattgcctggtgaagccaccacccacttgcactcctgacgcttcccttggtagtgttattgacagcattgcatcaagaataacacacaggatatatgtagtggatgatgaccttgaggttgttggtgttgtgactctgcgtgatgtgatctcatgctttattcatgagccacccggttattgcgacaactatttggcttcagcgatggagaagcttgaggggaaaggagtcagatcagtggagaaaatttgagcttttctgtagcgtgaatgttgataataacaggtcagtatgtgaggaaggtttatttggttggaacggtgcattcgtgtcgtgttaatccagcaaatcctgtgtaggttaagtaacaaggcttctgtgctgttaaaaatattttactatgtcatttctttggacggttttctgaacaaatgtgtggtaaccattaggccttgttcggttaaaaaaaagaaaaaaaaaaaaaaaatgattgaaaaaaaaaaaaa

SEQ ID NO: 17062 - DNA, 1032 bp, Zea mays
  misc_feature (5)..(6): n is a, c, g, or t
ttttnnttttttttttttttttttttttttttttttttttttttttttttttttttttttttaaacgagaaaatatatatttcgaaactgatatttggataactgaatcaattccattggtggctcaaaaaaggggcacaagcacaggtataaaaacaaaaaactaatacaaccatggtatgacgacgggcactagaaaaatacattgctctgcaactatgtcacacaagcaaatcataatggttccttccactgtataatagtcttactggtgtctttttcttccactgctttgtatttttggtgaattccaaaccatattcagctataggaatgaaaccattaccccgaccatggtactcacgctctggaatataaataattattggctgccgacacagtctagacaaaaccaggaattctgactctccaccccagaaatcaggcctccttatcctttggcagtagcgtttcaatgattgctccacagtaattgctataactgcttcttcgtactcctgccgcccagtctcgctgtcacatataatttctttcactgccatccgtaaatcatctgcatcttctacctcctcccttggggccaaaggaatccccttgttttttgccattcctttagccagcgctcgaaacatgcaccggccatcgccggtaaccctctgaaccccgtaatgctccaccttgttcaacgctgccgaccacccacccctcaacgagggggcaatcctggcaaagcagtgaagtcggggccaggccgggggcgcgtgcgcaagcgcaaacgcagagtcatccagcagctcgaacttggccgtgccgtcccggaggcgcgcgagaagagtggcgttggatggccgcgccgctgccgccatcagcaggtgaaggatgaacaaggagcaaagcggacgaggtgcggcctattttcggatagatggccgccgctggggtgaggaaggaaaccgaccatggcccgtctttcggatgttgagcctagacgatggcagccatgtgccctcc

SEQ ID NO: 17063 - DNA, 1451 bp, Zea mays
  misc_feature (126)..(126): n is a, c, g, or t
  misc_feature (150)..(150): n is a, c, g, or t
agtaaccataaagttcaatgcctcccaaacaatatcctgatccggtgatgaagacagggagctaaagacacgtgatttcttcctgtggtccagatgcttctctgtagattttaaggagagcatcanaaccggatctgcttgaggtgctancagtatgcatcacggcaagatatgcagcctttctagtatctggtggaagaagggaagttttgccgtcttcaaagaagatgtggaaacgccgaaccccttcatttatagtttcattatgtccaagtctgaccagcgcagtcaagagcagtgatctaagcattacatcaagatgactctcaccatccttggggtcccagcctaactttatgacagctgggagaagaaggttgatcaaaagctgtttgatatctttgttcaagtcaggagtagcgtcaactgttattttagaaatgcttaaacatacagaggttacatgtgaaagtacagtgtaatcagactcatcattataagcattcagcagtcgcaacaatgacgtcagtgtttgcttgcaagcaacagagagcgcatatgaatcttccacgataccaatcttatccattaatgagagcttctttgctttgattgcatttacaagtccagctgcaagttcatcatcatacttcactctataaaatccagtttgatcaatattcaatttgatccaaatgatttgattcttctccccatcagcactttgagagtcagaaaactctttaatatttatcttatccattttatctttcaataagaactttttctgtgcatcatatgagccacagcatgctgttacaggaacaatccacattccaggaccagacgatccatcagatagaaactgtgcctgttcaagttccaaatcatgtccattgatttttgcataaataacaggatatccttgttgcttagtccatgtagtcatcaaatccttaacaggctccccagattcctcctcaagaacagcccataggtcttcagtcttagcattcgagtaggcatatttctttatatatgaagccaaagctttctgaaaacactctgcaccaaggtaactttgtcggacgcagtggcgaataacagatgcacccttgtcatagcttatggaatcaaaaattgcatcaatttcactagcatggtttacctcaacctcgataggatgagactctgcaagtgcatccaatctgaggccagaggtcgtctcatcaagaaattgtgtccagttattccattcagccaacacagattctactgctaaatagcttacccaggaagcaaaaccctcatttagccacaagtgagtccaccattccatagtcacaagattgccaaaccattggtgcgccaactcatgtgcaacagttattgctacctgttgcttgttgcacccccctccatcagtagctcatcatacagcaaagctgaga

SEQ ID NO: 17064 - DNA, 1096 bp, Zea mays
gcctcattttttttttttttttttttgaaacaaacgtcattgcatcagttttttccctcaacaaatcatacgcaagcaactgccaatacaatgtagaataagcccacctgaaccttttcaagaatttataggcctggtcgtttaggtttaatttataccgacttctactgtttctacaatgtttatctctatagattataactgcagcaatctaaacaaccgactttaatctgacccgaacagcccgtatgagatgatcacactgaggaaccgctaccttccaggccacatgtttacgcatcggcctgcagcagctcctgcactgtctgaccaagcttgggctcactcctaatgctctcgatccatctcgcgctgatccgcaccctctccaggctctgcttcagtgctctctcgaatgatggcttaacttggccagcaaagaactcggtaacctcgacagctttctcctcggaggtaaaccgtgggacaatggactcaatgaagtctgatatgagtgaactcgatttccatgtcttcaacacgtgatcccagttttccttcaaccaggtccatgcaatttctcgtccttctaagctaatgccaccaaggatgtaaaatgaatcttgattccgcacctcatcagtaaacataaagttcaatgcctccaaaacaatatcctgatccggtgatgaagacagggagcctaagacacgtgatttctcctgtggttcagatgcttctctgtagattttaaggagagcatcaaaaccggatctgcttgaggtgctaacagttcgcatcacggcaagatatgcagcctttctagtatctggtggaagaagggaagttttgccgtcttcaaagaagatgtggaaacgccgaactccttcatttatagtttcattatgtccaagtctgaccagcgcagtcaagagcagtgatctaagcattacatcaagatgactctcaccatccttggggtcccagcctaactttatgacagctgggagaagaaggttgatcaaaagctgtttgatatcttggtccaggccgggggtgccgcaactgttatatagaaatcccggccggcttcgag

SEQ ID NO: 17065 - DNA, 5847 bp, Zea mays
  misc_feature (1811)..(1811): n is a, c, g, or t
  misc_feature (2216)..(2216): n is a, c, g, or t
  misc_feature (3206)..(3206): n is a, c, g, or t
gactgcagaaacttaccaagttggagaggatatttgtcaaccttttatttttagagcaactcccacaatagccctcaaaacagggtcaacaaggcccttactttttatttgagggctccctcgcttttgagggccggttttctgggccacactctagcatagcaatggccctcaaaatagagctctcaaactcattctagcagagaatctgagaatgacacatcgcacacgagaccttgttatcattgtctttttcttgggtaaaacactctgggacctgggctcatggttgtggtcgggcacgtcataatggagggaccctggactcatggttgtggctgggcgcgccatcatggagagtcacagtcacaactgccaaagagttgcggctgggcgcgccatcgtggggagtcacggttgcgccgccaggggagttgcagtcaccagtcaggcgcgccgaagttgtgtttttgacctgggcacctatatttaatttagctacgagggcacaaataggagccctgcttgatttgctcttaaatacagtagcttcccccccaccccaaattgttggaatacacttttctcttttgctaaaaaaatcaatataccgcgttgttttacagatgtattttcatgagtagtaacagcactctttgcccaggctggagaagacagcaaccgcggtcgctcgggctggttttctcccacttcccaggaggaaggtcatgcattgcagatcccggagttcctacagaggaaagggcgtccagggtttccacgagtctgaacacactttggttcaatgtttttcttgtcatagtttggtacgatgtaggtttggtttctgggtctcttagttagcaaggtagagcagatgttcctgaaccgcatactaatctgtgtgcaaacttcgtcgcctgagtacattggctgggctgctttgcttctcaggaacctgcagtaggtctcaatttgctagttattatgattaaaagacatcgctgagaccaaattataacgttccgtgtgaagaattactggctcactgccaatttcctttcctttgcggcatacattgtttcattagtcgttattttggtttcgttcaatgttatgacaccaaaataggattataagggttagtttggaaaccattttctcaataaatttctatttttcgagggaaattagttcattttcctttgaaaaataggaactacttgaaaaaatggagtttccaaactagctcttagatggatcatattatataccccatgtcctaaaataaaatttgttttagaaaaataacaatattcatacaataattaatgtattgtgttttatatatatgtcatttatttgaatatagatagaaaaatcaatagctaaaacgactgctattttggaatattttggaatggagggagtagtatcaaatctatttagagattcaaatgctaatgctggttgttataaataggaatggctcagctcgttaaggaaccgagtcagctcgtttagctcgcgatctacaataaaaaagcaatatacatatatatacaacaatataatcaattgctaattaattctaaaccaatttagcactagaaaagagtaataatactcacaattttacataccgtattaattcagtaccaaattaacatagttcatcacttttaaattcatccaacataagtggaggttttgttttgttgacaaatgctagctcgttcgagttaacaagctgggtcgagctcggctcgagttggctcgttaacgaatcgagctgagatactagctcagcncatgacaaaattaaacaaaccaagtcgaactgagttgaccatgagctgaataagctgacaagccacgagtattataaatccacggatcaaataggatccgctaataattccaagtacgagataaacattactcgaccggttctaaaatattatcagattaatcatacattcattaagtattttagattaatcatacattcattaacatatgaatatagtttgcatagatgtctatattcattattatttaaatgaatgtgaactatgagctagaaaaaactatattttaagatagaatgagtattatttttagaaggttggtgtactcgtattgttgttcagtttacattgcatgatgtagcattcatgtttgggcttggttcgcatttgtcttcgccctattgnagttcgatctcgttcgcttgctgcgctggtgcgcccaatcatacagccatacaggcatacagcaacatgtacaaggagaacaagtgcaagtttttatgttaccatggaatccaagatgaacttttctttgtcaacctttgtacctatttccttttttttttgaaaaaaaattcttatgatcccttgattgagatagaaagaattttgaccctatgaaagaactgacagaaagaagtgctaaacagtttttaactattcaaaaaatttcgttacaaagttatgtaaactgtgaccattgtcgaggatggtgacatcttctctatctaaatttgtatcagagtccaagccttattcaaatactacctccgttcataacaggcccgtctactgccccgtgcatatgagacgacggcacacggcctccaactttttggggcccaattttttgagttttctgaatataattaatttaagaaggtaaatattgtttgatattttgtaaaatgatcggcaaattcttaacctcaaaatagataatacgagaggataaaaatatgacaatatatcaaatattaagagcctattttagactacttatatcactatgtactataggtcatagcgtctatttttatgttttacaccaggacaaaaaaaaactcagagacggccctgattcataaatatatgtcacgttgatttttttaaagctttgaccactcgtcgtcttatttaaatatttatgttaaaatgtaaaattttgagtcaagcacaaactagattaaatgataaaataaatcacaaaaaatgataactcgttattttttaaataaaacaagtgtttaaagtttttttaaaaaaacagcggtgttatatatttatgaatggagggaggaaaattcggactaataaggttccacaaaagagaacatggccacagatggtcttcacgcccacattctagaaacattctgtgaacaagttcgaatntgaaattgaaatccgacgaagctatacaacatttttttttgcaaggaaactatgtacaacatgtgaataaacacgtgtatggaatgtacggcaaagcaatgtttcttgaacttaaaatttaatattttttatatttacagaaagaaatgctagtctcgactcggaccgaaattcgcacatctggttcgtatttacatccaagcagatctgaaaatttgtgcgtgtgtgggtggcttattgaagggtcggctgcgctgatcccggcatcccgccccctgatccccacgaagggacggactgtcctgtcgacgaaacccgaccatcaacaccgtaaaataagggacacagggtccacgtgatcggctctcggcagtcaccacgagccttttgccttttcgctcaaggagccagccgtgtgccgacccacactggtccacagttcctttcgcttttgcgcgggcagtgacacagttgggttgggccgttggggtcggagccagccagccagctgccgagcccaacgggaggagggccagaggacgctcgctggcgctgccctttataaatccgccgtgcgcgtgccccgcccccgcagtagtagtacacagcatcatcaatcgacgcaagcgcaaccacctcctcccctcgtgatccagccctgccccgcttcgtctagttgacatcatttcccttgcgccttcttgccagcaatccatccaatccatccatcgtgatcacctggcaaccaaaatgtcaaccgccaccgccccaagattgtccgtccccaaatcctccggggcaagctaccggaccgccgctccggcgcccaagacggccctctccttcgtcgccggccacaagaggcagcaggcgctgccccgcgcgcggccgcgtgggcggacgcgtggggtggcgcccgcggccgtgcacagggtgaggctggtcgggccggacggggcggagcacgagttcgaggcccccgaggacacctacatcctggaggcggccgagagcgccggcgtggagctgcccttctcctgccgcgccgggtcctgctccacctgcgccgggaagatgtcggccggcgaggtcgaccagtcggagggctcgttcctcgacgacggccagacggccgagggctacctcctcacctgcatctcctaccccagggcggactgcgtcatccacacccacaaggaggaggagctgtactagtagagttttgggtcgcttatatatgcgacagtcagtgtttgtggcgaatgcagtgaactgatttgtataccatacgaggaataattgattccaacaattccatacgaatcattggatccaactatagatgctaaaaagggcggcaccgccccgtccagcccgagcacgttttggctcgacctgtttgagcccggcacggataagtccgaaccattaactgtgccgggctgtgccgcccgacgggctgatagagtcagccgagcacgccactgttcaggcccaatcgtgtcgggctggcctggaaagcacgacctatgaaggagcctgtgacagctcgagcacaacaaatactagaaatatatacaaattagaaatatgcatagaaatatatatataaatatacatatcagaaatatacacagaaatatacagatcagaagtattcgcagattcacacttgcacattcacacagttgagataaatagtagatcctaaataaaggattagagctgttcgtgcaatagctgcctcattaaaaacctttttaggtaaaaactcacttctcgtgagaaacccctagaaagtaaaaaaagagtacaactcagctctaatttaatagttcatgtcaaggtttttcagttacatattacaacttacatcaccagatttccaaatcaacagaatggagtaggaactaggaagataaaagtcctaagggtcatcaagataaagtccttcaaaggcatcttcaagttcttggtcctgtgtaaatgctgccctctagcttcaccaagttctcagtctttcatgcaaaaaagcagctctaccatttctggtgctaggcgccttcgtcattcctcgattatcccgccacagagactaaatgcagattctgaggatatagttgaaacaagaacagaaataacatccctagctaagatggagagaacaggataggacaacttatgttcatgccaccagcttaggatattgaagtcctcatcaaacttctgcaaagtgtcactatctaagtaggaggatagctctgtgtcaagtgaactaaggccagcactagagtgtgcttgttgaagcaaagcaaatgctgatgttccactaccaaggttaggtgtggtagaaccaggatatgagaactcagaggtacaatcagatgcataaatcaatcctcacttttgttttcttttacctgtgacaattggaggaggcacttgctgcctaactgcaccaaacttcagatcatatttattaaacattgtagacaattcacttttcacacaagtatagtaaagtgagtagttagtaccagatagcccagataataatctcaagatattgttgaaaccccttagtttggctctaggatctaatataaaagcaaatgcatagagcataggaatatccctacag

SEQ ID NO: 17066 - DNA, 2145 bp, Zea mays
cctcgaggccggccgggccgggatcgtctactcgccgaaaacctcgccgagtccctgcctccctgggcggtgggcgcggaaacccttggtctgttcgctaaaccttggcggccggatctcccaccttcagaatccatctggtctcctctataaaagcgccgggaggatctgccgactttgccgtccataggcggcgtctctccggtgtcctgcgtctgcgccgcaccatcccccactcttcttccagtgaaacagttcaggcaaagactctcctggaattgattgttgaggcatcacagattgcatttgccagtgcaagagaatttcagagataaggatggcagcacaactacttttctccaatccttccagttgccactgcccattaggcatttcaaggataaacgttgggaagacacttcttggtgaaagtgcaagttttcagagaaagaagtcgttttctggtggttcctatcgcttttctcgatttgattgctctgcgaactcccgccgagctggaccaaggcgcaccaaggatactttatatgaccttcaccctgagatctccttgctttatggagaagataatggtgcagctaccgtatccagcaaagagcagggtattgacactacagctgaaagattggtggacacttctccctcttaccgctataatgagcccaggattaaagtcataggggtttggaggtggtggctccaatgctgtgaacaggatgattgaaagctccatgaagggtgtggaattctggattgtgaacactgattttcaggctatgcggatgtcacccattgaaccagaaaataggttacagattggccaggaattgacacgtggtcttggtgctggtgggaacccagaaattggcatgaatgcagccaaggaaagccaggagttggtagaacaggcagttgctggtgccgatatggtttttgtgacggctggaatgggaggtgggacaggcactggtggagcacctattattgcagggattgcaaagtccatgggtatattgactgttggaattgtcacaaccccattttcatttgagggaagaaggcgggctcttcaggcacaagaaggaattgcatcgttgagaagcaatgttgatacactgattgtaattccaaatgacaagttactgactgctgtgtccccaaatactcctgtgacagaagcattcaatttagcagatgatattcttcggcaaggtgttcgtgggatatcagatataatcactgtgccaggtctggtgaatgtggactttgctgatgttcgatcagttatgtcagatgctggctcatcattaatgggcattggaacagcaacaggcaagacacgagcaagagatgccgcactcaatgccatacagtctcctctacttgatattggtattgaaagagcaactggaattgtatggaatatcactggagggaacgatctaaccttgacagaggtgaatgctgcagctgaagtaatctatgatcttgttgaccctggtgcaaatctgatttttggctctgttatagatccgtcatacactggtcaagtgagcataactctaattgcaactggtttcaaacgccaggaggaaagtgagagccggtcttcacaggctggaggagacagcaaccgcggtcgctcgggctggttttctcccacttcccaggaggaaggtcatgcattgcaaatcccagagttcctacagaggaaagggcgtccagggtttccacgagtctgaacacactttggatcaatgtttttcttgtcatagtttggtacgatgcaggtttggtttctgggtctcttaggtagcaaggtagagcagatgttcctgaaccgcacatactaatctgtgtgcaaacttcgccgcctgagtacattggctgggctgctttgcttctcaggaacctgcagtgaggtctcaatttgctagttagtatgattaaaagtcagcgctgagaccaaattataacgttccgtgtgaatgattactggctcactgccaatttcctttcctttcctttgcattgtgtgtcttgtctggctcaggaaccatctaaccgatgactatatgatgacgcgcggcatacattgtttcattaatcattattttggtttcgttc

SEQ ID NO: 17067 - DNA, 1112 bp, Zea mays
  misc_feature (16)..(16): n is a, c, g, or t
  misc_feature (18)..(18): n is a, c, g, or t
  misc_feature (27)..(27): n is a, c, g, or t
  misc_feature (30)..(30): n is a, c, g, or t
aggtcgacggtatcgntnccagctttnttnttttttttttttttttgacaatatatacacactatatttacgtgtaataattattattataaagggtctcctttataagtcttgtcctgggcctctctaatgtcaggaccggcactggcgaggaagatagcagtagagcacagagacacgttcagatcgcatttgtgtccttgcactagagtacattattattacacaaaggcacttcgccccggctgtagctcatgacgatctcaaggacaaaatcgtcgtatcctcctaatagtatcccattgtttgtacccgcataaatatattaaccacactagtacctcctataatggcaattgcaattccaatcctgacctcctcatccgccccctcggcgacgccgtcaggtcgccgtcccacagcctcacgacgctgccgtcgagcgcggccatgtcgatgtggcggtaccaacccaggtcactcctccgcctcaccgccatctccctcccttcccacggccccgtggccagggccgccgctcttcttgtccccggctctgacacggtccttctgagaaccacctccaccgcgcagtctcggccgcgcgcaccgtcgtcgacgtcgtcgtcatccgcgcatttcctgacgccgtcgaccactccgtcttcgtctcccgagccaccgtagtacgcagtgaaccgaaccttggacggcgtgctcggctcgctcacggaagacggctcggcggcgggcggctcgtcagtaatggcagccccccgagacggcagaagaggcaccagtggctcctggttatcgtcgacgagggcgctgacgcctgcgtcacgcttgttgatgttggaaacgctgacggcgcggatgcgccagaggccgatggcggcggcgagtgcggcgacgagccaggcgtagagcgagccggcggccgcggctgctgcggggagggagtagaggcggagcgctatggcctccgcgggcaccaggccgaggagctccattcgcggcgtgtggcggtggtggtggacaggtctcggcggttgttgaagatcgaggaggggggaggtgggggatggtgttcgtgcggtgaggaatcccag

SEQ ID NO: 17068 - DNA, 645 bp, Zea mays
ggctatattttaattatttttatttaatatgaataactttttcagatacatataaatactttattgacaatatatacacactatatttacgtgtaataattattattataaagagcctcctttataagtcttgtcctgggcctctctaatgtcaggaccggcactgcgcctacgggaaggggaagccaacaacgaagaggaaaacggcggaagaagaacagagctacggtacgagggatagaaggcggcggaagaattcccccagccgtttctgtttattcctcgatggctccaagctcgatcttgttgccgtccccctccgggatggccaccagcaccggccgccagctccgtcgcatgagcaggctccgcagcccgccggagccgaacctccggcccactcgccacgcgccgacgccggcgccgggatccgcgctggcaccgcccgcccttccgtcctcgtcgtcgtcttcgtcttcgccgcagtcgcagcggcacccgctgtggcggcgcccggcttccggggacgcgacgaacagatctcgcagcgtgcggcccccgccgcccggtcggccgccgaaaacggcttcctgtcgtcctcctgccgcgtggccgctagcgtctctgccccggcctcgcggccgc

SEQ ID NO: 17069 - DNA, 1189 bp, Zea mays
gcgaatcatacgtcctcctcttgtgatcggcaatcttggcaccaccacggcctttcgctcaaggagccagccgtgtgcctgccgaccagcccagaggcgtcgaggccgcggccagtgacagttaggtcggggtcggagccagccgtcgaggccgatgggcagcaggacgacgctgcccctattaataaagccgccatgcgtgtgcccggcactgcacagcatccatcgtccatcgacccacccaacccccccctccgccccgcgcttcgcctgggtaccggcgtccgccgcgccccgtcccgtccaggaacaggaagagcagtaacccatccatcggggatcaccaggggagcaagatgtcgactgccgccgccccaagattgcccgctcccagatccggggcaagctatcactatcagacgaccgcggctccggtggccaacaccctctccttcgccggccacgcgaggcaggcggcccgcgcgtccgggccacggctgtccagcaggttcgtggcgtccgcggcggccgtgctgcacaaggtgaagctggtcggcccggacgggacggagcacgagttcgaggcccccgacgacacctacatcctcgaggcggccgagaccgccggggtggagctgcccttctcctgccgcgccgggtcctgctccacctgcgccgggaggatgtcggccggcgaggtcgaccagtcggaggggtccttcctcgacgacggccagatggccgaggggtacctcctcacctgcatctcctaccccaaggcagactgcgtcatccacacccacaaggaggaggacctgtactagagattgggttgctttatgcatcagtggttgttccaaaggtggtggtgactggtgcgttcgttgctattccgtgccaccagcggaaggggggtttcgttgttgagatgggctagttcttgtcatcaatttcggtcattcgatgagatcatgtcatatgagttgtggcaataatgctggcaatatggttttgcaattcaaactgcaaatgtgaccagcaatgtcaaaaactgcacactgtgtctgtgtgcgaacttgtgaaattgacattgagttcaattagctagttggctcgagatttcaaaaaaaaaaaaaaaaaaaaaaaagaaaaaaaaaaaaaaaaaagcttatcgataccgtcgacctga

SEQ ID NO: 17070 - DNA, 1157 bp, Zea mays
acgtcctcctcttgtgatcggcaatcttggcaccaccacggcctttcgctcaaggagccagccgtgtgcctgccgaccagcccagaggcgtcgaggccgcggctattgacagttaggtcggggtcggagccagccgtcgaggcccgatgggcagcaggacgacgctgcccctattaataaagccgccatgcgtgtgcccggcactgcacaacatccatcgtccatcgacccacccaacctcctcctccgccccgcgcttcgcctgggtaccggcgtccgccgcgccccgtaccgtctcgtccaggaacaggaagagcagtaacccatccacccatccatcggggatcaccaggggtcaggggagcaagatgtcgactgccaccgccccaagattgcccgctcccagatccggggcaagctatcactatcagacgaccgcggctccggcggccaacaccctctccttcgccggccacgcgaggcaggcggcccgcgcgtccgggccacggctgtccagcaggttcgtggcgtccgcggcggccgtgctgcacaaggtgaagctggtcggcccggacgggacggagcacgagttcgaggcccccgacgacacctacatcctcgaggcggccgagaccgccggggtggagctgcccttctcctgccgcgccgggtcctgctccacctgcgccgggaggatgtcggccggcgaggtcgaccagtcggaggggtccttcctcgacgacggccagatggccgaggggtacctcctcacctgcatctcctaccccaaggcagactgcgtcatccacacccacaaggaggaggacctgtactagagatcgggttgctttatgcatcagtggttgctccaaggggtggtggtgcgttcgttgctgttccgtgccaccagcggaagggggatttcgttgttgagatgggctagttcttgtcatcaatttcggtcattcgatgagatcatggcatatgagttgtggcaataatgctggcaatatggttttgcaattcaaactgcaaatgtgaccagcaatgtcaaaaactgcacactgtgtctctgtgcgaacttgtgaaattggcattgagttcaattggctagttggctcgagatttcagttttcatctccatttataggtcattt

SEQ ID NO: 17071 - DNA, 2171 bp, Zea mays
gacgatgagtaggagttgattgaaaatcttggagatactccacttttccggtcccatactcccattcctgcacccggatggtcctcccgaatcccgatcagcccagccgagccgactagacgagtccaaccaaaggagaaccaggcaggccaatggccccaaacgcccaaaccccccctgggcccctcgggcccgccgggctcctcctcatctcactcactcccttttcctcacgccccctccccgcctcgagcccctcgctggctcgctcccattcccatctcgcaccaccaaccttccggatccagtgccgcacgcctcactccccgtccccgacacccatgacacgcaagaggcgcaagcacgccgccgccaccgccgcctagggttccgatcccttcctcatggattcgctgccgcgtaagcgcaagggcgcgcgcgccgcgtgctccatggccggatcccgccacgatgcgcctgccgcccgcaagcgcacctgccgcgagcccaagccgcggcccgagaagaagaagccctcttccgccgatgagggctccgcctccgcccgcggcggcgtggtgatgacggcgccgcccgccagcgggcgggcggcgcctgatagccccgggcgtgggctgaagcgcaagctgggctgcatcgactccgccactcggatggggcggaagaagcggctcgagagcgagtacgagctcggcgccgagatcggccagggcaagttcggctccgtccggatctgccgcgctaaggtcggcggcgacgagttcgcctgcaaggagctgcccaagaacggcgaggagacggtgcaccgcgaggtggagatcatgcagcacctctcgggccacccgggcgtcgtcacgctcagggccgtcttcgaggatgccgacaagttttacctcgtcatggagctctgcagcggggggaggttgctcgatgagatcgccagggaggggaagttttccgagcagcgtgctgccattgtgatcaaggatctcatggcagtgctcaagtactgccacgagatgggtgttgtgcacagggacgttaagccggagaatattttgcttaccaaggctgggaaagtgaagcttgctgatttcggactcgctgcacgggtcactaatggtcagaaaatgtttggtgttgctgggagccctgcatatgtggcacctgaagttctttctggaagctattcggagaaggttgatatatggggtgccggtgtgctactacatgtactactacttggttcacttccatttcaagggggctctctggacgccgttttcgagtccataaagacacttgaacttgatttcagcagcaccccatgggaatcaatatcagttcttggacgggatcttattgggcgaatgctaaatcgagatgtctcttgcagaatgactgctgatgaagttcttagtcacccatgggtcgtattttacacagaatgccccctgaaggtggtagctgctaatttgtgtctccctaacaaggttatagcacccaaaattccatgggacagacacaaatcagaatgtgactcagtgtcagacgcaagccaaaggtcagaggatcaggatgagtgtggcatagttgacgcattggcggcagcaataacacgtgttagaatatcagagccaaagagaagtcggctctgtagccccgcaattaccattcagcaggaatgctcgtcaaacttgaagaataatctttgcacggctttctgacctgacctagtttatagcacctgatcggaatggcgtccattcttctcgctgagaaggtcgttctgatttaggtgttgtagaggcgaggataataactcagcttttccagccagcaacaaacgtctggtatttagtgtttctttcagtgttcctgatgaaccccgcagttgtagctgctgtaaaattctgtaaatagcatggtcctttctcaagctgcgcctgggttgctaatttgtgccaccaaaaccgtttcacgcaatgttcataattcatgatcgagttgtgcaagacctgtcttaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaatggttttttaggggtcattttttt

SEQ ID NO: 17072 - DNA, 758 bp, Zea mays
  misc_feature (376)..(376): n is a, c, g, or t
  misc_feature (383)..(384): n is a, c, g, or t
  misc_feature (386)..(386): n is a, c, g, or t
  misc_feature (404)..(404): n is a, c, g, or t
  misc_feature (656)..(757): n is a, c, g, or t
catgggaccctcgcgcccgggcgggattcccatctcgaataccaaccttccggatccagtgccgcacgcctcactccccgtccccgacacccatgacacgcaagaggcggaagcacgccgccgccgccgccgccgccgcctagggttccgatcccttcctcatggattcgctgccgcggaagcgcaagggcgcgcgcgccgcgtgctccctggccggatcccgccacgatgcgcctgccgcccgcaagcgcacctgccgcgagcccaagccgcggcccgagaagaagaagccctcttccgccgatgagggctccgcctccgtccgcggcggcgtggttatgcgcggcgcgggggttttttgaacgggcgcccgccnccaacgnngnggcgcgcaaactgaaaanccccggccggcggggataaaccggcaaaacggtatacacgggacatacggccactccaattcggcggggacagaactacttcccccgccgaaagttaacctttgggccccacttaggcccacacgcgagcccctccgggcgaggacaccatccgcaccaacggcactctgggcactatgcggggccccacaataaatttggtataaaaaatctgaatcataccactggccgcctctgagtggagttttccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 17073 - DNA, 1634 bp, Zea mays
accaagatcgcggaaaccctagcttctcaccataactcagcctcacctagcctccacactccttcccccgccgcctccttccgagacctccttaccgccggcttcccttccctccggacctccaccgcgtgcgcgtgaaggatagcggccgcggcgatggggaaggcgtccaagggctcacggaaggggaagaaggcgtggcgcgccaacatcggcaccgacgacattgacgattttttcgagaagcagacgcgcgatgcccacgcgggcaccgccgccatcccttctcttccttcggactcgctcttctttgtcgacaagcccgccacctccgcatctacttccgccgccggcgcctcggacacaaccaccaaagatattcctgtcaaaaggaagatcgagaagaagagggagaaggttctttatcatgagagtgtactgaagcggaatccgtttgtgcagccaatcccatcttctgtgccgggcaagaaggataagaagataaagaagaagaaattgcaggagacacagggagagaaaagtgttcctatggaaaatgattctgtagttaagaactttgacatctgggctgtggatggtaaaggtgattccaaggccaaaaagagatctactatatcagttattcctgctgttgaagttgagcctgcaggatgttcatttaatcccccattcgaagcgcatcaagattctcttgctcaagctgtagcagatgaaaaacgcaaagagtacatgaaagagctggggccaacacctgtaccactcatagttcctggtgaagctatagccgaagaagataaattttttcttgatgctggtgaaggagatgaagatgaagatgctgcagaaaatggagatcaggatgctgatacttccattggacaaaggaagaacacaacaaaaagagttacaagagtagaaatgaacagaagagctcgccggaaggagaggttaagagcagaagcgaaagcaaagaaaatggaaaatattttgaaagaaattgacagcttgccaaatataatggatgagatagctaaagaggacaaggaaaaggagaagaggcacaaacgtcgaactgtggttaaagaggagagacgtaaatcaggcccacctcgtctgggcagacacaaatttgagccagctcctgttcaagttctattgacagaagagattagtggctcacttagaaagctaaaggggtgttgtaatcttgcaagggatcgctacaagagcattgagaaacgtggaatacttgcaccaagcaagagaataagcaaacgtcggtagagaaggcaagttccaatctgagggatgatatggtgaagctggattgaagaggatttactagatttgagaagaccctttggatgttcactgtcggaatgttcccctctttcagtgtcttgcgaaagtacctaacgattggttctgtcgttgtgggctcgttgttgacgctagtttcataggatctgggatgcactcatatacctgggctggtcttgatgcatgatggcgtatcgcttggtatgtatgttatccacacatgcgtattccaatccaaccccaataaaaattcggcaaaaaaaaaacaaacgaataggaaagtcgcgtcgatt

SEQ ID NO: 17074 - DNA, 3175 bp, Zea mays
  misc_feature (3120)..(3120): n is a, c, g, or t
ttattatcaatttttcactgtaatattgtttagcatataatatactttaagtatggctttaaaattttcttttttccaaaaaattaaataaaacgagagggtcaaacttggtgaaaaaatcaaacgaattatcaattgagacagatgaagtagattcttttttatattttttagataatagaaaataacatatggattcatctctttaacggcgggatatgtcaaagttatgacgcagtactagaaactagacttggattagcttttggtatttgaagctgctgcatgtccttctttcttctttttttcaaacttgacaattgatgtatttctccgtgaacaccagagaatgaagcatgcacaacctcttagaagtgcttttgcatgtatacggataaggatgcgtgtaagtaactgcctatctttgcactgttattattctcaaaatatataaaaaatagtaacaatattttatctgtagaataaattacaaaaattgcaaacacacttgctagtctatgtcttgaaggcattttcatcacaagaactctttgttctctaaatagcttgaagctcaaaaaacaatggactataaggttgtgtacatcattaaacttgcaagtatcgtataagatttatcttcatatacaagtccatatataaaaaagttgtgaagaatgaattgacttaaaaggagtagctatgtggttcgttcgttgttaagttgaaaaaattggacaatagtcttctactttcagtagcaggctaggattgtctaggctgtctccaggaaggaatagtaaaaccttctctatcttatatttagggaagaattttcttctctaccactctaacaacattctctaaacaatacttaaaatatagagaatatttctgtccaagattttatcttgttccctttgtcgattttaatactttaaatagtaaattaaacaaaagtaaaatatatcctttcttgccaatgctggttaagcatgacgtcaacacggtctggggtgctttgccagcaagcaaaaccagttcctccccacgaatcaaatagggagcccgttccaaccaactttccagcgaagcggcgccgcgcaaccattctcatttctctcgggttcgtcgtgagtaaaaagaaaaaagaaaccaaggactctctgtaccagcgaagcgtgcgtgggccgtgggcgcgtcctgttcttcttcctacctttccctaacctctcctccctcctgcaaatccgatctccccgagaccatgcgcaactccgccgccgcccagccctcttctcccgccgccacgtacgtctcaggcgccgcctacgtcgcgcccgcctcctccgccgccatgtacggctcaggcgcctcctacgtcgcgcccgccgcttccgcccccggcggcggcgggtacatctatcctgcgcccgcctcctccggcggcagcgccggctactccaagatcccaacctacccggcggtcccgtcggcgtatcccaaccccagccgtctcccgccgcgagtctccacccacgccccggtcgaggaccccacagcgctgccctcgccgctggccaaggcgggcgagctcgtgacgcggctccgcgagcaggggcaggtgctcatcgcggcgcgccggccgtggggcgaggtcttccgcgcgccggccttctccaagccgccgtcgctcggggaggcgatcgcccggatgcgccgcaacaccgcctacttccgcgccaactacgcgctggccgtgctcgccgtcgtggcggcctcgctgctctggcaccccggcacgctcttcgtgctcctcttcctctgcgccgcctggttcttcctctacttcgcgcggcccgcgcagggcgggcagccgctcagggtcctggggatggagttcgacgacggctccgtgctcgccgcgctctgcggggtcaccgtcatcgccatgctcttcaccagcgtcggctggaacgtggtgggctccgtcatgatcgggggcgcgctggtcagcgcgcacgccgcgctcaggaccaccgacgacctcttcctcacggagcaggaggccgctggggacggcctgttggcagctggcatgagcgccgccggacccatgttgcccacctatgtccgcattggttgattcgcgcagctgggcgtggtgtgttcatcatggtttgcatacaggcttcatgcagttcagcgatcttgatgctattgcttgcagatattagcaatcttccttgtaattaccatcacgatgtctaatattggttgtgggcgtgtgaaaaacgcaaagagtacatgaaagagctggggccaacacctgtaccactcatagttcctggtgaagctatagccgaagaagataaattttttcttgatgctggtgaagatgaagatgaagatgctgcagaaaatggagatcaggatgctgatacttccattggacaaaggaagaacacaacaaaaagagttacaagagtagaaatgaacagaagagctcgccggaaggagaggttaagagcagaagcgaaagcaaagaaaatggaaaatattttgaaagaaattgacaggtaggtgtttatgttcttggatcatcgaggttactgtaaatgtgcttaggaaaaccggagttctgtacttttgcagcttgccaaatataatggatgagatagctaaagaggacaaggaaaaggagaagaggcacaaacgtcgaactgtggttaaagaggagagacgtaaatcaggcccacctcgtctgggcagacacaaatttgagccagctcctgttcaagttctattgacagaagagattagtggctcacttagaaagctaaaggggtgttgtaatcttgcaagggatcgctacaagagcattgagaaacgtggaatacttgcaccaagcaagagaataagcaaacgtcggtagagaaggcaagttccaatctgagggatgatatggtgaagctggattgaagaggatttactagatttgagaagaccctttggatgttcactgtcggaatgttcccctctttcagtgtcttgcgaaagtacctaacgattggttctgtccgtgtggggcttcgttgtgacgctagtttcataagatcntggatgcactcatataccctggctggtcttgatgcatgaaggcgtatcgcttggt

SEQ ID NO: 17075 - DNA, 2073 bp, Zea mays
gtcaggccgtgagccggggactagacccgaaattcaaacggaccggaccaacccgaaattcaaacaatacgggccttttcaggcttaggccgggccgggcggcccgaatatacgcctatacccaaacgtaaaaccattacaactcaaatccattagtaggtctacttgcgaagtctctcttgagcaagagcttagacggatcttttaataatttgtcggaaaattaattattcttcgtcacgtaaagatgattgattgtcttttgatagtttactcgtaaattacaccgctctttactacgaaaaagtgttggttgcccgctgtgtttttcgacccatgctgacctgacccggccaggtagatgacgcgtctttgcgtcaacagagttttggacggctgtaattttgtcatcgttattactaacagatacataatgttctctcacggtctcgcgacatgttaaaccctggcaactagctacgggaatcctccgtgtcttgcaggtatgggccagaaggctggctgagctgtgcggcagaagaagaatccggccagtatgtctctgcggctctgctccccggcgccgcagcccaccggaacgccggatgacggacagatacgacgcatgcatgcacgctagggcccagcagctctggacaaaagccacaaaacgcccccgccagctgctgctgctctggtccgtgctgacgacggacggctaatcgcctaatcggcagcggctggcctctcggcctcctccggccgacatgcggtccccacattgcctcttccgccgcgccgcaccacccgattttatttcccttatatattcaatccacccttgttgccttggccgtcgcctcgtctgcactctgcagtcccatttcccaaccataaccttctcccccatcttcttcttcttcttcttcttcttccattcttccttcctcccctgttcttgtacttgaattcggcgcgcgtctggtgtgttagccaggcctcgccccatccgaagtccgaccgaaggagggagagagagagaggcaacaatggcgaagggcgggctgagcaagctccggtgcatgatcaagaggtggcactcgtcgagccgcatcgtctcccgcgccccgtcgccatcatcagcccacgacggcgccacctccggcgacgcgcactgcgcctcgttccacggcgcggacgaggtgcccaagggcctccacccggtctacgtcggcaagtcgcgccgccggtacctcgtcgccgaggagctcgtgggccacccgctattccagaccctcgtccaccgcaccggcggcaccaccgggggagcggcagcaggcaccgtcgtcggctgcgaggtcgtcctcttcgagcacctcctctggatgctggagaacgccgacccgcagccggagtccctcgacgagctggtcgactactacgcttgctgagtcagtgctgactgctccgacttggaagcctcccgaatcctccaagccgcgcgcgggggtaaatcatgcatccttcagttctgatgttttaagtagggggagagtagaggaaccgatgttgcagctcatggacgacgacgctgctcttttggctccgttgatttggttcgattgacatgagttactagtatagttttgttttatcttcgctacttcgtcataataaagagtctggacgagtgcttctatgttcgttgaaatgcaaaaaaaaaaaaaaatcaattcaactcttctgtacgatacatcgttctactactcgcattcttgtttctatacagcactcttgtttcccggggaggcgagagagaggcgagagagagggggccaccggcagcggtgtgagggagggcagcggcggagcgaggggagatgaggcggcggtgggtcgcaaggaggcaggggttactgtacgtgacagatagaagaaaatgatctaaataatattgattattacatttaaataaaagagatgatagttatccggcgatctgaattgtttgttttgacggtatatttattatgtgggtttggtagatttagggaatgttataagtacgtagaa

SEQ ID NO: 17076 - DNA, 1569 bp, Zea mays
tgcagtgtgcggcagcagaagaatccggccaacatgtctctgctccccggcgccgcagcccaccggatggcgggcagagacgacgcatgcacgctagagcccagcagctccggacaaaacgcccccgccgccagctgccgctgcagctgttcggctacccagcggcagcggctgggctttcgacctccggccgacatgcggtccccacgtcgcctcccccactcacccgagtatcccctacattatatatagccactcttcgccccccccgggctaccattcttcaatcccgcgcgcgtcggctgtgttagccggtagccctccccccgtccgaggtccgagtccgaccgaaggagagaggcagcagccatggctaagggcgggctgagcaagctccggtgcatggtcaagaggaggtggcactcgtcgagccgcatcgtctcccgcgccccgtcgccaccggctcacgccgacgccgtcgccgtcgccgccacctccggccacgcgcgcggcgcgtcgttccacggcgcggacgaggcgcccaagggcctgcacgcggtgtacgtcggcaggtcgcgccgccggtacctcgtcgcgcaggagctcgtgggccacccgctgttccagaccctcgtccaccgcgccggcggcgccgggggtcccgcgggtaccgtcgtcgtcggctgcgaggtcgtcctcttcgagcacctcctctggatgctggagcacgccgacccgcagccggagtccctcgacgagctcgtcgactactacgcctgctgacctgcgattccgatggtagatagagtagacgaagcattgttgcagctcatgaacgctgtgttgctttggctcgttggtttgattttggttcgattggcattggtatagttttattttatttttttcgtcacttcacttaataataaggtctctggaatctggacgagtgcttctatgtacgctgaaacagagagaaagaaaaacaaattattctcccaatacaactcttcgataatatctgcattgtgccccctctggcgctcttgtttttatccggtaaattaaagcttgtggtttccggttttcacagctacatgcaggtcagcatgatcgtggaagcgatgtagaaagcgaaacagagtggggctctagaacaccgccacaccaactagagaaaaaaacgagtaaaccgagttagtttccggcaacaagtcaaaattaaccaagagaaagttctctatttcgtaggattgacaaatacgatgtggtttctccgtgaaagagatatttattaacttctaaaggaatgttgaatacactataaataatagttagtggctaaaattagttaaagacatcaaatattctaactaatagttcaactattaactatttttattaaattagttaatagttaggtatctatttatttgatagtaataatttttagctaactaattattagttataatacatttaaacacttcgtaagactattttacagcttctactaaaagcatccgaccaatagaagcgaaatatgcccctgctggatggagcagctgg

SEQ ID NO: 17077 - DNA, 1897 bp, Zea mays
tacgccttatatactgggacggagggagtatcgtttagcaactcctcacaactatctttagtgagctttattaattttataaaactactagagatattctaaaagtgactaaactttaatcagtaaagtttagaaggtggtaatcaaacaccccctatatttacgcattccgtgcagtttagacctctgtaaaattcctgcgagaaaaaggagtttgctgacgctgagtgacagtgacagagaatgccaggtctaggctacgttctctgctatgctccgagcagtgagcagtccagtccctcagctgccagctgcccctgggcataacaagccggccagttgccgatgcactgtcgctagcatagcggctgcaagctggcgctccacctctcgccgacatgcggtcccctcgtccctcctctccgactcctcccgaatatataagcaggccggtcgcctcccccccccttcctcgttattccatcaccagttcaccgtcgtcttcctcaactcttcctctcctctctcttctgcaccatctggtgtgcgtgcgcgttactcgccgcgtggatcgaagaaagaggcgcacgggagcgagctacgcgaagcaaggccatggcgaagggcgggctggccaagcttcggtgcatgatcaagaggtggcactcgtccagccgcatcgcccgcgcgccgccgtctcccggccccggcgaggatgaccgctgcgccgcgcgcggcgcgtcgttccacggcgcggacgaggtgcccgagggcctgcacccggtgtacgtcggcaagtcgcgccgccggtacctcgtcgccgaggagctggtgggccacccgctgttccagaccctcgtcgaccgcatcggcggcggcggcaccggggcagcggcggcgggtaccgtcgtcggctgcgaggtcgtgctgttcgagcacctgctgtggatgctggagaacgcggacccgccgccggagtccctcgacgagctcgtcgagtactacgcgtgctgagacagagtcatagagcctggccccgcgccgccagctcggccgtgacgcagcgcggcccgacggtggtggaagtggaatggaaggtagcttagcacggagggctgctgtatcatttcgttcggcattcttgtgtgtatgtagggtagggtagatttgtgataaatggcaaatgcggggggctaaaacgcccgattgattcgcttcgctaatgtatcctcggtgtcgacgctaatttgctaatggaaaataatttgcggccaaaaaaaaaaaaaaaaaaatgtactgctgtaactacaactgcgctgcccggcagctggcagattcaccagcaagtatcgactgaatcgtgatctctctctggtctctgcctccgtccgactcagaatacgtgctcgaatgccaagttcgtggggggttaaattcttcaaatggagtttcttttaataaatttcattattggaaattacatagatgtgcgatgcaagtagatgtgtcaactttgtagagttttggtttccgtatttaataatttatggactaaaatgagtgtaaaatgtagtgactaaaaattagctcttagaaaccaaacatccctaagtatgtaaagtttgcgtgtttagataagttgtgtacaccttttactatgtgtttgatactttggttcgctctctactcagtttgaaaagaaagtgctattccaggctctgtttgagaagaaacagaaaagttggagaaagattaagaaagaggtaagtttctaagacttagtcaattcgagtactctcttattatgtgtgtctaagtcacagtaaaagtcctccaaagagttgaaagccaattggagaaagaatagaggaacaatgacttagaacatgttgtccag

SEQ ID NO: 17078 - DNA, 2543 bp, Zea mays
ggtccgcacctcaatttggtgcccaacaatatgataattcttggtcacttcttgttatatagaaagtttaaactaaatacttattgcgctgttgtggtgctagttggttatatatttatattaaattaggtaaaacgggctatctgaatctgaacacaaaaaattcgaatactcgaaaatttgagtacccaatatataaagtttatgttgagatatcatttctagatattcgaaatttaaaaagctcgaaaagctcgacccaaattttgggctaaggtgaatgcccagatctacggactaccaagatgtggatacccgtgttaaaaaagcgtgaactgtacagtactatcatttccacggagccttccggataggatttgtctcccctccactgcgcctctccgtttccgccatggctccggccgccgccttcctgtcggcgtgcgccgctggttccattccccgtgcgcccttcctgatcccgaggcctcttcttctcccaattccgctctcccctgcgcgctgggaccgctcccgcagctgcagcctctttggcgtaggcgccaacactcgccgcgcgccaacccttcgacggaacgcctccacggagacggtggttccctacgtgccgggctctggcaagtacatagcgccggactacctcgtggtacgcagcacggttcactggatcgcaaatctttctgctcctcggcagtcggtgagttcgagtctgagcggtgctttgcattactcgtggttgcagaagaaggtgtcagccgaggaggtgcaggagctggtgagggggcagaggaaggtgccgctcatcgttgacttctacgcgacctggtgcgggccctgtgttcagatggcgcaggacatcgagatggtgagccaccctccctgccagttttccatcatttggtttgcctgtgtgacttttgatatcttggccaacacaatgcctgtctgtgaagttgcaatcaatgggagttatgggaccagtggtataaacgagttctatgtgcctcgtcagtgacaccttcagcggcaaccatgctttgaaatggaaaggaatgcagtacacagctatgctttgcataggttctgctggattaagcaatatgtgaagcttctgagtatatttaaatactttcattgggcgatttagtctagattaatatcagactatattattttagaggaatttagacagcttggtagctggtgtagtctggtataggacaagttgacaaggcctacgagaggaatttagaatttggacagtttagaattttcatgcgaaatgaaaaaaaaatattttctgaaaataataaaagacttcccctagcaaatattagtatctttagcaattagtgattcttcttttgtttcttttgaaaacaatgtgaaaagatgaccaagaagaaaaaatcttgttgaaaaccacttttggatttctagcttttattaaatcatagtcaatcacttgagattctgtttaactattgccggtatcttgaatcttggagctgttcgcacttacgtgtgctcccttttttcaggacaagaagattatctaattgctctttctatgttgatacatcatgtagtatctctaataagtcctttcaatgtattgcagcttgcagttgagtatgaggacaatgccctgtttgtgaaggtggacacagatgatgaatatgaatttgcaaaagacatgcaggtacaaccaaaatggcactcattgaagcgaacaatgtgttgattacattcttatttagggttcttttttttccttcaatttttgaagtcactaatgctgaagctttcaggtaagacggcttccgaccctttacttcttcagtccagaccaaaacaaagatgccatacgcaccgaggggctaattcctatggatatgatcagaaacatcattgacaacgagttatgacagctgatagatcactgtattaggaacataggcaatgttttatctttgtagcagaaaattttttgtcatgaggctaagcattaccgctaggtgctagtttgtgtgcttgatgttttcttttgctccaatggtaggtttcatctgtgcaaatccattctgctgtttctgtatcgtgttgtttattctcatcaaactctaggttgtgtcgtgctgttgtcggttaggcctgtgtgaccattttcatccctcgaatgataagatggctttggctcagattggtcctcaaattatgatagaaccaatttggtccttgaggtggcattctgggcttaaattttgtcgagaacatgggatgacttctgcttgcaaggaatgggagcagacaattcgattctcgcatggatggtttaagggaaggtaattaatggtgcaatggatataagaaactaataggctgtttggtttgaggaatgagctagtccatcatcttcccactcctcacttttttgtttcgtttgtggaatgaaatgagttgatccatcatcacctcgttccttatagttagttgtgttagtactaatatgaggaatatgc

SEQ ID NO: 17079 - DNA, 1016 bp, Zea mays
cattgggtacctcgacgccgccttgggcgcggccggccgggatttccacggagccttccggataggatttgtctcccctccactgcgcctctccgtttccgccatggctccggccgccgccttcctgtcggcgtgcgccgctggttccattccccgtgcgcccttcctgatcccgaggcctcttcttctcccaattccgctctcccctgcgcgctgggaccgctcccgcagctgcagcctctttggcgtaggcgccaacactcgccgcgcgccaacccttcgacggaacgcctccacggagacggtggttccctacgtgccgggctctggcaagtacatagcgccggactacctcgtgaagaaggtgtcagccgaggaggtgcaggagctggtgagggggcagaggaaggtgccgctcatcgttgacttctacgcgacctggtgcgggccctgtgttcagatggcgcaggacatcgagatgcttgcagttgagtatgaggacaatgccctgtttgtgaaggtggacacagatgatgaatatgaatttgcaaaagacatgcaggtaagagggcttccgaccctttacttcttcagtccagaccaaaacaaagatgccatacgcaccgaggggctaattcctatggatatgatcagaaacatcattgacaacgagttatgacagctgatagatcactgtattaggaacataggcaatgttttatctttgtagcagaaaattttttgtcatgaggctaagcattaccgctaggtgctagtttgtgtgcttgatgttttcttttgctccaatggtaggtttcatctgtgcaaatccattctgctgtttctgtatcgtgttgtttattctcatcaaactctaggttgtgtcgtgctgttgtcggttaggcctgtgtgaccattttcatccctcgaatgataagatggctttggctcagattggtcctcacaaaatgatagaaccaatttggtcccgaaaaaaaaaaaaaaaaaaagcggcc

SEQ ID NO: 17080 - DNA, 1554 bp, Zea mays
cggacgcgtgggctgagggagctcgaggcgctcaccaatgagatcgatgaggagtcacagatcgtcggcgaggtcctccgcatcaaggaactcctcctgcacaagggaagaccattcggatgccactttgttcgattcactgaggaggctgcagttgatgcaattgtccgtctctacgctaaaggctactgagattggaagagctgttaatcggctgcggaaacacaactcacgacagattcggcacctcgtgtgcactctcattgaaggttggaaagttttggttgatgaatgggtcagtaccacaaatgctgccctgacagagaactcccctggctcttcaaatccttctgttgtggatgaagaagaggaagggcttccatctccacctttggacgaaggggccttctttgccacccaaaccacttctattcaactctctgagttctttgacgaaatggatgaagatggaaatttgagacatagtaatgacccgagccttggaaacaagaggggtaacaatggtgggagacttgcaagccattcaacggttgcaaggcaagatccacctcgctcttatcctggagtcgtcgaaagagttcaacccaggaggctagaactggcaaggcaagagccaccaatgaggcaagcgaacccacaaaccctccaaagttcaagtttgcaagccaaacctcacggtgcgctcaacaagcagtctaataatccctcaagttatgaatctggaccggggagaccagtaaaggcagctcagcagagaccatttggtgacatgaaacctaaacaaactcgagagcatgttgctatcgagagaaagcctatggcaagccagacagataaatcaaggcccggcgctcgaccttcggcaggagccaagctagagttggcaaagccaaaggtttacgatgatggtctggataacaacaggaagctggaagcagcgaagcggaggctccaggagcggtaccaggaagcggagaatgcgaaaaggcaacgcacgattcaggtaatggagctgggtgacataccgaagcccaagaatcaaaacagacaaccggtggtgaagtccaggaatagccttaggaattgggcgaacgggcggcgctaactcctctgtgaccttttttttttgtttacctcacctgatgaattgttgccatgcctggccttgtcggatcatgcgtttattatgctcaacgaggagcagatgaacaatcttttttttctttttgcacagaaccttcaatggagggttcttttgaagtggcaagagttgcacttgatgccatgagtggagacgagagtttagccatgtctggataatggacatgtagctggatttgtatcggctggttctttccttctttctttcttcttgttcttcttcttcaaaggaagctgctgtagataccagatagaataatcagcaatgtttggtacaggtacaaaaaaaaaagtttctgcggcctttctttttttttaccgtcagtcactttgatcgcggaaccattgacaaaaatgcaacaaacctcgtgc

SEQ ID NO: 17081 - DNA, 1485 bp, Zea mays
ctgcaggggtgtctgccgtgccgggatggcgcacctgaaaccagcatgcccggcgttcggcagccgtgtctgtgcaacgctctcggttgttcggagccccagctcccaactgtccgtcgcgctggtcagctggtgcgctcctgccgctgccgcctgatccgtccacccgccgtccgtccgtccaaaaagctcgtgctggcctgggctggctgtattcactgcgtgccagccagggtgcaccgccgccgtagtagcattgaccctgacagcttaggaatgacaccagtaggcgacagctgcgcaggagcaggcggatgttcctgttgtttggtagcgccgccgtagtagcattgtagggccgttgtttggtagcgcccgcgtcaataatttaaatgatgatctcgcatgcgtaatcaattggcggtcggggacagagttagcgaaacccttgctgatgaaattttgaaactcccacgcaagttgaactgtgtacgcacttgtttattttattggaaatgtcgtttcgaaataaagcatttgccaaggttgttgaatagtacagaactcattcagttattgtttggttcttttataacgcgacgaataactaataacattaaatcatgcttatttaattttaactataattagatatcatgataaaaattgataccggtctattcaaacttgttgccgttgatatttaagtttgaatcattactaccattgttacttttcgggcccctttcttctttttttattcatgactcccattccatatttatgcaccggcaagctgccatagtaccattacaataacctgcaaaccccagcatgatcaagcaggaacaaaaaaaaaacccgggatcggaagccgcggaaaaaggcgcgcgatccaccgaccgactccatcgtctaccggtaggtagtgccgtaccgctaccagtgctatagcctgtagtggcggtaggacttgagcatggcgccgcagaaggtgcagatgatggcgcgccaggtgctccggtgcacggtgagcaggtagcagaccctggtggcggtctccatgtccgccacgctggcgcacccgccgcagcgcgagcagatccccgccgccggcttgctgctccgcaccgtccgccgctggtccaccaggaagcagaagaacaccatcgctcctgcactgccactgcactgcacgctcctcctccctggttccttggattggatcgcgcgctctctccaacaacaacaacaaccgaacagacaccgttgttctgcttgcgtgttgcgccgcgcgcgctggctgccggcggcaggtggcaataatgcggagcgaggcttgcaagcaacggccgggcgggctagcttttcggtggcgagggagggagggagggagggagtcagcaatggcgagcagagcaggcagtaagcaaattctgcgtgatgcggcgggggcgaacccggccggcctcgagggtcccaatg

SEQ ID NO: 17082 - DNA, 1240 bp, Zea mays
tgataatgtgagacgatctgtccatattaattttgcgcatatctgcacacacgcagtgcataggatcctatgtttgttgatcaatcggtggtccgggatggagtaccttttcattgctgatgaaagcctgaaactttcaggagttcagattcaggattttttttttaaaaaaaagtctgaaacgttcagaactgtgtacttgtttatttattgaaatggtgatttctaaataaagtatttgccaaggttgatgacgaataagtgagtagccttcatggcttcatggtttcatgctagagtgagagaccacaagtgcgtgatcgctgaacgctggccaaacggagaaaagcatccccagttccagttccccacacaacagatggaaagagcaaaatgcaattcgtgtgcaagattttatttaagagaaggaaaaccattctacgcttctctcgtggtggtgggagaggatcaccagcaggtgatggtggacaaatcagatggatgacacataactatatttacacgcagctctgccattacaaccatctgcaaaccccagcagcataatcaagcaggaacaaaacaaaaacaaaaaaaaaaaaaaaaaaaatctagtagcagtcgcgagcaagatacccagtcaggagaggactcatcaggaagaacagatcactagctagtaccgtaagtagctcatcactacacctcacagcaagccgcgaggcccgcgaagaatgaaggcgcgcgttccaccaccacccaccgactcgaacaactccatcgatcggccgagagtcagtagagcctgtagtggcggtaggacttgagcatggcgccgcagaaggtgcagatgatggcgcgccaggtgcggcggtgcacggtgagcaggtagcagaccctggtggcggtctccatgtccgccacgctggcgcacccgccgcagcgcgagcagatccccgccgccggcttgctgctccgcaccgtccgccgctgctccaccaggaagcagaagaacaccatcgacgaccctcctggctccttgcccggcccgcgcgctctccagcaaccactgttctgattgcgtgctgcgcgtgcgcggcgcgcgcttgtatgcgtatatatagcggcagttggcgaggcttgcaagcaacgggctagctcctggtggcgaggggcagggagcctgctgtgagtgtggtcagcaatggcgagcagcagccagcagtaacccacgcgtccg

SEQ ID NO: 17083 - DNA, 3083 bp, Zea mays
ggcacagataactctagcttcttcaaggagaagcttacacaagcccttcggtacttcaaggagtccacagatcaacatctgttggtccaagtctgggcaccagtcaagaacggagaccgctatgtgcttactacttcaggacagccttttgtgcttgaccaccagagcattggcctacttcagtacagggctgtatccatgatgtacatgttttcagttgatggggaaaatgctggagacctgggcctacctgggcgtgtctacaagcaaaaggtgcctgagtggacaccaaatgtgcagtactatagcagtggtgagtatcaacgacttaaccatgcgatcagttacaatgtccatggtacggttgccctgcctgtttttgatccttctgctcagtcgtgtattgctgtcgtcgaacttataatgacatcaaagaagataaactatgcctgtgaggtcgataaagtctgcaaagcacttgaggcggtaaatcttaaaagcactgaaatactggaccatccaaatgtccagatatgtaatgaaggccgtcaagcggctctggtcgaaatactagagatcttgactgtagtatgtgaagagcacaagcttcctttggcacaaacctgggttccttgcaagtatagaagtgtattggcacatggtggtggtttaaagaagagttgcttaagtttcgatggaagttgcatgggggaagtctgcatgtcaactagtgatgtggcgtttcatgtgattgatgctcatatgtggggatttagagatgcatgcgtggagcatctcctacagaggggacaaggagtttctggaaaggcatttatctcacacaaaccttgcttttcaaaagatatccgcaagttctgtaagttggcatatcctcttgtacactatgctcgcatgtttgggttgtctggctgctttgcaatatgcttgcaaagttcttataccgggaatgacgactacatattagagttctttttgccactcgattgtattgacgaagatgaccaaaatgccttactggagtctatattaactctgatgaagcggtgtcttcgtagcctaaagctagttgatgacaatgatttgagtggggtttctcttcaccttagtaatgtgctaaaacttgagaatgaagaatccaaaacagatgcacagtttgatggttcccttcgcgaatcacctgaggatgatagacatggaggatcccacaagtttgataatgagaaccagaaagttttggatatcacagagggacaattgttgactgatgactactctcaagacaatggtacttctgttggcagaccaaatggtagtggtgcttctgattcttcattgcttcacaaaaccaacaaaccccctgaaagaagacgtgggaaagctgaaaagactatcagtttagaggttcttcagcaatatttttctggaagcttgaaaaacgcagctaaaagccttggcgtttgtcctacaaccatgaaacgcatctgccggcagcatggaatttctcgttggccatctcggaaaattaataaggtcaacaggtctctctcgaaattaaagcaggtgatcgagtctgttcaaggctccgatgcggcatttaatctcacatctatcacaggtcctcttcctatacctgttggcccttcaccagagtctctcaatgtagagaaattaactcaaagtaaagtggcagaactttcgaatcttgctgttggtgttgacagagattctttgcagaagtcgcttgaaaatgatgaccattttgatatagtcatggcccagcaaggatttatagacaataacaatgacgtgcagcttgaagctgacaaagcttctcactcgagaagttcatctggagagggcagcataaattcacgcacttcagaaggctcatgccagggaagtccagcaaaccaaacatttgtttgtaagccaatcgcttcaatgttcgcagaacctcaacttaatcaagaggagttcaacaaagaaccttttcaagaaccacaactaccactttcaaggatgctgattgaagattctggtagctccaaagatttgaagaatctcttcacttcaacatcggaccaaccatttttggcccctcccaacaacttggtgtcaatgaagcattcagggactgtaacgataaaggcgagttttaaggaagatattgtgaggttccgtttcccatgctcaggtggtgttattgtattgaaagaggaggtagcgaagaggctaaggatggatgttggcacgttcgatatcaagtatctcgatgatgaccatgagtgggtaaagttggcgtgcaatgcagacttggaagaatgcatggagatctcgcggctttctggcagccatgtcattaggctactggttagcgatattgcagcacactttggcagttcttgtggaagctctggttgatatgcgtgtcagccttttgctttgatcaatgtagactcgaaagttcagttccacttggtagttttgttgctagttagctttagctgtttcattgtgtttgataaatgtatcattgtattttacccccaaaaaaatacatgtaattgtgcagaacgcacttgtagtcaactttgtatatatcatgtgctggaaattctatttcaagttataaaaactgaatttgttattgtctagaatcgacaaagaacagtgttgggttaaaatgattacattgtattggaattgcagcagattttcgtaggtcataattccatgctgtaaacacgtttatacattttatttatatctttgtgatccatgaagttgagacgcatgctggttttaacttattgcggtgatagaattggcaacttcataaagtagtatcacttgcactttactccctccatttctttctattggatgtaatatattaaaaaaaattgaacttcaaagttttgacaaaatggttaaatgtgttaaattagcttcatgcttagtgtctaaaatcatatcataaaattcacatatctcacgtcttttaccatggcgttgattttatagaaactgtatatatatatatatatatatatatatatata

SEQ ID NO: 17084 - DNA, 1559 bp, Zea mays
  misc_feature (20)..(25): n is a, c, g, or t
  misc_feature (29)..(29): n is a, c, g, or t
  misc_feature (33)..(33): n is a, c, g, or t
gggaccctcgaggccggccnnnnnnaatntccnatcttcctccccgtccgtcgcattcatccgatccgccccctcctctcccatggcccatcactcttgctccaccaatctctagcgccttgcgcaccagcaagcttccaaatctctgctctactcttggacggacggagaaagggaggggacccaaaccagatcttggcaacaccactgctccacccaaacacaggtagagtagagtagagtagggctgtggtggttcaactccctcccatgttcatgggctcataggtgaaccaccgccgcccacccagggcattggggctccccttcaaaagctccctgctttcttgggggttttggttcccgcacaaggtcggagccacggagggggaggggtcttgctgctacagctgggcctgggaggacgaatctatcttggcaacaggtgagggaagccgtcctgtttgcccatggaggcggtctcaatgtcgccgtcaaccgtctcctcccacacccacgacgaccacgacgccgcttccgtcaccgaggccatgtccttgcaggaaggcctcctcttctcagacaccctcaaggacctgaggaatctgcggtcacagctgtactcagcggcagaatattttgaagtattttacaggaacaactcgcacaaatctactgtgatgacgagtttgaaagattacacagttgaggcccttgttagcacagttgaccatctgggttttgtgtcatacaaggtggataaccttgtcagcgagaaagctgtcgaggttaaggagactgaattcctagtgtcttcagttgaacagagggttcgaatttgccaacagacaactgaccaggaggcaagatcccagcaagctcttcttatcaaggcgccaaagtatcataggcgttacatattaccaggcctggatctactggaatcttccatccacccggtttcagaacctccacggtatagcaggcagtatacaggccgcaagatgcacaagtcccagtcttccatttctactccagttcgtcggcagtctacgatgaggcgtgaaccatctcctacacctaacgatcggtcgcggtcgttatcgccttctcgtaaagcacgagctaaatctccatctcctcgaatcgtgaacacaaatactgcaagagaaacaagggcaggctccccgataccaagttccagcccgatggcacggtccgcctctacggttgcaagaagaccgccttcgaactcgaggcatttgagactagcttcgatgcagttgcacagcgactgggagcagcaggagagaagctcaagcaaaggcaggaggggtttcctcaggtcgctgctcacgaggcgccggtggaggaacgacgagtcgtccttgtacagttacttggatgagtactgattgctggaatgttggaactgaaaaaagtctggtgttaactgaatcttctatagatggatgcgatgctctctgctttgccaaaaaaaaaaaaaaaacccggccaacgaaaaaaaaaaaaaaaaactcgagggggggcccggtacc

SEQ ID NO: 17085 - DNA, 2034 bp, Zea mays
ctttttctcgacattaaaatggcttattcatagttgaaatgtttgcttatgagattttcgttttattttgagttcatggtgttgccatgtcgtgaagccatggttaaattgttggactaagtagaatctattctcaaaatactgcactatatagcagatactgtctgcacagaggtctttggattttagaacaggaaaagttgattcgggaaattgggtttctctacagtttagtgttttagactttttgtacatcgttgttaggtagaacctgcatgaaatacttgttgaaaggacaatgacttggttagacctagacctaattgcctttgagactcaaaactggatctctgtcattctagcgtactgctttgataattgggatttgggtaaattggttgtgcgatcatgtatgcagaaacaacctggaaaggatttctttcgatatccctgtacttattggatgctgccagttgcctatataatatttgcttgctgtattattattattagaaacgtcctatccatagccgcatgttttgcagaggagctacctgtgtcttgagtgtctgttgtccgcttgttataaaccctttatgctgtcaacttctgtttccatcaattgcgatttatagaacctaaagaggaaccagaggcagcaaaaagcggatttttcagtggtgataacgatgtaaggggttgactcttggagattgtgagcattaattagtttcactttttttatatctggcagtttgtcctacaaccatgaaacgcatctgccggcagcatggaatttctcgttggccatctcggaaaattaataaggtcaacaggtctctctcgaaattaaagcaggtgatcgagtctgttcaaggctccgatgcggcatttaatctcacatctatcacaggtcctcttcctatacctgttggcccttcaccagagtctctcaatgtagagaaattaactcaaagtaaagtggcagaactttcgaatcttgctgttggtgttgacagagattctttgcagaagtcgcttgaaaatgatgaccattttgatatagtcatggcccagcaaggatttatagacaataacaatgacgtgcagcttgaagctgacaaagcttctcactcgagaagttcatctggagagggcagcataaattcacgcacttcagaaggctcatgccagggaagtccagcaaaccaaacatttgtttgtaagccaatcgcttcaatgttcgcagaacctcaacttaatcaagaggagttcaacaaagaaccttttcaagaaccacaactaccactttcaaggatgctgattgaagattctggtagctccaaagatttgaagaatctcttcacttcaacatcggaccaaccatttttggcccctcccaacaacttggtgccaatgaagcattcagggtctgtaacgataaaggcgagttttaaagaagatattgtgaggttccgtttctcatgctcaggcagtgttattgtattgaaagaggaggtagcgaaaaggctaaggatggatgttggcacgtttgatatcaagtatctagatgatgcccatgaatgggtaaagttggcgtgtaattcagacttggaagaatgcatggagatctcacggctttcgggtagccatgtcatcaggttatctgttagcgatattgcgacacactttggcagttcttgtggaagctccggttgatatgcctgtcagccttttgctctgatcaatgggtactcgaaagtgcttgtaccatgagttcagttccacttgtagagttgtacttttgttgctagttagcattactgcattatcgggagcattagttgcttcattgtgtttgataaatgtatcattgtatttttccgcaaaatacatgtaattgtgcagaatgcacttgtagtcaactttgtatatgttatgtgcaggaaattctatttcaagttataaactagatagttgttgttgtctaaaagcggcccagtatattgcattggaaatgaagcggattttcct

SEQ ID NO: 17086 - DNA, 713 bp, Zea mays
ttttttttttttttttttttttttttttttttttttgccgaacttttctttttcctcatcttattcggagactcacatcagatacttttttttaggggatcacatcagatacatacatacatgcaacacacaccacccacccgtcgtgccgctggagagctgaaccgaacggcaggacgggctggctattctttctgcagttctactctgttctaggcctctaggggcatatgctattgctatagctgaaagcaacagctcaagggaagcacacatacacacgacacgcatatataaatcgcacatgtactactaccagtacgttaggtacgtagctcggctcggatggttcgtcggtcggtcgatcggtcggccgtcgtctggaccgcgtacgtgtttcgatcagctcacgaatatgatggacgggtcgcagcagcactcgtcgacgaggcagcagcagcacagagcagccaggcatccttcgaggaatcccgtctgccgtctcggcggcggggcgtactgcggcggcgccatcaccggcggtccgttgtaatacccttggttgtgtgggtacgagtacccgtaccttcggtcactcatgttggtcactgactatgaactatgaaccctagctgcagatggctgcctgctagcagaagtgttttcgattaagatggtctaagaaaatgggtctcgtgcgaattctgcaaacc

SEQ ID NO: 17087 - DNA, 700 bp, Zea mays
ggggcgcgtccgggatttccagagagacagaaacaaacggagacgcagagaaaccctttccacccagattcgttcggttcggttccgaccacgcgggagcgggggcgggcgcgggagagaggggggagatgagcgcggctgcggaggacgcggctgcggccgatgggggatccggaggcgggagcagcggcgcggggtcgtcggaagggggcgcgcggcgccggttcgacgacaagggcctcgtcgcccgcacctcgctcatcctgtggcacacgcaccagaacgacgtcggcgccgtgcggaagctgctggaggaggacgccgcgctcgtcaacgcccgggactacgacagccgcacgccgctccacgtcgccgcgctccacggctggcacgacgtcgccgagtgcctcgtcgccaacggcgccgacgtcaacgcccaggaccgctggcagaacacgccactagctgatgcggagggcgcaaagaggcagcccatgattgagctgctcaaggagcacggtggattgacatatgggaaaactggaagccattttgaaccaaagacgattccaccacctctaacaaataaggctgactgggagattaacccacttgaattggacttcacaaaaccacctgttatcggaaagggctctttcggtgaaatttctgaagcaaattggcgaggaacacctattgc

SEQ ID NO: 17088 - DNA, 895 bp, Zea mays
aaccctagaacatcctaatcgaaaaagttgtaagttttgtaccattagctatctaattttcttcagatctgtatataatttcactcaaactgaaattattagttgtttatttagatatacaaacaaaaattaaaaattgaggtatctaagtacgtatatctcaactgagtcagctcattgcccaggcaaatagatcgtctgcagataattacctacataaatttgaaaagttttaaatatgtcttttaatgcattggatgaagaatttttgaaagctataaaggatgtatctgtcccagaaaatttcaggggtaagtcatattcagattcagaaccaatgtcttcgcaagacccaacaagttctaaaggaattgaagaggcattctcttccgagaaatttcaagacccaatgtcttcccgagatccaacaaaatctaatggaattgaaatgccagaatcttctgagaaatttcaacgtccgatgtcttctgaaaagccgataaagtttgaggaatatgaaacggcggtctcttccgagagaccttaaagaagttgaaattaatggctatccctataaaatttatggttgagaaaatatctaaaaaagaaataataaataatataatatacatataacatatttatattgtttatttataaataaataaaggctctcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttttaaaaaaaaaaaaaatttttcccccccccccccccccgggggggggcccccccccccccttccccccattagggggggtttaaaaccggcccccgggggggcgtttttaaac

SEQ ID NO: 17089 - DNA, 2304 bp, Zea mays
aatggattcttattttcccaagtgaaagtaaggtcgagtgtggtaaccctatttttctacgggtttttcattttcccaaaggaaattaattcattttccattgataaattggaaatcctatggaaaaattggattgccaaactagctctaaactaatttttcttgagaaaattaaatcccttagaaaaatagggttgtcaaactagccctaaaagtttttgttaattagtttcattaataatttaaatatatgtatagtttatgtatagtttcatacattttgtgcatatatgtatgctcaactgaaaaatttataggcacaaacgtacaacagtagcatagcatacgtataaaaattatttgagataaaaaaaattaaatgaaaagaaaccataagaaaagaaagaagaaaaagacttgtagatccttttagcttccattgacttaccctaagaagcttgacacgcaatagcggttggaaaacggcagtaaataattttgtaatcgggacaatatgtgacctcgattttgtaccagtggggtttaggtaattaggttaaagacgtggggaaggaacagagcaaagtggaaacaaatttcacccaccaaccaatgtttggctgccgtatgccttcattgggtgcctcccgcccggccgggactttccttttccccccaagaagatgggcgagacgagggccaaggagggggtgtcgcttagactagcgaatccatccgccaagattccgtgcacctcgaccgccgccgccgctatctgtttgtccccgcccccgcgaccgcggcagcctagcaggaggggaggatccatgtctagtttctagagcagctgcttgcgtcccttgcaaatcacatcgaccgatggggatacccagcgacgacgtggtgcaaatccgccacgccgacgccgctggcgagcccaccgtcgtcaccgtcagctgccccgacaagacgggcctcggctgcgacctctgccgggtcgtcctcctcttccgcctcagcgtcgtcaagggagacatgagcacggacgggcggtggtgctacatcgtgctctgggttctgccacgcggggggcggccggtgcccgtgccatgggacctactcaaggacaggttgcttcagctctgccccgtcgcgccgccgttcggattcgacaacgcgtacctcgcagcggctggcctacaggaccttgcgcctcccccaccaaagctcttcttgctcaagctatgctgcttcgaccggatgggactcttgcatgatgtgacacgtgttctgtgcgagctagagctcacgattcggagggtgaaggtctctaccacgcctgatgggagtgtgctggaccttttcttcatcacagatgccagggagcttctgcacacaaagagcagaagagaagaaacccaggacaaactggaggctgtcttaggcgactccttgacatgctgtgaaatagatcctgctggtgaagacatgttgtcttgcctccaatcctgggcctcgctgacgcctgctatcacggaacaaatgtttaacacagaggagcaaccgatcagcacaaggggtggcaccatctccgtgacgatggacaactcacttagctctgtccacactcttattcagattcagtgcggtgaccataagggcctcctctatgatatcatgaggacagtcaaagacggtaacattcaggtttcgtatggccgattctatgcgagccaaaatggaaggtgtgagatcgatttgttcgcggtgcaatcagatgggaagaagatccttgatcagcacaggcagcgagcactgtgctgccgcctaaggatggagctcctccgaccactgcgcgtggcattggtgaaccgaggtcctgacacagagctgctggtagcaaacccggttgaggtttctggaaagggcaggccgctggtgttctatgacatcacccttgctctcaagaatcttcagaaacgaatcttcttggctgagattgggagacatgttgtggaagatagggagtgggaagtctacagattgcactttggtgaggagcatgagctctcgtctgcgctgcggagcaagatcgtggatgaagtcaccaacatgctgatggggtgggactcatgacactgctctgccgtgcctctgaaaaattatcattactgttccagcaggaatcaattaacttatttggtgcatgtaaaaaaaggaacgacttatctcttaaatgtagcggtatttaactaaaaaaaaaaaaaaaactactattataatgcacaagttttgtgcatggat

SEQ ID NO: 17090 - DNA, 1962 bp, Zea mays
gagcaaggagggatctcgctttagaccagcgaatccatccacaaagattccgtgcacctccagcgcagcctccgctgtctgtccccgcggccgcggcaaccgagcaggaagaggaggaggatcccgtcctcccagtctagagcagccgcttgcaaagcgcatcggcggcacggccgtggattccgcgaatctgccaccgcttgctgctgcttctgagactgacaccgccatcgcagctgatggggatacccagcgacggcgacgacgtggtgcaaatccggcacgccgacgccgccggcgagcccaccgtcgtcaccgtgagctgccccgacaagacaggactgggctgcgacctgtgccgggccgtcctcctcttcggcctcagcgtcgtcaagggagacatgagcaccgacggccgctggtgctacatcgtgttctggctgttgccgcgcgggcggcggcccgtggccgtgccgtgggacctcctcaaggaccggttgcttcagctctgccccgtcgcgccgccattcggcttcgggtcccacgacgcgtacctcgcggcggcggctggcctgcaggacgttccgcctcccgcgccacagctcttcctgctcaagctatgctgcttcgaccggatgggactcttgcacgatgtgacacgcgttttgtgtgagctagagctcacgatccggagggtgaaggtctctaccacgcctgatgggagtgtgctggaccttttcttcatcacagatgccagggggcttctgcacacaaagagcaggagagaagaaacccaggacagactcgagagcgtcttaggcgactccttgacatgttgcgaaatagatcctgctggcgaagacatggtgtcttgctgcctccagtcctgggcctgggcttcgctgacgcctgctgttatagcacagatgtttagcacagctgatcgcgtggaggagcaaccgatcggcacaaggggtggtggtggtggtaccatcatctccgtgacgatggacaactcgcttagccctgcccacactcttattcagattcagtgtggcgaccataagggcctcctgtatgatgtcatgaggatagtcaaagactgcaacattcagatttcatatggccgattctacgcgagccaaaacggaaggtgcgagatcgatctgttcgcggtgcagtcggacgggaagaagatccttgatcagcacaggcagagagcactgtgctgtcgcctgaggatggagctccgccgaccactccatgtggcgttggtgaaccgaggtcctgacacggagctgctggtagcgaacccggtcgaggtttctgggaagggtaggccgctggtgttctacgacatcacccttgctctcaagaatcttcagagacgaatcttcttggctgagattgggaggcacgttgtggaaggcagggagtgggaggtctacagattgcacttcggtgaggagcacgagctctcgtctgcgctgcggaagaagattgtggatgcagtcaccaacatgctgatggggtgggactgatggcactgctgctgctgccgtgcctcggtctgaaacattatgcttagtgttcttccagaaactaacctatttggtgcaagcaaagaagaaacaactgatctctatctcttagatgcagcggttttcagctaatgcagagaccatgaaacctttggttatctaaacatgcactaggaaccggggtcctactacttagtgggcaccagacctgatgtatatgcatatactgaagcatgatcaagagtcatgtgtggcatatatataccattttgtctttgtcaaaaaaaaaaaaaaaaaaaagtacacaagcacacaaaaaaaaacacgtagaacagatgttggagatgaagagttgtacttctggatgattacaaaatatgaagtgtatataaggttcagatttaaaaaaaaaaaaaaaaaa

SEQ ID NO: 17091 - DNA, 3834 bp, Zea mays
  misc_feature (1020)..(1020): n is a, c, g, or t
gctcgaagggtgtgtactcggttcaatctttatatgttgtcatcggcttcagaggagttcaaccggtttttataccttcgcctgtggaaactaacagttccacctaaggatacatgtgttcctgtggttgttatcaaacaataagattctcactagagataacttgaataaaagaaaaccattacttgatacatgttgtctgttttgcatagaaaaggaatcaatttgtcacttaatgtttgactgttgtgtagctaaatgtttgtggggagacctgaacagtctctttggttggaatgttgattataattttgtggttggaatgttgattataattttgaaaccattgtttgtttctggctgagccctaagaaatatgtgattcaaaatgttgtttgtgcagcaatcatatggatcttatggaaaactcgaaatgaattacattttcaggggaagagctggtctggcgtgcacaagctgacgggaagagtggcccagactatgaggggatggaaggtgatttccaagacaaatacctgaaaggagatcgatttatacattggtgctttggagaagagagagcatgaatcgaaatgcattacgtgcaaagagacgttaagcttgggagcaaggactgaaacagatgtaagggtggaagctaattagctagctagatgtgtaaaaggacatctgtactccttttgtcagatgttggtgttgacgggtgcagacgcgattagaaatacgctaaaaacctcgggcaacctacttttctaaaaaaaaatctatttatctcataataagtttatagactgagattaaaaaaataagacataaaccaaatagcacgatagtacacttcaccctgtttgaaacctctagaactatcaattactagttgttaggttccaaacacccaatgtaactaattgttagttacccataactaacaattagtttattagatgactcaactcagtcaataattttattagctggttgggttccaaacaggatctnaatgtgcgttggttggagagtcaactagaatagatccatttcactcaattttttgagaatggggccgttctattgtgcgtttggtaaatagaatagagtcgcttcgttctttgtttggttaaagatctatatgagtgtagagagcaggagagggaggagaacgctcgtgtcgaagaaagcgttcacatcctgtcaattttgtggaacaggaacatttcaactatttatagtaattttttatattaagattttacaaaccgcttcgctcttttttttattgaaaaccaaacattcaaaaataaagatatagtcactatattctccttcaatactcaaacaaacaaagcagagagcacccgctcacaaagttttcggacagagcagagagcacggagattggagactaccgtgcgtgcgcgatctttctttccataaaagaaaaaggtaaaaagaaattccttaagcaaggcaacttgcttaacatttcgcgcggcgccgacacctccccacaagcacgggagcccggccacctccatctcccagtcccaggctcccagccccgctccccaaatctcagccccgctccttcccagtcccagtcccagatccaggatgtcctcctccgacccggacgacgcccccgacgggggcgaggactcgcccctcttccgccgcagcggggggccgtcctccggcggcaccgttggcgacgtccccgtctcgcagtcgctcatcaaggcggcaagcaacgtgtgcttctccctcttcgtgctcgccgtccttgtcgtcaccgtcgtcgccgtcacataccagccgccggacccctggctccagtcctccgccgccatcaccacctcgctctcccgcgtcctccccaactccaccttcctcgtccccgacgactcgctcctccccaccggcgaggatttcaactcctccaccgccgtcccagccccggtgcgggatgacgatgacgcggctgcggccgtcagcgccgcctccgccgcggccgcgggcaacaggacctgcgacccggacgcgccgctgaactgctccgacccgcgcgtcctcgccgccgtcaaggcgttcaacgccagggccttcttccggaagtccatcgtgtttctcagctacgaggcgccggtgtccggccccaagcctggccagtgcgatgtcgcctggaggttccggaaccgccgggagaagtcgtggcgccgctacagggactaccgtcgcttcagcctcgcctcgggcgatggctgcgctcttgacatcgtcagcgtcggcaagttccgctcggggacgaatgcagctcgccggccgtatcctaagggctcgaagtcgaagaggccccgcgtgtcgccgccgcctgtcgatgcggagatcaatgacacaatccctgtcgtcggatcagaggcagagttcaagaagggaaagtacttgtactacatgagaggaggtgaccattgcaagagcatgaaccagttcgtctggagcttcttgtgtggactcggcgaagccaagttcctcaaccggacgttcgtgatggatctgaacatctgtttgtccggggcacacacggtcgacgggaaggatgtggatgggaaagatttccggtactatttcgatttcgagcacttgaaggagagtgtgccggtggtggaggaaggggacttcctgaaggattggaagcgttgggataagaagaagggcccaggacggatcacagtgcggaaggttccatcgtacaaggtaacaccaatgcagctgaagagggacaagagcaacatcatctggaggcaatttaatggccatgagcccgagaattactggtaccgagtttgcgaaggacgagctgccaaagtcatccaaaggccttggtatgctatctggaagtccaagagactgatgaacattgtgactgagattgcaggtaggatggattgggattacgacggtttacatgttgtccgagggtggaaggcgcagaacaagcaaatgtatccaaacctggattccgacacgtcgcctgatgcgctcgttgataaggtgaccaagcttgttaagccgatgagagatctctacatcgcaactaatgagccattctataactacttcgacaagctcaggtcacacttccatgtccatttgcttgatgattacaaggagctttggtcaaacactagtgaatggtacaacgagacaacaacacttagtcggggtaaaccagttccattcgacgcctacatgagggtgattgtggacactgaggtattttacagatcgaagacacaggttgagacgttcaacaacttgacaagggattgcaaagatggaatcaatacgtgcaacttgtgacacatgagttcacgcttcggatcatttgttggtgttcaatatacccttctagtggctggcacatcagaactcagtggaactcatccagggtttgtcttttggcattaccatcgttatgtatttcttgtcatggaatgtttagctggtttcatgtttatctgagttgtgtgctctccatttttttttttcttttgtagtttatgtactactcttccagagtccagacgtccgaaaaatttgtatttagtgggcaatctgcaacatctatgctctctgtacccgcactaaattaagtgagaactatagcttcacctttacagtgtatctgttttcacgagtcacacgcttcttgcccgaatatttggaggaaatgaatttgtcagtgagctcaaaaaaaaaaaaaaaaatgtaaagatatattgtgcccatcaaagtatgaaattactatctatgctc

SEQ ID NO: 17092 - DNA, 2519 bp, Zea mays
gcacgaggctcgcagccaaaattccaattattttcttgtccagccattgccacaactcgcaaggaagccctttttctcatggcggcggcggcggcggcggcgggtggagagggagatgtaggaggaggcaacagcgcgggcgccctactgcgcatcttcgtgggcgggctggcggagagcgtgggcgcggccgacctggaggccctgttcgcctccgctgggcgcgtcgccggcgtcgagttcgtgcgcacaaacgggcgcagcttcgcctatgtcgacttccactgccccaacgacaaggccctcgccaggctcttctccacctacaatgggtgcaaatggaaaggagggaagctcaggctggagaaggccaaagagcactacctcactcgccttaaacgagaatgggagcaggatgcggctgcagcggcgtcaaaggaagctgctctgaaagataatgcagagaaccagaagccgaaactggataaggctgctttggagggcttgaagattaacatctacttcccaaagctgaggaaggtgaaagctttgccactgaaaggcacaggaaaacataaatacagtttccgacatattgaagttccttcttatccaattcatttctgtgactgtgaggagcactgtggacctcctgaggaagctaataatgaatatgcttctgttctcaatgctgctgcatatgagaaggaacgtaacattatgaattctgtgatgaacaagctttttgagaaggaaaatgaacattttgattcaggtgcaatggagaaatgtgatgaccgtactgataccattgaaccctccaatactgtgaatggcatgcaaattgaagagacggaagatgctccagaggacttggatgacttgcaaatggaagaaacggaagagtcttcagatgaagatttagatgatgaccttgtgattaacattgctccccgcaagtccaataagccagcagttcgagagaacataaagcaggaagtgaataaggtaaccatattttaaatacttattgagcaatttgcacatggtttttaaatctatgagcaattatatgtgtaagcatgatcatcatatttcatttatatgcaggactcacagttacaaaagcgtccaaggattgaagagacttccctgccaaagaagaggcagaaatctgaagcctcatctgaacctataaaaaggaatggagaacaacatgtttcagttactctagacactagaaccgcaggcaagactttgcctgcaaaatcagaagccagccaaaatgaacagaagtctctggatttgaaaggaaaaagaacatatgagttctcttcggcactcccaaaagacaaaagctctgcagatcctcaaggcattacggctctagcaagttcttctatcaaaactggaagtgcacaaaacactggttctattgaaccgaaaaaaggttattcatggattcagaaatcagcctggagagatctggtagggggcacggggagcgcatctttcagcatatcgcaggtgttgccgaacaacaatccagcaccagcagtgttttcaaatgttgctgggagcgagaggtcttcgaaatcctcggaagctacagcacaactcttgagttccgtgggaacgctgtctaccagcactgcagatgagtcgacagaccatgccattggtggcgagcctaaggagagcaataagccgcagaaggtgcgggtggtcccgaagatcaccattagtgaagtttgccctttcatgagaaacacggagtcgcaaaagcaatgggcaaaggcgaagaaagctgtaactgggttcgccaagaagagaaacgagagcagcacaggaaagggaaagccatccaataagcaataaaactattttgaagatgaccgtagctgttgtattacgatgactatcacataccagtggcgttttttttccttgtataagagcaatccaaatttcatgtttctgtctgcgtgttgtgaacactttcttgcaacacgatcgacctctaaactcaagtattattaattatgatatgatctatatagttctgacaatgtcataaattcagtgtcctgggcaccaccgcttgtttttgtattttttgtatatatagtaggaagggtttgtgttcttttggtacagcttctaagctgtttatgaccaaaataagttgaaacttgaggccaagcgacagattgggctaaagtaagctaaaaaatttaggccaaaataagctgaaattagaagctaaacgctttactttttttctggccatgctcccagtcctatttaacactcctattagttctcaagtgctgctcataaaggacctaatcatcttggttttttagatacttagtgttgtggcaggatggatgatgggacagccaatggacttgaattcccatctgttttaaaccaccagcctcttactgaaataatatataacacatttgaggaacagtgttccactcttgcaagacttgtttgtttaaattttcttg

SEQ ID NO: 17093 - DNA, 2471 bp, Zea mays
cctcgagggctggccgggaagcatcactgactccattgatgtgtgcatctaatgagaaaaaggttcctgtcctgcaccgccttgtcctagacccgagtggacccgagtggctgagtccacctctgatgctctgacctccgcctcctcctttctctcgtcgtcgtctccacgacacctcaaccccaatcagaacccggacccagatctctaaaaaatccccaatcccaatctgccgtacgccgttgcgatcatacctccaaatccgcccccaagtctgctcgatgcgaatagcacctgcgatttagcgaaccgtgcgctcgctaggtttagggtttcgagggtttgcgttagggtttgggcgcacgatggggcggtcgcgaggggtgctgagttccggcgacgacgacaccgggcacaggtcgaagcggaggagagtctcgtcgggcggggatgcgacggactccatttcagcctccatcgggggagctggagagggagggggcaagaaggcgctctatcactgcaactactgcaacaaggacatctccgggaagatacggatcaagtgctccaagtgccctgacttcgacctttgcgtggagtgtttctctgtcggcgctgaagtcaccccgcaccgcagcaaccatccttacaaagtcatggacaacttgtctttcccacttatttgcccggattggaatgcagatgaagaaattctcctccttgagggaattgaaatgtatggtctgggaaactggcttgaagttgcagagcatgttggtaccaagtctaagttacagtgtattgatcattacacatcagcatacatgaactcaccttgttatcccctcccggatatgtctcatgttaatggcaagaataggaaggaacttctagctatggctaaagtacagggtgagagtaaaaaagggactttgctgttacctggagaactcactcctaaggttgaatctcaattttctccctccagggtcaaggtggaagatgcacttggagaaggtccagcaggtcgatcaccttcacacatggctgttggtgcaaataaaaaagcttcaaatgtgggacatattaaggatggcgctactgtatcaaaagtcgaagatgttcatgtagatagaagtgttggtgtgaagaagcccagatattctgcagatgaaggcccttcgttgactgaactgagtggatacaatgcaaagagacatgagtttgacccagaatacgataatgatgccgaacaagctcttgctgagatggaatttaaagaaactgattcggaaactgatcgtgaactgaaactccgtgtgctgcgtatttacctctccaggcttgatgaaagaaaaagaagaaaggagttcatattggaaagaaatttgttgttccctaatcccttggagaaggatcttacgagtgaagacagggaactttaccatcgctataaagtcttcatgcgttttctttctaaggaggaacatgaagccctcgttaggagtgttattgaggagcgaaaaattcggaggagaattcaagaactccaggaatgccgttctgctggatgccgcacactggctgaagcaaagatacacatagagcaaaagaggaaaaaagaatacgagctgaatgcgcaaaaagctaaggatagcagtcaacttaatgcaaataataaatcagtacaaaagatgaatcgacctatgaaaattgagtccgatgggaatttggatccaaagaaaggtggtgctggcttggattctcctaagacaacaggacctacaagtgttaagcagtgggatgactgggatatagttggtcttcctggggcagagctattaagtgctagcgaaaagcttctatgctgtcagaacagattgctacccagccattacctgagaatgcaggaggtgctgatgcaggagatattcaagggtagcgtcctaaagaaggaagacgcccacgtcttatttaaggtcgatcctaccaaagtagatagtgtttatgatatggtatctaaaaaactgggcaaccatgaggaggccccaaccgtctagcttacgcttttgagcttgcctgctgtgacatgccgaaggaaacaaatcttggtctggcccttcgcagcgtgtctgaatcagggctgaaggtggtggaactatactaaatcgaatcggccatagttagctgaaattcatatcagctgtcagtagcacagtaaggcattcccgccaagctgtaaaattattgccccgacgagaatgtgtagcatgaatttgaatttcttttctgctattgctgtgtactgttgcagggtagtgccttattgtagtatatgtataggtgcctgagttttatgtatcatcgtgtatgtaccatttgggcgctctatttatgccattgtaccaaccccaaacatcgattattataattcatctcgcagccaaattcttgtctcttaaggaatg

SEQ ID NO: 17094 - DNA, 2390 bp, Zea mays
gcggcccgcgctgacctccgcctgctcgccctctctctctcgatggtcgtcttctccacgagaccacgaccgatcaaccccaatcgtagggaactgggaacccggacccagatctcccctagatcctcaatcccaatctgccctccgccgtatcgatcatacctcccgatgcgaccccaagtctggtcgatgcgagtagcggcggcgatttagcgaactgcgcgttcgctagggttagggtttcgagggtttgcgctagggtttgggcgcacgatggggcggtcgcgaggggtgcagaattccggcgacgacgacaccgtacacaggtcgaagcggaggagggtcgcatcgggcggggatgcgacggactccgtttccgctggcatcgggggagctggagaaggagggggcaagaaagcgctctaccactgcaattactgcaacaaggacatctctgggaagatacggatcaaatgctccaagtgccctgacttcgacctttgcgtggagtgcttctctgttggcgctgaagtcaccccacatcgcagcaaccatccttacaaagtcatggacaacctgtctttcccacttatttgcccagattggaatgcagacgaagaaattctcctccttgagggaattgaaatgtatggtctgggaaactggcttgaagttgcagagcatgttggtaccaagtctaagttacagtgtattgatcattacacaacagcatacatgaactcaccttgttatcccctaccggatatgtctcatgttaatggcaagaacaggaaggagcttctagctatggctaaagtgcagggtgaaagtaaaaaagggacttcactgttgcctggagagctgactcctaaggctgaatctccattttctccctccagggtcaaggtggaagatgcacttggagaaggtctagcaggtcgatcaccttcgcacatagctgttggtgcaaataaaaaagcttcaaatgtgggacatattaaagatgggtctaatgtatcaaaagttgaagatggtcatgtcgatagaagtgttggtgtgaagaagcccagatattctgcagatgaaggcccttcgttgactgaactgagtggatacaatgcaaagagacacgagtttgacccagagtatgataatgatgccgaacaagcgcttgctgagatggaatttaaagaaactgattcagaaactgatcgtgaactgaaactccgtgtgctgcgtatttatctgtccaggcttgatgaaagaaaaaggagaaaagagttcatattggaaaggaatttattgtttcctaatcccttggagaaggatcttacaaatgaagacagggaagtttaccatcggtataaggtcttcatgcgttttctttccaaggaggaacatgaagcccttgttaggagtgtcattgaagagcgaaaaattcggaggagaattcaagaactccaggaatgtcgttctgctggatgccgcacacttgctgaagcaaagatacacatagagcaaaagaggaaaaaagaatacgagctgaatgcccaaaaagctaaggaaagtaaccaccttattgcaaatactaaattggtgcagaagatgaatcgacctatgaagattgagtctgatgggaatttggatccaaagaaaggtggtgttgccttagattctcctaaaactacaggacttacaagtgttaagcagtgggatgactgggatatagttggtcttcctggggcggagctattaagtgctagcgaaaagcttctatgttgccagaacagactgctacccagtcattacctgagaatgcaggaggtgctgatgcaggagatattcaagggtagtgtcctaaagaaggaagacgcacacgtcttgtttaaggttgatcctaccaaagtagatagtgtttatgatatggtaacaaaaaagctgggcaaccatgtggagttgcctacggtctagcttatgcctttgggcttgcctgctgtgacatgccgaagaaaacaagtcttggtttcgccccttgcagcgtgtctgaaccatagctgaaggtggaactgtactagatcaaatcggccatagttaactgaaattcgtatcagttgtcagaagcacaataaggcattccagccaagttgtaaaattattgcccttagcagaatgtgtagcgtgagttgtcatttcctttctgccattgttgtgcactgtttcagctgtggtagtgccttgtagtaggtataggtgcctgagtttatatgtatcatcgtgtatgtaccattgggagctcaattatatgccattgtaccaaccccagacattgattattacaattcatctagcagccaaaaaaaaaaaaaaaaaagaaggcatggcgtcaatat

SEQ ID NO: 17095 - DNA, 865 bp, Zea mays
tcccccctccagttccaactttattggggttccccacgtcctaatcgaaaaaaacatgattcactcccttaagccttagaacacagccgtcggccgtcactcagccgcccttctgcttccgcccgccgttcgccgagccgtcgaggccgagaccaagacgccgagtgaccacgcgcccacgcctatgccgctgtgccttccgccgctgccttccacactccgcagttccgctccagccgcagcggcagcacgcgcacacgccgacgcgccgtggcgtcagccgctcagcgtccggaccggcggcggcaaaggcagcagccgcgccgggaggagcatccggctgggctagtcactagcgagtgtcgtccgcccggtccctctcccgcgcgacgcgccgagttccgcctgtcagcccgccgcccaccggactgtgtccctacgtccaccggattccaccctgctggacatggcagtcggcacacagtagatgcccacgcggccacgcctataattgtaagcaaaatcagaggtacgacagttacatattttatagcaatttattctcattttagacagtgttctatttctttatatatatcactaattgttctacaacttgattatttgtatgctaaatattatacggtctagagccatacctaaaatttttttggtcctccgccactgccaaccagagctgtggttttaaaaatatataggggacggacatgcatgggacaaattaatttagtcgtgaatccatttagggcttgattctaccccgatccatatgaattgagagatattgagtggatttgaatctctagtaagtcaaaatttctttcaaaaaaaaaaaaaaaaaatt

SEQ ID NO: 17096 - DNA, 1625 bp, Zea mays
ggcgattggtttccctcgggccgctccggaggcacgactccatccccctctctctttctctctctctcttcgacgactccgccgctgtcttccactcgggggccgccgtccctgtcgtcttccgcccatcactgtcttcttcgctccaccacacttgggaaacgcagcgatggatggccagccaggtgctgctgcgttgtcgagtcctggtccgagagtaaaagcaagcctggttctgggatccgaatcgttcgctatcaactccgagttcggtaccctgtcggagcagctggccgcggtgaaggagaagagcatggcggtcctcaaggaacacatcgccaggcacaatgctccgaacgaggtccccgacgaggccgccgagggcgagtctgacagtgagggcgaagcgccgcttgtcgacaacccgccgaagaaacctaagaagcagaagtgaccgtctctagtcatgcacttgactttttttttttttttgccatgcgttgcttgtgtaacgccagactgttgtcagtcacaatagcaatatgcaggtgttagcactcacttgctgttcgtaccactatcattagttctgcttctctgtcatgtgttcatatttttcttcccatacacttgcaagggtgttcttgtctgtcggtgtgctgcacgctccgtatatctgtagcagaaacacaattcactaacagcttggtttgaggaatgagttagactatcatcttctcaaacaaaaaaaaaaaaaaaaaagcgaatgaaatgagttgatccatcaacaattagtaatagcagctgtaacacagagctagctggttaattctgtccccgaaggagtatggtttcctctcggtggttattatccagtaactcagccggcaggaaactactgttctgtggctctcaggctgaatggtgatggtgaggtgatcaagttcccaggacaatctcaggcgatgagcaagttcaatgcagctccggagctgctcgtctctgacggagacctgacaagccttggggcagtggtagaccggtagctcgatgccatgcgcggcgggttcttgttttgctggtcgagttttggggtgttttggtatgtgtttagtcgggttcgctgggcgatatgccacccctgtgttgtactaatgaacatgttattacaatttacatgcatgtttggtcagtgaactctaaaacaaattgttccatgcatctttgctcagtttggtgaccctaaagtacgtagcatctccccaccccctgaaaatccagtctgggctggtgggcaggatcgggagcgggattgttgtgcgagatcggacggctgaggttatagaatggtacgatgaacgattgagatcatagaacggcagactatccttgcaaccttaataaatagtagagattaggacatacttcatatgtcattaatgcaagagatcagtgacggataattattatgtatataccaaaataaacacatttgtaccattagtgatatcttgataaggtaattatttatttttataattaattattaaatatgaacatcgtcacatgtaagtttaacaggtccccgtaggaacgagtaatgctccccatctccgtccccgttt

SEQ ID NO: 17097 - DNA, 1339 bp, Zea mays
cctcgaggccggagactaggacacagctaacactcctgtatccgagctactactcctagtcctagtacaggctacagaggcagagcgagcaaaactgcctgtacatagcaaccatcaacggcgaccgatccaagtagtgagcattagtggatctactacgtacatatatagaaggaaacagctgcagctctctctctctcgctgtttcctgcgtgatctgcttgtgtagctactagctagctagcggagcggaacccatgggctgcgaggaggaagagaggctgctgttcccgtccttcgtctttcccgagagcttcgcggaggccgccacccccggctccggtggtgagcagaagaaggctcggcagcgtcggaggcgcaagccgcggccggcggagggcggcgagggcgcggacgagcaggccaggaagcggcggctgagcgacgaccaggcgcggttcctggagctcagcttcaggaaggagcgcaagctggagacgccccgcaaggtgcagctggccgccgagctgggcctcgacgccaagcaggtggccgtctggttccagaaccgccgcgcccgccacaagagcaagctcatggaggaggagttctccaagctccgcgccgcgcacgacgccgtcgtcctccacaactgccacctcgagaccgagctgctgaagatgaaggacaggctggcggaggtggaggaggagaagacgaagctcgtcgcggcggcggcggcggcggccggcggcgcagcgggcgcagggagcagcagcccgagctcgtcgtcgttctcgacggtgacgcaccacccggccgcggcgctgcaggtggggcagttcggggtggagccggaggaggccgccgacctcgcctacatgaccgagtacgcctacaacagctacatgaacatgatggacctcgcgcccggctacttcggcggagtcgtctacgactacgaccacttcaactgatccacgagcatgcaggaggaggaggagggaagctacaagacgaaggaaggattgactggcctatcagctaggtactattttcgtgttaatggatggatggaccgatttgcagggcgcgcgtagcagtagtagcaatcaaggtcactagtatagtctgtcagtacgacgacgtcgatcagtcaatgtctcccctgacgataattattaagtcgatctattcagtagtaacttgttaaaaaaaaaaaaaaaaagtagcagctggtaatctttgtaaatgtgtgtggattatcatgcaagtgcgcgcttatcatgatcgaaccagtagtctctgcgatgtaatattgggaggggaacgggggtta

SEQ ID NO: 17098 - DNA, 1557 bp, Zea mays
gatcctctttgtcgacctgcagctctctctctctcgctgtttcctgcgtgatctgcttgtgtagctactagctagctagcggagcggaacccatgggctgcgaggaggaagagaggctgctgttcccgtccttcgtctttcccgagagcttcgaggaggccgccacccccggctccggtgagtcgtccttcatctctctctctctctctctctctctctggtaccatcaatatgtaccgagtaataatccatggcgcgcaccgcaataatgtacatgtgctaccaggtggtgagcagaagaaggctcggcagcgtcggaggcgcaagccgcggccggcggaggttggcgagggcgcggacgagcaggccaggaagcggcggctgagcgacgaccaggcgcggttcctggagctcagcttcaggaaggagcgcaagctggagacgccccgcaaggtgcagctggccgccgagctgggcctcgacgccaagcaggtggccgtctggttccagaaccgccgcgcccgccacaagagcaagctcatggaggaggagttctccaagctccgcgccgcgcacgacgccgtcgtcctccacaactgccacctcgagaccgaggtacgtacgtaacgtaactgatccgcgaacctcgagtgtcctcggcgtggtacgctgaattggtctcgtaatccgtcccgttgcagctgctgaagatgaaggacaggctggcggaggtggaggaggagaagacgaagctcgtcgcggcggcggcggcggcggccggcggcgcagcgggcgcagggagcagcagcccgagctcgtcgtcgttctcgacggtgacgcaccacccggccgcggcgctgcaggtggggcagttcggggtggagccggaggaggccgccgacctcgcctacatgaccgagtacgcctacaacagctacatgaacatgatggacctcgcgcccgcctacttcggtggagtcgtctacgactacgaccacttcaactgatccacgagcatgcaggaggaggaggagggaagctacaagacgaaggaaggattgactggcctatcagctaggtactattttcgtgttaatggatggatggaccgatttgcagggcgcgcgtagcagtagtagcaatcaaggtcactagtatagtctgtcagtacgacgacgtcgatcagtcaatgtctcctgacgataattattaagtcgatctattcagtagtaacttgttaagccatgtagattagtagcagctggtaatctttgtaaatgtgtgtggattatcatgcaagtgcgcgcttatcatgatcgaaccagtggtctctgcgatgtaatattggggggaacgggggttaatcggaatcagaaaatgcatgcttgtagatgctttatttggtgtctgttctcgggggacgtggcccatttgagtgggcttcatttgagttctgggctgtttcacaagttaaattctcttagagcaacatgttgatcttatatatatacctggacgaggaccgaccaccatgccaattctcctctcttctggctt

SEQ ID NO: 17099 - DNA, 731 bp, Zea mays
  misc_feature (18)..(20): n is a, c, g, or t
  misc_feature (22)..(23): n is a, c, g, or t
  misc_feature (47)..(47): n is a, c, g, or t
  misc_feature (51)..(51): n is a, c, g, or t
  misc_feature (618)..(619): n is a, c, g, or t
atactgcgagtttagacnnnanngtcatagagtccgacgctgggggncagnttaagactttagcgaaataaacaacggtatcgatattttttttttttttttttggtttttttttttttttttttttttttttggttgaaaactcatatggggtggatttatgatcataaaaatcatcaagtttgcacgtaaagtaatggcagatggagtggaaatgttattcctggaaaaatgccaaagccacgtgagagacgacatattcgccatcataaaatcctcaaatggaaatgcataaaaattatagttggcggtataaaaatataatggaatgcataacacatggatcagatgaggtcgtcggaggaggatgcactaaagccttcgaatcggaggagctcgtcgttggacgattcactctgtcgcatcggcgtctgattcgtcagagctccatgaatagttggagttaggagggcctcatcgtcacgcgcacatcagggggtgccgctgcccgcgcactcctttggccgccgccgccgcgcgcgacccctgtgagcatctgccacgcgcgggggttggaactgggccctgccccccgggtggagcccccgccaccggcgnncccctcggggaggccaccgccgtgcgcccccctcgggaaccgtctccgcttgtggatatgggggggggggcgtcaaaaaatttggaattaggatgttcttaaggaaatggcc

SEQ ID NO: 17100 - DNA, 1803 bp, Zea mays
ttttttttttttttttacgaagaaactatttcgaatgacatttgtacgaagcacgatgtttagagtcacaaatatacaattatctccggggttttttaccttaaaaaggtttagtaaaccctgctgtctgctagtcttcagttttcacggcgggttgtcgtggcctgtggctgggagcctgggtggctgtgggcaggagtatgccaagatgatcgagacaccaacaaaccaaacaccatccgccacgaccacgactccacgagagagcggaggaggagggggagcaatggcagagccgggccagcagttgctgcggtcgttcgtggaggtggcagcgggctcgcacttccctatccagaacctgcccttcggggtcttccgccggcgggggtcgccaccgcaggctccgcgccccggggtggccatcggggacttcgcgctcgacctcgccaccgtcgccgacgcgggtctcttcgacgggcccgcgctctccggctccccgtgcttccaccaggagacgctcaacatgttcttggggatgggccgaccggcgtggagggaggcgcgcgccacgctacaaaaaatcctctcagccgacgagccagtcttgcgtgacaacgaagccctgaggaataaatgtcttattccaatgagtgatatcgagatggttctaccaatcacggttggaggttacacagatttcttttgttctgtgcaccatgcaaggaactgcggattcatcttccgagggccgcagactccagttaatccaaattggttttatcttccaataggatacaatggacgagcatcatctatagttgtgtctggaaccgatgtaattaggcccagaggacaaggacatccaacaggaaactccgctccttattttggtccctctcagaagcttgattttgagcttgagatggctgccattgttggtccaggaaatgaattaggcaaaccaattgatatcaatgatgctgaagaacatatttttggcctaactttgatgaatgattggagcgccagagatattcaggcttgggagactatacctcttggacctttccttgggaaaagcttcagtaccaccatatcaccatggattgttactcttgatgctttgaagcctttcatgtgtgaggctcctaagcaggaacccgaacctttaccatacctagctgaaaagaatcacataaactatgacattcctcttgaagtcttgattaagcctaaagatcaaaatgttgcactaattgtcacaaaaactaatttcaagcatctgtattggacggtgacgcagcagctaacacaccacactatcaatggatgcaacatgaggccgggggatatatttgcaactggcacactcagtggacctgaaccggactccctcggatgtctattggagctaacatggaacgggcagaaggagataccagtgggcaatttgacccgcaagtttctagaagatggagatgaggtcatcttgacaggatgctgcaagggtgaaggctacaacattggttttggaacttgcactgggaaggtcctgccggcacttccctgagccaacacgtctttacatcagttctcgagtccaaacactcaacaatctagcaagatgctatgtaactgaacaacgggggttgttttcgcataggaaactgatactctgttgtggaataaaatcggttcaccattttatacacaaaaaaaaaaacaaaaattgtgttattaaacttgtaaaaatgcaatgtctctcatctcttcatccatcgcccagtgagatttgaattc

SEQ ID NO: 17101 - DNA, 1786 bp, Zea mays
cggacgcgtgagtgctagtcttcacggcggggttgttgtcgcttgtggccagccgccagcaccagcacaaggcgatcgagagtggtgaccaccagtaaactgcaaagtgcaaaccaaacaccacccacgagaaagcggaggagggagcaatggcggagccgagccagcagctgcggtcgttcgtggaggtgccggcgggctcccacttccccatccagaacctgcccttcggggtcttccgccggcggggggtgcaggcgcaggcgccgcgccccgcggtggccatcggggacttcgcgctcgacctcgccgccgtcgccgacgcggggctcttcgacgggcccgcgctctccggctccccgtgcttccaccaggagacgctcaacatgttcttggggatgggccggccggcgtggagggaggcgcgcgccacgctacagaaaatcctatcagccgacgagcccgtcttgcgtgacaacgaagcactgaggaacaagtgtctggtaccaatgagtgatatagagatggttctaccaatcacggttggaggttacacggacttcttttgttctgtgcaccatgcaatgaattgtggattcatcttccgagggccgcagactccagtcaatccaaattggttttatcttccagtaggatacaatgggcgagcatcatctatagttgtgtctggaaccaatgtcattaggcccaggggacaaggacatccaacaggaaactccgctccttattttggtccctcgcagaagcttgattttgagcttgagatggctgccattgttggtccagggaatgaattaggcaaacctattgatattaatgacgccgaagaacatatttttggcctaactttgatgaatgattggagtgccagagatatccaggcttgggagactatacctcttggacctttccttgggaaaagcttcagtaccacggtatcaccatggattgttaccctagatgctttgaagcctttcatgtgtgatgctcctaagcaggaacccgagcctttaccgtacttagccgaaaagaatcacataaattatgacattcctcttgaagcctggattaagccgaaagatcaaaatgacgcatcaattgtcacaaaaactaatttcaagcatctgtattggacgctgacacagcagctagcacaccacaccatcaacggatgcaacatgaggccgggggatatatttgcgactggcacactgagtggacctgaaccggactccctcgggtgtctgctggagctgacatggaacgggcagaaggagataccggtggggaatttgacccgcaagttcctagaagatggagatgaagtcatcttgacaggatgttgcaagggtgaaggctacaacattggttttggaacctgcaccgggaaggttctgccggcacttccctgagccaacacgtcttggcatcagttctccggagtctcaacgatctcagctatcagagagttgtctcaacggtctcaactatcaaagagttcatgccgctatctagcaaggctgctatgtaactgaacaatatgaatatgggttgttttcctgggctgttgaagatgaggagactgatgctctgttgtgcaataaaaccgcttcaccattttatacgatgtctccctctatttaagagtcgggttgtgttcttaaacttgtgcattgcaatgtcctctgtggcatgaaatttagatcatgtatatattttgaatggaaatgaagatcaaagttcgcagataaaaaaaaaaaaaaaa

SEQ ID NO: 17102 - DNA, 683 bp, Zea mays
  misc_feature (1)..(28): n is a, c, g, or t
  misc_feature (47)..(47): n is a, c, g, or t
  misc_feature (54)..(54): n is a, c, g, or t
  misc_feature (82)..(82): n is a, c, g, or t
nnnnnnnnnnnnnnnnnnnnnnnnnnnntcccccccccccccccccnccccccnccccccccccccccccccacccccctcnctagtcccccccccccccccattcttctcagcaacttcacacatttcgaaagagaatctcagaaagatcaatctagagagaccaaaaagagatcggaagagatggcttctacctccgcgatgtcattggtcacaccacttaaccagacccgttcgtctcctttcctcaagccattacctctgaaaccatccaaggctttggttgcaactggaggcagagcacagaggcttcaagttaaggccctcaagatggacaaggctttgaccggtatctccgcggctgctcttactgcttcgatggtgattccggagatagctgaagctgctggttctggaatctctccttccctcaagaatttcttgctcagcattgcttctggtggcctcgtcctcactgtcatcattggtgtcgtcgtcggcgtctccaactttgaccctgtcaagagaacctaagacctatatatctttcttacatcattattgtaatctgttctccttctgtgtattcgtttcaatgttgcagcaatgaacttttggataaaagtcaaatttgttgtttcctaaaaaaaaaaaaaaaaaaaactcgagggggggcccggtac

SEQ ID NO: 17103 - DNA, 3276 bp, Zea mays
gccgggccgcgatctccatcttctctcttcactccgaggatcggagtgaaaggagcactagctactggcagtatggtgagtctgtgtctgcaggcgaagaggcctcgggtgggggcggcgccacgggttgtggcgaaccagatgggggcgttcgaggtgctgccccaggagctgatcctctccgtgctcaccgccctgtcgtcggccgcggacaagcccgccgacctcttcaacgtcatgcttgtgtgccaggagttctgcaggctggtgactaacccgcaggtgatccgggcggcgtcggcggcgtgcgtgtccgtgctcccgcgcaggtggtgcgcagccgccgaccgtttcctccgcttctgcggcgacaacggcaacgcggacgccaactttttcctcggcatgatccagttctactgcttggggctccagacccatgggtggtcccgcatgctgatggcggtgcggtcgggccacgcgcacgccgccttcgccgcggccgtcgtctactacaacggcagctgcatcgaccacaaccagaggcagccgctggcggccgcgaacctgttcgcgctggcggcgtgccgcggccacatgggcgcgctgcgcgacctggccttctgcgtcagcaacgggctgggcgtgcggcaggacgccgaggccggccgccgcctcaccttcacggccaacctgcgggagttccgcgccacgtacccgaccgcggcggagcaggcggtggcgtacgcccacgtggtcggcaaccccgggtgcctcaccagcgagctcggctgcttcaccaccgtgccggccagcctgcgggggtgggcgcacccggccaaccggttcctgtgcgactggttctcggcgaacccgctgccgttcccgccgcggcgcctgctgctcatgtgctccatgcccacctgcggccgcccggagacgcggggcctcgagtaccgccgctgccccgtctgcggcatcgcgcgctactgctcccgctcctgccagtcgctgcactggaggatgggccacacgcgggagtgcgtccccacgcaccagtggctcatggaagccattgccaaccacgccgtcgtcaatgccgacgacggcgccaatgctgctgctatgcccgctgtcaacaataatagcgccactcaccacaacaatctcggtggtgctgctgctgatgctcctgctcctaagtagacatgcgtcgacgagccggcccgctagctattcaccagcgctagctactacacctctcctatcctatgttctcagttaactttctgtcagacagtagttttgttttccttcgtgtaatcgcctagatatatatatttccatttctaaaatatatacctgtgagttttctagagaggccaaaaaaaatcgtgtggggggccccggcaccccgcccatgattatgcatgctttgctgcgcattactatcatcttcttatagctgatgatgatatagttgcggtagtacatacccaaactcatccagaaattcagtactacgcgcaccgaaccaccgtagcacgccatcaaaccaagtcacacgtcatctagtcaaagacaaatgacctggcgcacgtttcttgcgagcatcaataaagctcctttaatttcgtgtacgacagttgtcgaatactaacacaaaaaaagaaggattattttacgtaatatatgaaactgtagtaataatgcactgtgcaccaaggttcaaaattaatagcggaatcatttttttcaggctataaggctattgcgcagctatagccggatttataaaaacatgtataatttatgcaaaaatatggaagtcgagcgatatgtttctaaggcggctcttgaagactagtacattacacaatacatgattcatggaattcaagtgtctaacacttcaataacatagttattagccactagccaggcagttgctgcacaacatggcattaataggtttaggtaattctaaaatacaatagtaaagaatttaccagctcgctaatatggtagcaacacaataccatgatttaaatagtacataacaaaaaaatattagtttaagtgaatgactactagtacaatctattgatcaagcatagagtcatctgaataagaagaatgatccatgtcaatagcatgtgcatcatcttattatgtataaagcaagtttaggttgttatgtatgtacgaagttgggttcatgttgatcttcattgcattcactaatatcattgagctttctcatccttcttcatcacattcattatttttttgtacaccatgaaaagtagaaatagcgtggctatttagtgctaaagctagcagagctaaatcgggctatagtggtggcaggtaaaatagcgtctaaaagtgaaatatcgtaggtttagatcctccaaaatgttatagctaggctataacttcgctatagcccactattttaaactttgctgtgcacacaaacacagcaaatgcacatcagaaaaaaaacctaattattacctttagcctgtttgctagcccaacaaaaaacacctgaatcctttcgcaatgtaactaatggtctgggcctagcccaccaaggccataggccatgtatgggcgtatggcctagtttgggaatagaggccagattttgtcttgggtagcaaaccccctgacagcccatatcctcgtcggatcccagttttttctcgggataggaagcccgcacgaaaatcgccgcctcctcgtcagtcgtctctaaagtcgaaagtcgaaaccaggcgaggctctgtctgtgctgttgctgtccgcccccaggccaccgacgcgccatctcttcgacgacctctcgtctccgacagctcctcgtggcagagattccacgggccaccaccgcctcgcttcacctccaccgcgcccttccacgctgttcctctctgtcgccgtcacctcggatagcggcaacagcacctccacgtccgctggtgagctctcctccaaacacctttcccgtttctcgatccgctagggtctcactcgcatcatcattgttccttgtacttgttggagctggcgattcgtgcgcttggacgctgctaccgctaccccttgtttggccgcgagcaacatcgattgatcgatgctgacagcgacatcgccgacatgccggcatggctccatttctgctagcgaaagctttcttcatgcatgcccccctagctaaaatttcttcccctcttatcttctcacacagccttttgcgggtctgttttt

SEQ ID NO: 17104 - DNA, 1466 bp, Zea mays
ctaatcgaaaagctggacctgatgtttaatgatagtaaggtttgggattttcaaaaaaaactagcaggtctcaacctcgaggcactctcacgcccaacggccacaccaccgccctctccgcgtgcccccgaaaccaccacacgcggccacgccacgccgcccactacgggcgggcctccttgcgcttggagtattggtcgacgtgctcctctcaccgcaccctctactgatactgggttggcgcgagaacggcgagcccacctgaacgcgtgattttggatggtgaaggcacagagtaaagagtctgcaacctttggtggtgcagtttttatgtgcaaccatctgaccaggaaggagtgctttgacaagaaaatatttggcctctctgatttctgtgctgattttgtagagaaagttaaagctggcacaactttattcttatatgatgttgatcagtgtaagctccatggtgttttcgaagcaacttcagatggggctgtgaacattattcctgatgcatatgtcgcatcaggaaaggggtatccttctcagatacgtttcaagaggatttggttttgcaagcctttgatgcttactgaatttcaagatgctgtccacaattattctgttaaaaacaagtttagttatggtttgtcacaccaacaggttgcaaagcttctccatttgttttcttcacggaacaggttgcagcttcctcaaaacccaatattacaagatgatgtcccaggggaccttgagacttcttctctggctagagtaactgacgtgcagtgcagtccatgtggttcatccaggagcacctgtcaaacatgttcctccacctctcttggagaacatatggcgtcgatgggtgcaaaattaatcgatcccggggcattaatgcacagaggtctacaatcagacatctcaaaatctcccctgcaatctggagcggagatggccactatcaccatacctggcaaccaagaagcaatgcatgaccaacctactgatgactatatacctcttctccaggaggaaaatacttttgaaggtgttgatggtctatttgcgttgctaaaagatgtgtgccactcttcttctgaatctaaacgtagcagtgactctgaaaaccataatacattccaccaagtttgtattagtaaggaagatgaatgctgtccacccatcttcttaggttccaaactccgtgctgacagtgaagggcgaacaagtgtgttttctcggttagtgagaaagcacgatcgtggtcgtggggaggcaatgaaacagctgtgatgctgtgctcatcaccagatgcacaacctgcaaggacacactatccttgagctgccctcggtttgtgtttgagtgcctttcgttcgtttgttgttagggtaagaacggagtgtcgtgaaaaaaacacagaaaggagaatgtaagcaatttttaaagggagaaaaaag

SEQ ID NO: 17105 - DNA, 984 bp, Zea mays
  misc_feature (20)..(20): n is a, c, g, or t
ggggaaaggaaagacctggnaagattttgaggagcgaagagaaagccacaagcaaggctctttgatgctacgatatatgcatcaagggaggaagatcatctaaaggcaaaaaagaaaaacaagaaaaagaaaaaacatgaattcaaagatgatgacttacttgatcacaggccatacagaaatgacaggagggtacctgaaagacatcgagcactaaaacgatctagtccagctcctgtggttggatatgcatcatctgccaagcgtcgcagaggaggagaggttgagctctccaacatattggaaaaagtagttgatcacttgcggggtttgagtggatcactgctgtttttaaaaccagtgacaaagaaagaagcttctgattaccttgatatcatacggtacccaatggatcttggtaccatcagggacaaggtgagaaagatggtgtacagaaacagggatgaattcaggcacgacgtagcacagatacaactcaacgcacacatatacaacgacactcgctatcctcacatccctccgcttgctgacgagctcatggaggtctgcgaccatctgctttacgaaaacgcagatctgctcaccgaggcggaagatgctatcgagtagcaatataaaaagctagatttagcatttggatcttgctatatcctaacatagatgatgtatctatctgctgatctgtaggaggggaaaaggttgtacattttttgggcctagcagcaatctacatgtgatcccgaatccagccagcttctgttggtattgtgttgagaggtagtggaagtacaaaatgtctaggttagccactcaatggcctcatgttgtaaaaatgtagaatgtaatcatgtccatatacatggcatatatcggtccaataaaccgattgtgttgcagtatttgatatgatatggaatggcgtttcaattgcagcgtgaatcaagcaaaaaaaaaagcggccaa

SEQ ID NO: 17106 - DNA, 1432 bp, Zea mays
tcgaggtcgacgttatcgactcgcctttttttttttttttttcattacatactgttaaatatatacactcctctgactccacctacgtattaggtaggtccatctcctacgtactatatactgtttgagcttcaccgactccagcttttctgacaccgctaacgttcacctcataaaaatgtttagggaaacctccccactactctcacaacatacacacataatagccagtgcatccagtttttttcctccactgctgaggtgagagctctaggaatcaaagaggacccgtagcaggatcgctcgatcgatcattgggtcgattggggttcatcgagactgccgagcagaaaacatgcattcacatccgctccagctgctcgttgtacacgtcgcgcggctgcggcacccgttcgtgcggcagcggcagcggcagggcgccctccgcctccaccgcagccgccttctcggcctcccgctttgccgtgctccggctggcaccgtcgcctccaccctccacgcacttcgctcctgcaggcccgccgtcgctgggaggacgtcgcgggtcctcggttctcgcctttgccgcctgcgcctccatgtccatggtggtgaggtgttcaattcagcgggtgcacggtgcacctgacgcgtgcgtctgtgccctggcctgtgctgttcattttgtatcctccgccacgccacgtgtacatccacgcggcaagccggcaacacagatctggaggctaccgccacgtgcatccacgcggcagcgcactgcacgtgctgtgcctacgtgtccgggtgagcattgcgagttggacggcatatcagggctgtcaatggatctgacatctaacatagaacaaaaaggtaaagttagccgttgaagttgtggagatctacagtttgtcgcaattttgttgtatgagaagtacttgtacaaatagattaacagcgaagctagcaaataatttatcgggtcattaacattatctactcgatccgtactataaaattacttttttaacaatgtttttccgttagatatgtaggggttgtttgaatgcactagagctaatagttagtagctaaaattagctatagacatccaaacaccctttaactattagctactttagtaaattagttaatagttagctaggtatttgttagccagctaatttcactggtattttttagcaaactaactattagctctagtgtattcaaacactccctaaaaaattgttgaagtcaactgacaccgacaaaagggtatgactcggctcctgaaatagatcacctgctatcccaagaagccaagaatattaaattacctgtgtcatgttggaggcaaacaccatggctatgttcctagcgttcatcttattgagctctcctcttcaacaacaccagacattagctcaac

SEQ ID NO: 17107 - DNA, 773 bp, Zea mays
agcagctgcgccatgattacccaagcgggcagtagcccgtctttaaaggagcaaaaggctggattcccccgcggggcgccgccttggaaaatagggatcccccgggtagcagaatttcccaggagcccgttcctaggaccagccgatggaaaaattccgatcaaatcaaggcaacaagccacttcaatttcctcctctgctcaagtagtactccagtatctcgtgtgtgtgtcttgagctgcactagtgagtgcgtgtgttactagtgagttgagtgcaaatactaccattagatagccacgactctcttgtcgcagtagttctgggctaacaattggtatcatagcctcaggttatgccgaagcatatgccgaaggaaggcgtcgccggcgatggctccaagaccgccgggcagagctcggctgaggaggcgcgtgcggcggacgcgcttgcgctgtgaggcaggctaggaggggagttgggtgcgccacattccgtgcgagacgtgggcatgtccagcacctccttccctctcctcacgcggaccaactggggtagttggtctaaggaagtagtataggtcagcagtgacgtggtgttttggaatgacgtaagagcttagctcatttagaacagtaggtcggttcaaactgctatataagcagcaccaccccccccccccggttgtaagcattccattccgatcaaatcaaggcaacaagccacttcagtttagaaaaaaaaaaaaaaaaaagcttatcgataccgtcgac

SEQ ID NO: 17108 - DNA, 1045 bp, Zea mays
aaaaaatgacttttttgttgtctgatctaatgggaatgtacggaatctcgtctctcccatctcgcacttgagttgagactactgttgtgactattgtgtgcgtgagagagaaacagaagaggaaaaggaatccatggcggcgacgctggcgaggagggcggggcgctccgcggcgacgacgctatggggcgcggcgaggggcttcgcatcggtggggtccgacatcgtctctgcggctcccggcgtgtcgctgcagaaggcgcggtcctgggacgagggcgtcgccaccaagttctctaccacgcctctcaaggacatcttctacgggaagaaggtggtcatcttcggcttgcccggtgcatatacaggggtttgttcacaagcgcacgttcctagttacaagaagaatattgacaagttgaaagcaaaaggaatcgactctgttatctgtgtagctgtgaatgatccgtatgtcctggatggatgggcaaaaaagctagacgctaaagatacaattgagttctatggtgactttgatgggagtttccacaaaagcttggatttggagatagacctttctgctgctttgcttggccgccgttctcacaggtggtccgcctttgttgacgatggtaagatcaagtctttcaatgttgaggaagcaccgtccgactttaaggtttctggtgcggaggtgatcttggaccagatctgagctcctcaatgaacttcggccatcttcagtttgtgcggcatacttcctctgcagcagccgaataaaattaaatctcttacgacccgtgtaagatgttaaagatacgatgcgccccagactgtatggcctcggcctcggtttttctggaatgaattgatcagtgttcactgtgtgcgttatttctatttgcattggcttcaattggagcaatgaactagatttacaggccggacaaagaacatcgacctgaacagcctgcctgtggattatactctttcttggtgaaaatgcttgatagagaaaaaaaaaaaaaaaaaaaaaaaaaggacg

SEQ ID NO: 17109 - DNA, 1898 bp, Zea mays
tgcaggtttctgggtgtccttcctactagcgtggtaagatacttttcaacaatcttgaagatacagcacttgaagaaggcccattcgcctggggttttgcggtgccattacatttacaaaatgtacaatcacatcacctttttacttcatcaagaaggacccaagcgagccaaattttaaatttatgccctgtgaatccaaaacaacctcttctattcaccatgaaacaaccatggctgttataaattctgagaggagcagcagcagatttacttgtagctctagttacactaacacatgggtctctaagttatttccaccagtagttatcatttgtatgcactgctcagttcatggctctgatccgtgtgctatcatactggctgtaatgtattcactatttcttttagttggagtatttgttttcatccttgcagtatgcaacagtaattaagctacatcttggaccgtctggcgtgagagaaatgctagaattttcgacctgttctgtcttaatgctagatgcctcttaatcccagaaatttccggttttgtggctcacaaactagcctttacagtcttgtctagtttggttttgaatttgggaatttggacctacacttttgctgttacggtggcatggagactggaattggtttctccgtagacctgttctgtctcagccgccagcttcagtgactcgtgagagtatatatttctgcttcggcagcttgcagcagccacaccacagacaatgagacagcagctatcagagccgatcaggtttgcgatgtatctgcctctgcccaatcattttgacccaaaggtgacatgctgccacgcagggataaatacgaatttcctggggacggggacgtggacgtggtgcagaagcggatgaggaagcagtgtaggagagccaccctcgcttcccacctccagtgtctcatccgttccgacgacaaacacctccctttccctgcgctcccgtcttccttccagagctgccttgtctgcacatgcagaagcgccaagagcgagcgcctcatctctttatattgctctgggaccctcgaggccggggcccacccactgccactgtacttgtgctgtgttgtgtgctgcaagaagaagaggaagaagaggaggaggaggaggaggaagaagagcaggtgctgagaagcctgccggcgcgcgttacgacaagcatatatgggggagatcaccaatgtcatggagtaccaggccatcgcgaagcagaagcttccgaagatggcctacgactactacgcgtccggcgccgaggacgagtggacgctgcaggagaacagggaggccttctccaggatcttgttccgtccgcgcatactgatcgacgtgtccaagatcgacatgaccaccaccgtgctggggttcaagatctccatgcccatcatggtcgcccccactgctatgcagaagatggctcacccagatggggagtacgccactgcgcgcgcggcggctgcggcaggcaccataatgacactgtcgtcctgggcaacttcaagcgtcgaggaggttgcctcgaccgggccagggatccgcttcttccagctatacgtctacaaggacaggaaggtggtggagcagctggtgaggcgagctgaaagggctgggttcaaggccatcgcgctcaccgtcgacacgccgcgccttggccgcagggaagctgacatcaagaacagatttgtcctgccaccacacctgacgctcaagaacttcgaaggtctggacctcggcaaaatggacccaggctgctggattcaggggctggcttcctatgtcgccggccaagtcgtaccgcaccctgagctggaaagacgtcaagtggttgcagaccatcaccacgctgccga

SEQ ID NO: 17110 - DNA, 5477 bp, Zea mays
  misc_feature (4466)..(4466): n is a, c, g, or t
taaaacgaacatgatttaacgttatcacttacccattacgttacaaatatctgaaccaaacggtacccaaattcgattggcccttctgcatcgtatccccgtcagtccttcgtactagcgtggtaagatacttttgaacaatcttgaagatacagcacttgaagaatgcccattcgcctggggttttgcggtgccattacatttacaaaatgtacaatcacagcacctttttacttcatggctctgatccgtgtgctatcatactggctgtaatgtattcactatttcttttagttggagtatttgttttcatccttgcaatatgcaacagtaattaagccacatcattattcttacatagcaagaacctgccaattcttttttttattcaagtcatgcttaatcttaacaccttaagctggcatgaatgcctgcagatgcaccggtgttgtcaagttctttgggcggatctcattccttgtcgaacacaacactcaagcatcatatttcttcatgacagcaaaatgctgcaggtagtttttatttttgcttacatgtcttctctgctgccagtatccctatcaaatagggcactcatatccgtactgaaattgttgccatcgtggtgctggccgtggccagctcttcttcggcaggttgcagcagccacaccacagacaacagctatcagagccgatcaggtttgcgacgtatgtacctgcctgtgcccaatcattttgacccaaaggtgacgtgctgccacgtatggataccaaccggcgggcgtgaaaacgttctgaaaaagagagataaattcctgaaaaccggggagcattctgagtggcaaggcaaagagacaagcctaccgataataagaattcggtttcagaattatcccttggtttcctttggacggcgacgtggacgtggtgcagaagcggatgaggaagcagtgtaggagagccaccctcgcttcccacctccagtgtctcatccgttccgacgacaaacacctccctttccctgcgctcccgtcttccttccagagctgccttgtctgcacatgcagaagcgccaagagcgagcgcctcatctctttatattgctctcacaccctccgtttctcgctcccacccactgccactgtacttgtgttgtgttagtgctgtgctgcgagaagaaggagaagcagaggaagagcaggtgctgagaagcctgccggcgcgcgttacgacaagcatatatgggggagatcaccaatgtcatggagtaccaggccatcgccaagcagaagcttccgaagatggcctacgactactacgcgtccggcgccgaggacgagtggacgctgcaggagaacagggaggccttctccaggatcttgtgagctctctctctctctccacatctcctccttcattcgctttgctatactggcttcttattcttcagctggtgtaggagcagcggttgatgagataaggcaactaggccagttagtaaaccaccatcagtagttctgttcattgatcagaggctctgcttctagtactctttcagggtttcagttcctgtaaagttctgctgctcatctattcagggagactggagttcttttgcacaaaaaacatgtggttcatactgtcagcttcaaaacaaaccgcgcagcaggtttctgacgacaattcgctagctgtgttatatgactcatcaagtccatccaataagctagcctgagttttcgcagccggttttcttcatgctatctgcactttgggatttcttcatttcttgtattcatgtactgaaagcctgatctgcggcgcttccttcgttcgaatgcactctgcttcagagccgcgcagctgctcacctgattcttcatctttttttccctcctttgctaaggttccgtccgcgcatactgatcgacgtgtccaagatcgacatgaccaccaccgtgctggggttcaagatctccatgcccatcatggtcgcccccactgctatgcagaagatggctcacccagatggtacgccgctgcaaggattttggtttttgtttcggtctctggtttggtttcattgacggctgtatgctccacacaacagcataacatgttctctagaaaaaaacaaaacatgtttagtagtaactgagaagcttcaccttccaacgatctttgtgaattcttgtctgcaccttctttttgagctgaaaccatgcatggttaccctgccttcaggggagaacgccactgcgcgcgcggcggctgcggcaggcaccataatggtctgcagatgtccctcccagctccccgattccagtggttaaaaacaactgaacttaaccttgatggcctgttctttttttcagacactgtcgtcctgggcaacttcaagcgtcgaggaggttgcctcgaccgggccagggatccgcttcttccagctatacgtaaatgcactggcaccttcactaccactcctgctgctacacagcatgagtatatatctagctagctcttccttcaccagcttattattagcttgtcaatggccgtgcatgcgtgcacgcacgtcgttgccatgaatgtttttttgtatataggtctacaaggacaggaaggtggtggagcagctggtgaggcgagctgaaagggctgggttcaaggccatcgcgctcaccgtcgacacgccgcgccttggccgcagggaagctgacatcaagaacaggtgagatgggctgggcctgggttgtggcttcacacaataacagcatttgcttgatttgctttgtcataacagctagctccatggaagcaagctgatcgtattcgtacgtggctgctgttgctgcagatttgtcctgccaccacacctgacgctcaagaacttcgaaggtctggacctcggcaaaatggaccaggtgatgtatagcgagctcaagtttcagtgcagtacatcatatggagctttgtgcactctctgtctctgatacggagcttaatgtgtgcgcgccgatcgagcatgggcaggctgctgattcagggctggcttcctatgtcgccggccaagtcgaccgcaccctgagctggaaagacgtcaagtggttgcagaccatcaccacgctgccgatcctcgtcaagggagtgctcaccgctgaagacagtaagctcgcccggcctctgcttgtctacgcacggtcggtgtgaagtgtggacgtgctaatgcatttgcatctatctcatcgcagcgaggcttgcggtggcgaacggcgcggcggggatcatcgtgtcgaaccacggcgcgcggcagctggactacgtgccggcgaccatcagcgcgctggaggaggtcgtgaaggccgcccggggccagctccccgtgttcgtcgacggcggcgtccgccgcggcaccgacgtcttcaaggcgctcgcgctcggcgccgccggcgtattcgtaagctacctacctaccctgctacccagcgctgatacaaccaccgcacagacgtctaataacgtcttcattattcgtcttcctggcctgccgtcgtcggactggctgacgtacgtacgtacgtaccggtggactacggtggttgcaggtcgggaggccggtggtgttctccctggcggcggcgggcgaggccggcgtgtccaacgtcctgcgcatgctgcgggacgagttcgagctcaccatggcgctcagcggctgcacctccctcgccgaaatcacccgcaagcacatcatcaccgagtccgacaagctcagcgccatcccgtcgcgcttgtagatgaggcaaaatcaatcgcctgctacgcctacgcctacgctacgccgccggtcgatcggggatactcagctcgtgcatggatgcatgcatgcgtgctcgacgacgatcatgataccatatataatctaggactgcgcatatatatatattttgttccagaaatgatcgatcacgtactgtactgtaaaatcttatagattattacacgcatggtgtgtgctgcatcttcattagttgttaataatggcgcacatggtgatctctctgtatttgaatatttgatcacaaagtatttgtttcaaatttttatgtgtgcccctatctctgtggagaacaacaaaacaacatttttttttgcggcccatcagaaaaaacgaaacagaacaacaggcagcatcagaacccaatcaaattccaatctcgtcgaaaacaaacaaacaaaccacgtcttcctcttacgttgggaaaaaaaagagataaactacgtatatatactgtgagcgatgcccctcaagtcaggcgatgaggcactaataacaggtactagtagtattttatctagctagcaagcagaggacgacgtcagcaaggccgggcggtctgttagtgcctcatcgcctgacagcctgagcctggcgtccgccggcgtagggcggggcggcggcggcgnccgtccgggccttgcgcttctgcaggaacagctgcagcgaccgcttcatggacagcccggcgtccgccgcctggtcgatgtcgaccgccggtcccacgaggcctctgcctcgcgcgcaccgccgcgccagcgccacggcgctagtcgtagtgctgctgctgctgctgtcgccgtcctgctgccggccgtcgccgccgtctacccgcgtcagctgctgctgctgccgccgccgccgtccccggtggtccgccagggtctcctcgctcgccatggatatgatcgcccttgcctgaatgatgcgccaggacggccggccgtgaaaccgtacacaccgatcagtaacttgaagcagtgattacacgtgttcaatttaattaactattgacccgacaagagagtaaacaggagacaatgaacaacatataatttcatgatccaacttagaacagattcaatagtttacataaacaagttagtattgataaacactcgagtttgtaactttgtattcaaaccgatatatttcagatttttattggacatccacgggtaaaaaccgaaatcaagaaactgagcccgatagggaacctgaaatgaaagccgtgagtgggaaatcgaactcgaatccaaagtccaaacccattggacccaagaaccgaggaggatcagactcgaaaacttccatctatctctacatgcgagttggtcactcgtctttctttgtgtttgcgcgtgtggaccgtggaggtagtagacgtacagatggagacgagacgaagacaatttgtggaggaggccaagtccctgcctaaaccccaaaacacatttggcgcagcacgtgcgaaattgttttgtgaggattttcaactgtgaccgagcctgcaacgattgagacctcgatcggagtcaaagactcaaaagtcaccagcttaggcgacagacggctctgtctgtgcgccggggctaaaattctcttcacctacgtagcgcggttgctcgcattttacgaag

SEQ ID NO: 17111 - DNA, 1631 bp, Zea mays
attgcattggggacctccaggccggcggcgcccacccactgccactgtacttgtgttgtgttgtgctgtgctgtgctgcgagaagaaggagaagcagaggaagagcaggtgctgagaagcctgccggcgcgcgttacgacaagcatatatgggggagatcaccaatgtcatggagtaccaggccatcgccaagcagaagcttccgaagatggcctacgactactacgcgtccggcgccgaggacgagtggacgctgcaggagaacagggaggccttctccaggatcttgttccgtccgcgcatactgatcgacgtgtccaagatcgacatgaccaccaccgtgctggggttcaagatctccatgcccatcatggtcgcccccactgctatgcagaagatggctcacccagatggggagaacgccactgcgcgcgcggcggctgcggcaggcaccataatgacactgtcgtcctgggcaacttcaagcgtcgaggaggttgcctcgaccgggccagggatccgcttcttccagctatacgtctacaaggacaggaaggtggtggagcagctggtgaggcgagctgaaagagctgggttcaaggccatcgcgctcaccgtcgacacgccgcgccttggccgcagggaagctgacatcaagaacagattcgtcctgccaccacacctgacgctcaagaacttcgaaggtctggacctcggcaaaatggaccaggctgctgattcagggctggcttcctatgtcgccggccaagtcgaccgcaccctgagctggaaagacgtcaagtggttgcagaccatcaccacgctgccgatcctcgtcaagggagtgctcaccgctgaagacacgaggcttgcggtggcgaacggcgcggcggggatcatcgtgtcgaaccacggcgcgcggcagctggactacgtgccggcgaccatcagcgcgctggaggaggtcgtgaaggccgcccggggccagctccccgtgttcgtcgacggtggcgtccgccgcggcaccgacgtcttcaaggcgctcgcgctcggcgccgccggcgtattcgtcgggaggccggtggtgttctccctggcggcggcgggcgaggccggcgtgtccaacgtcctgcgcatgctgcgggacgagttcgagctcaccatggcgctcagcggctgcacctccctcgccgaaatcacccgcaagcacatcatcaccgagtccgacaagctcagcgccatcccgtcgcgcttgtagatgaggcaaaatcaatcgcctgctacgccgccggtcgatcggggatagtcagctcgtgcatggatgcatgcatgcgtgctcgatgtcgatgacgatgatgataccatatataatctaggactgcgcatatatatattttgttccagaaatgatcgatcactgtactgtactgtaaaatcttatagattattacacgcatggtgtgcgctgcatcttcattagttgttaataatggcgcacacatggtgatctctctgtatttgaatatttgatcacaaagtatttgtttcaaaaaaaaaaaaagaaaagcggccgaaaaagaaaaaaacgaaaataatcaacaacaaatcaaaaacagaaaggcagcacaaaa

SEQ ID NO: 17112 - DNA, 1957 bp, Zea mays
attgggtccctcgaggccccccgcccccacccactgccactgtacttgtgttgtgttgtgtgctgcaagaagaagaagaggaggaggaggaagaagagcaggtgctgagaagcctgccggcgcgcgttacgacaagcatatatgggggagatcaccaatgtcatggagtaccaggccatcgcgaagcagaagcttccgaagatggcctacgactactacgcgtccggcgccgaggacgagtggacgctgcaggagaacagggaggccttctccaggatcttgttccgtccgcgtatactgatcgacgtgtccaagatcgacatgaccaccaccgtgctggggttcaagatctccatgcccatcatggtcgcccccactgctatgcagaagatggcccacccagatggggagtacgccactgcgcgcgcggcggctgcggcaggcaccataatgacactgtcgtcctgggcaacttcaagcgtcgaggaggttgcctcgactgggccagggatccgcttcttccagctatacgtctacaaggacaggaaggtggtggagcagctggtgaggcgagctgaaagggctgggttcaaggccatcgcgctcaccgtcgacacgccgcgccttggccgcagggaagctgacatcaagaacagatttgtcctgccaccacacctgacgctcaagaacttcgaaggtctggacctcggcaaaatggaccaggctgctgattcagggctggcttcctatgtcgccggccaagtcgaccgcaccctgagctggaaagacgtcaagtggttgcagaccatcaccacgctgccgatcctcgtcaagggagtgctcaccgctgaagacacgaggcttgcggtggcgaacggcgcggcggggatcatcgtgtcgaaccacggcgcgcggcagctggactacgtgccggcgaccatcagcgcgctggaggaggtcgtgaaggccgcccggggccagctccccgtgttcgtcgacggtggcgtccgccgcggcaccgacgtcttcaaggggctcgcgctcggcccgccggcgtaggccgcggcggcccggtggtgttctccctggcggcggcgggcgaggccggcgtgtccaacgtcctgcgcatgctgcgggacgagttcgagctcaccatggcgctcagcggctgcacctccctcgccgaaatcacccgcaagcacatcatcaccgagtccgacaagctcagcgccatcccgtcgcgcttgtagatgagcaaaatcaatcgcctgctacgcctacgctacgccgccggtcgatcggggatactcagttcgtgcatatatggatgcatgcatgcgtgctcgacgacgatgatgatacccatatataatctagggctgcatatatattttgttccagaaatgatcgatcacacgtactgtactgtaaaatcttatagattattacacgcatggtgtgtgtgctgcatcttcattagttgttaataatggcgcacatggtgatctctctgtatttgaatatttgatcacaaagtatttgtttcaaaaaaaaaaaaaaaaaaacagccctgtggagaacaaaacaacagttttttttttgctcgacatcagaaaaacgaaacagaacaacaggcagcatcagaacccaatcaaattccaatctcgtcgaaaacaaacaaacaaaccacgtcttcctcttactttggaaaaaaaaaggaagataaactacatatatatactgtgagcgatgccaatgcatggctgcccctcatgtcaggcgatgtggcactaataacaggtactactagtattttatctagctagcaagcagaggacgacgtcagcaaaaggccgggcggtctgttagtgcctcatcgcctgacagcctgagcctggcgtccgccggcgtagggcggcgcggcggcggcggccgtccgggccttgcgcttctgcag

SEQ ID NO: 17113 - DNA, 1483 bp, Zea mays
cctcgaggccggccaaaaaaaatgggtacctcgaggccggccgggcttttggattctggtttctctcgtctttctcctccctctcctgacttttcttctagacatctcgcgggtcttatcgactccaacaagaacacactacacaccagccagcgagatagcgaacgctaggaacccagtggccatctttggagcggccatgacgctggatcagaaccatgccatgccgatgcagcccccggccctgcagcccggaagagcatatggagcagagggcagtgctgtggtgcatggttccatcagaacagtaggaagaagcgacctcgcagatcacgagatgggcctacgtcagtggcagctgtcatccagcggtgggctgagcgcaacaagcatttggagtatgaggaatctgaggaggcaaagcgaccaagaaaagcacctgcaaagggttcaaagaagggctgtatgaagggaaaaggggggcctgacaatactcaatgtggataccgtggagtgaggcagcgtacttgggggaagtgggttgctgaaataagagagccaaatcgtgtcgacagactctggctgggtaccttcccaaccgcggaggatgcagctagggcctatgatgaggcagccagagcgatgtatggagacttggcacggactaacttccccggacaggatgcaacaacctctgcccaagctgctctatcatcgacctctgcccaggctgctccaacagctgttgaagctcttcagactggcacgtcatgcgagtcgacaacgacatcaaatcactcggacatcgcatccacctcacacaagcttgaagcctctgacatctcgagctacctaaaggaaaaatgtccagctggatcatgtggtatccaagacggcacacccattgtagctgacaaggaggtctttgggccgttggagcctatcacaaatcttccagatggtggtgatggttttgatatcggtgagatgctgaggatgatggaaagcgatccacataatgcaggtggagccgacgctggcatgggacagccctggtatcttgatgagctggattcgagtgtcttagagagcatgctccagccggagccggagccagagccagagccattcctgatgtctgaagaaccggacatgtttcttgctggcttcgaaagcgctggtttcgtcgagggtctggagcggctaaactgaatttctgatgtttgaccgttgatcctcatcccacttcatgtctgagcttgtgaattcggaggcaaacattggcagaacttataagctctagcaattctaggctttacattcctctgtgatagttctctatgcatgggaactgggtttgcttcacaatttttgtaagaccagaagtgatgtaaatagttcccaccttgtggaaggacaagaaaaaaataaataaaaagagtgcttgctttcgttccttaaaaaaaaaaaaaaaaaagcggcc

SEQ ID NO: 17114 - DNA, 6235 bp, Zea mays
  misc_feature (2252)..(2252): n is a, c, g, or t
  misc_feature (2304)..(2304): n is a, c, g, or t
  misc_feature (6200)..(6200): n is a, c, g, or t
  misc_feature (6202)..(6202): n is a, c, g, or t
  misc_feature (6216)..(6216): n is a, c, g, or t
aatcttccaatgtaaaagttgcttagttttttatactctaccactttgatacatgcactttggtccaaaagtgtatagaaattgatcgcatatcatagatcacaaattagggtttctagggctcttattagggttttgagtgttctagggtttgtgtgccactcaaatccaccaagtttagcctcatatgaacattccactaacttttgagataatacttaatttagtatcacacacacctacacacctctatcccttggttaagtaccctgttttagggttaagaagcacttcaagtcatcacataataacttgttttgagattttagcctagtggatgcactttacgtgtaacatacataatgttatgtctaagttttagttattgtaacaccaataatattacagtgtgcacttatccctaaaatcttgttcggttgcacttatcctcgagtttatctatgtcgagaccgaaccgaacgtggaggtgttttcggggtttcgttttgtggaatttcaaccgcttggcgggaggcaagagtcgaggggtaaagcatataaaagcgggtaaagtggaacgtatccgcccctgacgtctccatctacacccggattcgccttttttttctgaacgtcttcacggctctccttccttcgccgccgcccgcccggccatggattccccgaggggtcccgcgagcttcgcaacgcaggccaacgccctcctccgcaagaacctctgcgttcaggtacaggcaccaccgctcttcccccacttcatcttttcccgcttcccttccacttaatctatagacgtagttcagctcgtcccgcctgcgaggtgctcgtggattttcctttggcggaccttgagggggatagaagcacctgtttgatcagcaaagagctgctcgagtctcatatgtttcgatttcagaggatcttgtgcggtctctgtctctgggttgggtccaatctgtgtgcgtggtgttttaggtgaaccaaggcgggtaggtagcctttggtgtgttggcctttcttctcctgtgaatgcaaagggtacatcagcatgataaatgcccagtgggcaagcaaaaaatgctacagattattctagttaaattttcgttttcctttattctttggaatttatccagtgcattgcacgctctgcatttgataccagtttcgcaacaagtgctgctctagcctggcggttaaaagctccaaatatcaccttgaagacccaaagttcgatttcactgggagacgaattttttagtgtggttaaaaactacctttgttgtaccttatccgctctcgtgttacaatgtcattctctcccgaccttaggcattataccggcaggacgattattccttcactggccaagttttttttcttaacaagtgctgaagtgcttataatatgtttttttacatgaagcaatgccaaacagccaaagctcgttacgtctccatgggcagcgcctgatttttatattgtcctcattgcagaaacggaacctcaagacaaacatcggcatcactttcttcccaatcctgatttgcgtgcttctcatcgtgctccagaacgtcatcaacagcgagcttgacaagcccaagtacaaatgcggttgcgtctgcctcgagaccagtgccaacggaaggtgcgtaaggaaagagtgtggcattcagtactcgacgctggatcaggtggggagctgtccgattcccagcccgccacagtggccagccctgattcagatcccccgtgctgatttccgggctgcaaggacgttctcccaaccgtttaatgatttgcctgatccattttgccgtgactcctggtcttgccctgcaactgtccttgtcactgggaaggacagagcggttgcagaaggtatgtgcttgtcatagtacagttaaaacacactttgaaatgcttacactttggtgactatgttcgtaatccttgagtaaatgttttcgaaatgtcagctatatcaagagggctgtttcctgtcctttctccgtctttgaatgcaacagatttactggatctcttctccaagatagtcgctgtgagctccctcaattaccaaccaagtaacccgcctgtaaattttgctgcttcatgttttggtttatgtggttatcgttggcttcattttgtcctagggctcagatacacagccatggtacacacagttgctagagcctgcatttttctctggtcgtacattgtatgtnatccagcctgagtgcacacctgtcatgtcacagaccattacatataatactnggggcataccctttcagctcagtaagtataagtatctttccataaaatgctggttgatggttttaggttggaaaatgtaaaaacaatttgcagcttcagtctagggactggtgaagtttccatgtttgatcttgaactagtactgctatagcatatgatggatcttactctgaaataaggttttaaatatccggttacaacggccgatatatcccaatatagcctttttagcagtgaaaagttatgctatttgacacgatatatcccgatatatcccaatatatctcgatatatcccgatatttgcgattttgagaagtgcggggataaatctcttatcctgctatttaaaacactgctctaaaacactcataaataggctcaaatctatggcccttttatttggatggtggtaggagcacactaataacaacatgccagatgcttgtacaaactctcatcattatatatatgtgtgttacactttcatgttgccacgttgaagggcaggtctggttcagtggtgagagttgtctcatagagttattaggtctcggaatcgaagcagtctctcggcatttgcgggaaaaaaaagcttgcctcagtttatcccttccccaaaccccactcatctgggagccttcggcattaggtctactctttttatagtatgattaaaagaaacaaatagttagctgcccgttcaaaaattgcacgcatttatatacatgattatattttgtgctatatggacattttctgaagcctgcttgacggcaacagttgagaaattgttgtctatcattttgaaaatttatgctgcagctttgacaccctcttgaaatgaaccagatatacagtgtgttgaaggtgctccgttatggcgtgaaactgcatcaattatcaaccatgaatttttaaagggttatagacaacgaggaggacaaataaacgaatttattgcaggttatatatcttgatgttacaattcttttatatgtgaattttgaaggacttcatatgtcaatgataatttgcaaaaaaataaaaaatgacagcccacgaaccaatggacccttggatactgccaatgtaatcagtaaccttattgactataatactatatatcagtttttgatataaaatgacacaaaaaagatcattcatacacaaatggtattggcatactttatgatcgccttcatttctgcaggttatgacttcttgggcacaacacagtatggcctcggtgtaaatgtttggtacaactctacttacaatgataacaatgcatattcatttatctcaacattgcgggttccacgcttggtgaatgcagtatgttgtaatcttatctctgactaattcagtatcttttgaaacatgggacctgttctgaacttctgaccgcttatgttttgtttcttacaggtatccaacgcttatctgaaattaatcaaagggactggggtagacatgctacttgagtttgtaaaagatatgcccaaagttgggacaagttttcagttggatctgtcttctcttctgagtgtcttattcttcacatggatcatcgaacttcttttccccagtgagtatgatgagatgtattgatgtagcgtttttgtaagtagggtgggaaacaccgcattaacatgctaacagttagtatcagtagagcttgcaatctgactaatttttaaacttaggttatgttgacatatctggtgtatgagaagcagcagaagctaaggattatgatgaaaatgcacggtctgaaggatgggccttactggctgatatcttattcttatttccttgctctatcaatcgtctatatgttattctttatgatttttggctccttgattggtaattgtattacaacgttactcatgaatattctgttgtggcaaataaatcttcattgtcttgactagccttcttctgttcaggtctcaattttttcagagtaaatgaatatagcatacaagctgtttttttcttcgtctgtataaatttgcagattgcacttgcattttttgtggcatctttctttttgtccgtcaagatggccacaggttaataactcaaaccttttaccttcaagtcagaactttattttttgaaagtgacagagggaatttcattttgctccttctgcagtgattggctacatgtatgtatttggctctggcttacttggtgcatttcttttccgtttctttgttgaggacaaaacttttccctatggttggacattagtcatggagattgtcccaggattttccctctatcggggcctatatgaacttggtcagtatgcattctcgggaagcagtataggaactactggtatgacctggagaagtctgaaagatcccctcaatggaatgcgtgatgttatgatcgtaatgagtgtagaatgggcagtgctgctcatattagcattctatttagatcaaacctctttgctaggcggtggtgtcaggaaaaatccttttttctgcttcagatgtttacagaagaaatgtgcaacatcattgcatgaacctagctttgtccaacaggattccaaagtcattctcgatatggagaaatctgatgttgctctagaaagaaaagtagttgagcaatttttgatagatcccaatgcaaaccaagctatcatctgtgataacctcaggaaggtttatcatggaagggatggaaaccctgacaagctggctgttagaggtttatctcttgtccttcaaaagggccagtgctttggaatgcttggtccaaatggagccgggaaaacatctttcattaatatgatgattggactcattaaacctacatctggtactgcttatgtccacggaatggatataaatatggacatgggtgacatatatacaaatatgggagtgtgcccacaacagaacttgctttgggaaacactgactggaaaagaacatcttttcttttatggtaggttgaagaatcttaaaggttctgcattaatgaaggctgttgaccactctctgaagagtgtaaatctatctcatggtaatgttggtgataagcaagtgaagaaatacagcggaggcatgaaaagaaggctcagcgtggcaatctcattgattggggaccctaaagttgtcttcatggatgagccaagcacaggaatggacccagcatcaagaaataacctatggaatgttgtgaaggaggccaagaaaaaccgtgcaattattcttactactcactcaatggaagaggcagaggtattgtgtgaccggcttggcatctttgttgatggcgatttccaatgccttggaaaccctaaagagctaaaggctagatatggggggacatacatattcacagtgacaacacccccagaccaagagatggaggttgaacatctagtgcgtcagttctcgcccagcgcaaacaagatctaccatctatctggaactcagaaattcgagctgccgaagcaagaggtgaaaatagcccatgtttttgacatggtcgagaaggcgaagcgccggctctcaatacatgcctggggactggtcgacacgaccttagaggacgtcttcatcaaggtcgccagaggagcacaagtgttcaacgagtttgcgtagataacacctttaggactgccttcgtagcaagcacgggaccccaattattggatgggcggactgcatagagaatcttgtggttttgtaggtatttttcattagtgagagtcattcttgtgtggaaaataggctccatatgcttggtttacgtggttgtacataaataaatacatttttgagactgcagttgcagaatagaataattgtccagttgtgtccatatatattttttctttttcaaaaaaaaaaaaaaaaaaananaaaaaaaaaaaaanggaaaaaaaaaaaaaaaaa

SEQ ID NO: 17115 - DNA, 688 bp, Zea mays
  misc_feature (667)..(667): n is a, c, g, or t
ttttttttttttttttataaaatttcggtaatttatcacatcttcataacatattttacctttatttatgtacaacgtataaaatctttacagaccaaactactaacccattgctaatagattcatatcatacacattttgggttttccaaattatatattatgggaatttacgaataaagaaatgaagttagtcaaataaggctaagctacaggagtgaattcgagcaacttcttagagaagagccatggttgaataactataactgagtcaaacatcctgctcgtgccatcgggttgagtcactgcaatccttagatagtatttggtacctgccacgacctgtttctgagccgactcaactcggctaaatttcaacggactcaacacagccgcgtccgttcttgcattggatgcttcgttaccttgcttgctctgttgttgtagattgaattgtttcacgcagtaccttccaagttcttgaatttcaatgttggttcgaacgttcccaacatctgacttccctccgagaagggtggacttcgccgatggagtcacgacggcgatcgccagaaaccctaacaatgacaatctaataagagagacttttgacatttgcttctaactttttttcttcttctccttcggcttttttcgaaaaggaaggncaagggaaggggctcccgccg

SEQ ID NO: 17116 - DNA, 853 bp, Zea mays
  misc_feature (1)..(1): n is a, c, g, or t
  misc_feature (15)..(16): n is a, c, g, or t
  misc_feature (28)..(28): n is a, c, g, or t
  misc_feature (30)..(30): n is a, c, g, or t
  misc_feature (36)..(36): n is a, c, g, or t
  misc_feature (45)..(45): n is a, c, g, or t
ntgggtaccggagcnncccctcgaggtngncggtancgataagcntttttttttttttttttaggtgactatagatagatcaaccaacagttacaagattacaaagagaatatatattggtgtatcttatagttcatcatgttgtgaagcgatgtcacctgaaactacatccttgaagaaaaagttaatttctctctcagctgatgaagttgaatcggagccgtgcacacagtttctctgagagtccttaccacacaatgctctgatgctgtgaggatgagatatcttagccttttgcgaatcagtaggcccgattaaaccacgccaatcagaaacagcgtctcctttctccaacaccatcaccaccacaggaccacttgtcatgtaagaaacaagatgaggaaaaaagctccttgacgaatgctcgtcgtagaacgcagaggctgcctccttctccagctgagtaagcctctccttgacgatattaaaaccagcctcgacaatgagccttttgatttcttcagtgtagttaccagagactccatctggctttatcatagccaatgttctctctttacctaaacacctgaccgacggcgacaaggagacagagacaagaaccaggagtaacaacactaggtgagctgcgaatcctgacatcaacttaatcggagttcagaaacggcgcggtggatgtcaggcgggaataaaactggtgttcggggtaggtaacggcgagttgagttttctcctccggcaagcggcagttaaactctaaaacgcgcttttaatttttttcgattaggatgttcttgttaaacacaataaagtgcgaactcctggggggaggtga

SEQ ID NO: 17117 - DNA, 1698 bp, Zea mays
  misc_feature (1681)..(1682): n is a, c, g, or t
gcccgcccgggaccgcccggctgattcctctccggccgtcccgacgttatccaactcctgaacacctctctctcgccacctcacctgaacacctgctcgccccacccattccctccgcatggctggcctccgccctcgcgccgccgtagcttcgaattgcctccgaccggcaattcggcgaggcgcccgtcacgcatcgggggcagcgtttggatactacacctgctggcagctacagggaaatattttgaattggagatctatatccgcaactaaaaagctctggagtacagtagctagtgcaaagcctgatgattctaaatttgaaagtgtggatgcaccacttgagccccaaacatgtgaaggcagcttcttgtgtggtctgttgaagaacctgccacacatttttctagctgcagcagagaagcagttgcaagaactgtcttaccaaagagaagagagcttaaaacgctgggagcatagtattggttctaaagaggattgccttcacaggaggattgctgaactcaaggaacacgagtgtcagagagctattgaggacatcatgtacatgttgattgtttataagttttttaagattgaagtaccaatggttcccaatctatcgaaactcatcagcaacagaaggttacagttatggccaccaagggagacagatcttgaatccattcatggacctgaggtgctagagctaattagggaacacttgaccagcattatcagatgggtgcacagaaatggtcccaagatcaatcgttcaacacttcgcattaaaagactgcaatttgttcggatatattctgcttcaataatgtacggatacttcctgaaatctgtcagcatcaggcatcgattggagctgacccttactcgctcagaaggagtgcctccgattcaatttctgaatgctcaactcacaaataaacaagagcaggaaggggccattggaggctctagtgaagcttcgtcttctttgagaccaagttctgtggtcaacccacacgacttgaggggctacataatgggattcgatccaaagaccttgcagctttgcgcgaagctgcgctcatctgaagcttctaatctcatcgagaggcacagctgggctctttttgggggcgacatggaactctcccaggagaatgatgaagcggttatacttgatccttcatccctgaaaagactactgcttgaagccattgcattcggttccttcctctgggacgtcgaggattatgtggacgagatcttcaagttatcggatagctgaagaaactgctacagaaagctcctacagcctttgtggttgtggatagatgaagccagctgaaaagaggagctgcagttcttttctctagatttgtatatatggctggctgttatgtacatgcatatacatcttcatctcaagtttgctttttggagggtacacaagtttttttttgtaagttatgtcatcttacactagtacacaatagcatcagcctatcaacgcagaggacgtgtgacataattttatggtcccaaaataactgggcattttgctaatctagaacgacattattttggaatgaaatgagttgtatcagcatttgtaaaaaaaaaaaaaaaaagtttgaaagcataaatctgataggcctattgggctttcggttgcgcnnaaaaaaaaaaaaaaga

SEQ ID NO: 17118 - DNA, 2898 bp, Zea mays
  misc_feature (36)..(36): n is a, c, g, or t
cattgggacctcgaccccggccgggaaacctcctcngagcaacccaccctgtcgtccgcgtcctccacgccctcgtcgtcctcctcccacaccgcgcgcgcggcggtgttgacccacccacccgttcctcccccaccccatcagcgctggaggcggcggtgcgtaagtcccccggacccttcggcggcggcggcggcgcgcggttatgccgagaggctcccaggtttcatcaccgtgctctgctggagttatagcattttcagcaaggatatggagtacaccccctgcacagcaagttcctctgtatcccacatctcgctgctcgaggaagttcttggctggaggttttgtctttacggagacttcctggtcatctcttttgtcaactgcacttgaggatcaacccacgcttagtgactgccttgcctggtcccatgctgtcagacattagagttgcccagtgattacactattacagtgcagctgtagcacatttatttgagcatggtggatctgtttctctggcaacattccagtaatctttgtcttggtgctaatcagccagcagaagttaccatcaagacatctttggacacttggatctaacgcttagagctttgccttcgcatataggctctaggtttgggttttcgttttctgctagctttcttctactctaccactgtaagttttcagtctgatcggtccaaagtttggtgtgtattggttacgctgtccttcaccagccttcactttgcatggcgtgaccttagagaagacgtgttcaagattttgttgtcgcaaaagcatgggaatagcatacatagctttgagaggagtctccagtgactttggtgttgtaacatccaaagacactcctgttatacatatatgagtcctgttttttactatacaactgttctgaaataagggcagttctgtgcaccaccagcgaataaaatggagagatatacaattatcaacgaagttggtgatggaacatttgggagtgtttggcgtgcaaccaataaggaaagcggtgaagtggttgcgatcaagaagatgaagaaaaagtattattcttgggaagagtgcataaacctccgtgaagtgaagtccctgcgaaggatgaaccatccaaacattgtaaagctcaaagaagtcataagagagagtgatacgctgttctttgtttttgagtacatggaatgcagtctttatcagctgatgaagagcagagggaagcccttttcagagactgaaatccgaaactggtgctttcaaatatttcaagctctgagtcacatgcaccagcgtggatattttcaccgtgaccttaagcctgaaaatttgcttgttacaaaggaactcatcaagatagcggattttgggcttgctcgtgaaatttcttctgagccaccttatacggaatatgtgtccactcgttggtatcgtgcccctgaagttcttcttcaagctactgtttataatgctgcagttgacatgtgggcaatgggtgccattatcgcggagctattttcactgcgacctctttttcctggatcaagtgagccagatgaactttacaaaatctgtagcattattggcactccaaatcagcgtacttggcctgaaggactgcagctagcagcatctatgggttttcagttccctcagtgtgaaagtgtacatctttcggaagtggttcctttagcaagcaaagatgcaatcaatcttatctcgtggctttgctcatgggacccacgaagaaggccaacagcagtggaggttttgcagcatcccttctttcagccatgcttctatgtcccaccttcacttcgcttcaaatctactggatatgcatcaacgccaccatcagctggggctaaaggagctgttgatcagaagaacattaggagatactacatgggtactgtacccaatgcgaggccaacagttaattactcgtacttgagaaacaatgctcctgcaagagcagttggtgcacaaaggaaattggagttggattatcagctcccagagactaataaccataataaggtgacaaaggcagaagcgatgaaccagtcttggtccagaccagcagcagtaaggagcaatgcaggaaatcatcttgccaacgacctgaacccccgtgtacctgaccttgccgagaagctgtctcagttgtcaatgggccccaacagggtgtcgggtttgggttccgagaggtttgttagaacccatgagaacgctgccaagcgccccttgcccgtgggatccagggcgtggcatggtccagctgaccccttccggcgcccatacgagatgccaggtgatagaactctccttccaaggaatctcgttcgctgaggctgtgaagctcttcgcaagaaacatatccaacgctcgctgtcttcggagctactcttccccggctatttacctcgcaacaataaataaacaaccaaacttcgtttccagcagtgggtgttgctcagcattgtctgttaccgtgcttgtgcgtgacgaggataagaggcgtccgggtttgtgcacccccccccccccccccgggtcctcgagggctccagggctggttggttgcagcatggcccgatgtgcctccatgtgatatcgtttttttaattatgctgtgcgatgtgtgattggtaacactgcttcagttgttaccgctgcttgttcagtgggtttgtatgaactgtgacatgctccgctaaacgttattctaaatactggtatgcaaacatgtcgaaggtgaacaatcaatggtgtatgtagagtagacttaaatggtaactgccttgtttcattctttaaaaaaaaaaaaaaaaaaaaaaaaaaaaaaaaaaaaaaaaaaaaaaaaaaaaaaaaagg

SEQ ID NO: 17119 - DNA, 998 bp, Zea mays
  misc_feature (859)..(859): n is a, c, g, or t
  misc_feature (874)..(874): n is a, c, g, or t
  misc_feature (888)..(888): n is a, c, g, or t
  misc_feature (894)..(894): n is a, c, g, or t
  misc_feature (896)..(896): n is a, c, g, or t
  misc_feature (901)..(901): n is a, c, g, or t
  misc_feature (908)..(908): n is a, c, g, or t
  misc_feature (925)..(926): n is a, c, g, or t
  misc_feature (928)..(928): n is a, c, g, or t
  misc_feature (930)..(930): n is a, c, g, or t
  misc_feature (933)..(933): n is a, c, g, or t
  misc_feature (936)..(936): n is a, c, g, or t
  misc_feature (941)..(941): n is a, c, g, or t
  misc_feature (952)..(953): n is a, c, g, or t
  misc_feature (959)..(959): n is a, c, g, or t
  misc_feature (965)..(965): n is a, c, g, or t
  misc_feature (968)..(969): n is a, c, g, or t
  misc_feature (972)..(973): n is a, c, g, or t
  misc_feature (975)..(975): n is a, c, g, or t
  misc_feature (980)..(980): n is a, c, g, or t
  misc_feature (988)..(988): n is a, c, g, or t
  misc_feature (992)..(992): n is a, c, g, or t
  misc_feature (994)..(994): n is a, c, g, or t
  misc_feature (997)..(997): n is a, c, g, or t
gggtaccctcggggccggccgggaggaaaatcctcgaagcaacccaccctgtcgtccgcgtcctccacgccctcgtcggctcgtcctcgccgtcctcctccacaccgcgcgcgcggcggtgttgacccacccacccgttcctcccccaccccatcagcgctggaggcggcggtgcgtaagtcccccggacccttcggcggcggcggcggcgcgcggttatgccgagaggctcccaggtttcatcaccgtgctctgctggagttatagcattttcagcaaggatatggagtacaccccctgcacagcaagttcctttgtatcccacatctcgctgctcgaggaagttcttggctggaggttttgtctttacggagacttcctggtcatctcttttgtcaactgcacttgaggatcaacccacacttagtgactgccttgcctggtcccatgctgtcagacattagagttgcccagtgattacactattacagtgcagctgtagcacatttatttgagcatggtggatctgtttctctggcaacattccagtaatctttgtcttggtgctaatcagccagcagaagttaccatcaagacatctttggacacttggatctaacgcttagagctttgccttcgcatataggctctaggtttgggttttcgttttctgctagctttcttctactctaccactgtaagttttcagtctgatcggtccaaagtttggtgtgtattggttacgctgtccttcaccagccttcactttgcatggcgtgaccttagagaagacgtgttcaagattttgttgtcgcaaagcgcatggggatagcatacatagctttgagagggagccccngtgactttggtgttntaacatccaaaganactccngntaaanatataangaggcctggattttttnnananaantgntctgnaaaaaggggannttttgnggcccnccnntcnnanaaaangggaaaanaaancncant

SEQ ID NO: 17120 - DNA, 2265 bp, Zea mays
taccctgatgaagagcagagggaagcccttttcagagactgaaatccgaaactggtgctttcaaatatttcaagctctgagtcacatgcaccagcgtggatattttcaccgtgaccttaagcctggtatgtggttttgcatttgttcttttttacattcatgtggcaatggttgatctatcctttcttgtttgttgcgaaacaagttactagttccagtcgttttcacatgatacttcggacaacaaaatagttctaaacacagttcaatcttcatgtctaaaacattgtgtgtatttaactggagggactatcacttatgagctcaggaacagttgccttgcaatttttctatatgagctgcatatttagtttacatatagttcaagaaaccttttgttagttaaattgctgtaggtgaataagtattcatgttgtggttgttctctgtggttattttcaaatttgttggagtgattcacttacagcaccagaaaatttatacatgatagtgggtaatggatctagttcttctctattttgcaattccattatttatttaacttacatgtaccgtttccatctggggatgtgttcagtgttgttagcaaacaacaacaaccataattgatcttggtataacttgtgcaatttcagaaaatttgcttgttacaaaggaactcatcaagatagcggattttgggcttgctcgtgaaatttcttctgagccaccttatacggaatatgtgtccactcgttggtaggttatgtttgaaggcctatattttcttaaagtgtagaaaataatagaataaacattctaatgcctgctatcaactaggtatcgtgcccctgaagttcttcttcaagctactgtttataatgctgcagttgacatgtgggcaatgggtgccattatcgcggagctattttcactgcgacctctttttcctggatcaagcattattggcactccaaatcagcgtacttggcctgaaggactgcagctagcagcatctatgggttttcagttccctcagtgtgaaagtgtacatctttcggaagtggttcctttagcaagcaaagatgcaatcaatcttatctcgtggctttgctcatgggacccacgaagaaggccaacagcagtggaggttttgcagcatcccttctttcagccatgcttctatgtcccaccttcacttcgcttcaaatctactggatatgcatcaacgccaccatcagctggggctaaaggagctgttgatcagaagaacattaggagatactacatgggtactgtacccaatgcgaggccaacagttaattactcgtacttgagaaacaatgctcctgcaagagcagttggtgcacaaaggaaattgggccgggattatcagctcccagagactaataaccataataaggtgacaaaggcagaagcgatgaaccagtcttggtccagaccagcagcagtaaggagcaatgcaggaaatcatcttgccaacgacctgaacccccgtgtacctgaccttgccgagaagctgtctcagttgtcaatgggccccaacagggtgtcgggtttgggttccgagaggtttgttagaacccatgagaacgctgccaagcgccccttgcccgtgggatccagggcgtggcatggtccagctgaccccttccggcgcccatacgagatgccaggtgatagaactctccttccaaggaatctcgttcgctgaggctgaagctgaagctctaagcaagaaacatgtccaacgctcgctctcttcggagctagtcttccccggctatttacctcgcaacaataaataaacaaccaaacttcgtttccagcagtgggtgttgctcagcattgtttgttaccgtgcttgtgcgtgacgaggataagaggcgtccgggtttgtgcaccccccccccctccccgggggtcctcgagggctccagggctggttggttgcagcatggcccgatgtgtctccatgtgagatcgtttttttaattatgctgtgcgatgtgtgattggtaacactgcttcagttgttaccgctgcttgttcagtgggtttgtatgaactgtgacatgctccgctaaacgttattctaaatactggtatgcaaacatgtcgaaggtgaacaatcaatggtgtatgtagagtagacttaaatggtaactgcctgggttcattctttccaagcctaaaaaaaaaaaaaaaaaaaaaaaaaaaaaaaaaaaaaaaaaaaaaaaaaaa

SEQ ID NO: 17121 - DNA, 2679 bp, Zea mays
ctcgctgttcccgcccgcccctccactctccactgttcactcccagtccccacaagcaccaggcacagatcactcgcttccccactcgctcacgccaaaaccaccgcgccgaatccgaatcgagtcgagcaagcaaggagctagcgcacgcatctaggctaggcgagagcaccaaaggaggcgccgcgggtggcggcggaatgggagggcccctcggcgcgatcatcggccgctacccgtcggcggccggcggcgacgagcagctgggaggcggcgccggaggcggcattatacgccacgaccgcaggtgccgcgacatcgccgttctcgtgctcttcgccgccttctgggtcgccatgattgtcaactccagcttcggcttcaaccagggcaacccgctcaggctgacttatgaactggactacaaagggaacgtttgtggcgataagcatggcaacccaaatttgcaggagctggatgttagatactggatgaatccgaatcaagtctaccaaagtggactcaagaacagcaaggttaacctggctgatgccaaagccatctgcctgatggagtgcccaaatccagctgtagatggattgaactatatttgtgattatccagaagggaacatagacctctctgttgatgattggatcaatagggactatgactattatgagtttctcacaccagacatgaagaatagctcacttcaactccagggtccatgctaccctataatatttccaactgtaaatgtctattggagctgccaatttattgcacgtgcatccaatgtttctttgaagcactggcatgagacgggtggtgtcagcattgatgaaaatatcctcattgataaaacagtgcacaaggccatcgattctagatctgctgtattgcagagatatattgcagacattgggaagtcctggcctgtgttcatcgtttgtggtggaattctccctgttttcctgtcagttatctggttgcttatgattcgttatttcgttgctgccatgacttggatcacagtagtcctcttcaatgcccttgttatatctgtaacgatgttcttttacatcaaagctggctggataggcaatgaccccttaactgttgtcattggtgaaagtgatccatatgttcacataagtggacgggaaataagtcaccttcatactattacaatcctaatgacagcagtaatgatcattgctttcctgtcctcaatagctattgtccgccgtatactgatagcaacacctgtcttaaaggttgctgcaaaggtcattggtgaagttcaggcactgatagcttttccacttttgccgtgcctgatcctttctatcttttatatgttctggttttctgctacactccatctcttcagctctggtcaagttgtccgaaatgattgcaatactgattgttgttcatatgatctgaagctgggaaaagtaaattgtgacaactgctgtgggtacagcatccattacacccctcatatcagcattgccattctatttcacttatttggttgctactgggcgactcaattcattctcgcatgctcttcaactgtggttgcgggatcagttgcttcgtactactgggcgcgtggtgaaatatcacatgatataccatttctcactgtagtctcttcactgaagcgactgatgcgctacagccttggatctgttgctctgggttcacttgttgtatctgttgttgaatgggtgcggtttatactagaatgccttcgtcgcaagttgaagctagttgattctgcccgagagagctgctttggaaaagcgacgtcctcctcttctgaatgctgcctgggttgcatagactggaccctcaagtcagtaaatcgaaatgcctacattatgattgccatcaccgggaaaggtttcttcaaagcttcagtgctcgcaactggattaataatgaagaacattctgcgcatcggaaaagtcaacgtcattggagatgtcatcctcttcctgggaaaactctgtgtgagcctattctgtgcgcttttcgcctttctgatgttagacacccacaagtacaagtccgcacacaacaagatatcctctccagttatccctgtcctggtaacatgggccctcggctacgtagtcgcgaagcttttctttgcggtggttgagatgtcgatcgacaccataatcctctcgttctgccaggacgccgaggagcaccaggggaacgcgcagtatgcgcccccagctctgatggaaactctggacgaacagggcgaactgcagagactaactcaagggccttgactgtcttttcctcttggtagtagcatggaaacttagcggcagcctaatgttttgttaccccgttccgttctcttggcttgtgaagaggtttgccatttttgcttgctaccctaattccatgtacaagtctgaatctgacatgttctcctggcccaattggcatgtgtaggcagcttatctatatatgtgtgcagtgtgctattgctgaaaaaaaaaaaaaaaaaagcggccgccgtttccaacttccaacatcataaatttaaccaaatttatatagtaaaacaataacatttttgatccctaaaaaaaaaaaaaaaaaaaaaaaaaaaaaaaaaaaactcgaggaggggggccgtgtacc

SEQ ID NO: 17122 - DNA, 6924 bp, Zea mays
  misc_feature (5971)..(5971): n is a, c, g, or t
ggtagtcatgtcaacggctctgatttgctagtgtacaataactggtatggcagacacctatatggctcacaattatttttagctacaaatgtcctatgtaaaggcatgaagttgtatgcggagcttgtacatgtcagtttacagcttaactggcttagtcacagctatattatgccatttggtgaaccactaatatattatgccagaaggttctaatttgctaatcgatatttgaataccttagatactcatcctatcgtctaaagtatttactgttgacctgttgtggagtatgccctggaagtgcactcacatccttctccctgataatgcagcgttagatccctagttgtgttaaatttatacaattatggcagtggaaggcatccatggggtgatctaagacctgagtatctcgaaaaggttggtacttgcattgccatgtggaacacatatgatttcacaattttactttcagttcctaaacatgggcctttgggacctaaaagcaaatatatttgatttcgcaaattggattgaaaaatgggtcagcttggcattagttttctagaactattgctgtttctttcaaggatatggagtacccagaatcagcattaagtagttgggtttggacaagggttttgtttcttttgcgcacaatggaatgtgatgttggcattctctaccgattcgcagaaaggctttgttgaagcccattcagatgatggcttgcttgaaatatttggtctgaaggaaggttggcatgcttcatttgtcatggccgagcttatcaaagcaaagcacattgcccaggtactttatttctgtggccttagtttttgcatcatatgtcaggcaaaacatttgtctgttggaataatcagagtgataagcaactgctttgttgtgttcactattttttatgagacaccttgatattgttttttttggctagtcagtagtcacaacattgtttggtctattaaggttttagaatttgttggggcttagtttagtactttagtcgatgttattgagcagttgagtcaatgtcctggattgttcctaattaactcaggtcttttcctgcggacgtttcttgctaccaggctgcggctatcaagttcgaaatgaggggtggcgagtggaaccgagcatatgttcagatggacggagagccgtggaaacaaccgctgctacaggagcactcaaccatcgtggaaataaacaaagttccgtatcattctctcatgataaacggggagtaatgagatttttactccgtcaaccaggtaaaaattctgaagtccagtgttcctttaggcaccatgtccttgttggcatatcatctcctgatatcacctccggcggccgctcactcgcagattgtacctgcctcgctctcccagatcgttaggatcgtgtacagttcaggagcagcgggcactagatccttagaactgggtcggccggcctgcagcgaggatggcatgcatgttcgttggccttttgtcgtgctatggtcgaagccatggccggagcgtgatgtggcaccatgcattgttgtattcgtaccataatatgtgcgttgttgtatcctaagttctttttgaaggaaacatgatttatttgtttgtattgtaacgttgtgtcattgcaaaagaataacctggtgtaaaactgtaaaatgggacagtctgccgtttgcacagccctgtagcattttttttttgttcttgttaactttttttttgatgaaagtattaactgatttgacttgtcagagttttctattaggaatgccagggagcaatttccctctaccaacttgtacgtagaaactaggaagtactagtgtggtagtaatttatgaggccgttgatcctggcatctccaccgatacagagtgtggcgcctccagtatcccctgcccgaacgaggtgccaagctccgacgccggcgacgaatcagcgttgatcgtctccgacgcagtagaggtgctgaacctgagcggggtcatgccaacggctatggctccctcctcgatcgccgcctgcaccgacccgttcccgccacggccattcctgacggactccacccatctcctatggttcccttccctgacgcagtcgtcgttccccgtcttgaacgtggggcacttgaggtccctctggtcgaagtgccgcatccacgcgagcagccggcgcaccgatgagctccccaaccctccctcctccggctccggccggacctcgccgcgctcgcggtagatgaaggtggcgaggtagacgagaagcatgaggctggacacgacgccggtgatgaggaacagcccgccgaagctccggaagctgaggttggaggcgccgagcgcggcggcggcgccgccgccgctctgtctcggacacgctcccggctcgccgaaccacttcttctcgatctgcgccatctcctccccttccgctagcgtcaggaccgcccgcgacacgtcgggcgtcagcgggctgcccgtcgggaagacgaacccgaagccgtcggccttgtagaccgggccgtacatggtgtagccatcgcagtactgcgacaggaagagcttcaggtacgggatttcgtcgaacacggcggcgactcggccgctggacagcgcgtcggcgtactcctccgccgtgctgtagctcctcatcttggtctcgtcgaagccttgtttctggagtcgttgcttgatgaaggagccctcctggtacccgatgtaggccccggtccgctggagctctgtcacgtcggtcgccgccggctggagcttctggaccgtcagcatcgacgtcaggctcgctgtgtaactcgacgtcaggatcaggacgacgaacacccagatgatcaccacgaacctcgacaggttgctctccagcttctcctctgcacgatgcaggctcagccttttcagccatcggtcgtccaagaaagaaagaaagaaagaatggaactaaactagcagattggcgcgtactgtgcgagaagacgagggtggagaaggcgaagtagaagatgaggccgaactgctgccaccgcgtgcctcggaactcggggttgatccggtgctcgatcgcccacaccacgaagccggtgaagcagaagaaggcgaagctggcgagccacaggctggtggtcagcggccgcaggaagatccacatgctcgtgctcgtctccgtgcgcaccgccaccaccatcgaccaccccgagtccgtgaacggcatgctgaagtccaccttgctcatcctgctcgccgtgattgtcacgtcgccgacgacgatgtccgcgctctgcagtcaccattggtgcgaaaccatgaagcttctcgatcagcgcgcgctcacacacagacacgctaccctacgtgctgctgtcatgcatggtgtgtgtgtgtgtatactgacctgctctggaaccagcgacacgatgttttcgtaggactcggagctgtcggggaacggctcgtactcgtagctcactgggtacggcatcttgctcatgaccgcgtcgaacacctcgatgcagtagcctgtgatgtttggatgctctgctgtcgccgactcaccgccgacgtcgacgaactccttgaacccattcttcaccggcacggcgacgcgaagcttatgtccgttcggcgacacgacccagcctctcggggcggacgtggaatcacctggccaaaagattgtcctcctcatccccttggcgccgtccgcccccagagtctgcgtgatcccatcatccggcgtccagaagcccaccgctctcgagcttttcccgacgacgttgacgaactcgtacgccggcggctgcagctgcccgtcgacaagggtgaagttaccggcgaggccgcggaaggtggtctcgcgcaccgccttgaggagcgtcgctccggttgccgacacgccgagccggtccaggtccgtggccgccgtgctctgctgccgtgtctggaacgccgggctggagacaccggcagcctcggccgccgccgcgatcgcccacgccgtgtcgtatgtccagagcatcaccacagtcgggtcatgcgggtagtagacgtcggcgctcgggtactcccgccggagcctctccctgaaccgcgcggagaagttgccgactcggtccgtcatctgcacgaacgggcggaggctgaggacaccttccatggcgctgatgtcgtcagggctgagcgcgtccacgacgccgcctacgccgtcggtggcgacccacgcgtagtcctccgtcatcatcccggcaagcctcgcccggcggaagaagcgcgcggcgaggcgggcgttcatgtgcacgacgaacacgcgcgtgggcatcgccttgaagcggtagagcagagcgtcgatgcggccgtcgcccggcacggcggcgcggtccatgatcctgacgccgacgccctgcagcgcgccggcgagcgccggaaggatgccggacccgtagggcgagtcctcgtagacgacgaccgccgcgcgccagccgaacgtggcgagggcggcggcgacgggcgcggcctggaacgagtcgttgggcgcggtgcgcacgaagaagggcgtctgcgccggggagagcgccggggaggtggcggaggaggagagcatgggcacgcgggtgcggttgcagaggtaggccacgaagtcggcctccgccgacgtctgcgggccgatgatggcctgcacctgctcgttcttgatcaggtccaccgctgcaaagcaaacgggaaggaaaccatacgctttcaggcttcagctcaggaaacgaataatagtggagctgaagcccacaaacatttcggcccaacggataatttggtctgcaaattaaagcagatagattctacgtgtctctgttgagaatttaccgatggaagcaccagcatgcacgcatctgcaagtgctaccatccacaaaccaccgctgctgacagtgacagtgaccgagagatggagagctacactttgagcagctagctatgagcggaaaaccgtccggctacaattttcccaaggaccgaccaaccaaagcgaggtcgcctgtggcgtccccatcatcgtggaactgtcaacgcgcattcggagcacagattttccacgcggcgggacgggaaccgcagggatggaattttcgcttcagttattgccattgccactggtaggtacgtggctgacaccagtgaatctatcgcaaccatcaggcttattgtattgtatgtaattaccggcggaagtggcggcgacgacgtccccggcggagtcccggaagcgcagcgcgaccctggtccgggatccggggcgcgcggcgtagtagtcctccaccgccatctcaatgccgagcttccgccgctgcccgaccggcgacgacggcgtcaggttgaggatgacgcccacgcgcaccggcaccggcaccggctgctgcgccgtggccacccgctggcaccagaccagcagcgcggccgccagaacgaggccgaggcgtcggagggaggaggaggggacgacggggcgagaggacgacgtgtaggaggagcagtagcccattgtttcagcctgctgctgcatgctggatcgcctcggcagccggccgtttgggaggggagcgcactgtgatgtgatgagtgatgacgctacacctatagctaaccgccgcaaagaggccctattttaaccgcgagaaggatggaagcgaaccggcgtgacgtggactgtcgtgttggaactgcgacgcttcaagaaccagtggtctgaaaattatacggccctgacccacgagtggcgtggggcgcgcacgcaagaagccaaggactcggtcgtgacgcggtggcaacgagcgcgccatgcatgggagaagtccgggggccaatgccatggctgcgtcgtggtcttggtcagccggccgccggtgtacagtagtacataccctacgtgttgccnttggcgggagaaacgttatcggaagagccgtcgttactgtctgcacctgacgcatctaccgacctctcccgtgaggtgaccgtggtgtagctgcatgtaactttatttaaagcagagataaatcttacgtattcaagtatatccggtatccgtaatgatctcaagcaacatggcgctctcgcatggttttattaattgttttctatacgtttctcagccaggggtgcgtggaagcggagctgaaatttcgtggggtttgtcaaacgttaacgcttgaagcaaagaaagtcaagatcttgaaacaaagatatgacgtctctgattagtccagcaattccgtagatttttcttgttgtactactctgtgcctctcacatcaaaattcatctttggaaagtacccttaaacaaaagattatatatattagagatagaatgttatccactgggtaagactagtgaattggactgatcgaattggtaaatggcaatgaaagccctccatcggtttcgcatagttgttcccccctggcgtgattttctactgcatggaaatcattgtcagtttctgacgaggctctaccgctctagctgcaaaaatcaatcaacacatggatgctgcccctcagcttaaatttctacatcagacctaattaacaaaacgccataagtttccagccccacctttgtcactgacgtctagctagatttcctaccggccacttctttcgtcatcctatatcccgaataaggtcggtaaagtgacggccactctcattgaggtttatgatagctcagtacgcattaaataaagttgatatgtaatactccatccgtcccaaaatattagtcgttatagctttcgattttttatgtctatattcaaatggatgatgatgaatttagacacacacatattaagtattgtataaatggatgatgatgaatcccgta

SEQ ID NO: 17123 - DNA, 2121 bp, Zea mays
aataaagtccacaaccatttcatttcttctttccccaattcccgtccatcagctcgcaccagcgaccagagcagcagaccaagcaagcgcgagggagagaagagacgaagaagaaaagaaaagccggagctctgccgagcttagtccgcggaggcggcgaccggcgacgcgtaaccatggagcgggcggaggaggcgcagcccgccgccgagcggagggcgccctcgacggcgccgtcggcgcgggtgtcgatctgggagtcggtacgcgcgtgcggggtgtgggggaaggagctggacaaggccgagctgtggaggcaggtcgtcatgccacgctacctgcgccgggccgtcgcggccgccgtcaaggccaaggacgaggccgccggcgtggcggtggcggcggcggccgcggaggaccgcgcgggggaggacgccgacggcccggcggtggcgcccgtggtggtgttcgtcaactcgcgcagcggcgggcgccacgggcccgagctcaaggtgcggctgcacgagctcatcaccgaggagcaggtctttgatctttcagttgtgaagccttcagattttgttcaccatggtttgagttgtttggagaggttagctgaccaaggcgataaccgtgcgaaggctgttcgtgagaaaatgaggattgtggttgctgggggtgacggtacagttggttgggtgcttggatgtctctcagatctttataagatgaaaagggaaccggttccacctacaggaatcattccacttggtacaggaaatgatcttgctagatcgtttggatggggtggctcttttccctttggttggcgctcagctgtaaagcgttatctcagcaaagcttccagatctcccatttgccgtcttgacagctggcaaactgtaattcagatgccagaaggagaaatagaagagttgccatatgcacttaagaaagtagaacctggagaccggttggaggtcagccaggagaacggtacagagttatccgaaaaggcttctttctataaaggagtattctacaactaccttagcattgggatggatgctcaggttgcatatggcttccatcatcttcgtgatgaaaagccatatcttgcacaaggaccagttgcaaataagttgatttatgctggatatagctgcactcaggggtggttttgtacaccttgcacagcgagtccacagctaagggggcttaagaacattttgcgactttccattaaaaaggccaattgttcagagtgggagcaagtgaaaatgccttcaagcgttagatccctagttgtgttaaatttatacaattatggcagtggaaggcatccatggggtgatctaagacctgagtatctcgaaaagaaaggctttgttgaagcccattcagatgatggcttgcttgaaatatttggtctgaaggaaggttggcatgcttcatttgtcatggccgagcttatcaaagcaaagcacattgcccaggctgcggctatcaagttcgaaatgaggggtggcgagtggaaccgagcatatgttcagatggacggagagccgtggaaacaaccgctcctacaggagcactcaaccatcgtggaaataaacaaagttccgtaccattctctcatgataaacggggagtaatgagatttttcctctgtcaaccagattgtaccagggctgcattcatagatcgttaggatcgtgtacagttcaggagcagcgggcactagatccttagaactgggtcggacggactgcagcgaggatggcatgcatgttcgttttggccttttgtcgtgctatggtcgaagccatggccggagcgtggtgtggcaccatgcattgttgtattcgtaccataatatgtgcgttgttgtatcctaagttctttttgaaggaaacatgatttatttgtttgtattgtaacgttgtgtcattgcaaaagaataacctggtgtaaaactgtaaaatgggacagtctgccgtttgcacagccctgtagcattttttttttgttcttgttaactttttttttatgaaagcattaactgatttgacttgtcaaaaaaaaaaaaaaaagggcggcagctcgcgatctagaactagt

SEQ ID NO: 17124 - DNA, 2186 bp, Zea mays
  misc_feature (2168)..(2168): n is a, c, g, or t
gaagccaggggaccgatggacgtcagtgttccgtcgtggtggcccgctagatccatattcagcaagaaaggtttgtgattcgtttggccttaggatgacaaacagtttttatttttccagaatcccagtgcatggaatcctctcatttatttcgtcagaacactgtggatttatccctttgctacttgcactcggtcttcttcattttcattcttctagagctggcggatgctgtaactctgcagcttcctgactatcacaaagtaatagctaaacctgtagctttcaatctcatgtgtgcttttggtttgttagtgtatacgcatactactctatatgaaactatttgtgggcgtccacatgtgcttcaccgtgacccgccgtagtgcccctgagaccatcgaccgtggcccgtcaccttcctccctccccccacccccccacaccaccaccacacacacacactcgcacccgccgcagatatctcgccatgccggcccagggccgcagcccgtcaccttcctccccccgcacccgccgtgacagccgcctccccacgcccgcttacccgactggccgcacaagatgcccacagtggcccccatcgcgcccacccgctccccccatccaccgcgacctcagccgccacgccgacgccatccccgtcctctagcgcgttgtcgccgtcgtcacaccgccaaaggtgcctgccccctgctaccgaggtcgacgaccagcagcggcaagctgccgagctcgacgacacgcacgccatgcttggccatatggacgagtccatcgcctgctacgagaaggggctccagatccagatgtccgcgctcgatgagcgcaatccctgcctccctgagacctgcaggtaggtgacaatgtcatcaagggcccctccccctttgtcgcttctcgatctagatctcgcctctccctaaagcacgggttgcacctccccccgtcacccactccttccttggcttctcccgggaaacgaccttcagtctttacaggtatgaggtcttattgtgtgccatcattttcttttgctattcattcccgaatccccactgtgccctccagtgatgatggggtatgagctctgaataacaaacaaggtaaatgtttactcttttgagtagctgaattttgctatgatgtagtaaattatactagtaaattatacttgtactgaatatgaatataagaaaaaaatactgcactaattatttttctacgctctatattgtaaaataataggaatataataaaaagctgacataaaagctaatttacaacatccctttattttactatgttttatgataaataccttgattttccttgtaagttgtatcttttagtgattttcaaagaaactcctatttgcttggtgctttttctgtaagcatatgttgattaaatctttgtgtattctttctgtacactaatttaacttatcattattctgtcatccagtatgttgtcttatttgaatggttcatttccttctttaggtgattgacatggtttaggaggaaacttccaaaagccgggcaagtatggagggcttaacatcactttggcaacttaaatttttttacatgtttgctttgtttgttaacaacataatttatgggctgacaatgtgatcatgtattctttctggtagtcttcgtgtcactgcttgcagttgcaggggagggatcatggctttcttttattttccatgtgcaatgtttaatttaggtgatgaactccaaagcttatcccattgttttctagcaagagctaagcaatactggatggagaacatttatctttttacaaaaaaaaaaaaaaaaaaatgcttgtgtttagttctctgtttgttgaccaatcgctatatttaatcttgattttttttatctataacttgaatttcaaagattcaatattttttattcagacattttctcttctctagatattcttttatgcaaataacgcggttacactagatcagccaacattctgggaaataagctatatggtcagagtaagaggttcaagagttgatagttcaacaactttaactgagagcaaatctacaagaaaaaggaaacaagcaacctggaacctacaactgcaggtccttgcttgaaagtgaacaatcaagnttgtgtgtatatattatg

SEQ ID NO: 17125 - DNA, 2682 bp, Zea mays
tccagcgtccggccttgcctcgcgcaccggtctggttcggttgggtgccctcttcgccggtggccggaaggcgagggggaagccggaggacgctgagggcgggcgaggccgccgtccccagatctcacttccgccgcccgcccgccccgcttttggtactactcttcttctgttccagggattgagagaggaaggaaggaaaggaggtgcttcaatatgaaggcgctcattcttgtcgggggtttcggaacccgccttcggcctttgactcttagcttcccgaagccccttgtggattttgcaaacaagcccatgattctgcatcagatcgaagctttgaaagaagttggggtcacagaggtggttttggccatcaactaccgcccagaggtaatgattaatttcttgaaggactttgaggataaacttggcatcacaattacatgctcccaagagactgagcccttaggaactgctggccctcttgctctagcaagggacaagcttgcggatggatctggcgagccattctttgtcctcaacagcgatgtcataagcgaatacccatttgctgaactcatcaaatttcacaagtctcatggtggtgaggcaacaattatggtcactaaggtggatgaaccatctaaatatggtgttgtggttatggaggaggcaactggcagggtggaaaggtttgttgagaagccaaaaatatttgtgggcaacaagatcaatgctgggatttacttgctgaacccatctgtccttgaccgcattgaactgagaccaacatcaattgagaaagaggtcttccctcaaattgcagctgatcaacagctctatgcaatggtccttcctggtttttggatggatgttggtcagccaagagactacattactggattgcgtctttatctagactcgcttaggaagaaatcggctgccaggctagctgctggagcacatgttgttggcaacgtgctggtgcatgagagcgccaagattggagaaggttgcctgatcggtcctgatgtcgcaattggacctggatgtgtcgtggaggatggcgtgaggctttcccgctgcactgtcatgcgtggtgtgcgtatcaagaagcatgcctgcatctcgaacagcattatcgggtggcactcaactgttggacaatgggcacggatagagaatatgaccatcctgggcgaggatgttcatgtgtgtgacgaggtatacagtaatggcggtgttgttctcccacacaaagagatcaagtcaagcattctgaagcctgagatcgtcatgtaagagttctccagttttaactacagtacattcttaagttcttcgagtaagtgaggattgcagatcccctttttataagtgatatctattggtatctttggcctaattcaaacagcttcagacatgttcgcttgctaaactgttgacaatgtatccttgttctttgttgaaaagttttgtacttgtagtgtcaatcatatttcacaaagtggttgtcatataatactgagaggttttggacccttgatctgcagaagttcaataccatagtagcaagaataagtttatttttaaatgttgtccaatgtaactttcagcagtaatgtttgtgtgctaaatgctctcccggagaaatgtacacgctgcccacgtgtgatgtaacttaatatgttcacgtatttaatcttgtaccaatgaatatattgtcggtccctttaaaatcattctaatacagtctgtctggcattacgagtcaataattctgactgacgctgttgctgctgctgttgaacagagaatgaagatatgcgtcgatcatgttcagttacagtgataaaaacgtcgtctaatagttacaatggcggggtaccggtgtacgtactgcgggtttgatttctaagttttttttttaaatggtgatgacaaggagtagatagagatagatttacaatatcacagatctaataaacctaataagataataagtacaagtcgatcaggcacgcactcgcttctcatgacaaggaggcactcgcggctttggaggctagctgagggcttgatctggcagaatcagagtcggcatctatgtacgatgacgatccagtcgaggcttcctcctcatcgctgacgtgaatgtggcgggccatggcgattattagatcctcgagaccaccgtccgtacgatcccaaagcctctgtccggtcgatcccgtctcgcgttccttttggcctcatccatgcgatgcgagcatccggccggaatggatcggagcaagtggcaagtaatcagagatgtgatataagcacgtccgcactacttagtacttactgactagttctccaatgctgaggtctggccatacatcagtcatgtcactctagctagctaacaaaccattaatttagcctcacattccgtcattattcacagctagcacaacacagctagcgcgcgagttattcctggaaatgacagactacgtacgtgagcagtgtggtgtatttagcttttaccggggcggacactacatcatgtactagcattgtagctaaagctaaattttaactgctggcgccgccggccgcacgccatttcagaagacaaattaaacgaggatgtacatacaccagtaataaaacatcaacaactgcaggcatgca

SEQ ID NO: 17126 - DNA, 2542 bp, Zea mays
attcaccgtcaccgacaccgcagcatgtttgagtttgacctccaaagtagccccgagatctgccgcgtttcgcgacgcatcaggtgaggtggtgcgtgcatgtgcatggcgctactgcgagccgcagcccgcagcctgcgtgggatacgtacggtacgataagataatcacagccccaaacgggtggtccatgtccgtggcgtcgtcgaggaatcagctgtcagaatatgccgaaaccatttggtggactcgtagtacttcgttgtcaccactcaccagaagaagaaaaaccggaaaagggccgcgcttgttcgttcagcacttcagctcggctttcactctggctagcttgcacatgtacagtacagacagatgacagacaggcctgaagaagaatagaagaagaagcaagcgcctgcttttccgtcgacgaagaaatgtgctccctttgcttcggcgcaaagccggcgatgtcgcctcgacggcccaggtcagctgcgaatgatagccacggaaggccagcagcagcatgggtgtgagcgacgggagacggggagagacaagaaaaaaaaagtgacagcgctgcaggcggcggtggcatcgatccgacgtgccacgagcggagcgggtaatgccagcgctacaccgcgctgacgtggccgcccggcccccgagagtgaggttgggttgggccctatatgccggcccctctcgctggagctgggcctccgaggccaaccgtttgaggagaagccaatcgccagaagcggcaagccttgcctcgcgcaccggtctggttcggttgggtgccctcttcgccggtggccggaaggcgagggggaagccggaggacgctgagggcgggcgaggccgccgtccccagatctcacttccgccgcccgcccgccccgcttttgggattgagagaggaaggaaggaaaggaggtgcttcaatatgaaggcgctcattcttgtcgggggtttcggaacccgccttcggcctttgactcttagcttcccgaagccccttgtggattttgcaaacaagcccatgattctgcatcagatcgaagctttgaaagaagttggggtcacagaggtggttttggccatcaactaccgcccagaggtaatgattaatttcttgaaggactttgaggataaacttggcatcacaattacatgctcccaagagactgagcccttaggaactgctggccctcttgctctagcaagggacaagcttgcggatggatctggcgagccattctttgtcctcaacagcgatgtcataagcgaatacccatttgctgaactcatcaaatttcacaagtctcatggtggtgaagcaacaattatggtcactaaggtggatgaaccatctaaatatggtgttgtggttatggaggaggcaactggcagggtggaaaggtttgttgagaagccaaaaatatttgtgggcaacaagatcaatgctgggatttacttgctgaacccatctgtccttgaccgcattgaactgaggccaacatcaattgagaaagaggtcttccctcaaattgcagctgatcaacagctctatgcaatggtccttcctggtttttggatggatgttggtcagccaagggactacattactggattgcgtctttatctagactcgcttaggaagaaatcggctgccaggctagctgctggagcgcatgttgttggcaacgtgctggtgcatgagagcgccaagattggagaaggttgcctgatcggtcctgatgtggcaattggacctgggtggggtctggacgatggcgtgaggctttcccgctgcactgtcatgcgtggtgtgcgtatcaagaagcatgcctgcatctcgaacagcattatcgggtggcactcaactgttggacaatgggcacggatagagaatatgaccatcctgggcgaggatgttcatgtgtgtgacgaggtatacagcaatggcggtgttgttctcccacataaagagatcaagtcaagcattttgaagcctgagatcgtcatgtgagagttctccagttttaactacagtacattcttaagttcttcgactaagtgaggattgcagatccccttttataagtgatatctattggtatctttggcctaattcaaacagcttcagacatgttcgcttgctaaactgttgacgatgtatccttgttctttgttgaaaagttttgtacttgtagtgtcaatcatatttcacaagtggttgtcatatatactgagggaggttttggacccttgatctacagaagttcaatacaatagtagcaagaataagttatttttttttaaaaaaaatgttgtccaatgtaactttcagcaataatgtttgtgtgctaaatgctctcccggggaaatgtacacgctgcccacgtgtgatgtaacttactatgttcacgtatttaatcttgtaccaatgaatatattgtcggtgtctttaaaatcattctaatacagtctgtctggcattacgagtaaaaaaaaaaaaaaaaaagcggcc

SEQ ID NO: 17127 - DNA, 6870 bp, Zea mays
  misc_feature (4939)..(4939): n is a, c, g, or t
tcctgctcatttctgtattcgttttactgctgtttacaagtttttgtgtgtgtttgagatccaacgaaaatggtgcttaatctcgggaactagagagatggaatgccttttgtccatgatggaaggaagcgaattacaatatatgtatatgtgtggattgaattgactattgcattatgcttctgcctatatatatctaagcaactgtccgcccacaaaaagttgaatttgaaaagatttcatttcaaatcactttggtacaatagagaatagatgggagaactgacctcttttggtttttttagagataaactgtatacatcctatgccgaacttctaggagcttgatagataaaccattcaaggttttcttattcattccagatttcatctggtcgtactgcttgtcactcaagtgatagacaatttgtctgcggatttgagtgaatcaatgatgaaggtttagtgtttggcattgttacttctactactatttgatgtcctaatctaaggtgaatggtgccggtaatcttgtaattttccttcacgtttatatttctcctatatgctctaggcatattgtgcagttgtaataatgcactgacaactaaggacttgtttggttagagggattaatctttagtcccaagtttttagtctcatttagtccctattttgctatacggaaggactaaaatagggactaattgactttagtctctagtaagggcaaaaattagtccaaatgtccttaccctagaaaactgacgtcatacccctgaaacaagaaaaaaaagatagatattttaatctttatgtgttgcatttaatgtatttagtccctacaaccaaacaacataaaattttgtacaggatctaaactttagttggaacaaaactgggcctaagagattaatactgaaagagagctgtttgtcggtccatgcaacgagaaaaaggtgcagaagccgtgcatcaagacgtgtgaaaagggcccatcgttgctattttttctttcatataagaaggtaaccatacctgtcttccatgtacaacaagacatgccatatattttttttttgcatatcaacaagacatttaggcttcaggttggtctgacagagctcaaagtgaagaaataaaaactgaaattacaggattcagctaaacagtagttcagagttcagggctcgggctacgtcgcaacgcaagtaatatactcatactttagaattcagcagaaacacaggcacgaaatcagtcggtcgcagatccattcattgcccgtcgatgcctcccggccggttccttggattcaccgacactgcagcacggttgacctcaaaaggcccgagatctgccgggtttcgcgacgcatcacaaggtgcgtgcatggcgcaactgcgagcccccaagcacgggaaggtggtccatgcccgcggcgtcgcggtaccacctgttagaatatgctgaaaccattggtgcactcgtagtacttcgtcgcgccgtcgccgttagaaaaatagaaggaaaaaaaaccccggaaaaggcccgcgcttcatcagcacttcagctcggcctcactctagcttttgcacatgcacacagacaggcgactccggtgccttgagctcgggaaagcatagcggccatggcaaactggaccggaagaagcaagcgcctgcttttgcgtcgacgaaggaagaaggaacgtgtgtgatgcggtgacgcctccggtccgagctcgcagaaaacacgctagtactgtactattcccgatggcgcgaagccggcgatgtcgcctcgacggcccaggtctcggtagtaaaccacgcaagagaaaataaaatgacagagagttgtatgttgtagacgggcgagtgcgacgagcggagaacgtaatgccagcgctacaccgctgacgtgtccgccccggctccgggtgaaggtcaaaaggggcaaagggcggggggaaaccgtgggccctatatagcgggccttctcgctggagctaggagaaatcgccaagccaagccaagccagaagcggcagcctcgcgcagcggtctggtctctctggtgggtgcccctcttcgccggtggccggaaagggtagtggagtgggaccgctcaaggagaggccggcgtccccaagtctcacttccgccgtccgcttcccccctggtactttctcttcttctattcgcaagcgcttatagccctggccccttgatcctctccctcctccgtttcagggggccccgcttttgtttagccttcctaggcgcgtgagatcaaaaatccatcggttccggttgccgccatagggttcggcactcggggcgcgcggggggagctttatttgtaccgaactaattcgaagggttcggttaagccccttgcagatcggttttactacccatttttcgattcttttgttgtgttctgatgcgggcttgacggcatcatgttatctggcttgtgatttgcggcaatagggatcgagggaggaaggaaaggaggtgcttcacaatgaaggccctcattcttgtcgggggtttcggaacccgccttcggcctttgactctgagcttcccgaaacccctcgtggattttgcaaacaagcccatgattctgcaccaggtgaagttactcttactcgttattacgctgatacagcatgaacattctagatatggctacatatttatagtcgctttggtgtgttttttaacccaatcccactgctggcgtcatgccagcatccatcatcattagcttttgatgtgccaggagttagcttagaaataatttagccatcccactattacttttatctagaacagtcaaaacgacctataatttaggatagagggactaggaattttgctttgtgtccaagtacatatttaaacatcaatcaagtgtttttatttttttttgcatgtgtggtggtcgctggaaagattcaaacttattcattctgtgcagatcgaagctttgaaagaagttggggtcacagaggtggttttggctatcaactaccgcccagaggtagaaataacagagcagttattgtcgcaattgggtctggcttctatgatctaattggtgtgttatatgtcttccaggtaatgattaatttcttgaaggactttgaggataagcttggcatcacaattacatgctcccaagagactgagcccttaggaaccgctggccctcttgctctagcaagggacaagcttgcggatggatctggccagccattctttgtcctcaacagtgatgtcataagcgaatacccatttgctgaactcatcaaatttcacaagtgtcatggtggtgaggcaacaattatggtcactaaggtaaatcctttttgacattttcttgtggaatcagcccgcatatgtgatctgaattttcttttcatataggtggatgaaccatcaaaatacggtgttgtggttatggaggaggcaactggcagggtggaaaggtttgttgagaagccaaaaatatttgtgggtaacaagatcaatgctgggatttacttactgaacccatctgtccttgaccgcattgagctgaggccaacatcaattgagaaagaggtcttccctcaaattgcagctgatcaacagctctatgcaatggtccttccaggtttttggatggatgttggtcagcctagggactacattactggcttgcgtctttatctagactcgattaggaagaaatcagctgccaagctagctactggagcacatgttgttggcaatgtgctggtgcatgagagcgccaagattggagaaggttgtctgattggtcctgatgtcgccattggacctgggtgtgttgtggaggacggcgtgaggctttcccgctgcactgtcatgcgcggcgtgcgtatcaagaagcatgcttgcatctcaaacagcattatcggttggcactcaactgttggtcaatgggcacggatagagaatatgactatcctgggggaggatgttcatgtgtgtgatgaggtgtacagcaatggcggtgttgttctcccacataaagagatcaagtcaagcattctgaagcctgagatcgtcatgtgagctctccagttttagctacagtacattcttaacttctttgacgaagggaggattgcagatccccttttataaacgatattgcttggtatcttcgacccactcctccccgcttcatacttggtctcttgttaaactattgacaatgtatcttgttttttgttgaaaagtttagtacttgagtgtcaatcatacgtattcgcttgctaaaaactattgacaatgtatcttgttctttgttgaaaagtttagtacttgagtgtcaatcatatttcagagtcattgtgatatactgagcttggaggttttggaccattgatctgcagaagttcaatacaattggaagaataagttaaaaaaaacgtggtccaaagtaaccttcagcagtaatgtttgtgtggctaaatgctcttccggagaattgtggtgatgcaaaccttgtaccactgaatatactgtcaatctgctatcttttccgtggcctctaactcttagagtgtgtttggtttgagttgaggaattacttcatccagcataaggtggtgtatcgtgaatctatttcttaaatttgatgggttgatcttattccttgtgttttgagaagatagactagcttatttcttaaaccaaacaccctattagttactagtactttctttaattttaaaaataattttggcaggagcaggctagtggtgagcaactgagtatagagctaggtgctccggcacttgagtcccgactcctacctgtagaattgtgttttcagtttgaataaaacgttggaatcattttaaaaaaaatttgctggaacatggcatttatgcatgngatgctgtacgatgtcgactgtttctatcatcgtcgtcgtcttctctttaaatcattctaatatagtctagaaagagtgatggatttattggttctgagccagtgaaatagtcagtcatgcaattgtagccaacaaaacgaggacccagatttaggggtttcatattgtgctacttgtccttccacgagcctcagaaattatgtggattgaaattagaccgctccaattattttcccccataggttcgtatataatatggcctggagacacgcgtgcaaaggactgactacgaaaaccaacagtataaatttgtatccctttcccctatttctttttgggataattgcctaccctgaggcgatcgtacagttttttttttttttttttttttttggcaatccctgtctttgtgccctttagaagaccagccagctagatctcaatgtccctatcgtattaaatcatccacggacttctgcaacgctttctagaaaaaaatgggtaatatacgttcgatgtgtcattctcatggcaacgagttcgaaactgtaatggggaatctgtggttcaagaagagcagcaatcgccaagtctatgcagatgtgtaacgtacaggtatcacaagcagatgattccgtgaccaggtatattcccccagcaacaaagctgtcgaaagcattagaaacaaatgcttgtggatgggcaaaatggcaaaaccaaacatatattcgtgtaagaagagctcacgtaactcaagtccaagaaattttaggatgtgtttggtttgacgtcaaagtaagatgagttggaaacgacaccatccccttaattttttaggatcacgctgcaacaaaaaaattactccgatttacctcgtcctcacttgactctcatccaaacactatagaaattatagccgcccatttccatccctccttatacatccaaccaaacacaatttctagcgtgtggtctgcccacacacaaaatgagcatgtgtacaatgagagagcatgctcgagatatacaaagagagcattacagacaccttacacaagatcactattcacaaggaggcaagcagccaagacattaccagagcggatgcagcactaaacgtccagcaaagaaatgcaaatgcagcagcaacctcgaatcttccacaagggagttggggatcccttctgcacaagtacgcatccctttcgaaaagcacaactacgcctgcagctgagcatgcagcagcaaacgaaagaattgctgtcacctgcatcgtatatagtgcagtcagtcagaacttcacgaagccacatttcaaaagttcaatatcagagatgtaatgtgctccataaaacaatgccaatatgattatgtatttgatgctaccattcaaaaaaaatccatgtaaaaagtgatagaaattacttggagttcacaacttcacatatgtttcaggcaggcaggctcaaattggtactgatcaaggtgacagaaaaaaaaatactaacaaaactaggaaaagatgcttcaacttcatggccatgtaaagctaggtagtgctaggtataacagtgtgcctgatattttacatgtctgcaacaatcgaacagaaatgggataattttacagtcacttatgtaatatataatgtgaatcatgaacagaaacgaaataaagcatgaatgcgtggaatgctcaacatgtttccaagtactgcaggaatattatacatacaggtgataaggtttatagattgaaaattctacaaaaaaagaggcaatttagttgtaggatgcagtaattgataacttcggatggtagcagaaacaaacgaggttcagtgatgaacaacatggataaaaggtggcccttaaataatttacaccaattcgccaaaaacaaataagctcatgagaaagagccttgctga

SEQ ID NO: 17128 - DNA, 2342 bp, Zea mays
atagcgggccttcgcgctcgacctgggcgccggcgaagccaatcgccaagccaagccaagccagaagcggcagcctcgcgcagcggtctggtctctctggtgggtggtgcccctcttcgccggtggccggaaaggggagtggagtgggaccgctcaaggagaggccggcgtccccaagtctcacttccgccgtccgctttccccctgtagggatcgagggaggaaggaaaggaggtgcttcacaatgaaggccctcattcttgtcgggggtttcggaacccgccttcggcctttgactctgagcttcccgaaacccctcgtggattttgcaaacaagcccatgattctgcaccagatcgaagctttgaaagaagttggggtcacagaggtggttttggctatcaactaccgcccagaggtaatgattaatttcttgaaggactttgaggataagcttggcatcacaattacatgctcccaagagactgagcccttaggaaccgctggccctcttgctctagcaagggacaagcttgcggatggatctggccagccattctttgtcctcaacagtgatgtcataagcgaatacccatttgctgaactcatcaaatttcacaagtgtcatggtggtgaggcaacaattatggtcactaaggtggatgaaccatcaaaatacggtgttgtggttatggaggaggcaactggcagggtggaaaggtttgttgagaagccaaaaatatttgtgggtaacaagatcaatgctgggatttacttactgaacccatctgtccttgaccgcattgagctgaggccaacatcaattgagaaagaggtcttccctcaaattgcagctgatcaacagctctatgcaatggtccttccaggtttttggatggatgttggtcagcctagggactacattactggcttgcgtctttatctagactcgattaggaagaaatcagctgccaagctagctactggagcacatgttgttggcaatgtgctggtgcatgagagcgccaagattggagaaggttgtctgattggtcctgatgtcgccattggacctgggtgtgttgtggaggacggcgtgaggctttcccgctgcactgtcatgcgcggcgtgcgtatcaagaagcatgcttgcatctcaaacagcattatcggctggcactcaactgttggtcaatgggcacggatagagaatatgactatcctgggggaggatgttcatgtgtgtgatgaggtgtacagcaatggcggtgttgttctcccacataaagagatcaagtcaagcattctgaagcctgagatcgtcatgtgagctctccagttttagctacagtacattcttaacttctttgacgaagggaggattgcagatccccttttataaacgatattgcttggtatcttcgatctaatgcaaacagcttcatacttggtctcttgttaaactattgacaatgtatcttgttttttgttgaaaagtttagtacttgagtgtcaatcatacgtattcgcttgctaaactattgacaatgtatcttgttctttgttgaaaagtttagtacttgagtgtcaatcatatttcagagtcattgtgatatactgagctcgctgcgttgggccctcgacctgcagaagttcaatacaattggaagaataagttaaaaaaaacgtggtccaaagtaaccttcagcagtaatgtttgtgtgctaaatgctcttccggagaattgtggtgatgcaaaccttgtaccaatgaatatacactgtcaatctgctatcttttccgtggcccctaactcttagagtgtgtttggtttgagttgaggaatcacttcatccaatataaggtggtgtattgtgaatctatttctcaaatttgatgggttgatcttattcttatgttagtactaactaactaggaataagacgtagatcaactcattccattctataaactaaacaaaaaaattaaaattgagaagatagagtagcttatttcttaaaccaaacaccctattagttactagtactttctttaattttaaaaataattttggcaggagcaggctagtggtgagcaactgactaactgagtatagagctaggtgctccggcacttgagtcccgactcctacctgtagaattgtgttttcagtttgaataaaacgttggaatcatttttttaaataaatgctggaaccatggcatttatgcaagggatgctgtacgatgtcgactgtttctatcatcagagaagacttgtctttaaatcattctaatataggctagaaagagtgatggatgtattgggtatgagccagtgaa

SEQ ID NO: 17129 - DNA, 1825 bp, Zea mays
ccgggaccgcgccgccatcaccatcacccaccatcagccgccaaagatcacgaaagcgacgcgcacaccccaagaaagggcggctccccactccgccgccccgcacccctttcggcctttcttcctcccccacctcttgctcgcgtcccagctcccaacaccagtacaccacgcgccggctgcgagcgatgcccgcgatcccaacggcccccgccccctgccccgtgcgcttcctcctcgcccgccgccacagcctccacatctcctacccgtcgccttgctctaaccaccagcggctcccgccccgcctcctgcgcctgcccgctcgcccccgggccgctcccatgtcggccgaggcgcgggcacccgcgtctccggtggcgccgccggcgcaccccacttacgacctcagggccgtcatcgcgctcgccctcgcagaggacgccggcgaccgaggggatgtatcctgtttagccaccataccttctgatgtcgaagccgaagccacatttattgctaaagcagatggtgtcattgctggaataagcctagcagatatgatatttaaccaggttgatccatctttgaaggtcgaatggtttgaaagtgatggcaattttgtccacaaaggactgcagtttggaagagtatatgggtgtgcccgcagcatcatcgttgctgaaagggttgtgctaaatttcatgcagcggatgagtggcattgcgaccctaacaaaggctatgtctgatgctgcccgtccagcatgcatattggaaacaaggaaaactgctccaggtttacgtctgattgacaagtgggcagtactgattggtggcggaaagaaccacaggcttggtttatttgatatggttatgataaaagataatcatatttctgttgccggtgggattgcaaatgcaatgagatctgttgatcaattcctgcagaaggaaaaactcacaattcctgtcgaggtcgagacaaggacaatcgaagaagtgaaagatttgttgaagtacgctgctgagaacaaaacttcattgacccgtataatgttggacaatatggttgttcctcttgggaatggggatttagacgtttcaatgcttaaagatgcagttcggttgataaacggtagatttgagactgaggcgtctggaaatgtgacagttgatacagtgaagaaaatcggagaaacgggggtcacctatatttcaagtggagcattaacgcactctgtgacggcgcttgacatctctctcaagatagacaccgagctggctcttcaggttggaagacgcacaaatcgtgcttgactcccacagcattacgttgtggacgcaacgcacgcaagtaaggcaggatgacagagggaccagcgtggcaaaccagcttaaatagcttaataataacttggcgctgaggcctctgactgcaactacgtgggattcattcttcagtttcatgcacaaacgaccgcaatattgatcggatcagaataattggcaggacatacaggttttgttctagcaccaagtttgggagcttgcgttctgcggcagataggcaggccaggtaggtgtacctcctcctgggcccagccacagctcgacagcaggtaccaggtaggtctactgtaaacgggggatgtcgcactgaactcgcaataccaaagacaaaataacaaaaggtggagataagatgcttatcttactgccattggtgataaaagcaacgtcaactcacatctattatttattgtatcgttccatcatcacttccagaatccatttgtatacagtgtatacgaccggtttgctcgccg

SEQ ID NO: 17130 - DNA, 1876 bp, Zea mays
ccacgcgtccgcgaacaaaaagaaaaaaagaaagaaaaacggtccaccacaccttgtatgtgccctccggcgggcgggtcagagctcgcaactcgcaccagcacagcagcaccggcagcaccaccaaccccagggcagccgcgccgccagccacgacaagcttagcagcccctcgcactcgctagggtatttattggtacaatcgggtgatctgcgtgccgcatcgcgccgggacacgggagacaatggcgttcacgacgctcggcggctgtggggcgcaggcttcagtgcggttggctccccagaatggaatccttggatctaattcgaagccattcgcgggcatcatactcaagaaacctcagcaggttggatccctgcccctccgtgcaaggggatccattttttcttcaccacgcaggcttttctcccctaaggcagcagcccctaaatcaggggattccatacgcattgcagtgctaggggccagcggttatactggagctgagattgttcggattctagcgaaccaccctcagtttcatataaaagtgatgactgcagatagaaaagctggcgagcaatttggatcagtatttcctcacttgataacacaggacctgccgagactggtcgcaataaaagacgctgacttttcagatgttgatgctgttttttgctgcttgccacatggtacaacccaggaaattatcaaaagcttaccccgacacttaaagattgttgatctctcagcggacttccgactacgcgacatcaatgagtatgctgagtggtatggacattcccacagggcaccggaacttcagggggaagctgtgtatggtttgaccgaacttaaacgagatgacataagaaatgcacgcctggtagcaaatccagggtgttatcccacatctattcaacttccgctcgttcctttggtaaaggcaaaactgatcaagctaaccaacattattattgatgcaaaatctggagtcagtggtgcaggacgtggggctaaggaagcaaatctttacactgaaatcgctgagggtatccatgcttatgggataacaagccatcggcatgtgcctgagattgagcaaggacttacagatgctgctgaatcaaaagttactatcagctttactccacatttgatgtgtatgaaacgtgggatgcaatctactgtgtatgttgaattggcatctggagtgactcccagggatttgtatgaacacctaaagtctacttacgagaatgaagaatttgtcaagctgttacatggtagcaatgttccttgcacaagccatgttgtgggatcaaattactgcttcatgaatgtctatgaggatagaatacctggaagggccatcatcatctctgtcatagataatcttgtgaagggagcatctggtcaggctttgcaaaatcttaatctgatgatgggactgcctgagaatatggggctgcaataccagcccctgttcccttgatcttttgtgtcattatctattattacattatttaggagtccagaaaccaaattatcattactgtcaagaggtggcaaggagcctgacatcagaattcagtcaagtcgaagttagacagttagtgtagcttggtctgtgttgttttagctttattaaaccattaagagaataatgatgatggcaatttagcagtacaatggtagtattatgtgggcagcttggttccaataaaatcataagcctatacacatcttgtgcccgcaatgttgtttgctattttgatcacgaaatcaatattgagcttgaattcagttatgaggcaaaaaaaaaaaaaaaaaaattaaaaaaaaaaaaaaaactcgagggggggcccggtaccc

SEQ ID NO: 17131 - DNA, 2454 bp, Zea mays
  misc_feature (1118)..(1118): n is a, c, g, or t
tgcatgcctgcagtgtgtcatcccttgcatggttcatgtcaaatcaggaaactagtttcgtaacaattggacaacgagtgcttgccaatccgttgaggtatccatcttggttcatatttgattttacattcatggtgtggcgatgcattgttggttctacttttgtcaatttttggattgtttgaatcgtcctctaatttattttgttctttggaattttactattctaaattgttgcctttgccatttttgttcctgaaccttctttattcagggttcgttttcattatggtcatcctgatatcttcgatcgccttttccacattacgaggggtggtgtgagtaaagcatccaaaattatcaatctcagtgaggacatatttgcaggtacttctcctttgctgttgccgcttaataatgtggaactgttatggtaacattgtggcttcttgtggtgcaggattcaattccacattgcgtgaaggcaatgttactcaccacgagtacatgcaagttggcaagggaagggatgtgggtctcaatcaaatatctctgtttgaggcaaagatagcaaatggcaatggcgaacagacgctgagccgtgacatctaccggctgggtcatcgctttgatttcttcagaatgctatcttgctactatacaacaattggtttctacttcagtacaatggtattttggtgacctgagtttttgaactgttcttgtccgttcattggttaacctttcttgcattttctgacttgttcgttgtttcaccttaacacctctgttatttctgcatgcacttagattacagtgtggactgtatatgttttcctctatgggcggttatatcttgtacttagcggacttgatgaagcgctggctactggaaggaggtttgtgcacaatgcacctctccaggttgcgcttgcatcggaagtcttttgtgcagcttgggctcttcgtggcgcgacccatgatgatggaaatcggtttggagagaggattcagaacagcattgagtgacttcatactgatgcagcttcagttggcctcagttttcttcacgttctcattgggaacaaaaactcattactacggaaggacattactcnatggaggagctgaatacagagccactggacgtgggtttgtggtgttccatgcgaaatttgctgacaactatcgactctattcccgtagccattttgtcaagggcattgagctgatgattctactagttgtgtatgaaatatttggtcagtcatatagaggggctataacttacatcttcatcaccgtatccatgtggttcatggtgggcacttggctctttgcaccattcctgttcaatccttctggatttgagtggcagaagattgtggatgactggactgattggcacaagtggatcagcaatcgtggaggtattggtgtggcaccagagaaaagctgggagtcatggtgggaaaaagagcaggagccccttcgttactctgggaagcgtggtactattgttgaaatactgcttgcattgcgtttctttatctatcaatatggactcgtgtatcatctgaatataacgaagaagataaccaaggataaccagagtgtgctggtttattgcttctcatgggttgtaattttcgttgttttactcgttatgaagaccgtatcagtggggaggaggaggttcagtgcagagttccagctagtgttccggctgatcaagggtctcatatttataacttttacagccatcgtggtaatcctaatagcaatccctggcatgacggttctggacatctttgtttgcatccttgccttcatgcccactggatggggtttgctcctgattgcccaagctatcaggcctgtgattcaaaagatcgggctgtgggggtcgatcaaggctcttgcccggggctacgagatcctaatggggcttctcctgttcacgcccattgctttccttgcctggttcccgttcgtgtccgagttccagaccaggatgctgttcaaccaggccttcagcagaggtctgcagatctcccgtatcctgggaggacacaagaaagaccgagggacgcggagcaaggagtagtagggctgctgattgaaggtccgtctatcgggagttatgtcgtcctggagcggtctatcaggttcagagaatattagggtccgtatgtatgtatgtgtgtgtcgcacctagcaccagtagtatgtatgtatgtatgcgtatgtaggttcagagaatattagggtccctatgtatatgtatgtatcaggattgctatggtcttttggattggaagatctgagatttgctggtgcaatggccagtatctgacatccaaatgttgaaactataattaggctctgcttatagttagctaacttacagccaataaaaaaaaaaaaaaaaaaaaaaaaaaaaaaaaaaaaaaa

SEQ ID NO: 17132 - DNA, 2723 bp, Zea mays
gttgagctgtattggcaggagcactatatggaggaggctttgaaaatgagaaatctgctgcaagagtttgagaagaaacatggagtgagacatccatcaatacttggagtcagagaacacatatttacgggcaggtaatatgccatgtttcatatatttaaggttaaaattaaactaagaccatctgatctctgatttttctgtagtgtccatgttttcatatcatgattaaatgttgtaaatttctgcagtgtgtcatcccttgcttggttcatgtcaaatcaggaaactagttttgtgacaattggacaacgagtgcttgccaatccactgaggtaaccatcttggttcatatttcattttacattcatgttgtggttatgcattatctattggttctagtatttcaatctttaggttgtgtgaatcgtcctcttatttgttttgttcttcggggtgttactatcctaagatgtttgcttcgtaatttttttcctgaaccttctttattcagggttcggtttcattatggccatcctgatgtcttcgatcgtcttttccacgttacgaggggcggtgtcagtaaagcatccaaaattatcaatcttagtgaggacatctttgcaggtacttttcttttgctgttactgctcaacatttgtaaatgtggaaccactaagataatattttggcttcttatggttcaggattcaattccacattgcgcgaaggcaatgttactcaccatgaatacatgcaagttggcaaaggaagggatgtaggtctcaatcaaatatctctgtttgaggcaaagatagcaaatggcaatggcgaacaaacgctgagccgtgacatctaccggctaggtcatcgctttgatttcttcaggatgctgtcttgttactacacaacaattggtttctacttcagtacaatggtatttttctgacctgaattgtaaaccgctcttgtttattcattggttaacacttaaccttgcatttttgtttggacttgtttgttatttaacccttaacatttctgttatttctgtatggacttagattacagtatggactgtatatgttttcctctacgggcggttatatcttgtacttagtggacttgatgaagcgctggctactggaaggaggtttgtgcacaatgcacctctccaggttgcgcttgcatcggagtcttttgtgcagcttgggtttttgatggcgctacccatgatgatggaaatcggtttggagagaggattcagaacagcattgagtgacttcatactgatgcagcttcagttggcctcagttttcttcacgttctcattgggaacaaaaactcattactacggaaggacattactccatggaggagctgaatacagagccactggacgtgggtttgtggtgttccatgcgaaatttgctgacaactatcgactctattcccgtagccattttgtcaagggcattgagctgatgattctactagttgtgtatgaaatatttagccagccatatagaggggctgtaacttacatcttcatcaccgtgtccatgtggttcatggtgggcacttggctctttgcaccattcctgttcaatccttctggatttgagtggcagaagattgtggacgactggaccgattggcacaagtggatcagcaatcgtggaggtatcggtgtagcaccagagaaaagctgggagtcatggtgggaaaaggagcaagagccccttcgatactccgggaagcgcggtactgttgttgaaatactgcttgcgctgcgtttctttatctaccagtacggacttgtgtatcatctgaatataacgaagaagataactaaggacaaccagagtgtgctggtttattgcttctcatgggttgtaatttttgtgattttgctcgttatgaagaccgtatcagtgggcaggagaaggttcagtgcagagttccagctagtgttccggttgatcaagggtctgatatttataacatttacagccatcgtggtaatcctaatagcgatccctggcatgacggtgctggacatatttgtttgcatccttgctttcatgcccactggatggggtttgctgctgattgcccaagcgatccggcctgtgatccacaagactgggctctggggctcgatcaaggctcttgcccggggctacgagatcctgatgggacttctcctgttcacgcccatcgccttcctcgcctggttcccgttcgtgtcggaattccagaccaggatgctgttcaaccaggcgttcagcagaggtctgcagatctcccgtatcctgggaggacacaagaaagaccgagggacccggaacaaagaatagggctgggctgctgctgattcaaggtttgtgtgcgccactagtatttatgtgtgaatgggtgggtagcatatggctcgagagtatctcctgaatggagattgattgatcctgaagagtagaagagactcgagtgatgtaagatgctgcaggcttgttgctttgttacctaggcgttaggcagaacagatgttttcaggatctctggcctgttaaccacatcttcccctgttcagagtgaattaattcctaatggaaactgatttgtgaattacttcctaatagaggagtgcttccaaactgatttcatgtgtgtgctgtgatattgtttagcatatagtattttaaatgtagctttgaattttc

SEQ ID NO: 17133 - DNA, 694 bp, Zea mays
aactcctttcccccctccagttccaactttattgtgtttaacaacgccatcgataagcttttttttttttttttttgttaaaagctcaaaagcccaaatgagattaaactctaaattaaaacctatgaaactaggcgtcatttcaggtaccaaatgtacttattccaaaaagaaataaataaaaataagctaaaattgaagaatgtacattctaagagaaatctcaaaaagcgaaggaaaaaagctcaagcagagtcatcagaatcatgtgattattatatctcaagtcgtgaaatttcttgacagaccaagtcgttgctatcgtaaggacccacaatcttatacaattcaagaactgattttccttccttgtatttttggttaatatcatgggcagtcacgtatttccagccaacgtttgatccacaaccaacacagaagatgtcagttaccgtatgaagtcccgtcatcaacattctgtcttcttcatttccagttgaaatgtttacaacttcattgaagagataagcttgtccatacctgcattgaaatgacttggacatgatgtcttgttcttttgtaagatgggtgttacagtgtttgcaactatagatttgcccttccagatccacgataaaaacccttcccatcttggttgaaacgacaagaagtgtctctcgactgtgaattgaat

SEQ ID NO: 17134 - DNA, 1687 bp, Zea mays
cgccacagatgcctggttcggcgccgccgtcgcggggatcttcacggccctggtcgaccgcgcagcgggcgagcaacgcgacgaggaagtacttcgccacggcggagatggatttcgaccctaagctctacggcctcgcgcagtgcgcgccggatctgacgccggcgcagtgccagggctgccttggagacctccagtcgagggtgacggcgcagttcctgagcggacggcccctcggcaacaacgctttcatggtgtggtgctccctgaggtatagtgtgtcgccgttctacgctggccgggcgatgctacagcttccggcgccgccggcacctccaccaacgtccacgcccacgcgcttcattcttcagggaggaaagtgaatgcagcaggaatctctgcaggcatagccagtgttgttgtgttgatgttgattctttcggtctttttctttattcgcttcaggctaaggattaaagtgaagaaaaatgatcactcactaaagaagattgggagagctcaatgcacgatctttgatttgttgacactggaagaggcgactgaacatttcgcagagaaaaataagcttggagaaggtggtttcggtattgtgtacaaggggatactgtccgacgggcaagagatagcagtcaagaaacttttaggaagagccgggagtgggttggatcagctacaaaatgaggtgcaggtactggcagagcttcagcacaagaatcttgttgggttacagggtttttgctcgcatcataatgatacactgctagtttatgaatacatcaagaacgggagccttgacactattctatttgatgatagggaaggaaatgcacttaactgggagcaacagtacaacatcatctttggaattgccaaggggattttgtatctccatgaggactcaagcatgaggatcatccatcgggacctgaaggcaaataacattcttcttgacgacaacatggaaccgaaaattgcagatttcgggttggcaaggcttctaggagaaggccacacacatactcagacaggcagagttgttgggacattcggttatatggcgccagagtatgcatcacatggtagtgtgtcgcctaagattgacatctttagcttcggcgtcttgatccttgagatcgtgaccaggagaagcaactgcagctctgatgaccacagcactgtgaatctcctaagtgatgtctgggatcactggaagaaagggacgatgccacaaatgcttcaccggtcactggatgagtttgctcgaagccaagcgctgcgatgcatccacattggtctgctgtgcgtccagccggaacctgacgataggcctgacatatcagccgtagtgttcatgttaaccagggatagcatagagctccagccgccggggcagcctgcgttcttcttcggtagagaatcaccttcagctttacgattagatggtcaaagcagctatgtatatcaccgtgatggtttcaaattgggacagggcgtctcggtgaatggggttacactcagtgaactgtatcctagataggatcaaagtctggatactgagcacatggaatacagttaacatgttgaactcgataggtttctttgatgtaaaacaaaaaaacaccaaagggcggccgccgactagtatgacgtcgacccaggaataaaa

SEQ ID NO: 17135 - DNA, 2522 bp, Zea mays
  misc_feature (583)..(583): n is a, c, g, or t
ccggccggatcgtattcgcacgccatcggcaccctagggccgccgggaaggaaacgccaccgctccagtcatatccccgccgcccgcgccgccgaaggccgaaccctcgtcgcctcccctgcccacgcccgccgcctccagcaggaccacaccgccggattcgacttttttgtcctcgccctctccccctcctctcgtctcctttgatggcgtcgaggggaggctcctccggctttatcgagtattttcataacagcacaaagcgtcatggcagcaatagagagaacacaagtcagcaaggcatgaatgctatcagggtgcaaaaagaaatgaaaaaagaatgggcaagacctggaagagttttcaatagaaatattactagaggaggctactctcgaagttcattgcctggactcaaccaaaaagcttgctgcccaacaccacttggttacttgcaatgttaatgggcatggagcggcccatgctgacaatggtatcaaaattgcggctcaagcccatgacaaggaagtcaagccttctattgtccgaaaaatggaacaatatgaagggacacaagcatcanttggttggatctcatgcagttcttggaaagggcaaccagaacacggtggacactgcagcatcagggaaaaataattttggtggcgaactttgctgttcttcatcagatccaatccatgtgccctctcctcgcgcctcttcagcgggtccttttggagccataaagcgtgaagttggagtagttggtgctaggcaaaggccagctgatagtgcagcaatatacacatctacttctaatggcttagtcaaagtggtatcagcaccaaaggttagcccacatttggaatggaagcccaaatcagtaagccccagcactgctgcacctcctggtgctccatcacctgttgatgatggaagtaaaacagaagtgtctgctttgtctaagaagctttcacatgctaatgtatcacatgaacatgtcattataccggagcacatcaggataccagattctgaaagaactcatttcatcttcggttcttttgaatctgaaatttatccaaaggcttctttagcagcctattatgatgctgtggctaaagaagacttgaatgatcactctccatcaaggatggataatgttggttcctgcagtccacttccacagtcagagcctgctgtttcagtttctgaacatgagcagtcattgacggagtgtgtggatgttcggagccctggtgttgtcggtggaacaaatgagacgatttcaagcaaggtaacacattctcaacctcgactccagcatcaggaagctgcacagaattttaaggcatatgagccagattctggttatgggatgtcatttattactaaagttgatggtgaagcagcccaaggtatagcttattcatctgaggctatggttttacattctgtaaatggctatcagttacctgcatctacagcaactcaacaaccagtgccccagatgttttctcaacaattccaagcacctcagtatccaaactttttgccatatcggcatgttttctcaccacagtttgggtctctaatggttgttccaaactattcaagcaaccatgcatttcctcagttgccacatgccagcagctatctggtaatgccaaatggagcctcacaactagctgccaatggcatgaaatatggatcaaaccatcagtataagcaagtatttcaaggagcccctgctggatatggctacggaaatcataatggttaccctaacggtgttattggcggcacaggtgctattgaggatatgaatatgagtaaatataaggacaactgcctctatgcacccaatccacaggtggaaacagcagatgtatggattcaaagtcagaaagagagtcccaatatgccatctgcaccgttctacaatatggtgggacaaccagtgtctccacatgcagcatacttaccaccacaaagtggccacactgccttcagtcccgccccttcccatcctggtcacttgcagtacccgggctttgtgcatgcactgcagccaacatccatgaccatggtgcagaacccgcagaccatgatacatcagccggctgcaccgccattggcaggaaatctaggcctggacatgtcggccatggttcctggaaatcaagtaggagcgtttcaacataaccagcttgcccatcttggctggaccacacaatccttttgagattttggtgtgcttctatggctggataagtgaaatttcggttccgtgtggatagaacctaattgaagtgatatgctgtaatatgcaggataggcctgatgaataccaggtttttctttgttttaattataaaaggggaaccgttttttcgtgccgttgtgatttgcaagaacgtgtttaatgttcacttccagtttttgttccaaaattttgttgtaagtgctagtttggaaactcaaattctctttcgggattagaatgaaaaaaaaaaaaaaaa

SEQ ID NO: 17136 - DNA, 1077 bp, Zea mays
cccatcatttaaaagtaaaaccaggggccctctaccctcccagctcactgccagtgccactgtgcgcccgtcgctccactcccccacacacacacacacacctcgcagcagcctcataaaaactcccgcagatcgcctcgtcgccgccacccacggccacgccccaccctcactccccttctgcccttcgcccgcatacacattgccccgcaagctaccggcgaccgcctagcatctgtggcgccgcgccgcctccgctgatggggatgaacaagtcacggtggtgtcgcgccaccctgctgctgctcctgtcccttgctctccgcggcgcggcgttcctgcaggagaggaagaactacatcgtgcacctccggccccgggaagccaccgacggctccgtcgacgggtggcaccgctcgttcctgcagcaggcggcggcagggctggactccacggccgacgaaggcccgcagatcatatactcctatagcgacgtcttcaccggcttcgccgcgcggctcacggacgaggaggcagaggcgctgagggccacggacgggtgcgtgcggctgtacccggaggtgttcctgccgctcgccaccacccgctctccgggcttcctcggcctccacctggggaacgagggcttctggagccgctccggattcgggcgcggggtggtgattgggatcctggacacggggatcctgcccagccacccgtccttcggcgacgacgggctccagccgccgcccaaggggtggaaggggacctgcgagttcaagagcatcgccgggggcggatgcaacaacaagatcatcggggcgcgcgcgttcgggagcgcggcggtgaactcgacggcgccgcccgtcgacgacgcgggccacggcacgcacacggccagcacggccgccggcaacttcgtggagaacgccaacatcaggggcaacgcggacggcacggcgtccgggatggcgccgcacgcgcacctctccatctacaaggtgtgcacgcgcagccgctgctccatcatggacatcatcgccggcctggacgccgccgtcaaggacggcgtcg

SEQ ID NO: 17137 - DNA, 1136 bp, Zea mays
  misc_feature (1083)..(1083): n is a, c, g, or t
  misc_feature (1100)..(1100): n is a, c, g, or t
gaaaaaacgggaaaaaaaaaaaaaaaaaaacgccacttccctcccgcaccctgctccctcgcttcaaatcgattcggcgctaccgactaccgagcaccaaacgccaaggcggctgcttaccagagtcatgcggacccaaagaagcctccttcccctgctcctgctttccgccgccgcgctactcgccgacgcgcaggaccgcaagaactacgtggttcatctcgagccgagggacggcggcagcaccgcttccttggaggagtggcaccggtccttcttgccggaggcgacgctggactcggcggcggacgacgggccgaggatcatccactcgtacagccacgtgctgacgggcttcgctgcccgcctcaccgacgcggaggcggagacgctgcggcgcaaggaggggtgtctgcggctgtacccagaggagttcctgccgctggcgaccacccactcgccgggcttcctcggcctccacatgggcaaggacggcttctggagccgctccggcttcggccgcggcgtggtgattggcctcctcgacaccggcatcctgcccagccacccgtccttcggcgacgccgggctgccgccgccgcccaagaagtggaagggcgcctgccagttccggtcgatcgccggcggcgggtgcagcaacaaggtcatcggcgcgcgcgcgttcgggagcgcggccatcaacgacacggcgccgcccgtggacgacgcgggccacggcacgcacacggccagcacggcggcgggcaacttcgtgcagaacgccgacgtgcggggcacgcgcacggcacggcgtccgggatggcgcccgcacgcgcacctggccatctacaaggggtgcacgcggagccggtgctccatcatggacatcgttgccggcctggacgccgccgtcaaggacgggcgtcgacgtgctctccttctccatcagcgccacggacggcgcgcagttcaactacgacctcatcgccatcgccacgttcaaggccatgggagcacgggatcttcgtcagccgccgcgggggggcacgacgggccccgccgcgggctccatcaccaacgcgncgccatgggatgctgancggtcgcggcgggcaccatggaccgcgcgatacgca

SEQ ID NO: 17138 - DNA, 668 bp, Zea mays
gcctgggcatcggggccggcggcgtgaaggagataacggggcgccgcgtcgcctgcggcggcaagcggctgaaggccatcaccgaggcggagctcaactacccgtcgctggtggtgaagctgctgtcccgcccggtcaccgtccgccgcaccgtgaccaatgtcgggaaggccagctccgtgtacagggccgtggtggacatgcccagcagggccgtgtccgtggtggtgcggcccccgacgctgcggttcgacagggtgaaattcggctcgagcttcaccgtgacggtgcggtggagcgggccgccggccgccggcggcgtcgagggcaacctgaagtgggtgtcgagggatcacgttgtccgcagcccgatcgtgataccgccggcgaaggccgccgcgtaggcgtagctcccagcccaattgatgagtgccccggcattggtcggcaaacggcatgtatccctccctccaacaaggtcagtagcggtagccggtaggtggtaatcttgagtcagtgtgaccggtgtacgtatggcgaaggaagtaggcaggcgactgttgtataggcaggcagaggcagggtaacccatcatctgtgacgcagcaagctcagctgcaatggcaatggcaatggcgcgttggttcctgtatgtcaaaaaaaaaaaa

SEQ ID NO: 17139 - DNA, 4947 bp, Zea mays
cgccagtgccatcagcatcgccatataccaaatggaaattcaaaatcggcccagtagtcctcttcctcctcctccccccctgcttcgattctgctcgccagctcaccgccagtgctctgcgctgcctgcccatcactcactcactcactccccccacccggcgcacactgccgctgcctgccaccaccctacataaccattgggtacctcgaggccggccgggacgccacttccctcccgcaccctgctccctcgcttcaatcgattcggcgctaccgagcaccaaacgccaaggcggctgcttaccagagtcatgcggacccaaagaagcctccttcccctgctcctgctttccgccgccgcgctactcgccgacgcgcaggaccgcaagaactacgtggttcatctcgagccgagggacggcggcagcaccgcttccttggaggagtggcaccggtccttcttgccggaggcgacgctggactcggcggcggacgacgggccgaggatcatccactcgtacagccacgtgctgacgggcttcgctgcccgcctcaccgacgcggaggcggagacgctgcggcgcaaggaggggtgtctgcggctgtacccagaggagttcctgccgctggcgaccacccactcgccgggcttcctcggcctccacatgggcaaggacggcttctggagccgctccggcttcggccgcggcgtggtgattggcctcctcgacaccggcatcctgcccagccacccgtccttcggcgacgccgggctgccgccgccgcccaagaagtggaagggcgcctgccagttccggtcgatcgccggcggcgggtgcagcaacaaggtcatcggcgcgcgcgcgttcgggagcgcggccatcaacgacacggcgccgcccgtggacgacgcgggccacggcacgcacacggccagcacggcggcgggcaacttcgtgcagaacgccgacgtgcggggcaacgcgcacggcacggcgtccgggatggcgccgcacgcgcacctggccatctacaaggtgtgcacgcggagccggtgctccatcatggacatcgttgccggcctggacgccgccgtcaaggacggcgtcgacgtgctctccttctccatcagcgccacggacggcgcgcagttcaactacgacctcatcgccatcgccacgttcaaggccatggagcacgggatcttcgtcagcgccgcggcgggcaacgacggccccgccgcgggctccatcaccaacggcgcgccatggatgctgacggtcgcggcgggcaccatggaccgcgcgatacgcaccaccgtcaggctcggcgacgggcaggtgttcgacggcgagtcgctgttccagccccggaacaacaccgcggggcgcccgctgccgctcgtcttcccgggccgcaacggcgacccggaggcccgcgactgcagcacgctggtggaggccgaggtgaggggcaaggtggtgctgtgcgagagccgctccatcacggagcacgtcgagcaggggcagatggtgtccgcgtacggcggcgccggcatgatcctcatgaacaagccggcggaggggttcaccaccttcgccgacgcgcacgtcctgccggcgtcgcacgtgagctacgccgcggggtccaagatcgcggcgtacatcaagtcgacgcccaggcccacggcgaccatcacgttccggggcacggtgatgggctcgtccccggcgccgtccgtggccttcttctcgtcgcgcgggccgaacaaggcgagcccgggcatcctgaagcccgacatcaccgggcccggaatgaacatcctggcggcgtgggcgcccagcgagatgcacccggagttcgcggacgacgtgagcctgcccttcttcatggagtccgggacgtccatgtcgacgccgcacctgagcggcatcgcggccatcatcaagagcctgcacccgagctggtcccccgcggcgatcaagtcggcgatcatgacgtcgtcgggcacggcggaccacgcgggcgtgccgatcaaggacgagcagtacaggcgggcgagcttctacagcatgggcgccggctacgtgaacccgtcccgcgccgtcgacccggggctggtgtacgacctcggcgccggcgagtacatcgcctacctctgcgggctgggcatcggggacgacggcgtgaaggagataactgggcgccgcgtcgcctgcgccaagctgaaggccatcaccgaggcggagctcaactacccgtcgctggtggtgaagctgctgtcccatccgatcaccgtccgccgcaccgtgaccaacgtcgggaaggccaactcggtgtacaaggccgtggtggacatgcccagggccgtgtccgtggtggtgcggcccccggtgctgcggttcgccagggcgaacgagaagcagagcttcaccgtgacggtgcggtggaacgggccgccggccgtcgccggcgccgaggggaacctgaagtgggtgtcgagcgagcacgtcgtccggagcccgatcgttataccgccggccaaggccgccgcgtaggcgtagctcccaatccaatctctgcttgacggccggcaggaccgttctcagctcgtgtcgtgtctccgaggatgaaggtcatcagtattcagtagctttaggtaatcgtgagtgcgcccggtgtacgtatggcgaaggaagtaggcaggcgactgttgtataggctggtggaggcaggcccgtcgcagggtacccgatcatctgcgacgcagcaagctcagctgcaatggcaatggcgcccgttcgttccgtatgtaaaaaaatggcggaaataattaatcgcatcgaaaacccccaaacccgatcatctgtctgttgcttgccttcttagaaaatacaaccaccagtccaccactacccctaacctaagtatcagtagcttaccttttgctccgtctagaatctccatggccagtactcctactttgcagtgctgaaggccgaaggggtccccatgccatgaccatgcatccatgccaggatgccaacgcgtctgggctggagccataggcttttgatttgatctcactcagtaccactaccacggcactgtctgtctttccactcccacccaagtcccaacggcaaaccgagctcgctttgttggagctggggctccaaagaagacgacgacggccgttgctgccctgctgggccgctgctgactccactcgatcgccattgctgccagccaggaaacgtcacaggagtaatagcgagaggagagggccagagactatggcgaggtcgcgccattcacggaaagacgcgtccccggcccgcgcgtacgttggagccgccattaactcccggtttgaagtgcctgacgaaagggctcgtccatgcgctttaaaaggcggcagcataaacacatcacctcccctttccagcctgtaaaaactcattcacttcctgcgctgcgccgccggacgcgcagcagcaagttactgctgctgctggtaccgctcactagctaggacgtgccggcaattgttgccttctggtctctgaacctgccgcatacgccgcacgcgtacgagaagcccaccgacgacgacgacgacgaggaggagaaactgttccagtttcagccgcgaaaagcaggatctttccgaggccattacgcgcggcgcaaagcacgttgacgagcggcagcagggcctttccactggatttgcgcgtacgtgttcttgtgcgcctgtgccattaacagtgaacgatgcactactgcccgggggaaccctgctctcgccactgcgcatgcgacagtgtaattagtgggtaacagcggcggcaaatgttaaggacgaggacgctgtggtgggtggtgctaccaccatgacgctgtggtgtggtggtgggatctaccagcttttccctcctccatcaccgcttctcacccgctcggccgtaaagttagttaacgccatcataacaataacatgagcccagcgcgtccagtcggcattgcgttgcaggatcgaacaaatagggttcagggaacaaaattgctcaggcggtcaggccttgaagggaaaaaaaacagtgaatgccgtttggcgattcagcagcaagagttctcgttatcttattcttctcgtttttaccctagcaaaagctaataagtggggcgcagcatgcccagacacccagtgtcatgccactctcctgtgctgcatccggcgtggccgtcattgtgggttgcatggctgtcccatgatcacgagcccaagcgagaagggcggcaagaggacatgagaacaggtgaggttagattgggataccatcataccagtcgcgctgtgctcgctggggtgatgaactggccgatcttttaggaccgagatatagtactgcagcccgattctatatggattttagaaaatattaatttcatgcgaaatttatatttttgtccctataaggactgctttgatgacccgagatcacgaatagatccatgggagaataatcccttgctattcaaaatagcaggaagatttctctctatggatcccctggtattttagaaaagacaatatcctcccctggtattttatcgctacaaggtatggctacaccttcaagatcaagtgcaccttcatatacaacttcatccggtagtctatcattttcttcctctgctccctcatactcagctcaaagtccaatgtgttcatgaaagtcggttagaaggcgggtgaatagacgaaacctaaaatttaactcaaaataatccaaaaattgatctgagataagtaatcttaagtgatagaacaagactcttagtccgagaattgactaacttcaatacttgatattgttgcacagaaaattgcatgatttagacttagcaataatataaaacaatgaagaacttagggagg

SEQ ID NO: 17140 - DNA, 5227 bp, Zea mays
gagcccgttgactcgcagcaggccaaaacccgtgcaaggaaacgaacacgtaggcttgaaaggcccgactcagtttcataaccatgtctgacgggttggacttcactagggacgtgacgggctggaccgggtagcccgtttgtgctcgattacttggcatggctaatccaccgaggccagataacacgcgagaaacagactcgtgcccagtgaaccctgtcacaaattgaagggccacagatggaccatgccagtggcctaggctgctagacaccgtaccgccatacgtgcctcttatctcgagcaatcgagctagactggtacgtgctctacacactttagctgtggtatagtgaacatgcatttcgggatctcatttttcaattttcatactagatttgtgcaaaatctatgcaacaaattattcttatttgtactgatatgctttataacgtaagaagagatcatcatcaaatgtcatacatacctattaaattatttaatttattgtgtgcgctcttgtgtcgcattcgtcgacgtaccatgcacacacgctctaattcgcgtggatcgtaccatgggtggtattagcacctgctaggatgctacgggcactgcccttggatcacatatcctgcaacaatgtgggtcgtggactcatggtatggacaggcatatcctgcaacaatgtgggtcgataattagctcggcggaatgtgggtcgataattgcttatttacacggctaaagtaatgtcaattaatgctaattccaatcaatagcagtggtaacaatgtggcacacccctgcaacaaactcttggcaatggtcaattggcttcatgtggcagtgtgggaaattggaaatagagtggaggaagaagtgaatacgagcttaaaacacatagcaacaaaaaacgctcatggacatgtgaatcgggctagacgccgaacattgatgcacggagtgagtatcctgttgttataccacgacaacactcccatcccaaactataaataatcataggtttcttggaaaatcaaaagagcctaagtttgaacaaacatatattaataataagaacaacaatacgatgctgattgggatggtactaaaccctaaacccttaaaaaaaagcgcactcccatctctatcattcgaaacgctttcgaacgctgctcctggctctcagacagacatgtgtctgtccgtaaagccgcagcggggtgaagagaatgattgaccctgcgcccatttattcacagaaatgcacactagccgcggaggatttggcccaccgtcccatcaacagcgctgtcgccgagaggtgggcccggtaccaaagcgaccgcaccgatcaccatcactctcgagccccattgtgttttggcgtgcccgtgcccgtgcccgtgcaagcagcagccattgacacgttgttttctggcgcaacggggcagggcagagcagagcaagggggaaacagtgaacgccagtggcatcacccaaatcaaattcaaaatcagtgcagtccagtccagtccagtccagtccagtcctctcttccggctccacttctgctctacagctcaccgcccactgccactcactcgtctgatcgtagtcgccctacataacacccggcaatccctcgttcttgccacgccactccactccactgccctcctcctgcaccctgcgcttcaaatcgtttcggcggtagtgagcaacgccaagcatccagcaacagcagccgctacctccctttgtctagctgtctccctcacccggtccagtcctgcattgcattgcctcatgaggacccaaagaaacctccttcccctcctcctgctgctgtccgccgcgctgctcgccgtcgccgacgcgcaggagcgcaagaactacgtggttcatctcgagccgagggacgacgacggcggcggcgggtcggtggaggagtggcaccggtctttcttgccggaggccacgctggactcggcggcggatgacgggcccaggatcatccactcgtacagccacgtgctgacggggttcgccgccagcctcactgacgcggaggcgcagacgctgaggcgcaaggaggggtgcttgcggctgtacccggaggagttcctgccgctggctaccacccactcgccgggcttcctcggcctccacatgggcaagcacggcttctggggccgatccgggttcggccgcggcgtcgtgattgggctcctcgacaccggcatcctgcccacccacccgtccttcggcgacgcggggatgccaccgccgcccaagaagtggaagggcgcctgccagttcaggtccgtcgcccgcggcgggtgcagcaacaaggtcatcggcgcgcgcgcgttcgggagcgcggccatcaacgacacggcgccgcccgtcgacgacgcgggccacggcacgcacacggccagcaccgcggcgggcaacttcgtgcggaacgccgcccggcggggcaacccgcaacggcagggcgtccgggatggcgccgcacgcgcacctggccatctacaaggtgtgcacgcggagccggtgctccatcttggacatcgtcgccggcctggacgccgccgtcagggacggcgtggacgtgctctccttctccatcggcgccaccgacggcgcgcagttcaactacgacctcatcgccatcgccacgttcaaggccatggagcgcggcatcttcgtcagcgccgcggccggcaacgacggccccgccgcggggtccatcaccaacggcgcgccgtggatgctcacggtcgcggcgggcaccacggaccgcgcgatacgcacaaccgtgaggctcggcaacgggcaggagttccacggcgagtcgctgttccagccccggaacaacaccgcggggcgcccgctgccgctcgtcttcccggagtcccgcgactgcagcgcgctggtggaggccgaggtgaggggcaaggtggtgctgtgcgagagccgctccatcagcgagcacgtcgagcaggggcagacggtggccgcgtacggcggcgccggcatggtcctgatgaacaaggcggcggaggggtacaccaccttcgccgacgcgcacgtgctggccgcgtcgcacgtgagccacgccgcggggtcgaggatcgcggcgtacgccaggtcggcgcccaggcccacggcgtccatcgcgttccggggcacggtgatggggtcgtccccggcgccgtccgtggccttcttctcgtcgcgcgggcccaacagggcgagcccgggcatcctgaagccggacatcacggggcccggcatgaacatcctggcggcgtgggcgcccagcgagatgcacccggagttcgcggacgacgtgagcctgcccttcttcgtggagtccgggacgtccatgtcgacgccgcacctgagcgggatcgcggccgtcatcaagagcctgcacccgagctggtcccccgcggcggtgaagtcggcgatcatgacgtcgtcggacgcggcggaccacgcgggcgtgcccatcaaggacgagcagtaccggcgggcgagcttctacagcatgggcgccgggtacgtgaacccgtcccgcgccgtggacccggggctggtgtacgacctcggcgccggcgactacgtcgcctacctctgcggcctgggcatcggggacggcggcgtgaaggagataacggggcgccgcgtcgcctgcggcggcaagcggctgaaggccatcaccgaggcggagctcaactacccgtcgctggtggtgaagctgctgtcccgcccggtcaccgtccgccgcaccgtgaccaatgtcgggaaggccagctccgtgtacagggccgtggtggacatgcccagcagggccgtgtccgtggtggtgcggcccccgacgctgcggttcgacagggtgaacgagaagcggagcttcaccgtgacggtgcggtggagcgggccgccggccgtcggcggcgtcgagggcaacctgaagtgggtgtcgagggatcacgtagtccgcagcccgatcgtgataccgccggcgaaggccaccgcgtaggcgtagctcccagcccaaatgcccaattgatgagtgccccggcattggtcggcaaacggcatgtatccctccaacaaggtcagtagcggtatgtggtaatcttgagtgtgaccggtgtacgtatggcgaaggaagtaggcaggcgactgttgtataggcagggtaacccatcatctgtgacgcagcaagctcagctgcaatggcaatggcaatggcgcgttggttcctgtatgtcatcgcttcgcaaatcccccccaagtgtctctgtccgctctgttccatttgctaccccctaacctaagtagatggctagtactgctttgcaggacggaagggggtggtcctcgtgtcgtgaccatgccgcgatgccaacgcgtctgagttggccactggcggcgatgggccaagctccatagtagacaacgcattgccccgttgcacggccaacaaatcgagctctgcttgttttgttgccttggagctccaacgaaacgaagaagaggacggccgttgcgttgctgcctctgactcgccattgctccagtaccggccggccggccagccagccagtcaggaaacgtctgcagaggccagaggagaggtgagagccatttactcaaacacgcgtctgtcgtccccgtctccgctccaccataactcccggtttctctgtgcttgcagcacaccttcccattccagcccgtaaaataaaataaaataaaacccattcacttctctgtgcttgcagcagcatagtggtagtggactagtggtagatgcacatcaggcgggccaacgcgttcgtgcaggcatcctagccttgcattgcagttgcaggaataaatgggagccgaacggatgtactagccaccatcaacgagtccgcgagatcacgagtgcacagcctcacacgcactagcaggagcgagatgaacgaacggacggacggacgagcgagcagacagcagatgctgggcgcttgatgccaggaacaggactggcatggctgaggcagatgcatgcactgaaatgcaatcgagtagcaagtacgtagggcccgtttggattccaaatgctaaactttaacatccctttgtgttaaccaagcagtgctaaagtttaacgcttcatttctactagtatcttttagcatacgtgtttgtatct

SEQ ID NO: 17141 - DNA, 519 bp, Zea mays
ggaaggccaactcggtgtacaaggctgtggtgaacatgcccaggcccgtgtccgtggtggtccggcccccggtgctgcggttcgccagggcgaacgagaagcagagtttcccccgtgacggtgcggtggaacggccccccgcccgtcgccggccccgaggggaaccctgaagtgggtgtcgagcgagcacgtcgtccggagcccgatcgtaataccgccggccaagcccgtccgcgtaggcgtagctcccaatccaatctttgcttgacggtcggcaggcccgttctctgctcgtgtcgtgtccccgaggatgaaggtcatcagtattcagtagctttaggtaatcgtgagtgtgcccggtgtacgtatggcgaaggaagtaggcaggcgactgttgtataggctggaggcagggtacccgatcatttgcgacgcagcaagctcagctgcaatggcaatggcgcccgttcgttccgtatgtaaaaaaatggcggaaataattaatcccctcgcaacccc

SEQ ID NO: 17142 - DNA, 2597 bp, Zea mays
  misc_feature (6)..(6): n is a, c, g, or t
tcgggnaaaaaaaaaaaaaaaaaaaaaaaaaacgccactttccctcccgcaccctgctccctcgcttcaaatcgattcggcgctaccgagcaccaaacgccaaggcggctgcttaccagagtcatgcggacccaaagaagcctccttcccctgctcctgctttccgccgccgcgctgctcgccgacgcgcaggagcgcaagaactacgtggttcatctcgagccgagggacggcggcagcaccgcttcgttggaggagtggcaccggtccttcttgccggaggcgacgctggactcggcggcggacgacgggccgaggatcatccactcgtacagccacgtgctgacgggcttcgctgcccgcctcaccgacgcggaggcggagacgctgcggcgcaaggaggggtgtctgcggctgtacccagaggagttcctgccgctggcgaccacccactcgccgggcttcctcggcctccacatgggcaaggacggcttctggagccgctccggcttcggccgcggcgtggtgattgggctcctcgacaccggcatcctgcccagccacccgtccttcggcgacgccgggctgccgccgccgcccaagaagtggaagggtcgcctgccagttccggtcgatcgccggcggcgggtgcagcaacaaggtcatcggcgcgcgcgccgttcgggagcgcggccctcaacgactcggcgccgcccgtggacgacgcgggccacggcacgcacacggccagcacggcggcgggcaacttcgtgcagaacgccgacgtgcggggcaacgcgcacggcacggcgtccgggatggcgccgcacgcgcacctggccatctacaaggtgtgcacgcggagccggtgctccatcatggacatcgttgccggcctggacgccgccgtcaaggacggcgtcgacgtgctctccttctccatcagcgccacggacggcgcgcagttcaactacgacctcatcgccatcgccacgttcaaggccatggagcacgggatcttcgtcagcgccgcggcgggcaacgacggccccgccgcgggctccatcaccaacggcgcgccatggatgctcacggtcgcggcgggcaccatggaccgcgcgatacgcaccaccgcaacggcgacccggaggcccgcgactgcagcacgctggtggaggccgaggtgaggggcaaggtggtgctgtgcgagagccgcaccatcacggagcacgtcgagcaggggcagatggtgtccgcgtacggcggcgccggcatgatcctcatgaacaaggcggcggaggggttcaccaccttcgccgacgcgcacgtcctgccggcgtcgcacgtgagctacgccgcggggtccaagatcgcggcgtacatcaagtcgacgcccaggcccacggcgaccatcacgttccggggcacggtgatgggctcgtccccggcgccgtccgtggccttcttctcgtcgcgcgggccgaacaaggcgagcccgggcatcctgaagcccgacatcaccgggcccggaatgaacatcctggcggcgtgggcgcccagcgagatgcacccggagttcgcggacgacgtgagcctgcccttcttcatggagtccgggacgtccatgtcgacgccgcacctgagcggcatcgcggccatcgtcaagagcctgcacccgagctggtcccccgcggcgatcaagtcggcgatcatgacgtcgtcgggcacggcggaccacgcgggcgtgccgatcaaggacgagcagtacaggcgggcgagcttctacagcatgggcgccggctacgtgaacccgtcccgcgccgtcgacccggggctggtgtacgacctcggcgccggcgagtacatcgcctacctctgcgggctgggcatcggggacgacggcgtgaaggagataactgggcgccgcgtcgcctgcgccaagctgaaggccatcaccgaggcggagctcaactacccgtcgctggtggtgaagctgctgtcccatccgatcaccgtccgccgcaccgtgaccaacgtcgggaaggccaactcggtgtacaaggccgtggtggacatgcccagggccgtgtccgtggtggtgcggcccccggtgctgcggttcgccagggcgaacgagaagcagagcttcaccgtgacggtgcggtggaacgggccgccggccgtcgccggcgccgaggggaacctgaagtgggtgtcgagcgagcacgtcgtccggagcccgatcgtgataccgccggccaaggccgccgcgtaggcgtagctcccaatccaatctgcttgacggccggcaggaccgttctctgctcgtgtcgtgtctccgaggatgaaggtcatcagtattcagtagctttaggtaatcgtgagtgcgcccggtgtacgtatggcgaaggaagtaggcaggcgactgttgtataggctggtggaggcagggtacccgatcatctgcgacgcagcaagctcagctgcaatggcaatggcgcccgttcgttccgtatgtaaaaaaatggcggaaataattaatcgcatcgaaaacccccaaaaaaaaaaaaaaaaaaacgccccggggggcccggtac

SEQ ID NO: 17143 - DNA, 1318 bp, Zea mays
  misc_feature (9)..(9): n is a, c, g, or t
ggtaccctncgggtttggccgggtcaggctcggcgacgggcaggtgttcgacggcgagtcgctgttccagccacggaacaacaccgcggggcgcccgctgccgctcgtcttcccgggccgcaacggcgacccggaggcccgcgactgcagcacgctggtggaggccgaggtgaggggcaaggtggtgctgtgcgagagccgctccatcacggagcacgtcgagcaggggccgaacaaggcgagcccgggcatcctgaagccggacatcaccgggcccggaatgaacatcctggcggcgtgggcgcccagcgagatgcacccggagttcgcggacgacgtgagcctgcccttcttcatggagtccgggacgtccatgtcgacgccgcacctgagcggcatcgcggccatcatcaagagcctgcacccgagctggtcccccgcggcgatcaagtcggcgatcatgacgtcgtcgggcacggcggaccacgcgggcgtgccgatcaaggacgagcagtacaggcgggcgagcttctacagcatgggcgccgggtacgtgaacccgtcccgcgccgtcgacccggggctggtgtacgacctcggcgccggcgagtacatcgcctacctctgcgggctgggcatcggggacgacggcgtcaaggagataactgggcgccgcgtcgcctgcgccaagctgaaggccatcaccgaggcggagctcaactacccgtcgctggtggtgaagctgctgtcccatccgatcaccgtccgccgcaccgtgaccaacgtcgggaaggcgaactcggtgtacaaggccgtggtggacatgcccagggccgtgtccgtggtggtgcggcccccggtgctgcggttcgccagggcgaacgagaagcagagcttcaccgtgacggtgcggtggaacgggccgccggccgtcgccggcgccgaggggaacctgaagtgggtgtcgagcgagcacgtcgtccggagcccgatcgtgataccgccggccaaggccgccgcgtaggcgtagctcccaatccaatctgctagacggccggcaggaccgttctcgtgtcgtgtctccgaggaagaaggtcatcagtattcagtagcggtaggtaatcgtgagtgtgcccggtgtacgtatggcgaaggaagtaggcaggcgactgttgtataggctggtggaggcaggcagggtacccgatcatctgcgacgcagcaagctcagctgcaatggcaatggcgccgttcgttccgtatgtaaaaaaatggcggaaataattaatcgcatcgaaaaaaaaaaaaaaaaaaaaaa

SEQ ID NO: 17144 - DNA, 1092 bp, Zea mays
agcttagaggcatgcgatgcaaacacgttctgctttcgaagtttataccgaagtgacacccctgacatgtgcaaggactactatgtatgcttctcttttgttttttttagcttcgaactcggtcgtctttaccatccgcaacactcctctaaaacaaatgaacctgaatgcctttagaaagtgaacaagcacaaccattcccatagccctccacttgtacctggtatttccatcggttcacttgattattacatgcattatttcataccaagctctccacgcccatgcgatatcaagacgacgacggcactaccaagtaaggccgacctcaccagaagacctacccccgccatctatattccgaactccactatgcctatattgccagaagtgttctgcacatccacttagatcttatggtgaggagagcctaagtacaagaagaaagcctgacggaaggccaggaacaaaatggggttgacgttgggcttgctcagcggctgcaaaatacgcctatgcaaatgtggcccgttgaatcacaaaatctttgcaccttatcactcagctcgggttgaaccagcggccgccagtcgtgctgttcatgtggtgcccgttcccgtgcatccctgccccgtttggtgccattggggatgcggggatccgtgaggccggagagccaactgccgctgaaggaggcggcggggagaatagggcagggatgtgagaaagggcggtgccacccaagagatggctgctacctttcctttgctggatagctttgatctgccttaaactctgctcgtggatgtttgcgagtgcctccagctcattaaacgacaatgattcgacgccgacaccgtatagtggagcatgccgggccacctcttcttggagggacgtttcaagtgtccggatgtattgctggcaatcatgatactaggttagttgccatgcaaggttctacactagtaataagagcagtagcaggaagacaatgtgaaattgcaaaattggtcatgataacgagtaccctgggtcattcaaagttgttcacatactagctgaagctgaagaacaactgcgcctcagatg

SEQ ID NO: 17145 - DNA, 1969 bp, Zea mays
tcgaggccggccgggccgggaccatttttcctccgttccattcttctctcctcgcctcccctcgcctcccctcttgaaccctccgccgctccgaggaaaatccgatttgaattgaaaatcatccggagacagagatcttttcttcctcgaagctatcttctctctcgactcgatccatagctgctcgcgtccctgttcctcgccggctggcaagtggcggcgacgggacgaggtcttcatcgcctcctcgcgagcgacgatcacccactagtttggtcggtctgaggcacatgatgatggccaacgcgaagctccacaagcaggccctgctgccgccgcggagccccttcccgacggcggcgccgtacgccgaccgcggcccaatcgcgcggccgcaggttggcgccacgcaccaccgccacggccaccaccagcgcacgtcgtccgagagcttcatcgaggagcagccgccgtcgtggctcgacgacctgctcaacgagccagagacgcccgcggcgcggcagagcggccgggctgggcaccgcaggtcgtccagtgactcgtttgcgttgtttgacggtggagctgctggtgctggtgcttacgccaatggtttcgaggggatggggagaggaggtgggcaacctgcgccgtggggtggtgtgcaggagtactatgccaagctggccccgattgggagggcacatggccggccgtgggagcaaggcatgccgaattcggcgggcttcaggcatggtggtggcctgccgatgcccacaaaagataaggttggtgggcatcatgggccaccgaaagtgtcgagggagcatgaccatggcatggacaagagaactgatgatgctggccatgatcaaaaggttggagccaaggagggtgtgccgccgaagcatgcacagtcagaggcggacaacaagcgtgctaaacagcaatatgctcagaggtctcgtgtccggaagctgcagtatattgcagagcttgagagtagagtccaggcattacagtcagaaggggtagaagtgtctgctgaaatggagttccttagccagcagaatatcatgctagacctggaaaacaaagccttgaagcaaagagtggagagtctagcacaggaacaacttattaagcgttttcaacaggagatgtttgagcgggaaattggtcgtctcagaacaatatatcagcaacagcagcaacaacaggctcctgctcttgttcgtagtaacagcagggaccttgatgtgcagttcgccaacttgtctctgaaacacaaagaccccaacacgggccgggatgctctctctgggcctcttcgtacttagttctttccatccttccgttcttgtgggttctatcagtggccaccactgtgtctgtcatctccaccaagaaaggagaagtgcacttggattgtgtgaaaaacaccggaaaaaggctaatagctatggatctgatgtttattatttcgggatatgcacctggcggtcatcctcagctcgcgtccattggtgatgctcgaccagtcggcggtgtttagggtttttgtttttagctagatgcttttcaagcatcattgtaccatttttcatgctagggttctaatctgttactacccccgttttcctgaactgtgtgcttcaagcatcttagtcatgtttggattagttctgcgttatcagtgcctcagtggaatgtggagcactaggcagcatcaggtaagttgctttggagatgtgccacatccttgacaactgcatgttctgctattatttcttagtactcaataagctagtgcaaatgaggtattagcgatcttcagatttcaggttgttcttgatgtactcctatgaatatatctcaattgctcaacgtttcctttttatgttaaaaaaagccccacggggggcccggttcccaatcaagcagtgctaaggtatggttgatttaattt

SEQ ID NO: 17146 - DNA, 789 bp, Zea mays
ggagcacatcatcaacgtgcagctgccttctttgaaaaaaaacacacagctgtagttgtcattttccttttttttcctggtctctgatccaaccagtttcagtgaaaaatcgtcatattaattctggactagaaaatgggaggcacataacaacaggacccatttttttttgcttgtataactaactatttgtatatttgtgttgggcttggatcttcctttgcttatcatggaagtgtatgaattggaatatggcctctggcctgtgtctgcaccaactcatgatcgatcatgtatccatccccttcgtctggatgttctgctccgctgcatgccggccaacatggctggtgattaattcctccccaacaaactgaatggcaggtggagcatggccattgtccagtcgggcgcttgcttgatctcatgcagcatgcgaaggctgctcgttggttggagattcacacggtttaatgcaacattttctattgttttagaccgatggttatcacacctttggctagaccatgctgcaaataaaatgtagtcgagataattaccttgttgatttttgaagatcgcgtccaacacgtggtcagttaagcttatcacgcgactccaattgccgatcagctcaacaatgacatatgtcaggtaaacaggatacacctctttagaaggttctttgaaaaatgtttgcggtcagcataggtggcaaagtcaaacatgtcatgttaagtctcatgatgatgcatctagctatgaggcattatacaaatgcggatttgg

SEQ ID NO: 17147 - DNA, 2290 bp, Zea mays
  misc_feature (1860)..(1860): n is a, c, g, or t
ccggccgggatggcgtgagcgccggggcaaggcaagtagccgctgcgcggtgctgccacctgacctgacctgactgccgtcccggtccccgctccccggtccatccgaacgccgttacgggggccgcccaccgcgacggaacggaaaggtgcggtcaacccaccccgtcccagtcccatcaccgccgggggccgggtggatgcacgagaccattaccccggcccgtccgggccccaaattcccttccttcctttgctcctcccctgcctcgcctctctctctctctcccctctcctcgcctccagctcctgctcggcccgctcgcgtccagctgcgcgcgcgtctgcggtggccgtgaaggacagcccgagggacgcgccgggtgcactgatctgggggccgcgtgtccccggtggtggggcgaggcggcgccggcttccaggaatgggcagcttgtagtggctgtttcttttgcatatgcactttctattgttgttgtcatttcaaaggaggccatagtctcctggattttgtatgccttgttatctggaattggtgaccatagatgtcatttcgtagcatagtccgtgatgttagggatggcttcggcagcttgtcgaggagaagctttgaggtgaccctcgcaagcatttatggccttactgggcatcacaaagggaagacccagagctcatcgcatgtgctcgacgactcaccttccataattcgtgaaagtcgatgggcgaatctacctcctgaactcatccgtgatatcatacggagactggaggctgatgagagcacctggccagcgcggaagcacgtcgtttgcttcgcagctgtttgtaggacatggagagaaatgtgtaaagagattgtgttgagcccggagttttgtggcaagctcaccttccctgtgtctctaaaacagcctggtcctcgagatggaaatacaatggtccagtgttttataaagaggaataagtcaaaatccacttaccatctgtacctgtgccttagcaatgttgttacttcagaaagtgggaaattcctcttatcagctaaacgacaccgcaaaaccacatgcaccgagtacactatatcaatggattctggcaacatctcaagatcaaaaagaacctacattggaaaaataaggtctaacttcctaggcacaagatttttaatttatgatacacaagccccctataatggggctgtagttcctcctgccggaaggaccagcaggaggttcaactccacaaaagtctctccaaagctgccttcagtcagttacaacatcgcacaggtatcgtatgagctaaatgtccttggcacaagaggtcctaggcggatgcgttgcatcatgcactccatacctgcatcatcagtggagccaggtggcacagtgcctggacagccagagcagattgtacctcgagccctggaggattcattccgcagcacggcttccttctcgcagtcgttccgtagcactgcctcattctccaagtccatcatggactcgtccatggatttcaatagcgctcgcttctctgacatagctggcagcagcgctcgcttcacgggcgttcctggtagcagtgctcgctttgcgggcgttcctggcagcagcgctcgcttctcgggcattgctggcgccagattggacaacgacgaggagagtgaaaccaaggagaggccactggtgcttcgtaataagccgcctaggtggcacgaacagctgcagtgttggtgcctcaacttccggggccgtgtgacaattgcctcggtgaagaacttccagctgatcgccgcggctaccccgccacccgcaggtgcgccaaccccctcgcagcntgctccgtcagatcctgacaaggtgattctccagtttggcaaagtggcaagggatatgttcacgatggactatcgctaccctctctcggctttccaggcctttgccatttgtctgagtagctttgatacaaaattagcctgtgaataaatggagaagaacaaaggtaaaggagaacagcaggttgcttgcattaggccatcagtgtacctctttccatctggctctcgtgttgccttggttgtatttgtgcttaatgtagccatgaagttggtggccatatatggacgcatgtgttgttgttggccctctcccttagaagtgattaaaagttgcatttggaccacatgttacccgatctgtaatatacttgcagtggcattgcatgccgcgtgataacaaagttcccgttcgtgaaaaaaaaaaaaaaaa

SEQ ID NO: 17148 - DNA, 5407 bp, Zea mays
  misc_feature (14)..(19): n is a, c, g, or t
  misc_feature (30)..(33): n is a, c, g, or t
  misc_feature (36)..(42): n is a, c, g, or t
  misc_feature (44)..(46): n is a, c, g, or t
  misc_feature (4782)..(4782): n is a, c, g, or t
cccccccggagggnnnnnnttttttttctnnnnttnnnnnnntnnnttttttgttccgggcttccttcctcctctttcttgtttttttttttttgtttttcttttttttttttttctcttatgagttaaaaattaatgtcataccgaaactcaagtatgttacagcaaatcagtttggaagtatgtgcagtgaaatgaggtagagattcatttgactctgaaaaggatgaagcagtgtcactgaaaaggcagaggaaatcctcaagtgagcacatcatcgacgggcagctgccttctttgaaaaaaaaaaaaacacagctgtagttgtcatttccctttttttcctggtctctgatccaaccagtttcagtgaaaaattgtcatattaattctggactagaaaatgggaggcacaaaacaacaggatttttgcttgtataactaactatttgtatatttgtgttgtcttggatcttcctttgcttatcatggaatgtatgaattggaatatagcctctggttgtctggcctgtgtctgcgccaactcatgatcgatcatgtatctgtccgcttcacctggatgttctgctccatctgcatgccgccaagtgccaacatggctggtgattaatacctcaccaacgaactgaatggcaggtggagcattgccagtcggcggcttgcttgatctcatgcagcatgcaaaggccgctcacttgttgatctgtgaagatcacgacaaataggaggtccattaagcttatcacacgactccaattactgatcagctcaacaatgaccatgatagataaggtgtgcggacttacaggctgtttggtttgcgtcacgaagccacgagaaatcatacgatccaacatctgagcctagccatgtcgtttggtttgcgtcacgaagccacgaggaatcatctgatccaacatctgagcctaaccatggcgtttggtttgcgtcgcaaaaccgagtcgtctatcgtgaagtcattcctcgtagtaccccaggtgaccaatgaaaaggtaattcctcagattgagttcgttccttgaaaaacgttggacgagctgatccttcatcgtacaggatcaatcatggacgaatccaaaccatcagagagattcaggtctagagaggacagggaaggcagtgttgttcatctgctagattttcttcaaccacaggcaacacattttcagcttagatgaggttgttgtcttcctctagttcgccgtcttccatgtcattctcatccaatgcgacaacatcctgggtagtgaattgatgaaaatctactatctttcactggatgcgttattcacaagcatatattgagttctcctatgccagtctcaattcctctgccagcaatgtctccagtaggatgcaaatctgtttaagtaatgggttgttcagaatatggagaaaataagttatactcatcggttcacaattataacaccatgttcaatatatcataattcagaggatgcagtgacactctttgggctagtttgaaagcaagggaattagaggggattgagggtgctcaaattcccttcctatttaattaggaaggggattttagccatctctcctctaattctcttgcttccgaactagtcctttatgtgtccttaagaacaagccgatagtatttttttcaaacaaaaagagaacaagccgatagtaccaacaatgtatagctaatatgaaaccatatactaaactcaaacttctcatcaccatataatatattttcatataaatttatatttttgcaacacagaatttttcaaaagaaacagagaactaaaattcatgcaagtgttcaaaaatggaatgaacattaacaacaacttatataatatatatttaattttaggtttcagatgtattaatattcacttatcaatttggtgatgaatcatcacctattcagtattctagatgaattgaaaattaagatgtacgtagttcatgaaaaaaacaataaatgtcataacaaagaagattggggggggggggggggggactagcgcctgatgaatttggcatataagaacttggactagcaggtttccgtctaatttgaatttcctttgtttcctctataatactggatgccttattatccacaattgtgagcccttcttccaaagcattttttggtctttcatccactccaactggttgatataatcagaaagagccgcaatggttttcaaatgatcaaaggaatggcttgtggtgctacatctcctgtcttccagtggttttcaaatgattaacgatagttacatgactgaaattacaaaaaaagttgcaatagctgtaaatagaatgccttgaactataaaacagcagagagagggagacaatgccatatacaagaagtccattagtgactgccaattttttcacatattcagatccacttactgcctcacctgatattttctagatgctccagggttgctaaaaggttgttctttcattatgtactcaaactaaggtgccaagccaacgtcgtcaagaattcacttgtctttactttctaaaattttccacatcccatgcttgttctcgtttattgccttgaacgctgtgcaacattacgatgaagcatagtcttgtaaaagaaaatcagcatatcatctcatagttgtgtgggggaaaaaagtattgtgacagaaacaaggtgattttgaaatgagcatatgcatcatggtttatgaaatctaataatatgataatgtggaaccaaacaatcagcaaccaaaaagaacaaactaagtaaactataaggacattgtgtttactagaccgttgaaactggtgctttaagtatatagtatagaaataacactcgcagtgaatcagggagtcccttgtttggtagcgatctgacgttttgagtcccagtgatatgtatttcctagagagaaggaaggcgatacaacccttgagggagggattgtagggccctataatgttcgaactgcaattcttgaagagacatgaggagctgaagcgccatgtccttctcttccatgaagttctctgtccgccaatcatgaaagaagattaacatctggaggttgcggagaggcatctacagatgggagcaacaggcaccacggtgatgctgtccacataaagtctcaccagttggaaggaactgatatgcattgctttagtccttgccacatctacaagtagatctgctgcaacataatacagctcggtctcaccatgtctcatattgtacacccttagattcttgaggttaaatgtgatgtgaggatcgaatccatccattgtgatatttgtacaatcaagtaactctagactagtaagagatgttagattcgtgagcagagccatcagcccagtgctttgttcatggcaaagacaattatatattttgaggctcttaagagatgtcaaattcatgagcagagcttcctgacgtagagttcccagataatgctgtcagcgagctagagggtggaaactacagtaccacttcctcatggtcctcatttgatgatgttgtcacatacaaaaaagaaagtgctgggaaacatttgaacaaatttgacaaagaatttttggtaggcgtaaatcgtccaagtttgagagattggactgtgagtagcacaacaccatcatccagtcctctaaaaaatgtatcctcgcatctattgacctctatatgtcttagggaatgtagatttcaaagatcattaaccacctgattggatggctgcgtccatgcgcagtctgccgttgtcctgaccagccatatataacaattttgagcgtatgcgtgagtgcaggttaatagcatcaaaatagcttattttgcatccactcattactactatatacaaagcaactaaacataatctcaactagagttaatgcatgcagtgatctaaaatgagatgattcgggtatccaatcaggtggtaaatgaaaagagtgatgcatcctgagttgtcaatctctttaggtcaccaagattttgaaaggccaatacagaggggtactcagtgtgcaaactagcacgattataataagacaaggagcccatttcaatacacgatatcgtcggagtgtcaagcaatggaggaaggcacaacttcgggcatcatgtaaagataacgaagactagggaaccatacggcgttatcttctatatgtgaaatagaccaatctgatatcatcaatccctaatctcggcggatggctccttccttccccgcgctcgctcccacggcgaccgagctccaaaacaacgccgccgccagatccgcccgccaccggccgtcctcagctcatgccggctgcaccaagccagatccaaccccgcaccctcctccagcaccaccagctcgccctcctgtgtcccagctcccatcgccaccgcccccaccaccaccgccggcccgcccttccgacccagctgtaagccgtgcgccggcggccccccgccctaccaagagggtgaggtttgcattcactacaagcaccatgccgccccgcattcaccacccctcccccgtatcccgcagccataatgccacccccgccccgatagctggtttgaagcccccctggaagctacgaccgcattgaagatgaggatcttgaaggatggacgacgattcggtgcaggcgtggacgcgtcacccgcgtaggcctaggccgcgccccagcggcgcctcgcctgctctcagctcaagcccctagccgtcttatgcntaagtctacgtgcatatgagatcactaattgagcatatgtatcatgctttagggcatctagtattataaagtggaatccaacaatgagcagccagccattcatgacttgccacaacaagaacgaactaagggggtgtttgaatgcactaaaacttagttagctaaaaattgctagtggaattagctagctaacaaatagctacctaactattaattaatttaccaaaaacacttaatagctaaactattagctaggttgtttgaatgtctcaactaattttagtcactaactattagctttagtgcattcaaacacccctaagtaatataaggacatggtgtttaatgagacaattttcttttctccataaaagtataaaagtaccaattcacgatatgagattgaaataaaactaaagaacggtgcaataatgaggtattgtacttcaagaagaaaaatgctagaaacatattttacccaaaagttgaaattgtagaagaaattaaattggttgattaaacattatgaaaattacctactgaattttgtgccaaccatgaccaacacatcatccaataagacatcatcctggctgtagaatcgatgaagatcaactatctcacg

SEQ ID NO: 17149 - DNA, 2699 bp, Zea mays
gcaaggcaagtagccgctgcgcggtgctgccacctgacctgactgccgtcccggtccccggtccatccgaacgccgttacggggccgcccaccgcgacggaacggaaaggtgcggtcaacccaccccgtcccagtcccatcaccgccgggggccgggtggataaacaaacccagcggcccccgcccccggcccgcctcattcccttccttcctttgctcctcccctgcctcgcctctctcccctctcctcgcctccagctcctgctcggcccgctcgcgtccagctgcgcgcgcgcctgcggtggccgtgaaggacagcccgagggacgcgccgggtgcactgatctgggggccgcgtgtccccggtggtggggcgaggcggcgccggcttccaggaatgggcagcttgtagtggctgtttcttttgcatatgcactttctattgttgttgtcatttcaaaggaggccatagtctcctggattttgtatgccttgttatctggaattggtgaccatagatgtcatttcgtagcatagtccgtgatgttagggatggcttcggcagcttgtcgaggagaagctttgaggtgaccctcgcaagcatttatggccttactgggcatcacaaagggaagacccagagctcatcacatgtgctcgacgactcaccttccataattcgtgaaagtcgatgggcgaatctacctcctgaactcatccgtgatatcatacggagactggaggctgatgagagcacctggccagcgcggaagcacgtcgtttgcttcgcagctgtttgtaggacatggagagaaatgtgtaaagagattgtgttgagcccggagttttgtggcaagctcaccttccctgtgtctctaaaacagcctggtcctcgagatggaaatacaatggtccagtgttttataaagaggaataagtcaaaatccacttaccatctctacctgtgccttagcaatgttgttacttcagaaagtgggaaattcctcttatcagctaaacgacaccgcaaaaccacatgcaccgagtacactatatcaatggattctggcaacatctcaagatcaaaaagaacctacattggaaaaataaggtctaacttccttggcacaagatttttaatttatgatacacaaccgccctataatggggctgtagttcctcctgccggaaggacaagcaggaggttcaactccacaaaagtctctccaaagctgccttcagtcagttacaacatcgcacaggtatcgtatgagttaaatgtccttggcacgagaggtcctaggcggatgcgttgcatcatgcactccatacctgcatcatcagtggagccaggtggcacagtgcctggacagccagagcagattgtacctcgagccctggaggattcattccgcagcacggcttccttctcgcagtcgttccgtagcactgcctcattctccaagtccatcatggactcatccatggatttcaatagcgctcgcttctctgacatcgctggcagcagcgctcgcttcacgggcgttcctggtagcagcgctcgcttcgcgggcgttcctggcagcagcgctcgcttctcgggcattgctggcgccagactggacaacgacgaggagagtgaaaccaaggagaggccactggtgcttcgtaataagccgcctaggtggcacgaacagctgcagtgttggtgcctcaacttccgtggccgtgtgacaattgcctcggtgaagaacttccagctgatcgccgcggctaccccgccaccggcaggtgcgccaaccccctctcagcctgccccgtcagatcccgacaaggtgattctccagtttggcaaagtggcaagggatatgttcacgatggactatcgctaccctctctcggctttccaggcctttgccatttgtctgagtagctttgatacaaagttagcctgtgaataaatggagaagaacaaaggtaaaggagaacatcaggttgcttgcattaggccatcagtgtacctctttccatctggctctcgtgttgccttggttgtatttgtgcttaatgtagccatgaagttggtggccatatatggacgcatgtgttgttgttggccctctcccttagaagtgattaaaagttgcatttggaccacatgttacccgatctgtaatatacttgcagtggcattgcatgccgcgtgataacaaagttcccgttcgtgattggacttgtatggtttcagaaaagcagcaaacaaagtttggtacggtgtgcatttttttttcctcgtctctggattggttactgtttgaagtgaactgcatcttgtctttcgcccctgtgtcttttgagaagcgagcaagagggctttacggctttgtctcacctcaaaagggatcgccgccgagtgccaaaccccacccacccatacatccatccttttatcagtggttatgagcacgactatatgtaatcatcattgcctgcattacctacaacgcgtatccctcacagcgttgcgcattagattcagatttagacgggcaacaatgcctgtgtgtgacatgggagctcgagcatcatatcacatgaacctgcttgtgcatgccttttcggcccgaataaagccgagctctttcggtgtggccctgtcttttgttatgagttgtttcggggggaagacgccggaacag

SEQ ID NO: 17150 - DNA, 1008 bp, Zea mays
tcgcattgggtacctcgaggccggccgggatacctctgcccttccccggtcctctccactttccggcctccgcttcccatcccgatcagcctgccgcagtgccgctccttccctccctctacccgtcgccgctgctgccatggacgaagtcgtcagccagattttggagaagcaagtgctgtctgccgcgaaggcggtggaggacaagctcgatgaggagatcgccgcgctcgaccgcctcgatccggacgacatcgaggcgctccgcgagcgccggatccagcagatgcgccgcgccgccgagcgccgcgccaagtggcgtgcgctggggcacggggagtacaccgaggtccccgagaaggagttcttctccatcgccaaggccagcgagcggctcgtctgccacttctaccgcgacaactggccctgcaaggtcgtggacaagcacctgtcggctctggcaaaacagcacgtggagacacggttcgtgaaggtccacgccgagaaggcccccttcctgacagagaagctcaggatagtcgtcctcccgaccctcgccatagttaagaacgccaaggtcgaggactacgtggtcggcttcgacgagctcggcggcaaggacgacttcagcaccgaggacctggaagagcgcctggcgaggtcccaggtcgtcttcctggacggcgaagggtccgcgcacgcgtcgaagcaggccgccgccgccaccaaacggagcgtccggcagtcgggcaccggcgactcgtccgactccgagtagctctcgggggtgttggtggtattattattattattatatctaaatgggtacacagcacagacatgttttggctgctatgccaacaggcaacattagcattgcaaggatatgcgtcttattaggacctggaagcgaaagtggttgtggtttgagttgctgtacagtgctactgctgccgtgtggatcacatctgatctgtggagccattggcaccttgcgtggttttgttt

SEQ ID NO: 17151 - DNA, 1014 bp, Zea mays
actccatagggcgattggcttcctcgccgccccggcttccggcctccgcttcccatcccgatcagcctgccgcagtgccgctccttccctccctctacccgtcgccgctgctgccatggacgaagtcgtcagccagattttggagaagcaagtgctgtctgccgcgaaggcggtggaggacaagctcgatgaggagatcgccgcgctcgatcgcctcgatccggacgacatcgaggcgctccgcgagcgccggatccagcagatgcgccgcgccgccgagcgccgcgccaagtggcgtgcgctggggcacggggagtacaccgaggtccccgagaaggagttcttctccatcgccaaggccagcgagcggctcgtctgccacttctaccgcgacaactggccctgcaaggtcgtggacaagcacctgtcggctctggcaaaacagcacgtggagacacggttcgtgaaggtccacgccgagaaggccccctttctgacagagaagctcaggatagtcgtcctcccgaccctcgccatagttaagaacgccaaggtcgaggactacgtggtcggcttcgacgagctcggcggcaaggacgacttcagcaccgaggacctggaagagcgcctggcgaggtcccaggtcgtcttcctggacggcgaagggtccgcgcacgcttcgaagcaggccgccgccgccaccaaacggagcgtccggcagtcgggcaccggcgactcgtccgactccgagtagctctcgtgtgttgttgttgttgttattattatatatatctaaatgggtacacagcacagacatgttttggttgctatgccaacaggcaacattagcattgcaaggatatgcgtcttattgggacctggaagcaaaagtggttgtggtttgagttgctgtacagtgctgcggcgctgccgtgtggatcacatctgatctgaatatctgattgggtgggtcttgctctagtggttttgtttgccctgtaccgccaggaggac

SEQ ID NO: 17152 - DNA, 3300 bp, Zea mays
  misc_feature (815)..(816): n is a, c, g, or t
  misc_feature (2097)..(2097): n is a, c, g, or t
  misc_feature (2429)..(2429): n is a, c, g, or t
acagagaagctcaggatagtcgtcctcccgaccctcgccatagtaagaacgccaaggtcgaggactacgtggtaagcgaaacgacactcctcctgctagtgattccttagcgctgtatctcccgccctcgccatagttaagaacgccaaggtcgaggactacgtggtcggcttcgacgagctcggcggcaaggacgacttcagcaccgaggacctggaagagcgcctggcgaggtcccaggtcgtcttcctggacggcgaagggtccgcgcacgcttcgaagcaggccgccgccgccaccaaacggagcgtccggcagtcgggcaccggcgactcgtccgactccgagtagctctcgtgtgttgttgttgttgttattattatatatatctaaatgggtacacagcacagacatgttttggctgctatgccaacaggcaacattagcattgcaaggatatgcgtcttattgggacctggaagcaaaagtggttgtggtttgagttgctgtacagtgctgcggcgctgccgtgtggatcacatctgatctgaatatctgattgggtgggtcttgctctagtggttttgtttgccctgtaccgccaggaggacaaccctgactgaccctgtggaggccggtggctttgctattgctgtctctgcgcgtcattgtttgcccatgaatggtggggggcagcggcctcacaatctagggacatgtgcgtgctccggcagattgcctcgtcgtcgtcatcccctgctgcgtcccaatgtactattcaccgccatgaatctaggaccatgtgcagctgctgnnggccatccatgaatagattcggtgccgtgtcctcctgcagcagtgccaccttttcaaccgctgctcactcgtttcgcttccccatcctgtattcctgttgtggaactggtaggtgtacaggcctgacggcagcatgaatgccggcaaattttgaattgcaggctcaggccggtcggttgttgtggcagtgtgaatgcgtttctttgattgtgcgtgccacaactgtttgtatcgggcataaataactggactcgacgcatttaaaccttctatataatctcgtccttttgttacagctggattaaaatctttcgaactgctttagctgcaatcaatagagacaaaatattgtagaaaaaaacataaaccagttgattaaagtcgcagtgaataggcttctggcttttcacactaaagtcctagttggatcctcctagctaattgtttgttggtggcaaacaatcagcctacgaataattagtcggggcgaacgattcaccataggtatgtttggagtcttgactaacagatgtctagaataatattatgttttacctctgcacgaacaaccaattagccgaaagagaaaagaaaaaaggaaccgacaaggtcgttttctcctttcatgatctattagcacctattggcaaggtcaaatggctaatgactgtagcaccccaaaatcatattctaggtatatcggcaaaaaaatttatctcgagacctcaatgaatgtgtttttaaataagagaataaataaagatccttatatgatttaaactatccttgtcaaataatatacatacataaatttgaatatattctctaaaggaattaagttaagtatctcttagtagatattatacattagaaattattttctaataaagtaaatagttaatgaatatcgaattgatcgaatgagcttttaattagactatacattcaaatagtaattatttctgagataaatatttttatgtgtgcactatatatttgaagcaattgtctgcataaataaaataattagtatctgtaaaaaaaaattatactttgcatacatgctggatatttttggtgctgctacatcttgtaaaaaaaattcaaagtttgaaaatttggaatttgaaaataaaataggaaaggaaaatagaaaaggaaaagaaacaaaatcttacctgcgcttgggccaatgccttcgatcacagcccgtgtacacagcccacaattcactcacgtacacacgttttccttttttttgtattatttactcctcttgcngcgcatgatgtcagcatgacaccggcgtgacatcaagctagcaagatcacgttcctgcgcaacagaaatttgttacgaactcccttgatcaccgagttgttgggatttgatcccaagactctgattggatccgtctcaccgccatgtggactgggggcttcttccagctctacccgtaacagccgcgccgcaacgctcggccatgacgccctggtggccgcgatgtgcccctgatccacccgccgcccaaccgaaatactcacccgtcgccaggaagctcggactccccttccatgaaggtcccacacgactgctgtccctgcaacctcggngttatcaaaacagaaaccgtggcgagctcctctacagcaaatcggactccgcccaacagatcaccatgtgccgcgcgttcctaaggttagtcattcaaattgaataactaaccttaagcaaaaaaaagttaggcaaagtgtggcaattgaggcaataaaccaaacatgccttaactccgctacaaactccgatcttcttggtcgacatgagatcctctcggagtatataaacagccacgccctcggcattgcagcagataagagaagaactgtgctccaagtcttgttggtgctccaccgtgatgcctgcttgctccacaggctggcaactccgcaacatattcgcaggtgagaagttccccatgcgattagctgtcgtccctttttcgtgtattgcccttcggattgaaatactgcgctcgggatctcgggttggaaacggccggcgatggcctccgccgtgcgggtgccgccgccgctgcctaggggaaacgcctggtgtatgggacgtaggggagaaggattgaggccatagatcttctaatggacggctctgatctgaagatggtgtatccgtggccgttgatccggtttgggcggccgggattgcattttgtgtaccgattcgctctacgggatctgtaacgtcgatatcggattcaacgagaacgatgtgatcgggtctagataggatccagagcgttggtgatcgatccaatggctgttgaagcataccggttcgatatgtgttagatataatcggggccatagattgtggatcgggcggactgaatcacccgataacccttcactgtggtaactttgttaaagagccctcggattttgattaaaataaccccgcggtcccgtt

SEQ ID NO: 17153 - DNA, 1809 bp, Zea mays
caaagggttgctccgagtcggcaggtcattcggtactccctctaattggcgtagagccgagtagagattgttgtgaaagactaaactagatctaattctaaggctaaattacttctattcctaagaattggaagaacgaaaaggtaaaactgataaatagatttgatttaattgattgtgaggttttaatcggtcgtaaccctttatctatataaaggaagagctacaaattgttttccgaattaatcccacgattttagctaacaaacgtagcaagaaactcaaaacccgtgcgcacgagaaccggctggatcgtccgccttgcctattttagtgctcaatacacacgcttgcttgccctgtgcgccgatgagcacatttattaggaattcccatttattattcgttgaattgtctatctagctagtaaatcccaatcacgcagcagcatgtatggatggggcctgacaagtcacaagtgtacgactggagtagcgcagtagagtggctgccgtgtgcagcttataggcaggcaggcaggcaggcagcctatataggtaacgcagctgtcgaatggaaggcgcaaatccctaattccagaatgaaccagcaagcacaactggttgcggagggaggcgtacgatgagcttgagccacttaccttgtcgagcaggaggcacgtccaggccagagccctgccgctgcggcggcggccgaggtagaggcacttgagcagctgcagcaggtggtagcccgccgccgacgcggccgccatcgccagcaccctgcggccgccgccgcggccgaggtagaggcacttgagcagctgcagcaggtggtagcccgccgccgacgcggccgccatcgccagcacccagagcgcctggacgtccttgacggtggccttcttccggacgagcagcaccgtctccgtctgcgtgctgagccccaccagcagcgcggccgccgcggccagcgccgcgcacgcgccccgcagcagaccctccgccttcacccccgacaccaccctcgccgcggccaccatcgcgcgcgcacagagaccgtcgtcgaccgcagcgcccgcgctggctggccccgctctgatcgtggatatcccctccgccgcaaccagcaggcgcggggcgcgtgaacgctcgcctcgcgcctgaccagtcgcgtggccggccgcgcgcgggagcgggacgtaccgtgtgcgagagcgagagcgagagagagcgagttggttttggcttcgagtcgagtccggatccagatcctcctcggcacggccggtctgccgggtcttatagggcgctcgacatggatcgctgcacgacacgtagcgggacatgctggtgtttgtaccgcgccagccagccatgtcatgctaccgaacagagctgtgcgttctgtgcacagttgacgggatcatccaaaggacacggccgatcgaggggtagcagcagcagtgcgaatgagacgggatcccagggaagacacggctagtacagtaggagttaatggaattcatgaggcgtggcacatgcatgtccgtaatactactactgtcctaggctcctagcctactggggggcggcgggctagcttttgacatggttttacggcaggggattgccgtgtcgtgtcgtgacagggccgggcaggaggtcccgcgaactaatttgttacaagtgtaaataaaacaagctattatacaagaagtgccgccacagcacattcaccatatcaatattgttgttgttggcgtggttgatgcttgaatattgatagatgtgtccctcaacggac

SEQ ID NO: 17154 - DNA, 1430 bp, Zea mays
cccacgcgtccgcccacgcgtccgcccacgcgtccgcgctccatagatttcgccgcaaggggcaacggcacacccaccaactgacctgacccacgagggatccgcagatgaagatcattccggtcccttgcctggatgacaactatgcctacttgtacgaatcagcccgcaccgcttgttttcactactctttcagttgttcgtttcaaatcgttgaattcttgattgctatttgtttcttccgttcgaagaatcgtggacgagagcaccaagaaggcagcggccgttgaccctgtggaaccggagaaggttctcaaggcggccggcgaggtcggcgcctacgtcgactgcgttctcaccacccatcaccactgggatcatgctggtggcaatgagaagatgaggctgcaggtgccagggataaaggtatttggaggatccctggacaatgtgaaaggctgcactgatcaggtggagaatggaatgaagttgtcacttgggaaggacattgagatactatgcctacacacgccttgccacactaaaggtcatatcagctactatgttactagtaaggagggtgaagatccagcggtcttcaccggagataccttgttcattgctgggtgtgggaagttttttgagggttctgcagagcaaatgtatcagtcccttattgttacactgggttcgctgccaaagtcaacccgagtttactgtgggcatgagtacactgtgaagaacctaaaattcatgctgacactggagccagagaatgagaagacgaaacagaaactggaatgggctgaaaagcagcgcgaagcgaatcagccaacagtgccctcgactataggagacgagtttgagataaatactttcatgcgtgttgatctaccagaaatacaggcgaaattcagtgtcaactctccagttgaagcaatgagagaggtcaggaagaccaaggataactggagaggttgaggacacccatggctgccactagtctgttgaaccagcattccgaagtgaactaatgctgaaaccttgccccagtagcgaagctagcaaataatttatcggggtcatcagtattatctactggatctttactatagaacttttgttattaacactgtttttctattagatattcaaaaaattaccggggtcagctgacaccaaaataagggctggctccgcccctgccttgccctgtaggtgggaatgaggtttactgccgtgcaatgctttgataaatgtgttgttgtgaaggagaagactcctacagtaagctccgcgttaatgagtagtaacaatacgctccttgtaacttgtggtctgtttgccaataataatgtacgaactgtagtgcctatcttgaaaatatgaagagctataatgggtttaaaaaaaaaaaaaaaaggccccta

SEQ ID NO: 17155 - DNA, 2885 bp, Zea mays
  misc_feature (607)..(607): n is a, c, g, or t
  misc_feature (756)..(756): n is a, c, g, or t
gcgaggtgctggccttagcttaacggaggtattggatgtcgcctccgttaatcatgctatggtccatgactaagtgtacgcctctattaatggttaatggaggtgatcaccataatatattcatctcctttaatactagtattaagttttagtagtcgactagtcgggctttatgcttgtgttattggtggtattttggtccgatggtttttttttgcctagttttcactcaaaaaaatggattgacatttttttatatacaaaattcatgtaagtcttctgacgtcctttgaaaggaattatcgtgatcttttttctatctgttggcagctatctgggtgccaaacacgggaacggatcgcctggcgggactctctgtggaggcacggacggtccacgacacaggtccggacggtccgcgacctgacgcaggagcggctccttctctgtacacttccggaaggttcgcgatagcgtagagagtctttttctccgcgaagaaccctagaactcgtcccaggagagatcccgtcgaggaggagagttccaaggggttgctctgggtcgacagaccgcccggtgctcctctaatcggcatagatttaantagagattgttgtggaagactaaactatatcttatcctaaggctaaattactcctactcctaggaattggaagaacgaaaaggtaaaactgataaatagatttgatttgatcgattgtgggggttcgcccttcatctatataaagaganaggtctgaacccgttacaaaccaaactctcgagttaattccgcgaatttagctaacaaccgtagcaagaaactcggaatattaattgattctttacgcgcgcggaccgtcggtctcagagtcagactgtctgtcctacctattttggtgctcaaaactatctagcttaagaatttatttgatccgatgaacggtagagacatagggctaattaggcctgctctatttttctcgtgttcttttttagttttcatctctcatttgtatagtaacataaacatttattttagttggtatacatatgtatttcgtcatcatgaaccatcgataggaaggcacaatcagagacatgttttggtcggttcatgtacttccagaatagaatagcacaaaatccaaatccatataccttagcagtctagcacacagcaagaacacagggaaaaatcccctaggatatgacgctgacgcgtcacctcgactcgtcggtgcaattacgaacgcacctgcaactgcaagtctgcaacctaagcgtagtgctgcagcaaccgctcggcctccctcacaccgctcaggtacgcggcgtgcgtcgtcgagtagtgcgtccggtgcgtcgcctcgccggcgaacagaacgcggggcggcggcgcgcgggcaacgtcgacgtcggcgtccaaccggcgtggcagcggctcggccatccggtcgaggtcctcgccgctggacccgacgggcacgtaggtgtaggatcccaggaagagctggtccgtggcccacccgctcctcttgatccgcttcaccctccaccgtgacggggccgggaggaaggagtccagcgtggagtgtaccccgcggatgacctcgtcgtcggggagagactcgaggtgctcggcctcccgcccggcgaaccacgccagcgccacgctggagcccgcgtggacggggcagatcgactcggtgccacgcatccaccacgggatctccgacacgtgcccccggaaagccatgtgtaggaacgggaactccggtggcgcagacgcggctagcgggtgctcgccgccgccacctcggtcgccttccggtctcgccgctggcacggcctccagctccatgaacatcttgttcacgacgccgaagccgagcctcgcgacggcctcgcgcttgaactgcgggagcggtgggtcgaaggcgatgccgcccgcggcgtgggcgtccttaccaaggctcgccttgaggccccccagcgacaccgtgaggatgacgtggtcggcggagatcgccgtcgcgccatcgtcgaagtgaagtcgcaggggggtctcgctccagtcgaggcggcggaggcggaggccgaggcgaacggtatccggcgggagcgccgcgacgaggtggtccacgacgcgggagtacccggcagggatcgtgacgtgctcgccggggaagtcgcggtactcgccctcggtggcgaggtcgaggtcgccgaggtcgtcggcggaggtgtccgccctctcccggttgatgtgcatggcgagcagcgcgtcctcgacctcctccagctccttgccgccgcccggtcgcgccgcctggaacgctcggaggccgcgactcaggtactcctcgacgccacctccgctgccggcctcgccggcgcgcgcggcctccatcatgcccctgtacagctcctcgatcggactggccacccggtcggcgtcgacctcctcgccgccctcggcgaccgtgagcacgcggccggggaacccgtccatgcgctcgtacgggagaaggtccttgccgcaggcgagcgcgccggcgtcgcgcgcgagcgcgtacacggggctcccatcgaccccctgcacccacgtggcgcccatctcgacgcggtggccggcgaactcggacgtgagcacccgcccgcccgcgcgggcgccggcctctacgaccgtcacctcgaacctgtcgccgcctgcagcgcagagccggtgcgccgctgtgagcccggccacgcctgcgccaactacggcgatccgcggcttcgtggccaccattctcgctcggtcgttacacagcggctcggtgcctgcgggcgcgtgtcggtgtcgcacaccggacacaatgcaagtgtttccccccgac

SEQ ID NO: 17156 - DNA, 5913 bp, Zea mays
  misc_feature (2167)..(2167): n is a, c, g, or t
agtctggtaccgccggcaaagcagtcgttttcgtcctcttccttgattaaaccttccgtacccatatccacctgctgctccgaccttccagtcttctccgtaggggcttcgctccatagatttcgccgcaaggggcaacggcacacccaccaactgacctgacccacgagggatccgcagatgaagatcattccggtcccttgcctggatgacaactatgcctacttaatcgtggacgagagcaccaagaaggcagcggccgttgaccctgtggaaccggagaaggttctcaaggcggccggcgaggtcggcgcctacgtcgactgcgttctcaccacccatcaccactgggatcatgctggtggcaatgagaagatgaggctgcaggtgccagggataaaggtatttggaggatccctggacaatgtgaaaggctgcactgatcaggtggagaatggaatgaagttgtcacttgggaaggacattgagatactatgcctacacacgccttgccacactaaaggtcatatcagctactatgttactagtaaggagggtgaagatccagcggtcttcaccggagataccttgttcattgctggcataccagctcaaagaactgggttggctcatcgtttgattgtcattcaagcatgttttataataagtaaacttatgtgggacccatgggtgactcaggagtggtttgcatgtgaggcttaaatagccgaattctgtgtggggacagaacattattatgcaatagaacagtgagtgcaggaacctttcgtcggcgcattatccctctcaatttctcctgtgtctcatgccttggcgagtggttgtcggcaaacaaggctcgtgacagctggtatcagcgcagtgtaggtggcaggattattttagaaactatgtagtacaacaataaccattgccaaagttgtatgaaatttacacaagtcaccatctccaaagtcatatgaaaattatggactcaatagaataacagttcactttagaaattttgctgttctctttggtagacacattcttgtattcttggaatctccatgcaactgatgagtggcatgaccatgtcattaatcctgagaaacttagttgagctctttgataaaatctcaatttagtgtgagccttatatatgtgttttctctgtaaaatcttgttgattaggtccctatcatttttctttcaacagccacactaaaggtcatatcagctactatgttactagtaaggagggtgaagatccagcggtcttcaccggagataccttggttagtatacacatctttcttagagcgatggtttcctttggttgttatatcataacctttttttttttgaaatacagttcattgctgggtgtgggaagttttttgagggttctgcagagcaaatgtatcagtcccttattgttacactgggttcgctgccaaagtcaacccgagtttactgtgggcatgaggtacaatctcttttttcagtttcattaaggaggaacctgaatgctagtggaccattgaacctgtatggtggatgtatataaagtaactgtgtctccctttgtcttgtaggatgtaaatattgtattgcatcttctaagaaaatttatattatcaatgactaaaggacatatgtacaaatctactttcttctgtttcatgttctcaggaataggcagtttccatattgattgactgtttattgaatttcttttgtagcagattctaaattctgtgatttgttgcatgtcttattttaatacatttatgctggttggaatgttatccaacagcaaggagttaatatagagatatgatgctcacatgtgcctccttttgttgctagctaatagagtttatggaattgtatatatgtggcatgcatgtttgttagttactaggctcgtcgtctttccattcatgctatagttttggtaacaggtgcttgagctgttcatgatcttttagtttgcttggttgaattttagctctcgagttgtaaaagatgatgtcaattttgattttgccaacaagaaagaaccagtaacatttggttgttttgtttatctttccttaatatggtatactaatcgtgctggcagaggcatactgtgctctttatggccttacctcaccttttngcttgttgagttgcagtacactgtgaagaacctaaaattcatgctgacactggagccagagaatgagaagacgaaacagaaactggaatgggctgaaaagcagcgcgaagcgaatcagccaacagtgccctcgactataggagatgagtttgagataaatactttcatgcgtgttgatctaccagaaatacaggttaatctcctcacttggaacacatttcttgcactgcctcccacattcatgcacagagttggttgatgtctgtgaatgaagagcgcttagaaggagttttcttcttgccgatcacaactacgtcatcaagacatctctcaattggttatccctatgaatctttcaggcgaaattcagtgtcaactctccagttgaagcaatgagagaggtcaggaagaccaaggataattggagaggttgaggacacccatggccgccactagtctgttgaaccagcattccaaagtgaactaatgcagaaaccttgccctgtaggtgggaatgaggtttactgccgtgcaatgctttgagaaatgtgttgttgtgaaggagaagactcctacaataagctccgcgttaatgagtagtaacaatacgctccttgtaacttgtggtctgtttgccaataataatgtacgaactgtagtgcctatcttgaaaatatgaagagctataatgggtataacctgcctgcattttatatttattcagggatcatcagtatatggattatgatcgatggatacagatgataaagatggatgagctgctatgctttcactgaagtttcttcttgccggaatcatttgacgccgaaggcttggagttcagcttgaacggacgtgctgaagaggcggcgaactggccgaagcccagccggccggggaccaacttgggcggcgcgaacggcccgcacgcggcggccgatggctcgctcgcgctgctcttcttcccgtgcccagtctcggccgtcgttgcagcgccagcgcgcgcccgggcgtcgtcggcagccttggccggttgcgcgcttttctctggctcatcttggccgaacattttcttggctctgctcaagaacgcagcgggcgtgcccatgagcacgaagagcttgagcacctcgtccgtctccagcttgcactccggcgccgccgcctgctgatctgacgacgtccccggctccgcggcggcggcgcccggaggccggggcgacggcgggaggaaaccggcgctgggagcgaagccgttccagcactgcgggacggggcagtgcctggcccgcgcgacgcactcgaggctcctgaactcggcggccacgcgcgccttcagccccgcgtgccgcacgaagcgctgcaggctgcctcggaacgtctgctcctgcggctgctgcacggtttgcgttgcatttgcaccagaaaaatgcttcagaatagacttttggccacccgaactcccccagtggtcggtcagtgggtcttacgtctctgagtgtaacgtgccggccttggaagaccggcgtcgccgctatctcccgccagccttgatcggcagcagcttcgtcattgtaagtgagccttcttcgagccaccagaccgcggccgccgttaaagcccgccgttgctgctgcgtctccaatggatcggaacagcgtgtcagctacattttgtttcagtgttagaactcagaaacagcgcaggcttacggcaaattgacaccttttctcgccctctttcccggcggcgtgggcgccgtggccttggtctccctggcgccgcgcggcctccctctctggttccccgtagcgttcccgccggtgcgggcgtcctcctgcttcttcgtctcggcggcgctcctcttcctcggcgtggcggcggacggctgcaacagcggcgcagcagccgtgtgacgtggtggtcccctgccgccgccctctcttccctccggcgtgatcggctgctgcatctggtccgcgtgcctctggcgccacgccgcgagctccgactccgagaacatctggttgctcctcagggacatgaacaccagcttggcttgatccagcagcgccatgccctgcaggcagctaggcgacctgctctctagcctttggctcctcgcatcttgcctgctaacaagaggtaggcgagcgacgaaattaacctctctgaaaggcacggtgtcctggctgttcatcgttatcgctttctggaacaccatgtaaacatcgttctgcgatcgcattgtgaagtgagctaagatcgtggatggaaattaaaaccgtaaaattgttcaagaaacggacctcgaattgctccagtgccgtgtacatgccatccctgttcttctgtctcagtgtcgcgaagtcaccgggcctgctcaccagctctgcataatcagtcacctgtagcagcatgtcgtcagtcttttcgcttgaaacaagaaacaggcgcatcaattaaaaaacagcctctccctctacgcgaatactccagatctaccatttcttacctggatgtcgtctggcattgcaaacagctcatgcctgtctctcctgaaagagacgaaaggacgcatcatcataataggaaaccacgcggtgcctgacggacaagccaaaagaagggagcctaataaagcttacatctccaactcgtcaaggatatactcgatgatctgtcctaccgaggtttggcttggtaagctatctgaaacaaaacaatgtgaaactcgcatgtctacgcaggcaatgcaccagtaaccgatggagataccaaagaagcaaagtttccgcactgctgtttcctgcatacagtggctcctggcggctgcaagaagcttctccctgcggctgcttcaaaatcatccgggccggcagatgagaaccggaggaagaagctacacacgtacgattattcgaagagagttgaaagcagccagcaatggccgcagattgttttttttctctctctcttcctttttttttttacctggattccttcattccttttccttttccctcgcgcgctcggaccggaaatgctgttccggatgatctgccaggggtcaaggaagcagacggcgccgccgtcgttcttctgctcttccagcttcaacaatctagcgcttcgcctcttcccttttccagacatctctgctggccctgtggtgcttccttcctcggaacgaaaaggggagagagagagggaggtgctacgatggtgacaatgcaatgcatctatctgcatccaccttctgtgtgcactgactactacgtcgcgaggtagaggagagagggtttcaattctactacagctggtagctgatcacgtgcatccatgcatctgtgtccgttcgtcctgaaatagaatccctctttcctggagagaagaaatgaggtttttaattgggctgtagaggcgcccggaatgcgtctgggccttttaaagcctgcagttttggtgtgacagattattatagacaggagcaatgcagcacaagctgtgaggagtgatggaccggagacaaacggcacgggatctgaagagaaatagacagctccacgcggtccagaaattcacgtcagaaatgggaggagctggactagcatccccagatagtatttggtttatgaggctattttgagcatgcatgtaagcgctacagtttattcttcttctcgtcccccatatgttgtagagtttttcttcatcaaaatgtaatcctgctagtagattaaaaa

SEQ ID NO: 17157 - DNA, 1319 bp, Zea mays
agtctggtaccgccggcaaagcagtcgttttcgtcctcttccttgattaaaccttccgtacccatatccacctgctgctccgaccttccagtcttctccgtaggggcttcgctccatagatttcgccgcaaggggcaacggcacacccaccaactgacctgacccacgagggatccgcagatgaagatcattccggtcccttgcctggatgacaactatgcctacttaatcgtggacgagagcaccaagaaggcagcggccgttgaccctgtggaaccggagaaggttctcaaggcggccggcgaggtcggcgcctacgtcgactgcgttctcaccacccatcaccactgggatcatgctggtggcaatgagaagatgaggctgcaggtgccagggataaaggtatttggaggatccctggacaatgtgaaaggctgcactgatcaggtggagaatggaatgaagttgtcacttgggaaggacattgagatactatgcctacacacgccttgccacactaaaggtcatatcagctactatgttactagtaaggagggtgaagatccagcggtcttcaccggagataccttgttcattgctgggtgtgggaagttttttgagggttctgcagagcaaatgtatcagtcccttattgttacactgggttcgctgccaaagtcaacccgagtttactgtgggcatgagtacactgtgaagaacctaaaattcatgctgacactggagccagagaatgagaagacgaaacagaaactggaatgggctgaaaagcagcgcgaagcgaatcagccaacagtgccctcgactataggagatgagtttgagataaatactttcatgcgtgttgatctaccagaaatacaggcgaaattcagtgtcaactctccagttgaagcaatgagagaggtcaggaagaccaaggataattggagaggttgaggacacccatggccgccactagtctgttgaaccagcattccaaagtgaactaatgcagaaaccttgccctgtaggtgggaatgaggtttactgccgtgcaatgctttgagaaatgtgttgttgtgaaggagaagactcctacaataagctccgcgttaatgagtagtaacaatacgctccttgtaacttgtggtctgtttgccaataataatgtacgaactgtagtgcctatcttgaaaatatgaagagctataatgggtataacctgcctgcattttatatttattcagggatcatcagtatatggattatgatcgatgcatacagatgataaagatggatgagctgctatgctttcactg

SEQ ID NO: 17158 - DNA, 1131 bp, Zea mays
aacatgtggccaccggcccggccgggagcgacacctcatcgcctcgccctcctaccacgacaactcgtacgtccggcccggatcacctcccgactcccctccacgccttggaatgctgctgcctgcgcagacgctaacacacacgtttcccatggcagcgtccacggcctcgcgcatcttcacgcccatcctccaccggcaccagcggcgcacgaaggcagtcgtggtcgcagccgcgagcccgcccgacgccgaaccgactcctgcgacggcggacggtgcagggccggggaagaagaagacggtggacaccaggatacactggtccaaccccgacgaagggtgggtaggaggcaaggccaagaaggaaggcgacggccgcggcagcagcaagaacgagccgttgggagggaggttcgcggacctcatcaacaacgcggccgagtctcactaccagttccttggcatagcgccagaggcggacatcgaggagatcaagacggcgtaccggcggctgtccaaggagtaccacccggacacgacgacgctgccgctcaaggtggcgtcgcagaagttcatccgcctgcgagaggtgtacaacgtgctgagcaaggaggagacacggcggttctacgactggacgctggcgcaggaggccgagagccgccgcctgcagcagctcaggtccaggctcgaggacccatacgagcaggacatcatcaactacaaacccgtgccagacatggttgaccgcctcggcggcaagaacatgaagcttagcgatcaggccatgactgcgctcaccatcgatatcgttatcatcatcatctccatctgctgcatcatctatgctgttttcttcaaggagcagtactgacagcagcataccagcaacagcagcaaggttgcaggagtgtaccatagacagaacattataggtaaattaactgataatgccctaagattgtcttttgggatgttatcatgcactgcatcatgtaatgtccaatagaataaggtaggaacgacgattattcatggtttgttgccaacaatcctatatttgcataatcaaatcataattccagtataaaaaaaaaaaaaaaaaaaaaaaaaaacccaccgagggcc

SEQ ID NO: 17159 - DNA, 1243 bp, Zea mays
aacatgtggccattggctaagtgaacagcgacacctcatcgcctcgccctcctaccacgacaactggaacgtgcgagcctcatcacctcccgactcccctccacgccttggaatgctgcctgcgcagacgctaacacacacgtttcccatggcagcgtccacggcctcgcgcatcttcacgcccttcctccaccggcaccagcggcgcacgaaggcagtcgtggtcgcagccgcgagcccgcccgacgccgaaccgactcctgcgacggcggacggtgcagggccggggaagaagaagacggtggacaccaggatacactggtccaaccccgacgaagggtgggtaggaggcaaggccaagaaggaaggcgacggccgcggcagcagcaagaacgagccgttgggagggaggttcgcggacctcatcaacaacgcggccgagtctcactaccagttccttggcatagcgccagaggcggacatcgaggagatcaagacggcgtaccggcggctgtccaaggagtaccacccggacacgacgacgctgccgctcaaggtggcgtcgcagaagttcatccgcctgcgagaggtgtacaacgtgctgagcaaggaggagacacggcggttctacgactggacgctggcgcaggaggccgagagccgccgcctgcagcagctcaggtccaggctcgaggacccatacgagcaggacatcatcaactacaaacccgtgccagacatggttgaccgcctcggcggcaagaacatgaagcttagcgatcaggccatgactgcgctcaccatcgatatcgttatcatcatcatctccatctgctgcatcatctatgctgttttcctcaagggggcagtactgacagcagcataccagcaccagcagcaaggttgcaggagtgtaccatagacagaacattatagctgatacaccagctgcccactggtgaagaagagaaggatggcgaagcccaagaggaagcaccatgctggcctacgagggagacaagggtacaaggctcaacctgtgatatcttggtttggtccaagtggatcaacaaatgaaccatactgtgaggacatatcaaatatgctcgtccgttgctacggatgaatagcacatggaactgatcatgtgttgatcctatttctatatcccatcccctgtgacgagtgttcaaataagtggagacacagatgacttcccaaaaaaaaaaaaaaaaaagcggcc

SEQ ID NO: 17160 - DNA, 2161 bp, Zea mays
caggccggccgggccgggcctgaccagaccaaaggcaggtccaatgcagcttcctcctcgtcttcctcctccacctcagctgctcatgctcctcccagtcccctcctcctgcccccaatcctcttccgcccctccctcgggcctcttccccatctcctgatcacactcgctcgcgcgccatgggcggccgcgcctcccgccaccgcgcgcagccgcacgaccagtcttctcaccctcctcctcggccgccgcccaagcagcagcagcagcagcagggccagcagcatcccaacaaccgccccaacaagcccaagcagcagcagcagcccccacctccacgtcctccgccgccacaccaggctccccccgcctccgccgccgccccgggcgcggccaccgtcggccgcgtgctgggccggccgatggaggacgtgcgcgcgtcctacacgttcggccgggagctgggccggggccagttcggcgtcacctacctggccacgcacaagcccactggccaccggtacgcgtgcaagtccatcgcgacgcggaagctcgcgcacagcgacgacgtcgacgacgtccgccgggaggtgcagatcatgcaccacctcacgggccaccgcagcatcgtcgagctccggggcgcctacgaggatcgccactccgtcaacctcgtcatggagctgtgcgagggcggggagctcttcgaccgcatcatcgcgagggggcactactccgagcgtgccgccgccgccctctgcagggagatcgtctcagtcgtccacagctgccactccatgggggtcatgcatcgggacctcaagcccgaaaacttcctcttccttaacaagagggaggactcgccgctcaaggccacggatttcggactctccgtcttcttcaagcccggcgagcagttcagggatcttgtcggcagcgcttactacgtcgccccagaggtgctcaagcggcgatacggagctgaggcagacatatggagtgccggagttatcctctacatcctgctatccggcgtccctcctttctgggccgagaacgaggatggcatatttgatgctgttttgcgaggtcatattgacttcgcatctgatccctggccttccatatcgaatagcgcaaaagatttggtcaagaagatgctgcgccaagaccccaaggagcggcttactgctgctgaaattctgaaccatccatggattagagaggatggagaggccccagacaagccactagacataacagtaataagcagaatgaagcagttccgggcgatgaacaagcttaagaaggttgccttgaaggttgttgcagagaacttgtcagaggaagagatcgtgggcttgaaggaaatgttcaaatccctggatactgacaacagtgggacaataacgctggaagaattgagagctggtttaccaaagctcggcaccaaaatctctgaatcagaaataaggcagttgatggaagcagctgatgttgatgggaatggcaccattgattatgttgaatttatatcagcaacaatgcacatgaatagactagagaaggaggatcatatatttaaagcattcgagtattttgacaaggaccatagcgggcacattacagttgatgagttggaagaagctttgaagaagtatgatatgggcgatgaggcaacagttaaagaaattattgctgaagtagacacagatcacgatgggagaatcaactaccaggagtttgttgccatgatgaagaataatagccccgagattgttccaaatcggaggcgcatgttttaagaaagacttctaagatatatttttccgcggtcagaggggagagcaactgatattcgaaagtgggattcagtctgggcatatgtgcaagatattacagactttggacaagtcatcagtcatgggtgattgcctttgtgttgcttccattttcgaccatctcatcctacgatctttccaagttatctttaatgaggtgtgtcgtgtggtctatgtttcctgcctctggatcttttatgtaagagaaacggacttgtaaaacagttccaaattatcatataccaggcgaaaagtaatgcgatgggacttgtgatcctcttttttttaaaaaagggcggccgctcgcgatctagaactag

SEQ ID NO: 17161 - DNA, 715 bp, Zea mays
  misc_feature (77)..(77): n is a, c, g, or t
gcttgtgtgcatgttttgaaacagcctctttcccgaggaagctgaacgaggaacatattcagctccatgatgacgcncagcatcttcagtgttcagtatagacctgagcgagtgacgctcctcacatctgggattgcgttgcccttgtgatgaatagcttcaaacagcaatttgcaatttgccggtggtccatacgtgagcttgctatcacactcattagtagtttccaaattgttttcatacgattgctcattgcgtagttcagctggggtttcagagatagtgccgcatagcttcaggtaacttgcctcgcgtctgagctcctcatcgattccacacccgtcagccaaatcctcatgaaatcgtccgtcccttactaagccttcctcatcccagatgacctccgcggcccgatccccgcgcacgagcgcatctcggcggccggagccgcggcgggggcgcgcgccgaagcacgagcggagacaggccaggatgacggcgtcgaggaactcgaccacggccctcgcgatcgcctccgcgcgccggcgcatcgcggagagcccgcggcgtagggcggtggccgtggcttagggtttggtttagctgcagcgcgggcgccggcgccgcttgtgggggggtcgcggcggagagagagagacgtacacgtacgtaggccagcgaggtgaggggggagatgcgtttgaaatcccggccg

SEQ ID NO: 17162 - DNA, 2034 bp, Zea mays
  misc_feature (3)..(3): n is a, c, g, or t
  misc_feature (8)..(8): n is a, c, g, or t
  misc_feature (16)..(16): n is a, c, g, or t
gcncgagnccattacntagaacatcctaatcgaaaaaagatgatgccgttgtagagagatggatcaaagtggggcaagaggtacatacatacctcaatgatgacttgtgcacatacatacccggaagtttcacctgcacaagaggctgacgggtaacagttgtcacaatacgtgaaaaaatatagactttcagatgttattaacaagaaagtggtgccatatgtatgtaacaattttcttttcatgcctgtatgtgacacataaggccttgaagcctgtattcagacacaaatacatagaaaacaaatgtacgtttcactcatgtcagtgctggtgcgaccatagagtgagctacagaccggtgtgcttgtgagcagtgagccaacaatgctgcatgcatgacggtacagtaactcatattcacaacccagctcaaactgtcatttatacacagcatcacaccccaacagaaattatgctatttgtacacggcaccttcagcagcatgcatgacggtaccagcttctgagctcagtttcataacaggtcgctggcagcctcatcacagttgggctaatatgataaccctgcccgctactcagctgtctcctcgagatggaacagcttcccccggacgactttccttggagggcaacggtcctcatcagacaacaccttcagcagtctttgttcaaatggcgtggtgtgccaactgaccctctgatcctctctgtatctggtcgttgtgttggggataccgttgccatcccatgccttgggcaacctaggagtagggttactggtatccaagttgagatcaggtgcaaccatgaagacaggcttctcagttagaaagctgcagtcttcatcatcttgattctcagcatctgcggaggaagatttcagccagcgggacaggctcagtgcagcgttcttttcatccgagttggattttgacagtgattcttctactccatatgaggcattaggatcaggtgcagaatatgatggagtttcagacagtcctgatttgaccactgaagttgaagacgcttgggttggatccttggtagaatctgctcccaagtctctctcctttagaggatcggacgatgccaatggtgaagagtcttctgtcagttcaatctgctgaagtctgttctcgatggatctgaggacagggtatatgaattgtttccgagtccgcacacgctttccagatatagaggtccctctgtgtgaagcgtatgctgtcccaggggtctgcatgtcatccctgagaactagaggagttggaaacggcgaaccaccagaatcaagtggcttgtgttgcatgttttgaaacagcctcttttccgaggaagctgaacgaggaacatattcagctccatgatgacgcccagcatcttcactgttcagtatagacctgagcgagtgacgctcctcacatctgggattgcgttgcccttgtgatgaattagcttcaaacagcaatttgcaatttgccggtggtccatacgtgagcttgctatcacactcattagtagtttccaaattgttctcatacgattgctcattgcgtagttcagctggggtttcagagatagtgccgcatagcttcaggtaacttgcctcgcgtctgagctcctcatcaattccacacccgtcagccaaatcctcatgaaatcgtccgtcccttaccaagccttcctcatcctagatgacctccgcggcccgatccccgcgcacgagcgcatctcggaggccggagccgcggcgggggcgcgcgccgaagcacgagcggatgaaggccaggatgacggcgtcgaggaactcgaccacggccctcgcgatcgcctccgcgcaccggcgcatcgcggagagcccgcggcgtagggcggtggccgtggcttagggtgtggggacgcggcggagagagagagatgtacggcgccgcctgtggggggtcgcggcggagagagagagacgtacgtaggcgagcgaggtgaggggggagatgcgtttgaaagtttt

SEQ ID NO: 17163 - DNA, 2160 bp, Zea mays
  misc_feature (306)..(307): n is a, c, g, or t
  misc_feature (332)..(332): n is a, c, g, or t
ggtgcgagcagcatgtaaccgttcgaatgcaaaattagatgacatagtcaggctccttgatgatctactcacagagtatgagtcaatggcctatggtcctggaaaatggaaaaggctagccacattcttacagcagtgtttggctggccctgttctggaccttttcagaagacagttagagcatatagatgctgaaaggaacgccctgagattgaaatgcaattcaagcgatgataagttggcattgctgaggaagcagcttgaagcaagcgagagtcacagagctgagtatgtgaggcgctatgnnaggaagttctgaatggataaacagnaaaatttccaaggattactctattcgtataactgaacttcaggccaagagtagcaagttggaacaacggtgcttgagcttgtcttcttctcttgaaactgcaaaacgagaatccaatgattggaagagcaaatatgatcatggtattttgcagcaaaaggcagatgagagtaagttaaaatctcaaattgcttccctagagtctagggtgagtatcagtgagggtagattatcggcaacacgtgaacaggctgattctgctcaagaggaagcatccgaatggaaacgcaaatatgaagttgctgttagtgaggccaaaacagctctgcagagagcggcggtagcacaggaacgcacaaataagaaagtgcaagagagggaagatgctttgagggtagagcttgctaaccgactatctgagaaggaagagaaaattgcaagattacatgcaaaacttagtcaaatggaaattcatgctacaagtttgatctcgaggcttgaggccactgaagcgaagtcgaagagccatgagtctgattcgttggctttgagggaggagatcagattactgactgataacctggagtctattagaagtgaagctctgtcacgtgagaaggaagttgggatcctggaacaggaaaagaaccatcttgaggagaagtatttgtcacagtgcaaaaagtttgatgagacagatattagatgcaaggaagctgaaagggaagcaaaaagagcaacagaattagctgatgtagctcgtgtagaagcttctgctgctcaaaaggataagggggaagctcaacggctcgcaatggagaggtttgcactgatagaaagaatggagcgacaggttgaagctctagaaagggacaaggctcagttggtagaagagattgagagacttcatcagtcagagaaggatgctgtgtccaaggtcgcattgcttgaaagaaatgtcggtgagcgggaaaaagaaattgatgagatgttgaagcagaacaaccagcaaaggtccagcacagttcaagtgcttgagagtctgctggcaacagaacgtgaagcacgtgctgaagccaataagagggcagaggaactgtcgttgatgttgcaagcaactcaaggcaaactggacatgctccaacaagaaaccacacttgatagcaagctcaagacctctgcaaggcgcttaaggggtgatgctacagagtctgtacatgatatggatatcgatggggacaatgggaggcgccggaaacggtcaaaaagcacaacaagcccgttcaagaacaatcacacagaggatggcggttccgtatttattggcgaagatacttacaacgggagtcagcaagggacagaaaccgaagactatactaaattcactgtgctgaagctgaagcaggagctcaccaagcacgggtttggtgctcaactactccagttgaaaaatcccaacaagaaggatatcgttgccttatatgaaaagcatgtcgtcggcaagtagttcctcggcaatacttgtatttatgctttatagacttccctctgtagcgttgaaactttaattgacacgatcggattgaagcgaaacaatgcatgtaacttagtttaaatctctggtctgtgtattgcaacaatggtgcagttcattttagcatgcatcgtcggcaagtttgtagttaggagtcgtgattgaaatgtttgtctttccaatcccggcacaggttttcttgtaatgctatgacgacaatctattcggatcccatggttttgtggtgtaattttatgccatcgatcttttcagattcaaaaaaaaaaaaaaaaaa

SEQ ID NO: 17164 - DNA, 1276 bp, Zea mays
gcttgcatgcctgcagttttaggagacaccactagagttcgtcctcctagatacaaaaggaccttgctggttatggagaggtcagttgaaggctggaggattgactatgttcgttgttttttatatgttatatatggctgttctgatgtcaattaatggtgggtgaagattgccaccggactaattagaaaaatgttgttagctggatcaggtgatgttttggaggaatggagctagatttaagcattttggaggtggattgaagctttgactggactccaagttcattgcatctggagaacatcgtttggctctgcctctcttttattggtgctcctaaatttcttgttccttacacatttgggatggcggttctctacttctacagcaactggattgtatggacggaggagcctgaattagattctgtttctgcatgagcaataagttctgaactgttcaggattcccttcgtttgctgtcaaggttcttcgaaacttttgctgtcaatggtcttaaaaatttacttccctcgtaggcttttcatgttctggtactggatgtgcagttttgggaggcattgctacagagataggacttctagctgaaattgttgcccattgatcacgctttatcctattcctaagttatttgatgaatgttcatgctgtttgtgttctcagttgtcactatcaaataggtagttatccgagggtggtctcattgactgcagatctctaggtgatagctgggcatgaaggaaccagtttgcatctattcagacctacaaccttcaacttgcattgtgtttgttcagtgtcttctaccttgaagtagataatgattagggtcattattgcaggtcttactgatatttttttttgcttgggcttgtcatcgtggattatgtgttggaggtactaacttattcttgtatatgaaccatgatacttgtgagactgcttcgaacctgttacatggtgacttgagagctattgtaccagccctgcttcaaactcgtgacatggtgacttgagacctctctcgcatttgtaccaggccagtcctttatgaaccagaatactacgttaatattcagatacttctaatttaatctgcagtggtagaaggtaatgatcatgttttaacttcagagattcaactggagatcactagaactacagtactacaacttacatttaatcaagcttgtttctgctttatcatgctatgctctgactgaagcattaattcttgtgctgctggtattctggtt

SEQ ID NO: 17165 - DNA, 1376 bp, Zea mays
ttaattcggcacgagggtgatttggaggtagatttaaacattttggagggggaccggagcccccccctggactgaagtttattgcatctggagaacatcatttggctctacctctattttattggtactcttaaatttcttgttccttacacatttgggatggtgattctctacttgtacagcaactggattgtatggtcggaggagcctgagttagattctggttctgcatgagcaataagttataaactgttcaggattcccttggtttgctgtcgaggttgtgcgagacctccgcggcccccccccccccaaaatttacttccctcgtaggcttttcatgttctggtactggatgtgcagttttgggaggcattgctacagagataggacttttagctgaaattgttgcccattgatcacgctttatcctattcctaagttatttgatgaatgttcatgctgtttgtgttctcaattgtcactatcaaataggtagttatccgagggtggtctcattgactgcatatctctaggtgatagctgggcatgaaggaaccagtttgcatctattcagacctacaaccttcaacttgcattgtgtttgttcagtgtcttctaccttgaagtagttaatgattagggtcattattgcaggtcttactgctattttttgcttgggcttgtcatcgtggattatgtgttgggggtactaacttatccaatttactaattcttgtatatgaaccatgatacttgtgagactgcttcgaacctgtgacatggtgacttagagcaactcccgctattgtaccagccctgcttcaaacccgtgacatggtgacttgagacctctctcgctattgtaccaggccagcccggtacgaccctccatgctatcactatgttaatataatattcagatacttctaatttaatctgcagttgtagaaggtaatgagcatgttttaacttcggagattcaaccagagatagctagaactacaacactacaactttcatttaatcaagcttgtttctgctttatcttgctatgctctgaccaaagctttaattcttgtgctactggtatttctgtgttctgcagatcatttagctcaagtaattggtagttcaattgtgataagtaggctgagcaaattgtactgctagtgtagtttgttttgtttgatttgtgtgggcacacttgaaattggcgtgagtctagtaacataagttgtgtcattttgctcagaagccttacatatgagttctttctggttcatctgatgtccacactgagtttatctgatgtccacactctgagtttatctgatgtccacacactgagttttggcaattaatttgcctgttta

SEQ ID NO: 17166 - DNA, 1209 bp, Zea mays
cggtcggcagccgggtcccgggcgcctccggcgcaacaatcccgacgcgaatcgcccagaacgcgaggcggaatttcccatcctcttggacccccccccccccccctctgttcttcctccttccccgctcctcgtccacacgctccgctccgattccgcccgcgtccgcggacccagatctggcgcccgcgcccatggcgacgcgcaggcgaatgctcctcaaggtcatcatcctcggcgacagcggggtcggcaagacctcgctgatgaaccagtacgtcaacaacaggttcagcaaccagtacaaggccaccatcggcgcggatttcctcaccaaggaggtccagatcgacgaccgcctcttcacactgcagatatgggatacggcaggacaggagcggtttcaaagtcttggtgtggcattttataggggagctgactgctgtgttcttgtatatgatgtcaacgtatccaagtcatttgaaaagctcaacaactggcgtgaggaattcctaattcaagccagcccatcagacccagagaatttcccatttgttgtgcttggtaacaagatcgatgttgatggtggtaacagccggactgtttctgagaagaaggctaaagcatggtgtgcttcaaagggaaacatcccctactttgagacgtcggctaaagagggcttcaatgtagaggctgcatttgagtgtatagcgaggaatgctgtaaaaaatgagccagaagaagatatgtatcttcctgatacgattgatgttgggggcgctggaaggcaacagcgttcgtcaggttgtgaatgctagaagatatggagcactgcgaattgctcggttggttggtctgattctctagggcttgttgtttgggtggcctgtgtcatcatttcatatatgtatttagtttgcaaaactgctatttgtggacactggatagtttggaagtctgcatgcgggtgcttattgtcgactcccgtgtagatgcagagaactcatttgtaactgccgtttcggtgttgtatcgtatctgcgctagatgctagtgttgtaacgcttttgattgttgatggattgcatatatgtactgtatttgtacatgaacagaacgtagtgcccattttcatagtgttcaaaaaagaaaaaaaaaaaaaaaaaaatcgagactagttctctctcgtgccgaattcctgcagcccgg

SEQ ID NO: 17167 - DNA, 1239 bp, Zea mays
gcatgaacaacgcacaggcagaggcaggaaacaagccaacgcccaacggcaacaagagaaaaaacccaagacctttccaagccagcaggcaacagcgcaccaatcccgacgcgaatcgcccagaacgcgaggcggaatttcccatcctcttggacccccctctgctcttcctccttccccgctcctcgtccacacgctccgctccgattccgcccgcgtccgcggacccagatctggcgcccgcgcccatggcgacgcgcaggcgaatgctcctcaaggtcatcatcctcggcgacagcggggtcggcaagacctcgctgatgaaccagtacgtcaacaacaggttcagcaaccagtacaaggccaccatcggcgcggatttcctcaccaaggaggtccagatcgacgaccgcctcttcacactgcagatatgggatacggcaggacaggagcggtttcaaagtcttggtgtggcattttataggggagctgactgctgtgttcttgtatatgatgtcaacgtatccaagtcatttgaaaagctcaacaactggcgtgaggaattcctaattcaagccagcccatcagacccagagaatttcccatttgttgtgcttggtaacaagatcgatgttgatggtggtaacagccggactgtttctgagaagaaggctaaagcatggtgtgcttcaaagggaaacatcccctactttgagacgtcggctaaagagggcttcaatgtagaggctgcatttgagtgtatagcgaggaatgctgtaaaaaatgagccagaagaagatatgtatcttcctgatacgattgatgttgggggcgctggaaggcaacaacgttcgtcaggttgtgaatgctagaagatatggagcactgcgatttgctcggttggttggtctgattctctagggcttgtttgggtggcctgtgtcatttcatatatgtatttagtttgcaaaactgctatttgtggacactggatagtttggaagtctgcatgcgggtgcttattgtcgactcccgtgtagatgcagagaactcatttgtaactgccgtttcggtgttgtatcgtatctgcgctagatgctagtgttgtagcgcttttgattgttgatggattgcatatatgtactatatttgtacatgaacagaacgtagtgcccattttcatagtgttcaattgttggttggtttggtattgttcttttaaaaaaaaaaaaaaaaaaa

SEQ ID NO: 17168 - DNA, 1225 bp, Zea mays
ggttattccgttttcccccttccctctctcgtcgcgtacagctggacgcctcctcccctccttttcttctcgctgttgctgttggctcctttcttctcgctgttgctgttggctgttggcctgttgcctgcctcgcctccgtccccctcgtcgcctccacctcctcggtcacagagagagagatagagagagagagggagggagagagggaacccggagaccgccaccaagcgtgaggcagaggaggagcatggcggcgccgccgtcgaggtcccggggcgactacgaccacctgattaagctcctgctcatcggcgacagcggagttggaaagagttgcttgctgctgcgcttctctgatgacacattcacaacaagcttcatcaccaccattggcattgatttcaaggttaggacggttgagcttgatggaaagcgtgtaaagttacaaatttgggacacggctggtcaagaacgtttccgaacaattactactgcctactacagaggagccatgggcattctgcttgtatacgatgtcacggacgagtcatccttcaacaacattagaaactggatccgcaacatagagcagcacgcgtctgacaacgtgaacaagatcctggtgggcaacaaggtcgacatggacgcgaagcgggtggtgtccatggctcaaggccagaagcttgcagacgagtacgggatcaagtttttcgagacgagcgcgaaaacaaaccagaatgtggagcaggtcttcttcgccatggcgagggacgtgaagcgaaggctcaccgagaccgttgccgccgcggccgagcctccggctatccagatcagcaggccggactcgggccaggccggcgcagcctcgtcgacgaggtggtcatcgtcctgctgtagcacctgatctgccgccgtgtgtgtggctggctctggctgctataggttactgcttaccgcgtggtgtgtgtgtgtgtttacttcctccggtgccaagccaagatttaaatttcgctccaaagatttgccggagcaaacgtgtaggcagatagctaggctgctgtgctgggtttgcttgcttctgtcgtgtaaacaaaacccttgagagacggtagtgtctgattgtgtcggaacatgacatgcttgtacattattagtgcatcgtatatccagctgttgctccccatgtgcactgcgcagggcacccctagggcctcaagggtcc

SEQ ID NO: 17169 - DNA, 1286 bp, Zea mays
gcacgagaccattacctagaacatcctaatcgaaaagtcctcctcgttgttttgttccgtttccccccttgcctcgctcgtcgcgtacagctggacgcctcctttctcgctgcgggctgttgccttgcctccgtcccctcccctcgtcgcctccgactccacctcccctccccggtctctgagagagggagcccggacccggagaccgccagcaagcgcgaggcagaggaggagcatggcggccccgccgtcgaggtcgcggggcgactacgaccacctgattaagctcctgctcatcggcgacagcggagttggaaagagttgcttgctgctgcggttctctgatgacacattcacgacaagttttatcaccaccatcggcattgatttcaaggttaggacggtcgagctcgatggaaagcgtgtaaaattacaaatttgggacactgctggtcaagaacgtttccgaacaattaccactgcttactacagaggagctatgggcattctgcttgtatacgatgtcacagacgaatcgtccttcgataacattaggaactggattcgcaacatagagcagcacgcatctgataatgtcaacaagatcttggtgggcaacaaggtcgatatggatgcgaagcgggtggtctccacagctcaaggtcagaagctcgcagatgaatacgggatcaagtttttcgagacgagtgcgaaaacgaaccgaaatgtggagcaggtattcttcgccatggcaagggacgtgaagcaaaggctcaccgagaccgttgccgctgcggctgagcccccgaccattcagattagcaggccagaccccgaccaggctgacgcagcctcctcgcggcggtggtcgtcgtcctgctgtaacacctgatctggcgactgccgtggcgaaatcaagcagcgtgaatcttgatgcgcgtgactggactgctaggttactgattgtcgcctgtgttcactttcattccggtgccgtgccaagccaagccgggatgtataaatttcgctgtctagtattcacctcaatcaatgtgttaactcccgctgcttcgcacgtcacgtcgtttgtttgttgagagcaaaacgtgtgtggggcagataaaaaaaaaagccctggtgggtttgctcctgtcacgtactaaacagaacgtgtctgatgattgtgtcgacggtggaacttggaagcgtgcttgtctcactattgttccgtgttttcgtccaaaaaaaaaaaaaaaaaaaaaaaaaaaataaaaaaaaaaaaaaaa

SEQ ID NO: 17170 - DNA, 1619 bp, Zea mays
cataaatagcgactggttagaaaacacagtacgctgatttcgaaattcgtggtttcagccaaccggcatagccgcacaggtactagatcagctgatcattagaagttgtgaaccacgcgagacaacaagttggtccgcaaacccacaaaatcactgaaatatacaattcctcctcacctcacgcgatgcgcaccatcagcggtccacacgaccatacaaatggggcagctgggaaggcatgggtcctccgcctcggcttcactctccgccgccttatacttgctggcagagccgcccgggctcctcgcaccgtcaccggatccctcgctcccctcctcctcctcatcgctcccttcctcactcgagccggacgagctcacttgtacagccgtgggagcagccacctctggggccggccgcggccgcctgccccgggagcccgaccgtgacggcattggggtggccgtctggccgagcttcgccgcgaccggattggactattggagagcggcagaatgaactggattgggaaaagaaatttcagcgagtgatggcgccggtcggtgagcgagcaacaaaaaggttggcgcgcacgagtcggaagatttcatgggctttcgtttatgggctctgcaaaataacgagcgctcgcccacttccagcgctcgagcgacagggtgactgggtgaggcacgtttcggttagtcccacctcgccgcctgaagatgggtgcgacgcgtgaggaggccacttgggcagtgcccctcccgacccggcccaatacttacctggacggggtcgactggctatcaagaaggcccgtggcctagatcaatggcccacattgcacttggtggatgcgttggcttaccatctccccaagtgggagagtggacgtcataatttgtggtagatggggtacgcgacgcagttcaggtctcggtttgctgcttcttgatcagttcagatctcggtttgctgcttcttgatccagatcagggtttctgatccatatagtctgtactttgttacaaaaatcatgtaattttaaaactttttcccatatctgggttcctgatttatgaagtctacagttccggcgcctggcccctgccaattctgatttgggttcttttgggccagatctgggttctgaaccatgtagactttgtttcatgagccgttcatgagccgtttatgcgctgcagtctcatccacgtctgcaagaaatgatgaacagaccgtcggaaaaaaaagtcaagcaaaaaaaatagaaaaatagggaggctgatggctgtggaaaactgttggagcaccgtaattctgcagctgattattaaataaatatagtctaattataaagctaattacgtaaaattattaaacctaattagttctgtttatttaatgattataatagatattcaaatatttgatgtgatacgaactaaactttagtcaaagaaattaggcacgcctctaaaagtagaattttaggggtgtttgacattactttggttctagcttaaactgtggtgtataatataaatttaaatgatttaaaaatatttttaatctgaataaaaaataaaataaattatctaaatgtcttctaaaag

SEQ ID NO: 17171 - DNA, 1083 bp, Zea mays
tgcgggagacgtcctccggcgagcggtagtcccggaagacgtcctccggcgagcgggagaccggctgcgtgcccggccggcctgatcagggcgctcaccaccgatgtggagaagttctacgtgatgtgcgacccagagaaggagaacttatgtttatatggacttcctaatgagacatgggaaataaacttgcctgctgaagaggtccctcctgaactgccagagccagctcttggaattaattttgctcgtgatgggatggatgaaaaagattggctatcacttgttgcagtgcatagtgattcttggctaatgtctgttgcattttattttggagcaaggtttggattcgataaagaatccaggaaacgtctcttcaccatgatcaataaccttcccagcatatatgaggttgtcacaggaacagccaagaaagagcccaaagaaaaaactcctaaaagcaacattaagactaacaaatctggctcaaagccctcgcgccatgcggaacccaactcaagggtcccaaagatgccacctccaaaggacgaggagagtgaagaggaggaaggggaaccacaggaagaccaggagagtgcgctgtgtggcgcgtgtggcctaggttatgacgacttctggatctgctgcgacttatgcgagacatggttccacggcaagtgtgttaagatcaccccagctaaagcggaccacatcaagcagtataagtgcccctcctgcacgggaagcaagagggccaaggtttgatccacgatccaaggagcctttgacgagagctgtaaactgactcttcgggctagggcagctaatagattcgaatgcttgtttcaatacaaattacgagtactgacgaaccgtaaactgatgtagtttgtgtggccctcaaagcatctatgtcctgacttgtgtggtttaggtttcctttggcacagtttctaagagctgattgtctatgaatctaatatgagttttgtcaattagagagaagtggctatgctgaatttccatgaaagctgattttataaagtgatgatataaaacaaaaaaaaaaaaaaaaaagcggcc

SEQ ID NO: 17172 - DNA, 1463 bp, Zea mays
ctcattggaaggcccgcgactgcggctgcgcctgcgcccgaccaaacgtaggagacccatctcctctcttttctttccaagaaaagtcttctcttctctgtctcagcgccgacgcttcccaactccttccaatcgattcttcgtctcgtcctcgtgtaatccccagcttgccctcctcgctcttccctcccaaaaccctacgcctccctgaccaagctccggggacgaatggacggaggagccggcttccctggcacgccggtcccgcgctcgccggaggacgttttccgggactaccgcgcgcgccaggccggcctaatcagggcgctcaccaccgatgttgagaagttctacgtgatgtgcgacccagagaaggataatttatgtttatatggacttcccaatgagacatgggaagtaaacttgcctgctgaggaggttcctcctgaactcccagagccagctctcggaattaattttgctcgtgatgggatgaatgaaaaagattggctatcacttgttgcagtgcatagtgattcttggctaatgtctgttgcattttattttggagcaaggtttggattcgacaaggaatccaggaaacgtctcttcaccatgatcaataatcttcccagcatatatgaggttgtcacaggaacagccaagaaagagtccaaagaaaaaactcctaaaagcagcaacaagactaacaaatctggctcaaagccttcacgccaggtagaacccaactccagggtcccaaagatgccacctccaaaggacgaggagagtgaaggggaggaaggtgaaccacaggaagaccatgagagtgcgctgtgcggcgcatgtggcctaggttatgacgacttctggatctgttgcgacttatgcgagacatggttccacggcaagtgtgtcaagatcaccccaaataaagcggagcacatcaagcagtataagtgcccctcgtgcacaggaagcaagagggccaaggcttgattctatctatctacgatatagatatgaattgcggacaatgctccaagaaccgaggagcctttgacgagagttgtaagatgaatcttccgggtagggcagctaatagatttgaatacttcgtgtggatactgtcggcattggtgcttgagatgcctcaaaatatagtgtcagtactgatcaactgttaactgttgtagtttgtggggccctcaggcatctatgttctgtagtctactgtgtggtggtttagataccgtctatgccatttgtgatgaagcagtcgttttaaagttagatcccagtaatttccctactatacatttgtcttcgtgtaatcgtgtttaggcagaatctagcagtgaaggtcaggtcccgattgtttatgcattcgaagatgtcggttaaatatgtggagtcgtagtggttctgcttgtttgtgtgctctccgaaaaaaaaaaaaaaaa

SEQ ID NO: 17173 - DNA, 1366 bp, Zea mays
  misc_feature (1348)..(1348): n is a, c, g, or t
agggtcaatggtgtgccagataggcccgcgcaaactaactattggacgcatcggaaggccctcgactgcgcctgcgcggcctgcgcctgcgcctgcgcgcgtgtgaacaaacgtaggacctatctcttttcgttctcggagagaagtcttctctgtcacagcgccgacgcttcccaattccttccaatcggcacctcgccgtcctcgtgtgcaatccccagctctcctcgcccctccctcccaaactccagcggccccccctgaccaagctccggggacggatggacggaggagccggctttccgggcacgcagccggtctcccgctcgccggaggacgtcttccgggactaccgcgcgcgccaggccggcctgatcagggcgctcaccaccgatgtggagaagttctacgtgatgtgcgacccagagaaggagaacttatgtttatatggacttcctaatgagacatgggaaataaacttgcctgctgaagaggtccctcctgaactgccagagccagctcttggaattaattttgctcgtgatgggatggatgaaaaagattggctatcacttgttgcagtgcatagtgattcttggctaatgtctgttgcattttattttggagcaaggtttggattcgataaagaatccaggaaacgtctcttcaccatgatcaataaccttcccagcatatatgaggttgtcacaggaacagccaagaaagagcccaaagaaaaaactcctaaaagcaacattaagactaacaaatctggctcaaagccctcgcgccatgcggaacccaactcaagggtcccaaagatgccacctccaaaggacgaggagagtgaagaggaggaaggggaaccacaggaagaccaggagagtgcgctgtgtggcgcatgtggcctaggttatgacgacttctggatctgctgcgacctatgcgagacatggttccacggcaagtgtgttaagatcaccccagctaaagcggaccacatcaagcagtataagtgcccctcctgcacgggaagcaagagggccaaggtttgatccacgatccaaggagcctttgacgagagctgtaaactgactcttcgggctagggcagctaatagattcgaatgcttgttttgatacaaattacgagtactgacgaaccgtaaactgatgtagtttgtgtggccctcaaagcatctatgtcctgacttgtgtggtttaggtttcctttggcacagtttctaatctaatatgagtattgtcaattagagagaaaaaaaaaacaaaaaaaaaaaaaaaaattataataagtgatgatataaaataaactaaaagactagagccgnaaaatgtagcttttctga

SEQ ID NO: 17174 - DNA, 514 bp, Zea mays
ttctgggatgtccttgcgtttgtgttgcttcttgtgatttgttatctgtgggcaccttcccaaagctcgcaaagatatgcatattctggtgaagctgctgacgatgacgatgaggaatctcaatctctgacgaaaggagatggtgaagtagggatggtaaaaattgacaaggacagaaatgctggtgtcagcagtgctttcggcttagaagatgaggctgaggaggacaagcgggaatagccatttcttgttcctgatgtcccctaggtcccagaaacaatcgatattttggagcagcaatattgcaagaatacttctttttcaagttacatgtggttgctgtagaagtgcttggtattgtaaacatgcgaactctatttaaaagaaaaggattaggaattctaatccaaaggcaaaaactaacgtgcaattaagctttacataaaaaaaaaaaaaaattaaactatcaaaagtcatgtttttttaaatatataaattcactattatttactct

SEQ ID NO: 17175 - DNA, 1094 bp, Zea mays
atcagcaagctattcagaatttcagatccccctcttcctcctcatcagcctccttcgtcgtagtcagcgacaacacgtcttcctgcagcgagcggcgttcaatacgggcgtggacatggcggagaagagctcgcttcgccggttgaagcgcctcctcccggcgttcgccgccatcgacgccgcaatcgaggccgccaccggcttctcccgagacaatatccggcaagagaggggcaagctcgtggaaatgctctgtgatatcatcacggacaacgacagcgtcgagctagcggaggggctctgccagctgctcgacgaggcgatggttttcgcgctcaagaggctgagggtggtggaggcgaccccgaccgtgctggcaaccaccgacgccatcaaggccgtcgccggtctgcggagtcacgagtccgggagggtgcgcggcctcgcgtgcagcatcatcggcgggtggacgacatcgattaattgtgacatctccacgggcagagcgatcttagtcaaactgtcgaagatgcagcaagcgcacaaggcgttacgcgttcccggccgtcgccactgatatggtcgtcacagggtttaggaattacggctgtgtacgtaatgatgcttgtgaatctgcgaggattatcttttccaggtttcattcaacaaccactgtgactatactcgttgtgctttctctgtacacaaaaaagatagaaggagagggggggagtgatctgtttctgcttgagtaaaaatactaaaaactcctagtattattctagctagaacatgcatcatgttctgtgttctgatcaaatccttcacgcacactatttgaagtcatcactcaatcaatatataagaaggattcatgatttccaaatatttatgagtcatgtaaaatagatataaagaagttctagtgggttactgaagagatgcagagtgatggggcatgcaattctgaaaaaaaaactttggaaatgaggtagcaagtgggtgtcaccatctacagcacttatctgacatatctaaccattagcaacgactaatatgcaatcagatactacgtacaagcgtgtaagcagact

SEQ ID NO: 17176 - DNA, 4912 bp, Zea mays
  misc_feature (2888)..(2888): n is a, c, g, or t
  misc_feature (2919)..(2919): n is a, c, g, or t
cgggcttggtcgtgcttgggttaggttaaactatgctgggccatgggttgtccaatagacctagaccatttggacatatatacccgtatgtgtaggcgagcagcagcacaagcaagaggatggcccacgtaggcggagctaccaggtgttaacatagcagcgttgttagatcatcggatgaggtatatggtttttcgaattagaaattttaggattagttaggttcgattcaagattgtaattgtttgagtgagaagatagaaacatacttccatggtaacctgacataaaatgcactagcaatgtcatcattgttagccttggctcccctgtcgacatctatagacatgcctagagcttgatggtgacatagatccatgactccctctagtgctctcatttatagagaggttcatcacgacataaggtagtcgggagcatggctcctagcagagctagaagtaggctttctcgaagttctagttgttcaacgcccagagaacgaagaaatgacaaaaaaggccaatatagggcctcacccccacgaatgtttcacatagatatgcaaaggtcaagagggcaaggatggagtgcactgtaagatgcctaacctagagaccatagaagttgaggatgtaaagaaagaatctcgaaaatgggaagttcatttccaccatcaaatgggagaaggagatggtgtactccttcatatcctttagagtctacatcagattcatcattgagcaaacattgttggacgccagtagcatgacccactcgaggagcttgctcaccatgtctaaacttttttggttgaggaccctaccatgtggtagtagttcaagagtggaggtcacgaccactgcgattgtgccgacagataagagggaacgataacagctgacggaagaagaccaggggaagaagggaatactaggcaagagcattggatcgtgtgagaaaaccaaatagtgaaaattgcacacacatacataaagccctcaattccctctctcaactatcaggtgtggaattcaaagcgtcgcatgacttgcatgatccttgagacatgcgatatgatgattgcacagtcaatgttgataatacatgtgtaattatttgcatgcatgatagaccaattatgttaggtgttttgggaaagaagcattgctagtaggtctccacagacccgtgactaatttcctatgatattttcattcaatattttccttttttcttgaactacttgggcttggagcctaagtgataatccactataagatcgagtgaagtattgaactattataggagtggtacaaatcttgccttgagtttgacatatatcgtatggcaaaagaattaagacgtgtgtatatcaaggttcgagtcatatgatctttatgtgtacatgagattcaatatatgttgcttggtgctgctattgattgatggactcaaaatgggttttgatcatggtcatctacacatgaaccaaacacgtacacatttaaggggttggaacagttgaacaaacgattaacaactacaagtgacagattattgatatacccaataagtaagtatgatatatgagaacatcgctaggcttttagggtaaaagcactttactagggggtctatatataaaggagttgacgtgattgaagagagaaacattctagccattacctctctccctgtagttacaggtgcccaagatatcactgcctttactctcactgcgcatgtggcgtcacaacgtttcattcgaatgatatggattccatggagatattgcaactattgctaagatgttgatcaacaacaaacatgaggagcacacttacatgttgttgttgctggtatgcaatgatgtacaattacttccactatgtcgccgtgctcttcttccactatgttgcatgtctagtggtaacaaccaatgatcttgtacttgcatgtcatcttggttgaacgtggtatttatgctagcctgttgtaaacccatttctctagacctccatgattgacaccaaggagatttggagagttgcgaatccatcgaaggttaaattttcttcacgatcgtaatgcataagactttgggctgaggatcatcataagcgacatgggcttcaatatggtgataagtgcgccctttacaatcaacaaagtgagacgacatatcacttgttactcagttgcatctttacttgagaagtttggtgttgggttctgtgttaggcagggcttgagtgcctcatgtcatcatcttcagacatctagtccattagtggcagcggtccggtcccttgcacaacacaagaatcgatggcataaggcccctaaattttttggggggcccaaattcatgctacaaggtttgattttttttgtttgttgatgatcaagttattactataatgactataaggttcgaacaatatcaggggtatgagaaaatcttcgattttttttacttcacttaagttgtggtctttagataacaaaagtttagtttcttcttatactcaacttgagacaacactaaagaatgtcaacattttgatgtcaacaacaaagacttgtatatggagttaatgttccttcagcagtttatctccaaaatgctaggaccagccctgcttggaaagaaaggaataaccgagttttcaatgaagatgggcaacactagcgaaactcattaagttggtcatggaagaaggaaactgtcggttacatgtggggtttgcaatgttgtcgacgttctcatggcgtcgagttgactgagagctttggtataaacgccacaacttggttcattttcagtgtctcagtgtgtgccgacagtctataggcgagcaactcgctcggcaataggctgagcnttgtaaattttctaccttctcaatgaaatangagcataatcccgtctgctaaaaataaatgttgaattgaatggagttttgcaaatagggtgatgatttttttatggaagaaaagaaacgacatttaaactaagcaaaaacctatagtatggccttagcccaactttataaaagctggcctatgatttacatttaccagcccttctatggcttttcatacagcaggctagtagaacggacattgtttggacgcgggccatctgattcaggaatcaatcactgaaaaaagggtgactaggcccaaacagcagcattttactgttgcgtcttgcgtggaaaaaaaaaaggcagcgacacagtaaaaggtgaaaacaaacggtccggcaagctcgatacccaatgcaatcccgcttccacctcctccgtcctcttcactctcccccatcccagtcagtcctctccatgacctccgccgcggccgcctccccggaccccatggtggcgtaatttctgccgccaattcccttgcctccagacttcaaatccccaccaccatcgaacctccccaacccggcaaatcctaaatccaatataggctaaccctagccgcccatccgcccgccatgaaggcgtcgatcaagttccgcgacgacgaccgaccgctgctgcgcgccaaggtgccgattggcgtgctggggctgcccttcctctcgggcctcgcggcggggggagacgccaaggacctccgcttcgacctctccaccgccttctcctctggcccggcgctccgcctctcataccgccccaacgaacccctccagcctttcgccctctccgtccgcacggggctggggccgctggggtcccctgcccgcgccccattcgccctcgccgccgaattcaacctcacctcctccaacccgcccgccttctcgctcctcttcaagccccggatcggggacttcgccgtcgccagctccgtccgctccccgccgacaccgccgcccacatccactccgcccccgctagcgatcaagatggtcgacctcaccaccaacggcgacgaccacgactgcgaagcacacggtaacggcttctcctttaacgggaatgtattgggggcgaacgtggcggccgtcaccgggacggacggcggcggcggcggcgtaggcgcgctgctgtccgggatgcggctcacgaccaggagcatgctgccactgtggagtaaagcgagcctgcggttccagtgggggctgcgtgtgccgccggagatcaaggccacgcttgcagacaacgggtacgggcgcaaggctgggagcctcgccatcagcaagctgccgctgctggtgatgaacaagatcaccatcgagcacacgcccaaggtgccttcacagtctgaaacggacaagaagaggaagaaagatacaccaccggcagccaaggatgaagagttctcactcatgaagaggcaactggataagctgaatgtggagaacacaatgctgcgtcgtgcagtcgaggacttgcgtgcagagattggagccggcaaaggcgatgatcgtaagctgccaacagcagtgccacctcaacaacattctttagtgtcgaaaccagatcgccatttccacatcaatgcgaaggaattggtagacagtgggacgaaaccggcctcaaatgaagcaagtgaggagttgaagaaggtgcttgagggccggcggaagtaagaagcacctagctagggcttgctgttattgcaagccctacattatgacatagctgctgactgctgtgtcaggttttgtggttaataataatacttcctcgctggagaagattgctaaggtcagtttagcccctcgctggagaagattgcaagtgaggttgccattcgccataggtgtggtagtaattttgcctcaattctattttcattgcttgtcttaggatattctgttctgtataaattttcatcttttgatctaaaatgaatgaaggattagttttttcaacaaaaataaaaaaaa

SEQ ID NO: 17177 - DNA, 1536 bp, Zea mays
attcccttcgcctcccacacttgaaatccccaccaccaccaaacctccctagcccggcaaatcccgtatccaaatccaatagggtaaacctagccgcccatctgcccgccatgaaggcgtcgatcaagttccgcgacgacgaccgcccgctgctgcgcgccaaggtgccggtcggcgtgctggggctgcctttcttctcgggcctcgtggcggggggagacgccaaggacctccgcttcgacctctccaccgccttcacctccggcccggcgctccgcctctcgtaccgccccaacgaaccgctccagccctttgccctctccatccgcacggggctggggccgctggggtcccctgtccgagcccccttcgccctcgccgccgaattcaacctcacctcctcgaacccgcccgccttctcgctcgttttcaagccccggatcggagacttcgccgtcgccagctccgtccgctccccgccgccgccgccgcccgcatcaactctgcccccgctgtcggtcaagatgtccgacctcgtcaccaacggcgacgaccacgaccgcaaagcgcacggtaacgggttctccttctctgggaatgggttcgcggcgaacgtggcggccgccgccgggaccggcggcggcggcgtgggcgcgctgctgtccaggatgcggctcacgaccaggagtgtgctgccactgtggagtaaggcgagcctgcggttccagtgggggctgcgcgtgccgccggagatcaaggccgcgctcgcagacgacgggtacgggcgcaaggctgggagcctcgccatcagcaagctgccgctgctggtgatgaacaagatcaccatcgagcacacgcccaaggtgccttcgcagtctgaaacggataagaagaggaagaaagatgccccaccagcagccgagggcgaggtgttctcactaatgaagaggcaattggaggagctgaatgctgagagcaccatgctgcgtctggcagtcgaggacttgcgtgcagaggttggagccagcaaaggcgatggacgtaagctgccagcaacagtgccacatccacagcgttcattcgtgtcgaaaccagatcaccattttcacagcgatgctaaggatttgggagacagtgggacgaaaccggcctccaatgatgcaagtgaggggttgaagaaggcgctggaggccagacgaaagtaggaaacacctagataggggggccatagggcttgctgacactgcaagcgctacaatatgatatggctgctgacggctgtgtcaagttttgtgcttaataataatgcttcctcaatggagaagattggtaagggctgtgaggttgccatttgccataggtgatgtagtagttttgcctatattctatttccattgtttgtgttaggatattatccgttctgtataaatccgcatcttgcgatctaaaatgaatgaaggattagttttttttttccaaaaaaaaaaaaaaaaaagcggccaaaaaaaaaaaaaaaaaagaaaaaaaaaaaaaaaa

SEQ ID NO: 17178 - DNA, 1749 bp, Zea mays
ttttttttttttttttatagctgatccaagaactaacaagtcatcgtttcttggcattcagacattttggttcgttaaggtggactcaaatctgaagtctgaacaaaagaacaggaacgcaactaagcttgatgagttcgaagcaagcaaaagctgaacaccgatcatcagaaagacgcactaccctcgatcagttccaaagaatgcagaaaaagaaatgacgaaagaatccttgaagaacctctgcgagaactgatccagttccagaccggcccacaggacgtgtcaacagcgtcctatccaagcttgatcacgcgcgtgtactgcgatgaaggcgcctcctctactatctcgctgtccaccggaactgaagcggcctcggcgtccgtttctcgccgtgcctcggaagcagtgggtcctccaaatcccgcgtcgacgacgacttccgcggcaactgttgttgcgctgccgccgatgctttttgtgaaggtggtggcgacggtggcgctgtccgtttccacggcagcgcgtgtcgactgcgatgaaggcgcctcctctactatctcgtcgtccaccggaagcgtcgtcgacgtccgtgtctcgccgtgccccggaagaagcgggtcctccaaatcccgcgtcgacgacgtccgcggcaactgttgttgcgctgccgccgatgcttcctgcgaaggtgctgacgacggtgcccctcccaacaaggtattccacggctgcacggaacggggaaacttgcgacactgcgggcagtaattaatcggttccctcataagaagccagtggtcgatgccctcgcacttgacgctgcggccgtagtggaactcgtggttgcaggagagcgtgcggaccttctcaccggcctccaggctttgttggcacaggacgcagtttcggctcaggttccgcctcagggtggtgacgccgccgagcctgaagacgcgccaccattgcttgatgtacaagaaaatgaatacgacgagccacggggccacggtgacgctggcaaagatgacgacgggcaggacgaggtcttcgatgtccatccaatcccaatagctggggtcggccatcggtccttcgctcccttgactcttgatcgttcgtctcttgctcttgctctggctttttcgctccctctccctcgtcgtcctttggattgtgttgtgattgtttgaaagtgaaaggctggccaaattggcgaggcggcacgggtatttgtagggaggatgctctgagctgctgataaggtgggggacccggcccgcggttagattccccacgccggcagttcagggaacgagaagggcaaagatgctggagatgggatgctagcaagcgtcgatgtttcatacagttcaatgacattggtgaaactaacggcaacagcgccaaggcaatggttatgatgtacaaacgggctacccacggcacggcccgggctcgttaaagcaagacccgtttagggcatgatctgccaggcacgattgtcaaatcaggtcagaccttaatgacccgtgggctttagaacctgtacgagcccgacacggcgcaagcctaaacgtgctgggatggcacggctaggccgatctagaaacaaggtcatgctgccctgagctggttttacacaagtgcactactaaatgaacacagcagcagccagcagcacaagtgcacaactcaattacagtttacacaagcacacaatagacaacagcagtaggcgcaggc

SEQ ID NO: 17179 - DNA, 1186 bp, Zea mays
tttttttttttttttttgaattgaacagagtataatagcaattaaccaaggatctattagcttttgttggaacattatagctgatcctaggactaacaagtcatcgtttcttggcattcagacattttggttcgttaaggtagtctgaacaaaagaacaggaacgcaactaagctcgatgagttcgaaggaagcaaaagctgaacaccgatcatcagaaagacgcactaccctcgatcagttccaaagaatgcagaaaaagaaatgacgaaagaatccttgaagaacctctgcgagaactgatccagttccagaccggcccacaggacgtgtcaacagcgtcctatccaagcttgatcacgcgcgtgtcgactgcgatgaaggcgcctcctctactatctcgctgtccaccggaactgaagcggcctcggcgtccgtttctcgccgtgcctcggaagcagtgggtcctccaaatcccgcgtcgacgacgacttccgcggcaactgttgttgcgctgccgccgatgctttttgtggaggtggtggcgacggtggcggtgtccgtttccacggcagcacgggatggagaacctggtcacagatcgggcagttccagggcgtcatcggtgtagtgcaaagccgttggtcgacgccctcgcacttgacgctgctgtcgcagtggaacacgtggttgcaggagagcttgcggacattctcgccggcctccatgctgccttggcacagggtgcagtggtagttcagcttctgcctcagggtggtgacgccgccgagcctcaagatgcggaaccgtggcgattcccaccactgcaagacggagttgtacccgaaatagaagacgaggcacgggacagtggtgacgatggcaaaggagacgatgagctcggcgacggcgcagacttcgatgcccatccactcccaatagctggtgtcggccatcgttccttcgctcccctgactcttccgtattctcctctcgatcgctcgtctcttgctcttgctctcgctctccctcgtcgttctcgtttgaaagcgtaaaggcttgccaaattggcgaggcggcacgggtatttgcagggacgatgctgagcagttgctaagtttgttacaaggtgggacccggggttagattccccaagctggcagttcaaactggaagactggaaatgt

SEQ ID NO: 17180 - DNA, 893 bp, Zea mays
  misc_feature (48)..(48): n is a, c, g, or t
tttttgctggtaggataatccatacgtacgtgttcatttccacgagancgagagagcaagaactacagcccaaaatacgagaggccgaaaccaagcgggggagagagacgccatcggtccatggcccacggctctccgatccggcagcatgcatggctctacagttctagccttggatcaggatactacgtgtatgtagtagcaaaaaaaacccgagccagctgtcgctcgcccgcgtacggtacttacgcacggcactagtgcatgcatgcaaccggtgctgctgcggcgggggcggggcgcggcgcgggggaagtgtgccgtgtgcgtgcggcgcgctaattcttttgctcagacgcgcagcgcgggcgccctgggcctggcgaacccggcgtcgacccacgggtggcgggtgtccatgccggcattccgcggctgcggttgctgctgctggtggtggtgctgctgcagctgctgctggtgccggtgctccctgctgcgtgcggacagcgcgtgcgccgccgcgcgcttcttccgccggtgcttcgccctgtccacctcgatctgctgctccctgcactcctcgctgcagaacggcgtgtcacccctgtacatgaagatgtcgccggagagcgatttggcgcagagggagcactcctcgaggaagtggtggatctggacgacgtccgcctcgtggacgtagaacataggcgacggcctcatggcaccgccccccttcatggccgcgcgcgcgcctgcctgcgtcgctgggggacgaagagggagggagcaccgccgcgagaaggcgaggcctggcaccggattcccgaggagctcggctagcttgccccgcccggccgcggggaccccaatccccctaaggagtcgatacg

SEQ ID NO: 17181 - DNA, 667 bp, Zea mays
gcacgaggagaggagagaagtgtaaggagtgtgttgctatctacaactctggtacagcatggaacaatggtgaagagctctgggacggtccagattcagcaaggtgcagattcatgttcagaagattagttgcctctgcattagatcccttgcaccatgtggtggggctggtcacaagaaagcattgctatcagcagaggatgtgcgaatctaccatgatgtgacctccagtcagtggatcaagacgctttcatggtgggtgattataggctcatgatgtcaggttgaagaaaggctgctgtagccctcagtgttatggagttcgcaggagtttctttctcagaacaaggctgtctgatgtgttttgacattgctatccttgctttagccagctccatctttcggtagatacatacatgcatgggcatatccattttgaaacatgccaggagaaagctcactggctctagagcagggtaggtctcaagcgttgttgcctgattgctgctgcgatcgttgcatgcttgacatgtctagtaggatcagtatgctaacataggcagggcttctgtaccatatgacataagttccttctgtatacagggtcgagatctagagaaaagaagttcattatttcattcaaaaaaaaaaaacgacgcgcccccgc

SEQ ID NO: 17182 - DNA, 5313 bp, Zea mays
gtctcgaccactcccctcttcagcccacacagagctctgcacaagaaaaggggaggaaggacgagccggagccactcagccgccacctcaccccccccatcggccgcctgcgtcccaccacccgctcctgctgccgggcctgccgcccgttgctctcgccactgaagccctcgccgccgcctccgcctccgcccgcttgcttgccctcctgccggctgcctcccggatgagaagcggcgcaacctgggcagcggaagcgtggtcggcctgagccttcgccggggtttctgccgagaaggatcctggagattaagcgcatgggttccttggaggcccggtacaggccggccggggcagctgaggacacagctaagagaaggacccaaaaaagcaaaagtttcaaagaggttgaaaaatttgatgtttttgtgctggagaaaagttctggttgcaagttccgatcgatgcaacttttgctcttcgctatcatgtctgctgcatttctaacaatcctatacacaccatctgtgtatgaacatcagttgcagtcaagctctcggcttgtcaatgggtggatatgggataagaggagttctgatccccgatatgtatcttctgctagcattcaatgggaggatgtatataaaagtatccaaaatctgaatgttggtgaacagaagctcagtgttggactcctgaattttaacaggactgagttcgacgcttggacacacatgctcccagaaagtgatttctcaatcataaggctggagcatgccaatgaaagcattacctggcaaactctctatcctgaatggatagatgaggaggaagaaactgagataccatcttgcccttcgcttccagatccaagtttccaaagagcaacacattttgatgttattgctgttaagctcccctgttctcgtgtggctggttggtcaagagatgttgcaaggctacatttgcagttatcagcagcaaaattagcagcgaccacagcaagaggcaatagtggaatccatgtgctgtttgtgactgattgcttcccgattccgaacctcttctcttgcaaggacctagtgaagcgtgaaggcaatgcttggatgtacaaacctgacgtgaaggcgttgaaggagaagctcaggctgcctgttggttcctgtgagcttgctgttccactcaacgcaaaagcacgactctacacagtagacagacgcagagaagcatatgctacaatactgcattcagcaagtgaatatgtttgcggcgcgatcacggcagctcaaagcattcgtcaggcaggatcaacaagagacctagttattctcgtcgacgacaccataagtgaccaccaccgcaaggggctggaatctgcggggtggaaggtcaggataatacagaggatccggaaccccaaagccgagcgcgacgcctacaacgagtggaactacagcaaattccggctgtggcagctcacggattacgacaaggtcatcttcatcgacgcggatctcctcatcctgaggaacatcgatttcctgttcgcgctgccggagatcacggcgacggggaacaacgcgacgctcttcaactcgggagtgatggtcatcgagccttcgaactgcacgttccggctactgatggagcacatcgacgagataacgtcgtacaacggcggggaccaggggtacctgaacgagatattcacgtggtggcaccggatcccgaagcacatgaacttcctgaagcatttctgggagggcgacgaggaggaggtgaaggcgaagaagacccggctgttcggcgcgaacccgccggtcctctacgtgctccactacctggggaggaagccgtggctgtgcttccgggactacgactgcaactggaacgtggagatcctgcgggagttcgcgagcgacgtcgcgcacgcccgctggtggaaggtgcacaaccggatgcccaggaagctccagagctactgccttctgaggtcgagcctgaaggccgggctggagtgggagcggcggcaggccgagaaggcgaacttcacggacgggcattggaagcggaacgtaacggacccgaggctgaagacctgcttcgagaagttctgcttctgggagagcatgctgtggcactggggcgagaagagcaagagcaactcgacgacgacgcggaacagcgccgtgccggcagcaacgacaacgcctgctgcgagcctgtcgagctcgtgagacttgtagatagctctgtctgccgagagtagtataccagtaccagatacagaacttctgaagctctccatacatacatagcgacagctctgtaaaggtagctatgtaggccttttccttccccgaatgactatataccttcgtcttcgttcgccgtcacagctgcaggcagctccctccctcccgctggtttccgatggttaacaattcttttgtttttgccaataattcatcagtataggatgtcaggctatgttgcctcaattcccagtggcaaatgctgtgctgcagtacgtctggtttgatatgtggtggttgaacggatttttcagtgataaaatctggagtggtgcaatatggggttgctgaccatcgaacactgcgtcatcttgggacgagtatgacggcatcaccttttatgccgtagtgaagttggaatttagctcgctcgctcgctgggtaccgaaggatgaacgaaaccacccttgacttgtgagccgtttggatgcacagcatcttactgatacagagcaaagcatcattgcgcccgtcgggaggtctggtccggttgagctgctgttgtggcaaagaacgaaacgcatccatgttctcgtcatgttcagctccttggagatgcagccctttgcagctcatcagcctgatgagtctgctgtccttctttccaacagcagcacagctaaaaaagcacacagggacagggataggataggctgtacgagcttgctccggcgggcggcggcggcggcatgtacaggacaggctcccgattgatgagtccttcttccccttgtcgctcatgcctagagtagttggacgtttgcgttgcaagtgactgggattaggttttctccttgtttgccactagaaaaaaaaatcctagacagaagtccagatctgacgcgtactatattacaatacggagtaagtacacggaaaaggcacatctctacccactattcttgccattcccacgcgcgtcggcgtcggcgtcgcgttgcgagctcgctcctttgtttttttttttgggtgccgccctgcctgtgtctgtgagccatcgtccgagacactccgtcgtggtccgtaccggggtgcactacaatattgtctgggagaggacgggttcgtacacgcggcggcggcggcggtggccggtgggagccccagtcccccggtgtcactgcctcggccagcacgagcgggagtgcgggacgcggcaatctaacgccatctctccctggcgtcaggtcagatacgcatgcaagacggcatgccggcatgggccgaccacctcactctgtgccctaggtttaggccagagaccaccgcgcaacggccggcgccgcgacatgcgtttgtcgcgctagctgccagcttttgagcttttgaccgggcaaagcaacagccaggggacaaattcgagaaagaactggacgcggcgacgatgcagtggtggcactcatacgagttcacgctagcctcacctgttccagcactgcctgccgttggcaacgaggaagccgtgggctttcggccattcacatggtgacatgaagacgtgacgtcgtgctccagcagggggccggggcggcaactattccgggtccggtcacggtcacggtcacggcggcatgctccgaagtctcggagcgcgggcggggtagggttgagagtggagagtggagactcatggccggcgcagattacggttgctgttgctgacgcgcacgtgacccagggtttgcggtcgcggctgtgctcgcaagtctcggaacgcggcgtattggtcggcgcagattgcacttgctgacgcgcgcgtgagtgggccgctacggacatggtgaagtaacagggtgttgattgggcccaaccgccacgcgaagcccaaaccagcaaaccttggattccagagtccgtgtgtggcacccatttgtcctgagcagcggaccccttccctactccacaaacggcattttttgtattgctagtatactagcgggacgagtcacgagttgaagcaaagccacgaaggccatgagcaaagtcccacttttgttcaggccgtgtctagccgttcacctattgcattattttacactatagagtgtgttgttcataaaatacagtttaaatatagatatgaggatgtgtaagctagtggagatagcctcatagagtgaaagctcacaaatagccaccaataggatgtccataagtgacagccaataccagaggtgggcgcaagggttggacaaggtgggtcatggtccgcctcaatttttataacctcttatacataaatttaaacatacatcaaaataaaaaaaaatattatatattaggtgtggctaaatctaatgattatctttttcttaacgctccactatttggcccacttccacacccgatttgttcgattccctcctctagtggctagctcacccgtggctcgcttgcttctttgataattgactaatcgattagtgggtgacttaacccattagatgtcatcccacttgtctccacatcactcgtcagctcgtcacgtcgtcggggtctgcatgcagtgacactaatttgcctcctagtccacattaatgggcaggcagactatcgatggaatcctgccttggttctatagaacagcctaccctcgctatctcactaaagtcccaccacactgtcgcaatgtagcaatggctaatggttgtcccttgtcgtcacctgccctcgctacctcccgcaagttgttgccacatcatcgccatctcgcggcagactcaccagtccgccattggccaatccgagggagaggcttcactagttgccaaccaacccgtccttatgtccctcagcgattggatgtccataaggggatcgaacttgaaagaaatgacatcatggctacctgattgccctaatatcgtcatccttcaataccaaaggtataatctattagcgtctgattggttacctacgtatggtctgatcagatttacaggaaacaacctccacgtgtgcaaagatttcctctaggctaggctctgttgctgctatt

SEQ ID NO: 17183 - DNA, 2785 bp, Zea mays
  misc_feature (71)..(71): n is a, c, g, or t
gccggccggtctcatcagcttgctttgcttaaaccagctcggcctttgcttttttgcagcggggtatatantcttcgctatatatccttcggcgccccggcgccggccgggaagcccacccagagctctgtagaagagaggggaggaaggaccgaggaccaaccggagccccactcggccgccgcctctcacctccaccgactgcctgcgtcccaccgctcctgctgccgcccgttgctctcgccattgaagccctcgccgcctccgcccgcttgcccgccctcccgtcggctgccttccggatgagaagcggcgcaacctgggcggtggaagcgtggtcggactgagccttcgtgggggttagcgccgagaaggatcctggagattaagcgcatgggttccttggaggcccggtacaggccgaccggggcagctgaggacacagctaagagaaggacccagaaaagcaaaagtttcaaagaggttgagaaatttgatgtttttgtgctggagaaaagttctggttgcaaattccggtcgttgcaacttttgctcttcgctatcatgtctgctgcgtttctaacactcctatacacaccatctgtgtatgaacatcagttgcagtcaagctctcggcttgtcaatgggtggatatgggataagaggagttctgatccccgatatgtatcttctgccagcattcaatgggaggatgtatataaaagtatccaaaatctgaatgttggtgaacaaaagctcagtgttggactcttgaattttaacaggactgagtttggtgcttggacacatatgctcccagaaagtgatttttcagtcataaggctagagcatgccaatgaaagcatcacctggcaaactctgtatcctgaatggatagatgaggaggaagaaacagagataccatcttgcccttcgcttccagatcctagtttttcaagagcgacacactttgatgttgttgctgttaagcttccctgtactcgtgtggctggttggtcgagagatgttgcaaggctgcatctgcagttgtcagcagcaaaattagcagcagccacagcaagaggcaatagaggaatccatgtgctgtttgtgactgattgcttcccaatcccaaacctcttctcttgcaaggacctagtgaaacgtgaaggcaatgcttggatgtacaaacctgacgtgaaggctctaaaggagaagctcaggctgcctgttggttcctgtgagcttgctgttccactcaacgcaaaagcacgactctacacggtagacagacgcagagaagcatatgctacaatactgcattcagcaagtgaatatgtttgcggtgcgataacagcagctcaaagcattcgtcaagcaggatcaacaagagaccttgttattcttgttgatgacaccataagtgaccaccaccgcaaggggctggaatctgctgggtggaaggttagaataatacagaggatccggaatcccaaagcggaacgtgatgcctacaacgaatggaactacagcaaattccggctgtggcagcttacagattacgacaaggttattttcattgatgctgatctgctcatcctgaggaacattgatttcttgtttgcaatgccagaaatcaccgcaactgggaacaatgccacactcttcaactctggggtgatggtcattgaaccttcaaactgcacgttccagttactgatggagcacatcaacgagataacatcttacaacggtggtgaccaagggtacctgaacgagatattcacatggtggcaccggattccaaagcacatgaatttcttgaagcatttctgggagggtgatgaggacgaagtgaaggccaagaagactcggctgttcggcgccaacccaccgatcctctacgttctccactacttggggcggaagccatggctgtgcttccgggactacgattgcaactggaacgtcgagatcttgcgggaattcgcgagtgacgttgcgcatgcccgctggtggaaggtgcacaacaagatgccgaagaagcttcagagctattgcctcctgaggtcaaggctgaaggctgggctggagtgggagcggcggcaggccgagaaggcgaacttcaccgacgggcattggaaacggaacataaccgatccgaggctgaagacttgcttcgagaagttctgcttctgggagagcatgctatggcactggggcgagaacaagaacaactcgacgcagagcagcgcggtgccggcaacacctgccgcgacgagcctgtcgagctcgtgaggcctgttgtgtagatacagctttgttgagagtagtagtataccagatacgaaacttctgaagctcctccatacatacatagcaacagctctgtaaaggtagctatgtaggccttttcccccccgaatgactatactcttgctcgccgtcacggctgcagcgccccctcctgctgcttcctgatggctgacaattcttttggtttttgccaataattcatcagtataggctgtttttcactctgggcggcttgaggtccggtctggggctgttgttgcttcaaaccctaccggggctactgcttttgctgcggtacgccagcggtttgatgtatggtggttgaacagtttcagtgataaatctggagtgatgcaatatgggattgctgaccagcaaacactgcatcatctatggcatgaatatttatttgatcggtaaaaaaaaaaaaaaaaaaaaaaattaaaaaaaaaaaaaaaaaaggccccta

SEQ ID NO: 17184 - DNA, 1419 bp, Zea mays
cctcgaggccccccgattttcatttccccacctctctaaaaccctcgctcttgcccgctgttttacacctaaaagaaaggtcctcgccgtcgagccgccggctcccatctcccgcgccgtcgccgacgaggacacaccagacgcctcgctgatggccttggctcgcctcggacggtctcttgccggccgcctccaccgttctatctaccgtccaccggcgcccacagactaccatgcctccgtttcccgacccttcgctccgacccacacaggcgtatgcgtacgaggttttgcaagcttgacgtacaatgccagcagcatgattggccacaatctcgaggggccgttgccagtccacattgtgaaggttctggatctcgtagtacatatgaatcatgctagaccgatgtcaacagcagcagcatcaaaggtgcctgttggagcccggaaggttggtctgaaggttgccatgatgagtcctggtttcgtatatgagccgtacagcccacgggaacgcattcccttctggaaaagatggtttacactaagtggctggagaaggacaaaggaggacatcattttggagatgaagaacgcatatgctgtttcaaggctgaggaagaaaactgggtataccaaaaatcaattctacgatcaagcattaaaaatatacaaggaggttaacactttgatggcacatggagacacatcatcgcttcggaaaattctgacagagaggatgcattctactataaaaaatgaactaaagagaagacagtccatgtggaattctgtacactgggaactggtggagcctgctgttagtatcagaactttgagggctcgcatgattggcctcgataagaatgacctggataaagcttttatacagcttacacttgagtttgttaccaaacagaaatttgaagcctataattcaaagggtgcagttgtgtctggagacaagtcgaaggaggtacttgtgaaagacatttgggtgtttgagaggtccctttttcaccccggagcatattggcgtgtatgcggaagaattacactgtaaccatatctgttttggtgtccacgttcaatttctcaccctggagctgaacaagagctagttcaataaaattttgccctgaactccttttttttcatccggttctaactgatgcctaacagggtctatgcagtgatgtagtatttatgcctttcttctttgtgttttttattagcagaaaatacaggttttctatttatgcttttgttagagaactagcccttggagagggggcatattgaccccatttggaagagtttgcatctcagcagcagcaggtatcagaattgagaatactgcctaatgtgcgcgacaagtaaaagctggatctcttttgtcgtaaaaaaaaaaaaaaaaaa

SEQ ID NO: 17185 - DNA, 2880 bp, Zea mays
  misc_feature (2360)..(2360): n is a, c, g, or t
gccggccggatccagaaattcgagcacgagaccattacctagaacatcctaatcgaaaacaccccaaccaaaaccccacggacggaacccaagaaagaagagaggggcacgagtccccatgaacgacgccggcgaggccgaggcgcaagaactcgccccacccggcgcctccgccgccgccggcctgcaaggcagggcggaggtcgacacctcgacgcccttcaagtcggtgcgcgaggccgtcgaccgcttcggcggcagcgccgcctggagctccgacctcatcaagcgtatgttcgcgctgcccccgagcccaaagaagcaggaggggggcgacgaactggccgatctggaggagcagaccgcgcagctagagaaggagctcggcgtcaaggaaagggagacgcttgatgtgctcaaagagttggagtccaccaagaaggtggtcgcagatttgaagctaaagatacagaacgaaggtgccggtgcattttgcatccctgaagagagtgttcggggtcaagccgagctgcccactgccgctgaagaggttgcagaagtgcagcctgagaatgctgaaactgatgtggttatgggcgcgcttcatgtgcagctgcaccagtctcctggtacttcagtgctgaagggccttgagcaggcaaaagccaatctaaacaggaccacgagtgatcttgcagctataagggcctccgtcgagtcgctgcggaacgacattgcgaaagagagaatcttggtggagagaagccgagagaaggtatgtgccaacacgacactgattgcttctctggaggatgagctgaaccggactgcacagaagctgcagacgctgcgggatctgcagaggaggcgtgacgatcaatcggacatcttcatagagatcaagaagatgacatctgagctagagcagctcaggaatgcagcgagtgctgccaaatcggaagctgctatgctgtctgccgaaattgagcagatgagagctagcatcggcactgctgaggtgaggtgccgtgcagccaggaagatagaagaggcggcaagggcagcagaagctcttgcccttgctgaaatcaagatcctactacgcaatgaagcttcagttgaggatcttcagggcatggaagatgtgagcctttcattggaagagtactctgagcttgctgccaaagctcaggaggctgatgaacgctcaagaaagaaaatcgatgctgcaatggtgcaggtagatgaagctaacaggacagaatctgactccctcagaaagctggaggaagctcgattacaggttgaggaatgtaagaaggcgctacaggatgcccagaagagggtggatgctgctaaccgagggaagagcgcagtagaagaggctcttcgcagatgtcgatccacgactggacacaggaggaggtcggtccatgaccctcccaggttcaaacatccagctccccgttccagagattctcagaatatggatatcgtcggtgtttcaaagggtcccttgaaaccaacgttgtcaatagggcagatactgagtatgaagctaatgggaccagatgggtatgacaaaagcgtctgggacgacgcaagcgaagcttctactatgtcgctcggacatatcctgaaccgcaggcatgcagtcgtgtatagcagcgatgcaactgctcagaagaaattcccagggaagaggaagaagtttgcctttacaggactctctattttcttggcgagacaggccaagaggaagaaggaaaagggatcgcattagaaactgctgaagccaacttgggctgggaaaagagaagcattgtagtctaccttgctagctgttaactcagaccctagtgttactgttcttgtaatttactagtatgtgtcgttgataggtgcctagatcattggtttttccatagcaggctagtaagttgtagctgatatttctgtctagtggttatttcaggtgctgtgtgaacttgcaatgtagcagtatgactagtagctgatatcaagtatatgaggcatatgtggttcactgagattggaatcttcttctctgctacatgatttcacaactgatacctctctgttttgtgaacttggtcttttcaaccatggttctaacctgtcttgatgaaacgcgtgcttgcatgtccttcaagaaaataagaaaaaaaaactttctcacttcatttgttcagtccaccctttgtttggtttttctcatggatgggtggatacggttctctacttctcttggttgggataagaccttatagattcaggtgatcgggatacgatcgatcaatatggtttatatgatgaacccatgggataagcttggttgntctgctataaaaatagccaagcattcttgaacaaataacctgaaaaaaatctaggtacaacaagcgtcgatatgtccgagtggttaaggagacagacttgaaatctgttgggctacgcccgcgcaggttcgaaccctgctgtcgacgcaatatgttttttttgtgttaactcttgttgagcattggactgggccttttgtcatcctgggcctgattcgtcgaactattattgtgctaacaaatattttattttatgtaccgcaatacccccaagagaagccttcaaatcgtatttctattcgaatatctcgtttggagtccagaccaagaaaaaacaacttatctgaaacgacagacatagccaaactagactaaccgacaacgtctttgtctccatggggtatctctcgtgtgagagttttaacggttcctttgctaactggttgagaattagtcatttttttttcgttacataaatgtgatagctattttctaatggtttactcataaatcatttttg

SEQ ID NO: 17186 - DNA, 779 bp, Zea mays
gggagcgcgccttgtgtcgccccgcggtcgcccgcgtggggccggggcgcccgctcattgcttgcctccagtctccagagaacgcgatttgttctgttgttcggtccccaatcttcgcctccgctccgcccgccccgacccagatcaggagctgagagatggacgccaacaggcgccaaggtgggattcagcagttgctggctgcggagcaggaggctcagcaaattgtgaatgcggctagagctgctaagtcagcaaggcttaggcaagcgaaagaggaggcagagagggaaatagccgaataccgtgcccagatggaggctgagttccagaggaaggtcgcagagagcagtggtgactctggtgcgaacgtcaagcgtctcgaggaagagacaacggcgaaaatcgaacagctcaaccagcaggctgcaagcatctccccagatgtcattcagatgcttctgaggcatgtcaccaccgtgaagaactgagaagtgctgctcccaaactatgctcatcggtctatttatttttgtcagagcaggtgaggaataataatatggcccttgtaccagtaattctttttttaactacggaataagccgcagcagctttagcggcaaccgtgactgttactaccagaacttgccattatttggtataatcggcaaattaaataatattgttttatattggatttttgaacaaacttttttttgctgattcaaaaaaaaaaaaaaaaaaaaaaaaaaaaaaaaaaaaaaaaaaaaaaaaaaaaa

SEQ ID NO: 17187 - DNA, 1642 bp, Zea mays
tgaagatacagatgttcataaagagcctccacactttacaaatatatctcaatcagagatgtataattgcacaagttcaggcagaatgtcatctgatgaagatcatggttcaggcacagtaaatggtgatttattcatactgaagcgcataatggtggagaggggaaatgcagcttacttgagtggattgcgggagaaatactttggggaattattttcaaatgcttccaggactcttgaaggtttgtcgaggatagaatcatcgactatctcagtggacatgctatatgatcctgatatccatctagaaaagaacttgtcagctactgaagaaccacttaagcatgtggctaggtttatagaatcttttgaatcagaatcaagggaaatttggctggtgtatcacaatgaaggccactcattatcaaaattgatatatacagctgaagaaacgaagttagtcactggcaacaataatgagagggtcagacatatccaagttttgcacccatcgaagtggtggcattggctaaggacaacaaaagctgggctaaagcagatgcaaaacctcttatggcagctgttgatgggactgaaggcttgtcatgatcgtaatatcacccaccgggatatcaaacctgagaacatgatcatttgctttgaggacatggagactggaaagtgtctaagagaggttccatctgaagcaaagcaaaataagctgaacatgcgtctgattgacttcggcagtgccattgatgatgacacgttgaagaatctttatggtccaggacctactcgatctgaacagacatttgagtacactcctccagaggcactccttaattcaaactggtttcaaggatcaagaagtgcaaggcttaagtatgacatctggagcgttggagttgtcatgctagagttgatgatgggttctccccatgtttttcagataagtgaccgtacacgcattttaatggatcagcatctcggagggtggagtgaacaaacaaaggagcttgcatacaagttgaggtcatacatggagttgtgcattttagtcccagggatttcctcgcaacatcatggcagtggtagcccagaacagggtcaatttgggttagcttcttggaaatgctctgaagaatcatttgcacatcaagtgaagatcagagatcctctcaagattggttttcctaatttatgggcgttgcgacttgcacgccagctacttgtgtggcatcctgaggatcggctaagtgtcgatgaagcactaaatcatccttacttccaggagccaatgtaatgtaaggagaggagattagtgataactaaccgacgaatcttcagctcagtcctttcaagttcaagccgcatgcatttggttagaggaattcatgaatcgtttgtaatttaccatcctagctgtgtcataagatgttgtgaatataacatgaagtaaaagatagtagcataagtgaaattacatgtgtaacgactttgcccttacaagctacagcattaggccagactgcctttggttgcaatcactaatgaggaagaacgttatctatttgttaatgtaaacagctaagggtgtcccttctccaaaaataaataaaaaaaaaaaaaaaaaaaaaaa

SEQ ID NO: 17188 - DNA, 2178 bp, Zea mays
aatgccaatgttccactgtaaattacatcctttctgtatcaacttgagtggttttcttcctgacagacatgtttgatcctttcgtaatatgcttttgtactcaaatgattgagaattaaggccagctaaactaactgaaacagtatttgtctaacattttttaatctaacaacatgtgccagtgtataaaagaatgctttccttgccccgggttcgattcccctcggggacgaatttcgggcttggttaaaaaaatcccctcgctctactcccggtttacgccctgcgtgccaccctacggctgggccgttaaagagtgggcggtgacgtcccactagtgacggggtcagggtttaggggattttctcgaccaggaccatgtcttagtctcttcttaatataataccgggagggcagactttccctctccggccgagttttttacatttttctgatatgttttttcttcaagtgacgttagacatgggttgcatggcactactttgacttgttttgttccattctaattcaattgtactgcaactccagatctgaacagacatttgagtacactcctccagaggcactccttaattcaaactggtttcaaggatcaagaagtgcaaggcttaagtatgtctctttttcccatttctcttctacgaattctggtatgtgccactgtgtttgacatacagctgcactgtgattcactgaatttcttgtttaactatgcacaggtatgacatctggagcgttggagttgtcatgctagagttgatgatgggttctccccatgtttttcagataagtgaccgtacacgcattttaatggatcagcatctcggagggtggagtgaacaaacaaaggagcttgcatacaagtgagacaatgtttaaatttctccgtgaagtctggattagcaaagctgatacaatttgcagttcttgttctattagcaaacttgagaacatcacagaaattccagttttaattaagtattatgaactgcaatttcccctatggttcttggggtatcccaaattattggtactgatgaatatcataaatctactgccttcttttttaggcgaacaaaacacttgaaatttttggtgctcttgttatatataggcaagaagcaacctcacgcattgatatttgctatgttgatatgacatattgacataatgtagcattatctggtcctgagtcctctctaaccatcatagtcaattggctatattaaatgaaattaggaagtgaggtgttccagataggcctgcagtatgaatgtttagagtattctagagagaaaatgactgccatagctttccttggtttcctgttctgatgttaggttgaggtcatacatggagttgtgcattttagtcccagggatttcctcgcaacatcatggcactggtagcccagaacaggtcagcaactctattatctgcttattactgcatcttataattctactgtatattcttgtgcaccatcattgtttctcttattgtaaaaaaatgcaagataagtccacattattgcgtagtttcatttccacaatgtagttcatatggtgcaaaaaggacgtattttcttgggagaaagaacgtattttggggctcccttaccctgaacgttgaccccctgaagccctaattaaatatctgccctggtatgtagcaagaggcttcatggccgtgacagctgatgttgtaattcttttttactttaagggtcaatttgggttagcttcctggaaatgctctgaagaatcatttgcacatcaagtgaagatcagagatcctctcaagattgggttggagtttctattcttggccacatcttcattgcccccagaatgcttggatcatcaccattttcatatctaatagcttcatcattgcttatgcttccagttttcctaatttacgggcgttgcgacttgcacgccagctacttgtgtggcattctgtacgtttcttgaaccctgctacatagaactatttaagtgctgtagttaagaccagaatagtggcctcctgacatgggtctcactcttatttatacagatcttttttttccttgggttcctattgcagtaaatacttatcctatcttgcacgaggatcggctaagtgtcgatgaagcactacatcatccttact

SEQ ID NO: 17189 - DNA, 951 bp, Zea mays
cctatgggcgattgggttcctcgaggccggccgggaccaacgacgagccacatcgagaacacgatcgagcacacaagcacgaagactcgtttaggagaaaccacaaaccaccaagccgtgaaagcatcatggagtacggtcagcaggggcagcacggccacggcgccacgggccatgtcgaccagtacggcaacccagtcggcggcgtcgagcacggcaccggcggcatgaggcacggcacgggaaccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggcatgggcggaaggaggaagaagggaatcaaggagaagatcaaggagaagctgcccggaggccacaaggacgaccagcacgccacggcgacgaccggcggcgcctacgggcagcagggacacaccggcagcgcctacgggcagcagggacacaccggcggcgcctacgccaccggcaccgagggcaccggcgagaagaaaggcattatggacaagatcaaagagaagctgcccggacagcactgagcgcccataagtacagtggctgtgctggcgcgtcaaagccgtaatgttcagtgttccatagataataagataaatccatgaataagtgtccctacccttgatcatgtgacagggacagggacagtttcctgtacttgtggggtgaatttgtacgtgtgatacggtaactgggtccgtgtactgtttatgctacgttttccttcctaaaagtacgtatatatatacagcacttgcgagtggctttacttgaaaaaaaaaaataaaaaaacacgagaccagtctccctcttctcctcgggccgtccgctttagaggatcca

SEQ ID NO: 17190 - DNA, 932 bp, Zea mays
ccacgcgtccgcacgatcgagcacacaaccacgaagactcgtttattaggagaaaccacaaaccaccaagccgtgcaagcatcatggagtacggtcagcaggggcagcgcggccacggcgccacgggccatgtcgaccagtacggcaacccagtcgggggcgtcgagcacggcaccggcggcatgaggcacggcacgggaaccgccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggcatgggcggaaggaggaagaagggaatcaaggagaagatcaaggagaagctgcccggaggccacaaggacgaccagcacgccacggcgacgaccggcggcgcctacgggcagcagggacacaccggcagcgcctacgggcagcagggacacaccggcggctcctacgccaccggcaccgagggcaccggcgagaagaaaggcattatggacaagatcaaggagaagctgcccggacagcactgagcggcgcctatacgtggctgtgctgggctgtgctggcgcgtcaaagccgtaatgttcagtgttccatagataataagataaacccatgaataagtgtccctacccttgatcatgtgacagggacagggacagtttcctgtacttgtggggtgaatttgtacgtgtgatacggtaactgggtccgtgtactgttcatgctacgttttcctacgtatatagtacagcacttgcgagtggctttacttgtgtgcacttcctaaaagtgtcgatattacctccatcagtaaatatgacccttgtgatgaaacttacacagcatgtcttaccaacagctgttattat

SEQ ID NO: 17191 - DNA, 854 bp, Zea mays
tcgtcccgcctcatcgagaacacgatcgagcacacaagcacgaagactcgtttaggagaaaccacaaaccaccaagcatcatggagtacggtcagcaggggcagcgcggccacggcgccacgggccatgtcgaccagtacggcaacccagtcggcggcgtcgagcacggcaccggcggcatgaggcacggcacgggaaccgccggcggcatgggccagctgggtgagcacggaggcgctggcatgggtggcgggcagttccagcctgcgagggaggagcacaagaccggcggcatcctgcatcgctccggcagctccagctccagctcgtcggaggacgacggcatgggcggaaggaggaagaagggaatcaaggagaagatcaaggagaagctgcccggaggccacaaggacgaccagcacgccacggcgacgaccggcggcgcctacgggcagcagggacacaccggcagcgcctacgggcagcagggacacaccggcggcgcctacgccaccggcaccgagggcaccggcgagaagaaaggcattatggacaagatcaaggagaagctgcccggacagcactgagcggcgcctatacgtggctgtctgtgctgtgctgtgctgtgctggcgtcaaagccgtactcttcagcgttccatagataataagataaacccatgaataagtgtccctaccctttgatcatgtcccccccccagggacagtttcctgtacttgtggggtgaatttgtacgtgtgatacggtaacttggtccgtgtactgtttatgctgctacgtttccttcctaaaagtacgtatatatatacagcacttgcgagtggctttacttg

SEQ ID NO: 17192 - DNA, 3737 bp, Zea mays
catacagattttgtatatcatagtgatgtttatcgttccgtttctatgtttcatacaaacttttttactcccgtcgcaacgcacgggcactcacctagtttggtattatatcagatatggcactactaaataaaaaaatgagttgaatgaataacaaacctccgtctaaagaattatggtatgtatgttggatcatctgagaagtaatcctcatataatctacagtgtcctaattctctcttacgacgaacgacttgatgatcagggatagaaccatgtttcggtttgttgacatattcatgtaaaatttgtgaccctcccaaaagaaactgatcatcgactcaccttcatcacagaggacgaatcgatttcctgttgcaacaaagagcctcaattcatatgtaaaaagcaataccccatggctgcattacgtcaaacaggtggaataaagcaaggtgtccaatatgtattgcgtgagacttgcgatgctcgatcaacatgaagttgttcattactgtggcggtgccgccgagacttgcgatgctcgatcaacatgaagttgttcattactgtggcggtgccgccgcggcgccggcgctagcgctggcgaccaagcggccgacggagggcgtccctggcttgggcaaggtgcccaacatgctctacgcctctgccatcacccttgacatcgtgctggtacacaaatcgagacaagtcatacatggtagtgtagactcggtggcggcgcacgttaggtctcaggcaagctgcacaaggtaaacaattcctcggtgataaaaatatatcaatataggttcgaggctcatctattacccagtttaaaatattttacgcctatttttaggagaactgctgaagacaaggtcaaaatcatctcctaataaattacaggaggctattaaaaacatgtttttagaagttattttttgggagctcttgaatatatactctaagcttactagatagttgtggctcgtgctttgctacgagttgttatatatcatataaataggtattgcgaaatttattaaaatataattattgtttatttttaaaaactaaggtacatgtggtctggtggtcagttctaaagtactcgctttgcactatttttgcgcggcaggatcaggtgctgggtagcacaatagctggtgcgtgggggctggaggcgtggggtccacatgtgcctacattaaattcttaatagtatagattgagtgttcacataaaatacatatataatttaatcattagtttaataagttttattagattgagcgtagaatttatttctgtaaaatttatttacagatacaaatattaatatttttctgtatttttaattataaatttaaaaggtttgtcttttaagaagtgagatatatatttgccttgtaacagaaggagcagctagaacggtcatatatgcatgcatatgcaatgcgtgcatgctaagggtcagtgtattatttttatagttttgaatcaatactacaatatttaacgatactgtgatattgatggcaacaagatgtttggccggtatatgtaaaatatagtttcagatactatgatttattcaaaactatactatttttagagttgtagaaactacacttagaaccttagttttttttcttttctcttacatatattttggttttttaatggagccaaacaaatcttaattctaagcaatactttgattttactgtgataagatagtactgtaatatttatattatatataattataaactataatatttcaaaactatagtattttaaaattgcattaacaaacatgtcctaattggtactcctgagatactataccctcctgttttaaaatagttggcattatcgaattatcattttactttttaatgttttctcttcttttaatatattttatgaattttaatgtattttaaaatgttatgcagttcgctctggacttttctgctgcgcctacacttgggtgtactgggcctaaattcagcctgaccgaccgcctgcattgaataatggatgagcaccggtaaaatccgcgtacccaactttcgagaagaaccgagacgtggcgggccgggccaccgacgcacggcaccagcgactgcacacgtcccgccggcgtacgtgtacgtgctgttccctcactggccgcccaatccactcatgcatgcccacgtacacccctgccgtggcgcgcccagatcctaatcctttcgccgttctgcacttctgctgcctataaatggcggcatcggccgtcgcccgcttcccaccggcgagccacatcgagaacacgatcgagcacacaagcacgaagactcgtttaggagaaaccacaaaccaccaagccgtgcaagcatcatggagtacggtcagcaggggcagcgcggccacggcgccacgggccatgtcgaccagtacggcaacccagtcggcggcgtcgagcacggcaccggcggcatgaggcacggcacgggaaccaccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggcatggatacttctttcttttgtgtgcgcgctgcttcgtcctatatataataatacatgagttaggcttagtaataatcaattaatttaatccgtgggtttcgtgtttaagtcggaggacgacggcatgggcggaaggaggaagaagggaatcaaggagaagatcaaagagaagctgcccggaggccacaaggacgaccagcacgccacggcgacgaccggcggcgcctatgggcagcagggacacaccggcagcgcctacgggcagcagggacacaccggcggcgcctacgccaccggcaccgagggcaccggcgagaagaaaggcattatggacaagatcaaggagaagctgcccggacagcactgagcggcgcctatacgtggctgtgctgtgctgtgctggcgcgtcaaagccgtactcttcagcgttccatagataataagataaacccatgaataagtgtccctaccctttgatcatgtgacagggacagggacagggacagtttcctgtacttgtggggtgaatttgtacgtgtgatacggtaacttggtccgtgtactgtttatgctgctacgttttccttcctaaaagtacgtatatatatacagcacttgcgagtggctttacttgtgtgcactgcctaaaagtgtcgatattacctccagcggtaaataaatgacccttgtaagaaacttacacagcatgtcttactaattaacagccgttattatgttcggcgcagtactcacactggaacttacgaacaagaattgctctatcaatcaccatctactttagatatatcttctgaaacttttttcaaatccaaaagttcagtatcttcctacaaattagtgaattaggaggggttcttttgtgcagaaaaagaaagaaaagagcagtacaatctttcaaacttgcatttgaaatgtgaaatatttatacaaagggggagagatcaagacaatgcagcagggttggttatctaattggctagttaaacatgacgtggttcataggtctttgggcttcgatcatcgaggagtagagactttacaaataaaagcggggg

SEQ ID NO: 17193 - DNA, 956 bp, Zea mays
cattgggtaccccccccccggccggcccaccggcgagccacatcgagaacacgatcgagcacacaagcacgaagactcgtttaggagaaaccacaaaccaccaagccgtgcaagcatcatggagtacggtcagcaggggcagcgcggccacggcgccacgggccatgtcgaccagtacggcaacccagtcggcggcgtcgagcacggcaccggcggcatgaggcacggcacgggaaccaccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggcatgggcggaaggaggaagaagggaatcaaggagaagatcaaagagaagctgcccggaggccacaaggacgaccagcacgccacggcgacgaccggcggcgcctatgggcagcagggacacaccggcagcgcctacgggcagcagggacacaccggcggcgcctacgccaccggcaccgagggcaccggcgagaagaaaggcattatggacaagatcaaggagaagctgcccggacagcactgagcggcgcctatacgtggctgtgctgtgctgtgctggcgcgtcaaagccgtactcttcagcgttccatagataataagataaacccatgaataagtgtccctaccctttgatcatgtgacagggaagggacagggacagtttcctgtacttgtggggtgaatttgtacgtgtgatacggtaacttggtccgtgtactgtttatgctgctacgttttccttcctaaaagtacgtatatatatacagcacttgcgagtggctttacttgtgtgcactgcctaaaagggccggtattacctccagcggtaaataaatgacccttgtaagaaactt

SEQ ID NO: 17194 - DNA, 4654 bp, Zea mays
  misc_feature (1635)..(1635): n is a, c, g, or t
ccgcatggagttagagaaatatgtggattttttcaaaaatatattcggttcgaaatctgtttgacaagttctaacactagagtaagagataattactctctctctctctctctttttaactctcgtgtcgtgtcccttaggctcttttcactcctggttcccaacccctcgctgaaacagtatgttccctttgcagtactgtttctccatcagtacgtcatatatttcgatcttttttcctttcttttttgagcaaatacgtgatttttgtaacataaaacgatgatatatttgtggtctttaccatgcttcatgcattaacaaaatgttatggaccacaagaaatttcctttattagcatctttttcattccctgttcagtactgccggtctgccgctagagtaagaagaacagaaggcgatgctaatgttcggttggatttggtgatcgcttctcgcagagtgcgtgtggccaacgagctcggcgccggcaacgggaaaagggcgcgaggttcgcgaaccgtcgtgtcgtcgacgacgtcgctggtgatcggtgctgatcatgagcctgcacgacaagttcgcggtcatcttcacctccagccccgtcgtcctcgacgccgtcgacgacctctccgttctcctcgcgttcaccatcctgctcaacagcatccatcccgtgctctcagtctcaggtcagcgcgctgctccaccacgcatttctcttgcccccattccaaaacaaaaacaaaacgtgtggcccatttaggcccgcccataagcccacatgatcattgattggcccagtagcctgtaccgagcagtgctgagtagtatgacccaagcaagcaaatactcaatgtggactgtggtggtggactggtggtcgtcgtggtgtttgttgaattcaggtgtggccgtcggctccggctggcaatccatggtggcctacgtcaacatcggcatccccatgggcattctgctcggacggctcttcaacgttggcgtgctggtacgtcgcgtactgtgccctcgtttattttcctcttgaccatgcatgggcagtctggtagctccagcgttgcctcgccgcctgaaattaaattcgccgcacggaacctttgcagggaatctgggcggaaccctcgtttattgccacgctcatcctggccattatgacagtccgctgcgactgggaaaaggaggtcagacacacacacacactgccggcaaaattgttgctcattagataaaccagatgttcttctgcttgccgcttgccgagagctaacggtttggacgcggtgtcgtttgcaggccatgatcgcgactcgcgagcacgcgcatgcacaagatgtcgcaggttctgcatgtatgctagtttcgtcaaatcagatcttgcccctgtggaaaagcaatgcaaggtgctcaggaatcagggacagatcgcccgggtccgctttaggccttgttcgtttacgtcggattgcaaccagaatcgttccacctaatcaaagtttatataaattagagaagcaatacggttagaaatctttctgacccattaatccggcagaaacgaacaagcccttaagacgaaggagaggcctggcttagagtggcgtcgcactgatngtcttttgcttgtaccttcgtcttctaggccggggtagacgtctagtccttgttgatgaccttgcttactttgggtcgccgtcatgcaactatggcggccattgttttttttacggaatacattcttcgactagttatctctgaccactgggcaccggccaaaaaaagaaaagagaataaaaagaaaaaaaatagctccggcaaccggcgtcgttgtttttttttttttgcagtcgtacactcgtactgtctcatgtcatgcctaccgtggagtctactgtacaacttcatgccacagctggaggcaatcaaggacttccaagtaaccgcgggccgcggttactatcttattacagtgaccaatttcttgaggcattcatatccagattaaaaaaacaatgtactagtaccgggatggaaagcatccgacatgctgattctttctaccataccatccacgttacttttccctccgtctgaaaaaaatgcagttctataatttctaatgtctaagacgaaaacgtcgggtatactcctttatataattttttagttcaggtttaaaacgtttagctagaaaccaaactagaatcgcaaatttttcccggagggaagcagcacagcacttagacgacaccgatcaatgaccatcgtcctcgcatggcgaaggtaaatgcaaatcgatcagacctggtttaacaaggcgtcatggtcaggcttctccatgtcgtccgtagcatcatcccctgacccgccgctgggcctttccgccggtgccccgttgatcgggacgacgcgcttgctgccgccgctgtcgtcgacggcgtccggatccgtccggctcggccgctgccacgacacggaccgccagatcgacgccagccacccgggcgtccgctccgcggcgccggggtatgcggcgaggctcgcggcccgccggtgcccgcgcaccgcggtgagctccttcatcacgtgctccggcagccgcagcgtgtgccggtcgggcacgtccatggcggactgcgtccgccggtagtggaactcgtggtgggggggcgccgcgccgaggctggcgacgacggactcgggcgtgcaagcggcgacgaggcgcgcctcgccccgctcctcctcgtcgtccgtctcctcccgcaccgcttcgtgcgggcgcgccgccaggttggacccggacccggagccgtcagaggacgcgggagggtagtaaggcgcggcggcggccgtgaggtcggcgcggcagagcgggcacgtgacggcgccggcgagccaagggtcgatgcagtccgggtggaagacgtggcagcaggcggggagcacccggagctcgtcctggtcctcgaacgcggcgaggcacacggcgcactcgagcgggcccgacccggaccccgatctggccgccacgcgcgccttcacgtcgccgtacaccgcggtggggaacgactcgacgacctccttgtcgaggccggcgcgcgcgccgccaccgcggcggtccgggtgggcggcgctccctccggcctgctgctggtggtccggtggggcgtagcgggacggccggcgcgggggagcagggcgggtcggcgcgcagcggttgatgtagatggagaagagggtgagcacgacgagggcggagatgagtgccaccagcacgatcactgtggttggggtgaacccgccgccggcggtggttcgggagtggtgttggctgctcgtgctgttgttgttgctcggctgagccacagacggtcgcgccgcggtggacaggagcacgaggagcaggacggcgagtggtggcgcgacacgccgtcgggccattgccaatgccacctccgggcgccggagagagatctgctggccttgtatctggagattgggaaatgggaagagagagagagagagagagagagaggtcagaggtgttttgaattacgcgggcgcgcaatgtaacgcacgcgacgcgagacagaggggccgcctggtcagtggctgtcggtgcgacgacggggggcggcagagggggagactcgctcgacggagcaggtcacggccacgtggcgatgcgctgactcgcgcatgcctgccccagccatgccatggcatagtccgcgcccggtcaggagtcaggacacaaaggcacgcggcatggattaggcgtgcaaacgtgcagaactgcggacgtgggcggtgccgcggtggcctggtgctgatggatgaaggctgtccagtctgcacccgagattcatgcctgcaatttgtcggagctgcttaatcattctcttgtttaacgggtcagctgagctcgccggtgacaaactatagtgcgccatgatctcagctggagcaggtgaacgaatgaggctgtggtttggtcgagatttgataatgcgtttgcttgtgcagatcgatcaccctcacacccccctcttggatagaaaataaattaaaaacaaactgaaaagaaaaagaaacgccgagcctcatcaccgagcatctccaagaacacccagtatttaacctctaaatatattttgattcggatctcctccaaaagcttttggacctagcaaacagtttccaattattttgccaagaaaacatgtggcttgtctcggtggaccattcttcacctcgagtaatttgctaacacgagagaaggattgggattagcaaacactgcatcttacacgtacgcgtcatccaaacgagcctgctgtttggagcaggttgcatcccacatgtacgctgtgcggccgccaagctcacgtcacggacgtgcgaacacagagacaaacacgcgaacacggcgcatgaatttgagatgttgccgcgggagaggtcaaaatgaggaggattgggagagatgatccggctcatgttttcgcagctatgcatgatattgggagagcatgaatttgagagttaatttttctaatttcttctaaaatatattgggagagatgatccggctcatgcttccgatatctctaatcctaaaatatactccctc

SEQ ID NO: 17195 - DNA, 915 bp, Zea mays
cggaattcccgggtcgacccacgccttccggtggcggtctttggcggcccccgaattgcgtgtggccaacgagctcggcgcggccaacggggagggcgccaggttcgcgaccatcgtgtcgacggtgacgtcgctggtgatcgggctcttcttctgggtgctcatcatgggcctgcacgacaagtacgcgctcatcttcacctccagccccgtcgtcctcgacgccgtcgaccacctctcggttcttctcgccttcaccatcctcctcaacagcatccagcccatcctctcaggtgtggccgtcggctccggctggcaatccatggtggcctacgtcaacatcggctgctactacctcatcggaatccccatgggcatcctgctcggatggctattcaaccttggcgtgctggggatctgggcggggatgatcggcgggaccgccgtccagacgctcgtcctggccatcatgacagtccgctgcgactgggaaaaggaggccttgatcgcgagcacgcgcatgggcaaactgtcggaagttcggtgatggcaggatctggtgctgcacatctgaacgagcgcccgtgatttttaagctctggcgggatcgtgtgttcccgcatgttagtttcgccaaattttgcctcgtggaaaagcaacgcaaggtgctcaggaatcagggacacaggtcgccggggcagctcttgaagacgacggaggaggggcttggtgtggctatgatggttttggtgcttttgcttatgggctttatggtggtaacttcaaatcaaatagcttgactgtggaccgttgatctggatgtgttttatcatatattacttcatagaaggtaataataaaatttaattgttttaaattttgaaaaaaaaaaaatcgagggggggcccggtaccc

SEQ ID NO: 17196 - DNA, 718 bp, Zea mays
aagtcaagcctcaagcttatcgagaaaactatagttgccgcaaatcttggtgtgacacccaagcaatgacggagaagtgatacgagtgactgtcccaccattgacatctgatcgcagaaaggaattagcaaagacagtagctaaattggctgaagatggcaaggttgctataaggaacataagaagagatgcaatcaaagcttacgataaactacagaaggaaaagaagctttctgaagacaatgtgaaagatttgtcagctgacctacaaaaagtcacggacgagtacatgaaaaatatcgattccatccagaagcagaaggaacaggaactgatgaaaatctagatcttcaacaagctgagctgactgtgtatgactgcttggcgccgcgccgccggggactgcgcacgttttgaggtcaggtcaggtgctttgctgcaaccttctggatgcacacatgctgaggcaatgctgttgtgggtcgtttctctttttttttttcgtatttcttttgtaatgctcgtaaataggctctcgctcgtcgccgtgttgtctgactgttgttacgttgtcaatacttgtcgccatctgaatcgaatgtctgaaatgttcctgcccgactctcgtacgcttgtttgtcagaactcagaactctgctgaggttgtcaaagctatttcgcaccagctagcttagctccacgtgctgggctcaagctc

SEQ ID NO: 17197 - DNA, 946 bp, Zea mays
ccggccgggatccatggaatggaacggaacggaacggaacctttgcctgtctgtactgtactgtactggctgcctggcactggcgatcatccatccgtccaccgttactgttctatagcactagaacctgctgattcctggtcgccagcttctctttcccacacccacaccacaaccccccgccggcacggctcccggtgtcccttccactctccaccctctccttcccttcggcgccaagtccatccgcccctccgaatctccgattgccgccgtccagttttggcaggtgccggccgacagttgagaatgggactgaggcgcctgatgagatgctgctgctgcattgcaaagcacgcggacgacggcgacaagatcgatttcggaggtggcaatgttcacgttgtcacaagcaaagaggactgggaccaaagaattgcggaggcaaacaaggatgggaaaaccgtggttgcaaacttcagcgcttcctggtgtgggccgtgccgtgtcatcgcacctgtctacgccgaaatgtcgcagacgtaccctcagctcatgttcctgacgatcgatgttgatgacttgatggagttcagctcgtcgtgggacatccgcgcgaccccgaccttcttcttcctcaagaacgagcagcaggtggacaagctggtcggcgccaacaagcctgagctggagaagaaagtggccgccgtcgccgacgccgccggcagcaagacagtgtagtgtaggcaaagacccgcctagcttgttgacctggccctgtacatcgttatatcctattgttgctgtgtgtttctttcttggcaccgtgcgcatgcgtcgatctgtcggcggtaatgtcttccgccatgtgctgattgtaagagttgcccggtaatggtaatggtaatggtaatggtgtcttacagtttcaaaaaaaaaaaaaaaa

SEQ ID NO: 17198 - DNA, 1628 bp, Zea mays
ttttttttttttttttattttaaattctactatataaagtgcaatatatagcgcaaaaccgtattttacagtctatagacacgccgtaccgaatcgaagtgcaataaaaaaagaaaaaaatcgagtaaatttcgtcaagagtcttttcctggtccaaagcctccgcccgttcaatccgtcttctgacttctcctccggtgcccgccgactgcgaacccgatctcgattcgaccccccaagccgatcatggcggtcgccttcgcctcctcgcggcgcgccctgcacaccctccaccgccgcctcctcctccacccctcccccacacccgccgccgcgcgccgcgcgctacccacttccactcgtactcccatccccgcccactcccctaccttcttctcctcctcctcccgcttcttcaccaccgcgcgcaccgatgcgacgaggctgcggcacggggtactgccgcagcggctggcgggcggggtcaggtcggtggcgagcggcgggtcgaagctggcgccactgggccagggggtcaaggggctggggcggcccatggaggcggcgaggagcgcggccgcgcggtaccgcgcggccgtcggcctgcaggtcgaggccttctggcggcgcaactacatgatcctcgtcggcgcgggggcagtcgtcgtctgcgtcgcgctgtggaggatcatgttcggcatcgccagcaccttcgtcggcctctccgagggcatggccaagtacggcttcctcgccctagccaccgcccttgtcgcctttgccgtgagtagcattcctttctcgttttccctctgggctagctattatgtttctggttggctatagtcagaacgcctggtagtttgtgtgccactactgcggtactgctcttatgatgcttcagcatactgcacatgagcataccacgactgttaagactaaactgatagctggctatcccaatggactatatccatgataagacttaggccttgtttggttcccaggaattgagaggaattgaaaagtaatctaataataaaatgagaagcactttctagatattggtttcaattcatgggatccaaacatgcagtaagagaaaatgctttctgggataatcaaatttgttgtaggcagtagtccgcccgaaatttgctcagttatggacttatggtctacagaggatagttgcactactcgatctcacaaagtatgggtgttcagtaattagtttaacagtgattgctgtgaaaaacaaataatgtggcaaactcttgacaacagatgttctacttcacaggctgtggttgtttaccaaagcagtccgtcatgatttactccacaaaatttgcaagacctcaggctggaccggtggacttcgctggcaggcctctggttcttggacgctcggacaagaggcgagtggttacagatagagacattttccccatgttatgggttatcagattagtcttcattagcttttgattctcatgatatcagagcagttttgatgcatgccactattgaaaaaatcgaagcggagaaatccctcatcgaaaaccaagctgtatgttacagtgtatctgcattgagaaggcccttttgcctggtcaggttttgtt

SEQ ID NO: 17199 - DNA, 1185 bp, Zea mays
caattggccggccgcggacgcgctcgtcccgtctccttccctcccttggtcagcctcagccaccgaccgttgcaccagctcgcatggcgctccacgccgtctcccccgcggcggtctcctccccgctgcgcgccctctcgcgcagattcccccagcgctcaggctgtggttgtttaccaaagcagtccgtcacaatttgctcctctacgaactttgcgagaaaacttcaggatggaccagtggacttcgctgccaggcgactggttcttggacactcggacaagagagcagttttgacgcatgccactattgaagaaatcgaagcggagaaatccctcatcgaagaccaagctaaagaaaagatggagaaggcgatcgaaacagtccaaactaacttcaacactgtgaggacagggcgtgcaagcccggcaatgcttgaccggatcgaggtcgagtactacggaactccagtgaacttgaagagcattgcacagataagcactccagatgcaacttctcttcttattcaaccatatgataagtcaagcctcaagcttattgagaaaactatagttgccgcaaatcttggtgtgacaccaagcaatgacggagaagtgatacgagtgactgtcccaccgttgacatctgatcgcagaaaggaattagcaaagacagtggctaaattggctgaagatggcaaggttgctataaggaacataagaagagatgcaatcaaagcttacgataaactacagaaggaaaagaagctttctgaagacaatgtgaaagatttgtcagctgacctacaaaaagtcacggacgagtacatgaaaaagatcgattccatccagaagcagaaggaacaggaactgatgaaaatctagatcctcaacaagctgagctgactgtgtatgactggtgagtaataaccacctctgtaaagcatgaacccccgcatatatgttgggggaatgtatctggtgctcatcagagggatatggtgctcacgtgtacatttaacagcagcatcaattttataaagaactgttccacctccttcccatggcgggggaggggttctttgtaaaattagtttctaccattggatacaaggtagatgtaacagatttaaagtttctaccattggatacaaggtagatgtaacagatttaaaatatgcacccg

SEQ ID NO: 17200 - DNA, 1317 bp, Zea mays
acttacttcattgcggccctccgggccggccggcatccccttttgccagccactgctcccgtcccacccgccacaccgtccaccggcacgtccaccggctccatggcgctccacgccgtctcctccgcggcggtctcctccccgttgcgcgctctctcacgcagcctcccccagcgcccaggctgtggttgtttaccaaagcagtccgtcatgatttactccacaaaatttgcaagacctcaggctggaccggtggacttcgctggcaggcctctggttcttggacgctcggacaagagagcagttttgatgcatgccactattgaagaaatcgaagcggagaaatccctcatcgaagaccaagctaaagaaaagatggagaaggcaatcgaaacagtccaagctaacttcaacactgtgaggacaggacgtgcaaacccggccatgcttgaccggattgaggttgagtactacggaactccagtaaacttgaagagcattgcacagataagcactccagatgcaacttctcttcttattcaaccatatgataagtcaagcctcaagcttattgagaaaactatagttgctgcaaatcttggtgtgacaccaagcaatgatggagaagtaatacgagtgactgtcccaccattgacatctgatcgcagaaaggaattatcaaagacagtagctaaattagctgaagatggcaaggttgctataaggaacataagaagagatgcaatcaaagcttatgataaactagagaaggaaaagaagctttctgaggacaatgtgaaagatttatcagctgatctacaaaaagtcacagatgagtacatgaaaaagatcgaatccatccagaagcagaaggaacaggaactgatgaaaatttagacctcaagctgactgtatggctggtgaggagtaaccgcctccgtgaagcatggacccctgcatatgttggtgtttctgaagcaatttgtttggttcatggctttggcgtctcggcgctgcgccagggatgcacgttttgaatcaggcgctttgctggaacttttgggtgcacacaagttgagactgctgctgctgctgtgtgtgtgttttgagattaagacaatgctgctgtgttttttctttgagattaagacaatgctgttgcgtgtgttcttctcgttttctgtaatgttcgtaaatagtctcttcgtcgccgtgttgtctgactgctacattgtcaatatttcaaaacatacatctctgaatcaaaaaaaaaaaaaagttctgcctaaaaagaaaaaaaaaaaagcggccgcggcc

SEQ ID NO: 17201 - DNA, 682 bp, Zea mays
gccggccgggccagcactagaacctgctgattcctcgtcgccagcttctctttcccccaccacaacctccgccggcgcggctcccggtgtcccttcccctctccttccttcggcgccaagtccatccgcccctccgaatctccgattgccgccgtccaggtgccggccgacagttgagaatgggactgaggcgcctgatgagatgctgctgctgcattgcaaagcacgcggacgacggcgacaagatcgatttcggaggtggcaatgttcacgttgtcacaagcaaagaggactgggaccaaagaattgccgaggcaaacaaggatgggaaaaccgtggttgcaaacttcagcgcttcctggtgtgggccgtgccgtgtcatcgcacctgtctacgccgaaatgtcgcagacgtacccccagctcatgttcctgacgatcgatgttgatgacttgatggagttcagctcgtcgtgggacatccgcgcgaccccgaccttcttcttcctcaagaacgagcagcaggtggacaagctggtcggcgccaacaagcctgagctggagaagaaagtgggcgccgtcgccgacgcggccggcagcaaggcagtgtagtgtagtgtagtttaggcgaaagacccgctccttgttgacctggctctgtacatcgttatatcctgttgctg

SEQ ID NO: 17202 - DNA, 1185 bp, Zea mays
atcaacgctaggtcacccgggcttccctcctcctcggacaccagcgccgacgccgacgccgccacccaggcctccctccacggacgtgggcctccctcctcctcggacgccagcagctggcgccaagtctccaccctctccttcccccgccataacccccgccgacgtggctaccggtgtcccttccactctccaccctttccctcccttcaacgccaagtccatccacccttccgaatcttcgattgcctccgtccatgtaacgactccaatcaccctagagtccggactctagtctggtcagatccactagcctgcgcttccacgcctagctcacgccttcttggaccctgttccctttttcttcgcgcaaaaactccacggatttgcccatgttcttcgctcctagatagactgcttcgcgatcccgcggactggtggttccggttcgttggggttccagatcttaacgaataggccggggttttcctgtggttggtgtgtcaaatagttggtcagtacggtgataccctcatcaccaccagcagcagatgttgggaggtttaggtggtcatgggtgtaaggattggatattggactgcagtactgggtcgtggcataggaaatgtcctttaaggaacctctggaacaaaggcttgtcccaaaaaatgttcccattgattttctattttctctggaattaagggaaccttactatctgttgattttctgcgatctcaagttagttattttctctgtaaacttaatgtgcactagcaacactttaaatggtccctactgaaagcataacatattccaatgacaattgttatctgcacattccttgtaaagttttttagagtttcatgggacatagcccttgtccatgtgataaaaattgcctaaatatcatgtataaccttgatttgttctatgttgttaacttcttgtttttgttatttgtattgcctctagccttattcaaaacgatactcctatctgttatttccattcttgggcattatatcttgtgtgatagagtgactagcttgtctttccagttagggagcatcaagccaaatcactaccgttcaacgatcatacatttctggtctctcaatttgttgatatgttgagtcatctgctattctagtgttttatttgactgtatgatccatacatcag

SEQ ID NO: 17203 - DNA, 792 bp, Zea mays
ccctcgaggcccgccgcgcttcccccaccacaaccccccgccggcgcggctcccggtgtcccttccactctccaccctctccttcccttcggcgccaagtccatccgcccctccgaatctccgattgccgccgtccaggtttggcaggtgccggccgacagttgagaatgggactgaggcgtctgatgagatgctgctgctgcattgcaaagcacgcggacgacggcgacaagatcgatttcggaggtggcaatgttcacgttgtcacaagcaaagaggactgggaccaaagaattgcggaggcaaacaaggatgggaaaaccgtggttgcaaacttcagcgcttcctggtgtgggccgtgccgtgtcatcgcacctgtctacgccgaaatgtcgcagacgtacccccagctcatgttcctgacgatcgatgttgatgacttgatggagttcagctcgtcgtgggacatccgcgcgaccccgacgttcttcttcctcaagaacgagcagcaggtggacaagctggtcggcgccaacaagcctgagctggagaagaaagtggccgccgtcgccgacgcggccggcagcaaggcagtgtagtgtagtgtagtttaggcaaagacccgcgccttgttgacctggctctgtacagcatcgttatatcctgttgctgtgcgtttctttcttggcaccgtgcgcatgcgtcgatctgtcggcggttatgtcttccgcccatgtgctgattgtaagagttgcccggtaatggtaatggtaatggtttctttcttcttat

SEQ ID NO: 17204 - DNA, 1508 bp, Zea mays
aaaattcgtcacaggtctcctggtccaggccgccgccggttcaatctctcctctgacttctccggctgtcctcgactgcgaacccgatctcgattcgatccccaagccatcccatggcggctgccctctcctcgcggcgtgccctgcacagcctccaccgccgcctcctcttccacccctccccctcacccgccgccgcacgccgcgcgctacccacttccactcgcagccccatccccgcacactcccccaccttctccttctccttctactcctcctcccgcttcttcaccaccgcgcgccccgatgcgaggctgcggcacgggatgctgccgcagcggctgataggcggggtcaggtcggtggcgaacggtgggtcgaaactgggaccgctgggtcagggggtcaaggggctggggcggcccatggaggcggcgaggagcgcggccgcgcggtaccgcgcggccgtcggcctgcaggtcgaggccttctggcggcgcaactccatgatcctcgtcggtgcggggggagtcatcgtctgtttcttgctctggaggatcatgttcggcatcgccagcaccttcgtcggcctctccgagggtatggccaagtacggcttcctcgcccttgccaccgccattgtcgcctttgccggtatgtatgcccgggcaaggttaaccataaaccctgacaaggtttaccggctggctatgacaaaactcaatacatctgctgccatccttgaagttatgggtgcgcccctaactggtactgatgtcagagcatatgttatgtctggaggaggcccgaaactgaaggacttcaaatttaagcttggcagtaaacggtgcttcctcattttccccatcaaaggatcagaaagaaggggcctcgtaagtgttgaggccaagaagaaaaatggacagtatgacatgaagctactagctgttgacataccaatggcatcaggtcctgaccagcggctgttcctcgtcggtgatgaacaagagtacaaggtgggcgggggcttgatatctgagctgcgagacccgatcgtaaaagctatggccgcggagaaggagtttgactatctcgacgagagagaggatgaggaggacgagcggagggagcgtgaggaggcggagcaagaggaagcggaagcattgaggcgcgaggaggaaaggctgcgccaggagggtgaagagcgtaggcggcgggaggaggctgagagcctggagaaagctacgtgacatgacttactgtactgactttccaccttgccttgtgcattgtcttctacctctgtctctaccggagtgtagcgatcagcggtttccacagcaggagattgcttccgagttcacttgagtttctggtggtcagttcggcgtcactagtctcaaagttgttgagaaggaaggaataattttgacggttacgcgacaggtcacttcggcgaagcaatgtaatttatagtggttgatcagtaaaaaaaaaaaaaaaaaaaa

SEQ ID NO: 17205 - DNA, 2965 bp, Zea mays
gctaccgccacctgcacgagaccattacctagaacctcctcatcccggattccactcggtgctttgcccgaggcccggagaagccttatcgcctcctccttgcacgccgaccgatcgccacaatcccccaccgctcgcctgcctggtgcccgccatgccggagatcaagtgcggcgcggccgagaaggtgaagccggcggcgagcccggaggcggagaagcccgcggacatcgctggcaacatctcctaccacgcgcagtacagcccccacttctcaccgttcgcgttcgggccggagcaggccttctacgccaccgccgagagcgtccgcgaccacctcatccagagatggaacgagacgtacttgcatttccacaagacggatccgaagcagacgtactacctgtccatggagtacctgcagggccgcgcgctcaccaacgccgtcggcaacctcggcatcaccggggcatatgcggaggccgtgaagaagttcggctacgagctcgaggccctcgcggggcaggaaaaagatgcagctctagggaatggcggcttgggtaggcttgcatcttgctttttggattcaatggcaacattgaatttgcctgcttggggctatggcctgcgttaccgatatggactgttcaaacaacacattgccaaggagggccaggaagaagttgcagaagattggcttgataaattcagcccttgggagattcccaggcatgatgtggtgttccctgtcagattttttggccatgttgagattttgcctgatggctctcggaaattggtcggaggagaagtcctgaaggctttagcatatgatgtgccaatccctggatacaagacaaaaaatgcaatcagtcttcgtctttgggaagcaaaagctactgctgaagatttcaacttatttcaattcaatgatggtcaatatgagtcagctgcccaacttcatgctagggctcaacagatatgtgccgttctttatcccggtgatgctacagaagaaggaaagcttctaaggctgaagcagcagtttttcctttgcagcgcatcacttcaggatatgattgccagatttaaagaaaggaaatctgatagagtttcagggaagtggagtgagttccctactaaagttgctgttcaactgaatgacactcaccctactcttgccatccctgagctaatgaggttacttatggatgaggagggacttggttgggatgaagcttgggacattacatataggacaatttcctacaccaatcatacagttctccccgaagctcttgaaaaatggtcacaaattgtgatgaggaaattacttccccgacacatggaaattattgaggaaattgacaagcggttcaaagaattggtaatctccaaacataaggaaatggagggaaaaatcgattcaatgaaagttttagataattcgaacccccagaagccggtagtgcgcatggcaaatttgtgtgtggtgtcttctcatacggtgaatggagtggctgagttgcatagcaacattttgaagcaagaactatttgcagattatgtctctatatggcctaccaaattccaaaacaaaactaatggaatcacgcctcgaagatggctccggttttgtaaccctgagttgagtgaaatagtcacaaaatggctaaagtcagatcagtggacaagtaatcttgatctgctcactggacttcgcaaatttgcagatgatgaaaagcttcatgctgagtgggcagcagccaagttatcttgcaagaagcgcctggccaaacatgtgttggatgtgacaggtgttacgattgatccaactagcctttttgatatacagattaagcgcatacatgagtacaagagacagctcctaaacatattgggagctgtttacagatacaaaaaattaaagggaatgagtgcagaagagaagcagaaggtcacaccgcgcactgtcatgataggagggaaagcgtttgcaacatacactaatgccaaaagaatagtgaaattggtgaatgatgttggtgctgttgtgaacaatgatcccgaagttaacaaatatctgaaggttgtctttatcccaaattacaatgtatcagtggctgaagtgcttattcctggtagcgaattgtcacagcatattagtactgctggtatggaagcaagtggaacaagcaacatgaaattctctctgaatggttgtgttatcattggcacccttgatggagctaatgttgaaataagagaggaggttggagaagataatttcttccttttcggtgccaaagccgatgaagttgctgggctgaggaaggatagagaaaatggtctgttcaaaccagacccacgttttgaagaagccaagcagtttataaggagtggcgcttttggcagctatgactatgaacctctcttggattcccttgaagggaattctggatttgggcgtggtgattatttccttgttggctatgacttcccaagctacatcgatgcacaggatcgggtggatgcagcctacaaggataagaagaagtggaccaagatgtccatcttgaacacagctgggagtggcaaattcagtagcgatcggaccatcgcccagtatgccaaggagatatgggacatcaaggctagccctgtcgtgtgaacgagggggttgcgattcaacaccaaacgtagtttcttggggtgctataatagtaaggaagaataatgacccacggtgcttgacgcccacttgcgttgtaggcatggaacgggggcacctagcttgttctacagcgctgtctattttgaattggtgcgactttgttgctcttttttcctcccccttatatcttatgaaacaagatccttttgatctgtgctctgaaataaaataattcagttatgataaaaaaaaaaaaaaaacaacaaaaccaataataataaatataaaaat

SEQ ID NO: 17206 - DNA, 2966 bp, Zea mays
atccccctgtggagaattttcaaaaggtagacaccagctgatatgtttcctaaattcctatatatttccgcctatgtgttttgtaattagtacatagttgttagaaacacaaatgcttgtataatatttgaaaaatagctgaataatcatttgcatcaagtgttgttttcgtgcagctcatttatctgatatgtctctacagaaaaaagagagacgtttaaaacggcaggagaagaaggacaaacttttagcttttactaacacattccaaacccgttcattgcgggaacgtcgacctgtcagctacaattactataaggggcttctttattgatcgtagtcctcatctcgttgaagtagtcagtgattcttgcccagtatgatttcattggctggttcacacctgccactggatccttcgacacatttatgtacgcctagcatcatgtttcatgctccactgatataatgtgttgggaaattgatcctgactgatttattggtcgaaagtattttgttcagttttttacttgttccaaacagggtaacattatatttctttcctaatgcggtgtacctttagaattatttttcaggatatggagtttgtaaatgtagtatggactatgatgttaaaagttatttattatttatttctaggttgagaaagctcacagtggagatgttcattatgttgattggaatccccttgatgttaactatatcttaattggatatgatggcattaaggttcaattcagcataatcgttgaagcaaattcgatctctatcagttccttatacgttcgagtaatgaatctttcaattgattaaaatagcacaatttatgtatggctaagatcacaaatggattataaaaccttttcttataacgctataacacgcatttatacataagttatcgtgttaatacatgtttccgttgcaacgcacggacattcacctagtaaaaggaagaagattcgggtctcgccgtctcgggggcaagaggcggctttcttggttgatgccagagtagacctagcaaaacgaggggattacacgttttgccgataataggtcggctgccttctgtcactctccccccgcccctctgctcaaaatttcccccaaaacttctcctcttgaggaaggcagcccgagcgagcgcgctgcaatggcggactcgtcggcgccgacgagagtgatgatggcggtgaacgagtcgtcgctcaaggggtacccgcacccctccatcagctgtcgcaccgccttcgactggacgctctccaagctcgtccgctccaaccctgggggcttccacttcctcttcgtccacgttcatgtccccgacgaggacggatttgatgacatggatagcatctatgcttcgccggaggactttcaccaaatgaagcagagagacaagataagagggcttcatttgctcgagtactttgtaaaccaatgccatcagttagggataaaatgcgaggcatggatcagacatggagatccaaaggaggttatctgcagcgaagtgaagagagtccagcctgaccttctagttgtgggaagtaggggtcttgggccatttcagagggttttcgtgggcacggtgagcgagttctgcgttaagcatgccgaatgccccgtcatcaccataaaacggaacgctaccgaagctcctcaggaccctgtcgacgattgatgctttcattttttttttttttttaggagaatgagatgttcttcttcactgctttataatgggttgatgtacaaaatacgatatggaagtgcctggggaactagttcccggagggaactcttgcacactgcgcccccaaaaactagagttgaagatgtaaaacgccgtcgtccgccgagggacgacgagagattgtacgtgatacatcgatcgagtctcgtgaacctaaagctgccgctacattattgttcgctcatgtgccaggcttcgctggaacgaacgccccgccccttatttgccgctgcccggccacagccacagccacagcttgagcagggtacctcaagcccgcgtagtcctttggcacggcgtagcctttgggaacgccgacgagctggggctgttgctgatgcttaagctgacgccccttgttgctgccggcaagcttgccgtcgctcttccacgccggaggcttccccggcgcgaacttgatctcgaagccgtcgtcgatgtcgtggatcgtggcgcgggagctcgccacgggcttcatcgccgggcacttgatctcgaatccgccgcccttctccaggtcgcctccgacggagtcggaggcgtaggagtcctggtcggcggcgtacctcttcctggagagccggcgcccgcacagcctgccggcgacgcaggcggccacggcgaggaaggagatcgccgcgagcacggcgaagaccgggccgaacgagcccttggcggtcgtggaaggcgcccgcgcgcgcaggacggcgttggaggacgcggggtagtagaccgtggggtcaggcatatccttggttctcggcgctctctcaagctgctagctgctgatatatgccaccacgctctccctcgaagaaaatggttcggccgtttgggtgtcgcactcttgggcaccgaggggagcgctggtctttttatgatggggagccgaaggcgccggtttgaaccgagtgattcctttgcgattttgtttttcatcacgagccaagttgcctcgagccgactctcactcagctcagctgctgtcatggcattggcatgatgatgcccgctgccgccccatcctccctctccctcgtcggaccgcgagaaaggctggcgctttgggatccctttagagcagttcaatgcgagcttggaataacgtctcggcacgtctgcactctgctgcagcagccgcctggcctctctctcactcactcacccccgtgtcccccctgtt

SEQ ID NO: 17207 - DNA, 871 bp, Zea mays
cctcgaggccggccgggctgccctccgctcaagttttcccccaaaacttctcctcttgaggaaggcagcccgagcgagcgcgctgcaatggcggactcgtcggcgccgacgagagtgatgatggcggtgaacgagtcgtcgctcaaggggtacccgcacccctccatcagctgtcgcaccgccttcgactggacgctctccaagctcgtccgctccaaccctgggggcttccacttcctcttcgtccacgttcatgtccccgacgaggacggatttgatgacatggatagcatctatgcttcgccggaggactttcaccaaatgaagcagagagacaagataagagggcttcatttgctcgagtactttgtaaaccaatgccatcagttagggataaaatgcgaggcatggatcagacatggagatccaaaggaggttatctgcagcgaagtgaagagagtccagcctgaccttctagttgtgggaagtaggggtcttgggccatttcagagggttttcgtgggcacggtgagcgagttctgcgttaagcatgccgaatgccccgtcatcaccataaaacggaacgctaccgaagctcctcaggaccctgtcgacgattgatgctttcaagccatgccatgccactggagaatgagatgttcttcttcactgctttataatgggttgatgtacaaaatacgatatggaagtgcctggggaactagttcccggagggaactcttgcacactgcgcccccaaaaactagagttgaagatgtaaaacgccgtcgtccgccgagggacgacgagagattgtacgtgatacatcgatcgagtctcgtgaacctaaagctgccgctacattattgtt

SEQ ID NO: 17208 - DNA, 972 bp, Zea mays
aataggtcggctgccttctgtcactctcccctctgccctctgctcaaaatttcccccaaaacttctcctcttgaggaaggcagcccgagcgagcgcgctgcaatggcggactcgtcggcgccgacgagagtgatgatggcggtgaacgagtcgtcgctcaaggggtacccgcacccctccatcagctgtcgcaccgccttcgactggacgctctccaagctcgtccgctccaaccctgggggcttccacttcctcttcgtccacgttcatgtccccgacgaggacggatttgatgacatggatagcatctatgcttcgccggaggactttcaccaaatgaagcagagagacaagataagagggcttcatttgctcgagtactttgtaaaccaatgccatcagttagggataaaatgcgaggcatggatcagacatggagatccaaaggaggttatctgcagcgaagtgaagagagtccagcctgaccttctagttgtgggaagtaggggtcttgggccatttcagagggttttcgtgggcacggtgagcgagttctgcgttaagcatgccgaatgccccgtcatcaccataaaacggaacgctaccgaagctcctcaggaccctgtcgacgattgatgcttccaagccaagccatgccatgtcactggagaatgagatgttcttcttcactgcttttataatgggttgatgtacaaaatacgatatggaagtggtgcctggaactagttcgcggagggttccaactcttgcacactgcgcccccaaaaactagagttgaagatgtaaaacgccgtcgtccgccgagggacgacgagagattgtacgtgatacatcgatcgagtctcgtgaacctaaaaagctgccgcgacgttcttctcagtctccagtgacatggcatggcttggcttggaagcatcaatcgtcgacagggtcctgaggagcttcggtagc

SEQ ID NO: 17209 - DNA, 915 bp, Zea mays
ggccgcgtttttttttttttttttaacaataatgtagcggcagctttttaggttcacgagactcgatcgatgtatcacgtacaatctctcgtcgtccctcggcggacgacggcgttttacatcttcaactctagtttttgggggcgcagtgtgcaagagttggaaccctccgcgaactagttccaggcaccacttccatatcgtattttgtacatcaacccattataaaagcagtgaagaagaacatctcattctccagtgacatggcatggcttggcttggaagcatcaatcgtcgacagggtcctgaggagcttcggtagcgttccgttttatggtgatgacggggcattcggcatgcttaacgcagaactcgctcaccgtgcccacgaaaaccctctgaaatggcccaagacccctacttcccacaactagaaggtcaggctggactctcttcacttcgctgcagataacctcctttggatctccatgtctgatccatgcctcgcattttatccctaactgatggcattggtttacaaagtactcgagcaaatgaagccctcttatcttgtctctctgcttcatttggtgaaagtcctccggcgaagcatagatgctatccatgtcatcaaatccgtcctcgtcggggacatgaacgtggacgaagaggaagtggaagcccccagggttggagcggacgagcttggagagcgtccagtcgaaggcggtgcgacagctgatggaggggtgcgggtaccccttgagcgacgactcgttcaccgccatcatcactctcgtcggcgccgacgagtccgccattgcagcgcgctcgctcgggctgccttcctcaagaggagaagttttgggggaaattttgagcagagggcagagccccgggcccccccaggtaccc

SEQ ID NO: 17210 - DNA, 872 bp, Zea mays
attggtacctcgaggcgccccggggaccctcgcgccctccgttcgcaaacccttctcgctgccttctgcatccacgacgacgcctgcggcggcgctggcaaaatcccactgcgatggccaccaaatcccacgagaacaagaagcctactgcctccaagccgtctgtcaaccccaagtccccttcctccgacaagaaatccaagccgccgaagcccaccgaggagcagcgggagcaggtgccggcggtcaagaagccgaagaagcagaaggtgagggacgagatcgatgagatcttcagcgccgcaaaggcgggaaagaagcggaagccgccgcagcgggaggaggctgagacccatggggacgggaggaagaagcccaaggagagggccggggggagcagcagcaagaagaagaacaacaaggcgtcggggagtaagggcaagggtcgggtagctgctgctgacgacgacgaggaggaggagttcgaggagaagcggccgcgtcggcgcactgcggacggactcgccatatactcggccgatgagctcgggttcggcaaggccgacgccggtggcaccccgatgtgcccgttcgactgcgaatgctgcttctgagctctgagtttgtcggctgccgccttccctgccggaggtgatttgcacgaggctaattccagtgtagttgtacttgatgaattcggtggcgtgtccgcttacatctgtgctctgatgaaatggaaattttgatcctgaaattcagagtcaatgcttactgactggagcattaagaatttattatgttgacacatctagagcttgttgtttgttgatcagccgtagcttaatacctagcgtttcagtgcaacacaaaaa

SEQ ID NO: 17211 - DNA, 1159 bp, Zea mays
ggggtgcgaccgaatccacagaagaggaaaggggcggttgctttatattccttctcggctgcaacctgcgtgcatctatccagccgtctcggggcgtcgtgtgcgcgtggatctctccgtagaagggatgaagatcacggcgctccttgtgctgaagccgtcgacctccggagccggtagctcctcgtccggcggccagtcgggcccggaggcggtcgtgctcgcgaacgcgacggacgtcagccacttcggctacttccagcgcagcgccgcccgcgagttcatcgtcttcgttgcccgcaccgtcgctcagcgcacccagccaggccagcggcagtccgtccagcacgaagaatataaggttcactcccacaacagaaatgggctttgtgcggtggcatttatggatgatcactatcctgtacgaagtgcattttctcttctgaatcaggttcttgatgagtaccagaaggcttttggggactcctggaaatctgctactgcagatggaactcaacagtgggctttcctgacagacgccttggcaagatttcaggaccctgcggaagctgacaaactaatgaaaattcagagggacttggatgaaacaaaaattattcttcataaaactattgatagtgtcctggccagaggagagagattggatagcttggttgagaaaagttctgatctaagtgctgcttctcagatgttctacaagcaggcaaagaagacaaaccaatgttgcacaatactttaaactttggtgcttcaatcatgtttgcaagaaacaaaaacgatcgatattgtgctaatttactgtaagttaaatcgcccatgaagcgtggacacgcggttgcaaggctcgagctcagtgctgttggtctcagtttgcaaggctatagttttctccaagacctgccgattggactgttttcttgtgagaattcctgctctccaaacagcacatggagtatcattctttagtggttatgaaactgcgtagtgcctgctaacaccatttattgtactatataaggcttgcctcaaactgcagaaattaccaaatattgttaaattctcaaagcttactggcagtggcgaagacagcacaagctgataaaaaaaaaaaaaaaaaaaaactcgagggggggcccgg

SEQ ID NO: 17212 - DNA, 1838 bp, Zea mays
  misc_feature (14)..(14): n is a, c, g, or t
  misc_feature (16)..(16): n is a, c, g, or t
  misc_feature (1681)..(1681): n is a, c, g, or t
attgaatcactggnanaacttattcatcagcgggcccctcgaggcccgccgggaagtagtaagatatgtgttacacctatctattcatctctcccgtcagaacagcaaatgaatgcttttaagcctgcaccagctggaactcgcaaggtagttctagctacaaatattgctgagacttcagtaacaatacctggcatcaaatatgttatagatcctgggatggtaaaagctcgtgcttacaatcctgtgactggaatggaatcactaatcattattccagtctctaaagcgcaggctcttcaaaggagtggtcgtgctggacgtgagggaccagggaagtgcttccgattgttccaagaaagtgagtttgataagctggtggattctactgtgcctgagattaagcggtgtaacctctcaaatgttgttctgcaactcaaggctcttggaattgatgacatcataggttttgattttatggagaaaccatcaaggactgctattttgaaatcactggagcagttaatcttactaggggctctgactgatgattataagctctcagatccagttggtcatcagatggctaggctacctttggatccaatgtactctaagtcattaatagtatcaagcaaattcaagtgcttggaagaaatgctcattgttgtatctatgctttcggtggaatcaattttcttctccgtgcgtgagaagttagaagaggcaagagctgccaggaagagattcgaaagctccgaaggagaccatatcacattggtgaatgtctatcgaggagctgcagaatgcttggagaagagcagaaatgcaaatgccaaagaaaaaacaatggaaaaggctctgaacaggtggtgcagagaaaacttcatcaactaccgctctctaagacatgctcgcgatgttcacagacaaattcagggccatgtccaacaaatggggctgagcatgtcgtcatgtggagatgacatggttctgtttcggagatgccttacgtctgccttcttcttgaatgcagcgatgcgacagccagatggttcatacagggcccttgcaactggccagagcgtgcagatccacccttcatctgtgcttttcaggaccaaggtcgactgtgtcatcttcaacgagctagttcggacgacacagaactatatcaagaacctgacccgtattgaccccttgtggctggctgagctcgccccgcagtactacgctaccgaagagtaattgtgatcagtggacattgggcacaacagtaatactttatggtgatgacgaattatttatatttatgcaattcgttattatattaaagtatggtgctattgccgaggagtttctagggggtagatgaaaaaaatttaagagatgggctattcgtaaagagcccgtttttacgattccctatatttattgtgtcttgactgtatttatgatgtagagtctcgaggttgtttcatgcagtttcttagttgtctcgtccttatcctatgagcaagtttaataatagagcccattgctggctctaactccttgtcacgtcatctagagccaacaataaacacacttatatgagatatgataaagttggctatagggttggcttttagattaatcccttgtctctctctttcaaaagagaaaagagaggtaaaaaaanatttttgggggtgagcaattatttaattttaagccattcggtattattattaagatttggggtatttgccaggaggtttttagggggaagtgaaaaaaattttaagagaggggtctatcgtaaagaagccccgtttttcacaatccctaatattaat

SEQ ID NO: 17213 - DNA, 1272 bp, Zea mays
cattgggtacctcgaggccggccgggaagatgggcccagtgtcagactcgtcttctcctgtgggaaccgtcttgctatcgtgctaggcattggggtgcgaccgaatccaacaggagaggaaaggggcgcttgctttatattccttctcggctgcaatctgcgtccatccatccagccgtctcggggcagccaagaggtcgtgtgcgcgtggatctctccgtagaagggatgaagatcacggcgctccttgtgctgaagccgtcgacctccggagccggtagctcctcgtccggcggccagtcgggcccggaggcggtcgtgctcgcgaacgcgacggacgtcagccacttcggctacttccagcgcagcgccgcccgcgagttcatcgtcttcgttgcccgcaccgtcgctcagcgcacccagccaggccagcggcagtccgtccagcacgaagaatataaggttcactcccacaacagaaatgggctttgtgcggtggcatttatggatgatcactatcctgtacgaagtgcattttctcttctgaatcaggttcttgatgagtaccagaaggcttttggggactcctggaaatctgctactgcagatggaactcaacagtgggctttcctgacagacgccttggcaagatttcaggaccctgcggaagctgacaaactaatgaaaattcagagggacttggatgaaacaaaaattattcttcataaaactattgatagtgtcctggccagaggagagagattggatagcttggttgagaaaagttctgatctaagtgctgcttctcagatgttctacaagcaggcaaagaagacaaaccaatgttgcacaatactttaaactttggtgcttcaatcatgtttgcaagaaacaaaaacgatcgatattgtgctaatttactgtaagttaagtcgcccatgaagcgtggacacgcggttgcaaggctcgagctcagtgctgttggtctcagtttgcaaggctatagttttctccaagacctgccgattggactgttttcttgtgagaattcctgctctccaaacagcacatggagtatcattctttagtggttatgaaactgcgtagtgcctgctaacaccatttattgtactatataaggcttgcctcaaactgcagaaattaccaaatattgttaaattctcaaagcttactggcagtggcggaccagtggcgaagacagcacaagctgatagtctcttctggcggccacaccacaggaaaaaaaaaaaa

SEQ ID NO: 17214 - DNA, 1419 bp, Zea mays
  misc_feature (943)..(943): n is a, c, g, or t
ccggccgggaaatccaaatccccgtccgcactgcgagcgcgcacccgctctcgtgccgctactggcgaccgccgccgccgccctaggccacgtgctcggcagctcatcgaagcttgttgcggcagtgaacccgtctcccccagacgcgcagcaccaaaaaccctaccaccaattctagaccctcccggctctagcttccccacactccgtcgcgggctcgtgggctccggcggtggctagattcagggtgcgggagtcggcgtcgtcgtccgagatgccatccttctctgccggcgcctcatcgcagaagcagaagcagcagttcgcgagagggaggcagctgattcgacaacagcgcaagtcgctccccattgcgtcagtggagaaaaggctagttgaggaggtgaggaataacgacacactgataattgttggtgagactgggagtggcaaaactactcagcttccacaatttttgtatgatggtgggctttgtcaggatggtaaagtcattggcatcactcagcctcggagagttgcagctgttacagtagcaaagcgtgtagcggaggaatgcaatgaccatattggcaaaaaggttggatactccatcagatttgatgattccacatccaatgcaacaaggattaaatacatgactgatggtttgcttctgagggaagcacttttggatccactcttatctaagtacagtgttatagttgttgatgaggctcatgaaagaactgttcatactgatgtcttgttgggtttgttgaaaaaagtgcaacattcccgagctaataccaataaaaatgggaagaccttgcttgggcattctcaaaatgtaactattaaggaatgccaaggaataagatgtgctccactaaagctgataattatgtctgctagtttggatgctaagtgtttttctgattatttntggtggtgctaaagctgtacatattcaaggtcggcaatacccggttgacatactatatacttatcagcctgagtcggattatatggatgccacactagttactatctttcagatccatttggaggaagggcctggagacattctggcatttctaactggccaagaggagattgaatcactggagagacttattcatgagcgtgctcgtttatttccaccagaaagtagtaagatatgtgttacacctatctattcatctctcccgtcagaacagcaaatgaatgcttttaagcctgcaccagctggaactcgcaaggtagttctagctacaaatattgctgagacttcagtaacaatacctggcatcaaatatgttatagatcctgggatggtaaaagctcgtgcttacaatcctgtgactggaatggaatcactaatcattattccagtctctaaagcgcaggctcttcaaagga

SEQ ID NO: 17215 - DNA, 1974 bp, Zea mays
ctggccaccaaggcggcgcgcaagtcggccccggccacgggcggcgtgaagaagccgcaccgcttccgcccgggcaccgtcgcgctccgcgagatccgcaagtaccagaagagcacggagctgctcatccgcaagctcccgttccagcgcctcgtccgcgagatcgcgcaggacttcaagacggacctgcggttccagtcgtcggcggtggcggcgctgcaggaggcggctgaggcgtaccttgtcggtctcttcgaggacaccaacctctgcgccatccacgccaagagggtcaccatcatgcccaaggacatccagcttgcccgccgcatccgtggggagagggcctaagcatcgtatattctgtcatcagtgcccgatcagaagatgtagagatgtgctgggttctgtagtttgggttactgtcgaatcatcgagtagttggttgttcactgctgtaacttattatcatgatgcatatgaaatggcaatgaactatgttatcagttctcgaatttctccgtttggatcccttcttgttcctctgtgcctaatcattttatatttgtgcggataacgggatgaatgctgagaaagatgaatcagcgttcagaccgagcgttctttcacaagtgatcgtgtaggtatgctgggctgtcaactgggcccactggcaggctaatcttccccttctgtgtgaatcgtcttgtactgttctcgtgctaggcagtgggctgcgaccgaatccaacataagaggaaaggggcgtttgctttatattcgttctctaacctgcgatctccgtccatccagccgagaggtcgtgtgcgcgtggatctctgcgtggaagcgatgaagattacggcgctcctggtgctgaagccgtcgacctctggagccgggagctcctcgtccggcggcgagtcgggcccggaggcggtggtgctcgcgaacgcgatagacgtcagccacttcggctacttccagcgcagcgccgcccgcgagttcatcgtcttcgttgcccgcaccgtcgctcagcgcacccagccaggccagcggcagtccgtccagcacgaagaatacaaggtccactcccacaatagaaatgggctttgtgcggttgcattcatggatgatcattatccggtacggagtgcattttctcttctgaatcaggttcttgatgagtaccagaaggcttatggggactcctggaaatctgtgactgcagatgaaactcaacagtgggctttcctgacagacgccttgacaaaatttcaggatcctgcggaagctgacaaattaatgaaaattcagagggacttggatgaaacaaaaattatcctacataaaactattgagagtgtccttgccagaggagagagattggatagcttggttgagaaaagctctgatctgagtgctgcttctcagatgttctacaagcaggcaaagaagacaaaccaatgctgcacaatactgtaaattttggctcttcactcatggttgcaagaaacaaaaacggtcgatatcgtgctaatttatttactgtaagttaagtcgccagtgaagcgtggacacgtggttgcaaggcccgagctcagtaaaggctatactgttcttcaagacctgccagaattggactgttttcttgtgagaattccagctctccaaacaggccatggagtaccatcaacattctttagtgactatgaaacctcgtagtaccagctaacaccatttactctactactactatataaggcttgcgtcaaactgcagaaatcaccaatatggttaaattctcaaagcttgctggagcacattttgtgtccacaacacaacctatgtcacattcttactcaacacaaaaaaaaaaaaaaaaaaaataaaaatgaaaaaaaaaaaaaaaaaaaaaaaaaaaaaaaaaaaaaaaaaaaaaaaaaaaaaaaaaaaaaaagggcggccgtttta

SEQ ID NO: 17216 - DNA, 4875 bp, Zea mays
acatcgtggctaaccttgcgcatacaaaatgattgacgtgatgccacgacaaagaaaaatattgtataaactggctaagtgtaaaattaaacgatgttaaaagtcgagtggtgacacgagggaggaaatggggacttttttatatacagacgctatgcacgtggctatgatttctatacatatcataagtaagctttattctaataaaacacaaaatatatgcttcttttattggttatgtaggttaaatgtagaaccgataattaaacttcaaattctttcgtacatagttttactttatttttacaaatgtttgttatttttttcgaagaaaaaagagacccaaagcgttttcgggctatgtacacgcatcacggcccgtctcggcccagcccacgacctccctttgctacgctcgccgcaactgcaaaggcgacacggggcggggtccacatgcgcagaaattgcaaccctcaacaaccgcatcaacaaaaaaccgtgggcactctcgtcattccgcaccgcgccctcctgcatccacccgatcgcgacacggaaccccagccccacccgcgcccatgacacgtgggaccaccctcccacagcccaagccatcagcagccgcgtaagacgattggaggtgcgcttagcgacttgtccttttctctcctcttatttttctcctcccctagttaacaaacatagggctagaggctagagcgagggaccggaagtgagagacggaccgaggagagagatagagagacaaaggggagagaccaagcgccagagacacagagaggggggcggaggagagagagggagaggggaatcgcgggagggaggcggggttttggcgtgatttgagttctccggttttccccacgctcccgccatggtgtccgaccaggagatcgccagctgcgtcgagtccgtcctccgaggctccgccggcgggcccggggaggtctcgctcaccgccgtgctgcagcaggcggaggccacgctcggcgtcgacctttcccacaaggcgggcttcatccgcgaccagatggacctcttcttcggcccgcgcctccagccgcagcccccgtccaagccccagccggcgccttccccgcctcaggccgtcgttgcccccgcggccgccgtgccgcagcctcatgtcttaccgcaggtgcaggcacatgcacaggcgcagcagatgcagccgcagcagctcgcgccgctccagccgcagctcatcttccagaccatccctcagctctccgccatggcccccgtccccgcggtctccgcgccgccggccgtgccggccatggcgttctacccgccgccgccgctcgccttccgctacaccaccggcctcgctggggccgccaccggtgggaccgtctctttccagcagccgacccctggggctgggggcactgcttcccctaccgctgcaccgcaggtcgccgccgacaacaaggaaaggtgagctgtcgatggaattagggtttgcggtccgcgctccgtggattgaggggattcgtatgcatatctgtcgattggcttggaaatctactttgattcgacatctagttggtcgattcgagtgattagggttgtcgagattgaagattcaaggtctatactgaggatgactagttggtatcttgaaaatggttttgttcctgtttgtgctaacctgaggttagggtttacggttcagactttcttgttggttgtgtcagtttccacttcagttcaactggttattttgtactgtagtgttcaggatatgtggcttaggatggcattttcttccccccaccccatttgtagataatggatcagtaactgtttaattgtagttttgttgccaacttctttcaacggtattggtcaaacagagaagaatccaaacgttgttctgtcgacagcttgtatcatgcatattttttgcttccaaaaaattcttttgtaaagcagaaaagataatattctgtctacactcgtaagctacaagaagttttccagactagtagtttattaaaaaggtacaaccagcaaagcacgggagacacattgtgtttcatgagtttgtttggatttataacaccactttccgcttcctgagaacaatcaagtgcaactgactattttataactccactctgtgcatgaaacggtcccagtagacagctcaagtcacttgctccctatctatgggcgtgcaaaacactattccgcactgtaggctgtgctgtttttaaagagtggagtttgaaatgaggagtgagatatggaggctgctggagatagcctaaactagtgcacccgagcaagcaaaaatgtaaccattaaatactcaaattttcatacatactaattgcatatgacatcttcatccttaacacttgattctttgttttttagtaagattcattttcctggctggtttgatgtgattgcatgcacctatgtttttctttgagatgtattgaactaaagcttgtgcaacctgttgcacagtactatgggagcaggacagcaggtcctaaaatgtaatctatttcgtttgaagaatatgttgaagactcttgtatctgaccaacattcctttattggttagtttgttttgctggtcgtggttgttcatctgtttttgagactttactcactactcagcatgtcaactgatttgtacttcgctatagtatcttggttcttttctgaagctcactgattagtgatttgtgtataatttcttctagtgcttctaagcgaaaaagaggtggacctggtggtttaaataaaatttgtgcaatttcacctgaacttcagaccattgttggtgagactgctatgtcaagaacccaggtactactcaatttctttacaatagaaattgacacactctatactctactggtactctttgaatgattgactctaggaaattaatgttagtcttcattcagattgtgaagcagctatgggcatatatcaggcagaacaatcttcaagaccctgatgacaaaaggaagatcatttgcaatgacgaacttcgtgtggtttttgaaactgacaccaccgacatgtttaaaatgaataagttgttggctaagcacataaccccacttgacccaagtacatgcttctatttcttttaatcagcgtacactaccttttcttttgcgttactaaagtttagtcctggaatatgctcaagcgcttcctaatgacaccgcagaagatcagcttcatgaagtaaaaagaatgaaggctcccacagtggttcctcaaccacctcccattaatcagcccagtgtagttatttctgatgcacttgcaaagttcatcggaacagatggaacatttcctcaagatgatgccctgaaatacctgtgggattacataaaagcaaaccaacttgaggtatggttggggtcctaccttttggtttgcagaataaccataccatgtgctctggctttttgctgcaagtctgtagtgagtatcatcatttgaagtgcaaattcactgttccttttctagaggtacattgaatgcatgcacagcagaccattcaattcttagtaacaaattttcaataatgttcaggagcagtatgagtgtatgacagtaaaaagtgcagaatgactgggtagattcaagtcaactttgtgttaatgatacaaacttgggctgtatcctctttttggctaactgcctgattatattttgttaacctatgctgctgtcaataactaggaatgttcttactataatggctgatgaagagcgttatcggtggcattgtgtagatatttgtttattggactaggtattcgtttgttgaaatatattagttcagatatcctggaatatgattgaggttaggacagtgtccacctaaaaagttctgcacaaagttgtactaacagttaaaaaaaagtttgatgtttccttgtcttttttcttgcagtcatgattatcatgtgtatagtctctgagctgtgaaatttatgtcttaatgtacacacatattaattgctatgtttggtaatgcgtaggatgtcatcagtggatcaatattatgtgattcaaagcttcaagagctctttggctgtgagagtattcctatgtcaggactatcagaaatgcttggtcaccacttcatcaagaaaacatagcaaatcctcgttaactggtcagtttctggctgtatctcctatttctagtgtcacatttgctgatttctgtccagatgtcagggatgacagtaattttcccataagttattttcatgacggcacattgttacaagttaggaatctgtttttacctgttcatttgaacatactttgatgtaagttgtgctttgtcttattctgattccatacattgtgtgcagatctaggattgcagtttggcagataggcctaacattacaatatggtgttcttgacagaatggacagcatagcgtctgtatttcttcaatgttatggaatatgaatggtgtctggcaaagatcatattatttgcggtagcctgtgctttgttacgtgtgcaggccaccgctgcggcgtctggtggaacctctttactgaattcgtagtgctagttcctaaatgtcaaaatgtcatttctgactatgtaaagttgctttctatttgagtgccagattgtactcttaaaaaggaatttgaaggaatttctgtaggtaccgataatcttgttacttccgaattgcgaagatgaaatctttgaaggtcagcaccgtttggatgtgtagaatttgaatgaactagaatcatattgtttgggcagcttgtttgatggaacgggaattccaagtaattccaagaagatgaagcccgca

SEQ ID NO: 17217 - DNA, 4846 bp, Zea mays
taatatatgaccgagttatagatttatctagataagttatacatggtccaataaatatgaatttttatgtatagtcaaaacatgcaatgatttgttcaccatatttttaccacatctggatctgcatgcctgcagctataaattaattatagaaaacacatatacaagcttatagattaaattttataataaaatatattatatcatatattcattatacatatatatattcatgtggagttctataaaattgattctttattttatgtttttacgtgatttattttattttataaaaattatttagtcaaaataaacataaaagaaaaagagaacgaaggaacgtctagagatgtcatgtgttcggtttttagcgatgagagaggatatatgtccggttttataattaaaatagaaaaactgattttttatgaaagttgtgcacgataaaatagtttttttaaaaattaatttttatgtactgtagtacgttattccggcgcatcgtatttttagaagaaaagtgcaagaggaaagagggcccaagtgattccgttccatccgcatgcatcgcggcccatcgcggcccagcccatgacctctcctcaccttggcgctcgacgctcgttaggcatcccgggcccggggcgggtctttttgcgcagaaacccctttacaatcgcataagaaaactgtgggcactctcgtcattgcgcacagcgcctgctgcatcctcctggtctcgacacggagccccattcccacccatgccaatgacacgtgggcccatcctcccgcagcccacgacatcagaagccgcgtaagaggataggaggtgtgcttagcgacctgtccttttccctcatcttattttcatcgctcccgaagaaatttgctctaaataacaaaacatagggcaagagcctagactgaggggccaggagagagggagaggccgaggagagagatagagagacaaaggggagagaccaagcgccagtgacacagagaaggggcggaggagagagagagagagagagagagagagagagagagagagagagagagagagagaggagaatcgcgggagggaggcggggtttttgcgtgatttgagttctccggttttccccacgctcccgccatggtgtccgaccaggagatcgccagctgcgtcgagtccgtcctccgaggctccgccggcgggcccggggaggtctcgctcaccgccgtgctgcagcaggcggaggccacgctcggcgtcgacctctcccacaaggcgggctttatccgcgaccagatggacctcttcttcggcccgcgcctccagccgcagccgctgaccacgccacagctggcgcctcccccgcctcaggccgtcgttgcccccgcggacgccgtgcctcagcctcagcctcagcatcaggttctgccgcaggcaccgccttcggctcagcagatgcagccgcagcagctcgcgccgcttcagccgcagctcatgttccagaccattcaccagctccccgccatctctcccgtccctgtggtctccgcgccgccggccatggcgttctacccgccgccgccgctcgccttccgctacaccaccggcctcgctggggccgccacgggtgggaccgtctccttccagcagccagcccctggggctgggggcactgcttcccccaccgctgcaccgcaggtcgccggcgacaacaaggaaaggtgagttgtcgatggaattagggtttgcgttccgcggattttggtgatttgtatgtactctgtcgattggtgcggaaatctagtccgtcgattcgcatggttagggttgttaatattgaggattcgagttctatattgtgatgaaatggttttgttctgcttctggctaagctaaggttagggtttcgggttctgatttctgaccttcttattggttgtgtcaggttcagttcaactggttcctatgtactgtagtgttcaggatatgttaacttaggacgacattttctgcccctttaactttaagtaatggatcagtaactgtttaaattgtagttttgttgtcaacatctttcaactcaacggtattggtcaaagagaagaattcagacgtcattctgttgacagcctgtagcctattaccatgcatattttgtgcttccaaaaatattttttggaaaacagaaaaaggccaattttctctatacacttataagctacaaaaattgcagattagtagtttactaaaaaggtacaatcagccaagcacaggaagcatgttgtgtttcatgaatttgtttggatttataacacctctttccgcttcctgagaacaattataattgaccattttcttgtttgtttgaatcttatttgtggcttgtctctgcatgaaatggtcccagtagacagctcaagtcatctgcagacatttatagtgcccccgtgcaaaaaataaactaaaataaaaaacaaaatgtaactgttaagtactctacttcagttttcatatgtattatttgcaactgacatcttcatccttaacacttaatttttttagtaagagtcattttcttctctgatttgatgtggttgcatgcaccttttgcaccaatgttctttgagatgtattggctaaggttgtgcaacctgtcgcacagtactacgggaacaggacagcaggtcctgaaattagtctgttttgtgtggagagtaaagaaggttaggcttgacacagtgttgagaaacttctccacttagccaaaggtcctgggtttgatgtagcctcactgcaaaaatgcaggggtaatgtttgcctcggttattccttctccagactccactcatataggagccgccaacactgggtctgttctttggagtatgttgaggactattgtatttgaccaacattcctttattggttgttctgtttcgctggtcacgattgctcatctgtttctgaaacctaactcactactcagcatgtcaactgatttgtattctactatagtatcttggttcgtttccttttatgaaactgactgattagtgatttgtgtgtgatttcttctagttcttctaagcgaaaaagaggtggacctggtggtttaaataaagtttgcgcaatttcacctgaacttcagaccattgttggtgagactgccatgtcaagaactcaggtactaaatttcattgtgatagaaatttacacactctgtactcttctggtactctttgaatgattgactctatagagtctagaaaataaatattagtctttattcagattgtgaagcagctctgggcatatatcaggcagaacaatcttcaagatcctgatgacaaaaggaagattatttgcaatgacgaacttcgtgtggtttttgaaactgacaacaccgacatgtttaaaatgaataaattattggctaagcacataaccccacttgacccaagtacagacttctatttcttttgatcaacatatgctactttatgtttgcattactaaagttcagtcctggaatttgctcaagtgcttcctaatgacattgcagaaggtcaacttcatgaagtaaaaagaatgaaggctcccaccatgtctcctcaacctggacgttccattgatcaaccctccatagttatttctgacgcactagcaaagttcattggaacagatggaacatttcctcacgattttgccctgaaatatctgtgggattacataaaagcaaaccaacttgaggtatggttaggttaggtcctaccttttagtttgcagaataaccctgccatgtgttcttggttttgctgcaagcctgtagcgaatatcaagaattgaagtgcaaattcaccttttgttttctagaggtgcattgaatgcatgcactgcagtccattcaatttttggtaacaaattttcattaatgttcagaagtagtatgacagtaaaaaagtgaagaacaaccgggtagactcaatagtcagcaacttcgtgttaatgctacaaacttggacttatcccctttttggttaattgtttggctatacttttgtgaacctatgtcactgctgtctggccaagaggactcggttgtcaggataactaggtaggaatgttcttagtgtgaatattttattgtaggctgcaatggctgatgcagagcgttgtgggtggcattgtgtagatatttgtttattggactaggtatttgtttgttgaaacatattaattcagatatcctggaatctgattgaggttaggacactaacagttaaaaaagttctgcacatatttgcgctaacagttaaaaaaagtcattttgattatgaagtgtggattcactgtgagctgtgaaatttatggcttaatacaccacaaatattaattgctctgtttggtaatgcataggatgtcatcaacgaatcaatattatgcgattcaaaacttcaagagctctttggctgtgagagcattcctatgtcaggactatcagaaatgcttggtcaccacttcatcaagaaaacatagcaaatcctcattaactggtcagtttctggctgtatctcctctttctagtgtcacatttgctgatttctgtctagatattaggtgtaatagtattttccctaaattactttcatgatagcacattgttacacgtcagtaaactattttctacctgctcatttgaaccagagttcggtgcgtaaggttttgtgctttgtcttattctgatttcataccttgcgtgcagatctaggattgcagtgtggcagataggcctaacattacaacatggtgttctttacagaatggacagcatagtttatgtat

SEQ ID NO: 17218 - DNA, 1602 bp, Zea mays
  misc_feature (1559)..(1561): n is a, c, g, or t
  misc_feature (1585)..(1585): n is a, c, g, or t
gcgggagggaggcggggtttttgcgtgatttgagttctccggttttccccacgctcccgccatggtgtccgaccaggagatcgccagctgcgtcgagtccgtcctccgaggctccgccggcgggcccggggaggtctcgctcaccgccgtgctgcagcaggcggaggccacgctcggcgtcgacctctcccacaaggcgggctttatccgcgaccagatggacctcttcttcggcccgcgcctccagccgcagccgctgaccacgccacagctggcgcctcccccgcctcaggccgtcgttgcccccgcggacgccgtgcctcagcatcaggttctgccgcaggcaccgccttcggctcagcagatgcagccgcagccgcagcagctcgcgccgcttcagccgcatctcatgttccagaccattcaccagctccccgccatctctcccgtccctgcggtctccgcgccgccggccatggcgttctacccgccgccgccgctcgccttccgctacaccaccggcctcgctggggccgccacgggtgggaccgtctccttccagcagccagcccctggggctgggggcactgcttcccccaccgctgcaccgcaggtcgccggcgacaacaaggaaagttcttctaagcgaaaaagaggtggacctggtggtttaaataaagtttgcgcaatttcacctgaacttcagaccattgttggtgagactgccatgtcaagaactcagattgtgaagcagctctgggcatatatcaggcagaacaatcttcaagatcctgatgacaaaaggaagattatttgcaatgacgaacttcgtgtggtttttgaaactgacaccaccgacatgtttaaaatgaataaattattggctaagcacataaccccacttgacccaaaaagtcaacttcatgaagtaaaaagaatgaaggctcccaccatgtctcctcaacctggacgtcccattgatcaaccctccatagttatttctgacgcactagcaaagttcattggaacagatggaacatttcctcaagatgatgccctgaaatatctgtgggattacataaaagcaaaccaacttgaggatgtcatcaacgaatcaatattatgcgattcaaaacttcaagagctctttggctgtgagagcattcctatgtcaggactatcagaaatgcttggtcaccacttcatcaagaaaacatagcaaatcctcattaactgatctaggattgcagtgtggcagataggcctaacattacaacatggtgttctttacagaatggacagcatagcttatgtatttcttcaatgttgtggattatgaattgtgtccggcaaatatcagattatttgcggtaagcctgtacattgttatgcgtgctggctactgctgtgttgtctggtgtaagtgtgtaaccttctctactgaattcgtagtgctaattcctaaatgtcaaaatgtcattgctgactatgtaaagttaagctttctattcgagtgtcagattgttactcttaagtcttaccaaaaaaaaaaaaaaaannnaaaaaaaaaaaaaaaaaaaaaaangaaaaaaaaaaaaaaaa

SEQ ID NO: 17219 - DNA, 978 bp, Zea mays
ctgaacttcagaccattgttggtgagactgctatgtcaagaacccagattgtgagcagctatgggcatatatcaggcagaacaatcttcaagaccctgatgacaaaaggaagatcatttgcaatgacgaacttcgtgtggtttttgaaactgacaccaccgacatgtttaaaatgaataagttgttggctaagcacataaccccacttgacccaatgacactgcagaagatcagcttcatgaagtaaaaagaatgaaggctcccacagtggctcctcaacccccacctcccattaatcagcccagtgtagttatttctgatgcacttgcaaagttcatcggaacagacggaacatttcctcaagatgatgccctgaaatacctgtgggattacataaaagcaaaccaacttgaggatgtcatcaatggatcaatattatgtgattcaaagcttcaagagctctttggctgtgagagcattcctatgtcaggactatcagaaatgcttggtcaccacttcatcaagaaaacatagcaaatcctcgttaactgatctaggattgcagtttggcagataggcctaacattacaatatggtgttcttgacagaatggacagcatagcgtctgtatttcttcaatgttatggaatatgaatggtgtctggcaaagatcatattatttgcggtagcctgtgctttgttacgtgtgcaggccaccgctgcggcgtctggtggaacctctttactgaactcgtagtgctagttcctaaatgtcaaaatgtcatttctgactatgtaaagttgctttctatttgagtgccagattgtactcttaaaaaggaatttctgtaggtaccgataatcttgttacttccgaattgcgaagatgaaatctttgaaggtcagcaccgtttggatgtgtagaatttgaatgaactagaatcatatttgttgggcaaaaaaatatactttatcctt

SEQ ID NO: 17220 - DNA, 993 bp, Zea mays
  misc_feature (952)..(952): n is a, c, g, or t
cctcgaagccggccgagtaatgtatcaatagatcgaacacgagacatgttttacgtggagaactcttgtatgaaaaaaaaatcatggatgctaactcgtgattttcattgtattcaaaaaaaaaaaaaaaaaaaaaaaaaaaaaaaaaaaattgggaccctcgaggccggccgggaaaaaatttaaaaaaattccactagattaccaccacctccacctcgtcgtctcccaccaccgccgagcgcgagccctagcccgatctagccggcggcaggcaccagatcccgccgcccgcggcgtcccgggacgcgccccgccgaatccgccgctcctcgcactgcaacacgcccggaccacgggtgcatttgatccgtcccggccgcctacacgatgtccaagtcgggagcgctggatcttgcttctggcctcggagggaagatcaacaaggtggaagtcaagtcggccgtcgatgagtatgagaaatatcatggatactatggagggaaggaggaagcaaggaagtccaactatactgatatggttaataaatactatgatcttgccactagcttctatgagtatggttggggtgaatccttccactttgctcacagatggaatggagaatccttacgtgaaagcatcaagcgacatgagcattttcttgccctgcaacttggtttgaaaccaggaatgaaggttttagatgtgggctgtggaataggtggaccactgagagaaattgcaagatttagctcaacttcagttaccggattgaataacaaccgaataccagataaccagggggaaaggagctcaaccggtttagcaggaattagtggaacatgtgattccggcaaggcggactttatgattatttttcttcgagacaacactttcgatgctgtttacgccattgaggcaacatgtcatgcacctgatccaggcgggngcttcaaggagatatatcgtgtgttgaagcctggccagtgc

SEQ ID NO: 17221 - DNA, 1841 bp, Zea mays
ttgggaccctcgaggccggccgggatgccattttaggcttggccggaccgccggcccaatgttgtaacccacccgtggggattgccaagcccacgatgccttaacaaaaatagtagttatactccgccagccttacctagtcgcactggcccgtggccactgcttaaatccctctcagcctctcctcccgcccggattccactagattaccaccacctccacctcgtcgtctcccaccaccgccgagcgcgagccctagcccgatctagccggcggcaggcaccagatcccgccgcccgcggcgtcccgggacgcgccccgccgaatccgccgctcctcgcactgcaacacgcccggaccacggtgcatttgatccgtcccggccgcctacacgatgtccaagtcgggagcgctggatcttgcttctggcctcggagggaagatcaacaaggtggaagtcaagtcggccgtcgatgagtatgagaaatatcatggatactatggagggaaggaggaagcaaggaagtccaactatactgatatggttaataaatactatgatcttgccactagcttctatgagtatggttggggtgaatccttccactttgctcacagatggaatggagaatccttacgtgaaagcatcaagcgacatgagcattttcttgccctgcaacttggtttgaaaccaggaatgaaggttttagatgtgggctgtggaataggtggaccactgagagaaattgcaagatttagctcaacttcagttaccggattgaataacaacgaataccagataaccaggggaaaggagctcaaccgtttagcaggaattagtggaacatgtgattttgtcaaggcggacttcatgaagatgccgttcgatgacaacacttttgatgctgtttacgccattgaggcaacatgtcatgcacctgatccagttggttgctacaaggagatatatcgtgtgttgaagcctggccagtgctttgccgtgtacgagtggtgcattacggatcactatgatcctaacaatgcaacccacaaaaggatcaaggatgaaattgagcttggcaatggcctgccagatatcagaagcactcggcaatgtctccaggcagtaaaagacgccgggtttgaggttgtttgggataaggatcttgctgaagattctcccttgccttggtacttgcccttggatccaagccgattctccctgagtagcttccgtttgacctctgtgggacgcatgattacccgcacaatggtcaaggccctggagtacgttggtcttgctccgcagggcagtgagagggtctctaatttcctggagaaggctgcagaagggctggtagagggcggaaagaaggagatcttcacgccaatgtacttctttcttgttcggaagcctcttctggaatgagctcttggatcaccttttcagagagagaaggcaagtggtcatttcgaagaagccgaggagagggaacctggaatcaagaaaaccttcagctctcctgtgtaggaggaaagttaacgaacagtgtagtaactgttcagctttgtgtttattcagttgttttgctgcttgaggttattcgtttctaggtgggggttggaatccttttcgccataaacctctcagtggcataaataagatggtttgcataagagtacttcatggataccgtaagggctactactgaaagagaaatgtttaagcagcatggtatgtgagcaactagtgataattattccatccttttttttaatataaagcaggagttttgtcaaaaaaaaaaaaaaaaaaacagccggggggcccgcgggtaccc

SEQ ID NO: 17222 - DNA, 1832 bp, Zea mays
attgggaccctcgaggccggccgggatcggctcctagcagaggcgcaccaggtcccactgccaccgcaaccaagcgcaccttgccggccgccgctcgtcctcatcttcaaatcccctcttgcacggccgcgccgccggccccgacccgtagtgtggatccatccccacacggccctcgccaaatctactcctccagtcggcaggaaaggaacccctctctacctcggaggctcggacagagtgaacgcgccacccgccccggcgagcattgtccgctgccgcgcgccaccttccgctcacgggtgcatttgatccgtcccggccgcctacacgatgtccaagtcgggagcgctggatcttgcttctggcctcggagggaagatcaacaaggtggaagtcaagtcggccgtcgatgagtatgagaaatatcatggatactatggagggaaggaggaagcaaggaagtccaactatactgatatggttaataaatactatgatcttgccactagcttctatgagtatggttggggtgaatccttccactttgctcacagatggaatggagaatccttacgtgaaagcatcaagcgacatgagcattttcttgccctgcaacttggtttgaaaccaggaatgaaggttttagatgtgggctgtggaataggtggaccgctgagagaaattgcaagatttagctcaacttcagttaccggattgaataacaacgaataccagataaccaggggaaaggagctcaaccgtttagcaggaattagtggaacatgtgattttgtcaaggcggacttcatgaagatgccgttcgatgacaacacttttgatgctgtttatgccattgaggcaacatgtcatgcacctgatccagttggttgctacaaggagatatatcgtgtgttgaagcctggccagtgctttgccgtgtacgagtggtgcattacggatcactatgatcctaacaatgcaacccacaaaaggatcaaggatgaaattgagcttggcaatggcctgccagatatcagaagcactcggcaatgtctccaggcagtaaaagacgccgggtttgaggttgtttgggataaggatcttgctgaagattctcccttgccttggtacttgcccttggatccaagccgattctccctgagtagcttccgtttgacctctgtgggacgcatgattacccgcacaatggtcaaggccctggagtacgttggtcttgctccgcagggcagtgagagggtctctaatttcctggagaaggctgcagaagggctggtagagggcggaaagaaggagatcttcacgccaatgtacttctttcttgttcggaagcctcttctggaatgagctcttggatcaccttttcagagagagaaggcaagtggtcatttcgaagaagccgaggagagggaacctggaatcaagaaaaccttcagctctcctgtgtaggaggaaagttaacgaacagtgtagtaactgttcagctttgtgtttattcagttgttttgctgcttgaggttattcgtttctaggtgggggttggaatccttttcgccataaacctctcagtggcataaataagatggtttgcataagagtacttcatggataccgtaagggctactactgaaagagaaatgtttaagcagcatggtatgtgagcaactagtgataattattccatccttttttttaatataaagcaggagttttgtcatgcgtcgtgtctctgcccacgtgtagcggcgccagtgaaatatataaaaattgttgctagcttggagatttgaattaaaaaaaaaaaaaaaaaa

SEQ ID NO: 17223 - DNA, 1536 bp, Zea mays
ggtaccctgcgggcccgcccggagagacgggtggagtggagactctggttctgacatgcagcaattattgcaggtgcatttgatccgtcccggccgcctacacgatgtccaagtcgggagcgctggatcttgcttctggcctcggagggaagatcaacaaggtggaagtcaagtcggccgtcgatgagtatgagaaatatcatggatactatggagggaaggaggaagcaaggaagtccaactatactgatatggttaataaatactatgatcttgccactagcttctatgagtatggttggggtgaatccttccactttgctcacagatggaatggagaatccttacgtgaaagcatcaagcgacatgagcattttcttgccctgcaacttggtttgaaaccaggaatgaaggttttagatgtgggctgtggaataggtggaccactgagagaaattgcaagatttagctcaacttcagttaccggattgaataacaacgaataccagataaccaggggaaaggagctcaaccgtttagcaggaattagtggaacatgtgattttgtcaaggcggacttcatgaagatgccgttcgatgacaacacttttgatgctgtttacgccattgaggcaacatgtcatgcacctgatccagttggttgctacaaggagatatatcgtgtgttgaagcctggccagtgctttgccgtgtacgagtggtgcattacggatcactatgatcctaacaatgcaacccacaaaaggatcaaggatgaaattgagcttggcaatggcctgccagatatcagaagcactcggcaatgtctccaggcagtaaaagacgccgggtttgaggttgtttgggataaggatcttgctgaagattctcccttgccttggtacttgcccttggatccaagccgattctccctgagtagcttccgtttgacctctgtgggacgcatgattacccgcacaatggtcaaggccctggagtacgttggtcttgctccgcagggcagtgagagggtctctagtttcctggagaaggctgcagaagggctggtagagggcggaaagaaggagatcttcacgccaatgtacttctttcttgttcggaagcctcttctggaatgagctcttggatcaccttttcagagagagaaggcaagtggtcatttcgaagaagccgaggagagggaacctggaatcaagaaaaccttcagctctcctgtgtaggaggaaagttaacgaacagtgtagtaactgttcagctctgtgtttattcagttgttttgctgcttgaggttattcgtttctaggtgggggttggaatccttttcgccataaacctctcagtggcataaataagatggtttgcataagagtacttcatggataccgtaagggctactactgaaagagaaatgtttaagcagcatggtatgtgagcaactagtgataattattccatccttttttttaatataaagcaggagttttgtcaaaaaaaaaaaaaaaaaaaaaaaaaaaa

SEQ ID NO: 17224 - DNA, 926 bp, Zea mays
ttgggtacctcgaggccggccgggctctcagtctctccttcctctcccattccactagattaccaccacctccacctcgtcgtctcccaccaccgccgagcgcgagccctagcccgatctagccggcggcaggcaccagatcccgccgcccgcggcgtcccgggacgcgccccgccgaatccgccgctcctcgcactgcaacacgcccggaccacgaggcgcaccaggtgtccaggtcccactcccaccgaaaccaaacgcaccttgccggccgccgctcgtcctcatcttcaaatcccctcttgcacggctgcacctcctagcccgtagtgtggatccatccccacacggccctcgccaaatctactcctccagtcggtcggcaggaaaggaacccctctccacctcggaggctcggacagagtgaacgcgccacccgccccggcgagcattgtccgctgccgcgcgccaccttccgctcacgggtgcatttgatccgtcccggccgcctacacgatgtccaagtcgggagcgctggatcttgcttctggcctcggagggaagatcaacaaggtggaagtcaagtcggccgtcgatgagtatgagaaatatcatggatactatggagggaaggaggaagcaaggaagtccaactatactgatatggttaataaatactatgatcttgccactagcttctatgagtatggttggggtgaatccttccactttgctcacagatggaatggagaatccttacgtgaaagcatcaagcgacatgagcattttcttgccctgcaacttggtttgaaaccaggaatgaaggttttagatgtgggctgcggaataggtggaccgctgagagaaattgcaagatttagctcaacttcagttacgggattgaataacaacgaataccagataac

SEQ ID NO: 17225 - DNA, 2878 bp, Zea mays
  misc_feature (208)..(208): n is a, c, g, or t
atacgagtagttatacatacatgcacatacatatcatcacatatatcacaatatttttctaaattaaattaaaactaaaaatgactaaatttctaacaccaacgacattgtaatgttttctccaacaactttacctattctacattgttctatttcgaatttcactctataaacaacatagtctacaatggaaaacagtgctttgtangactatatacgcgatgtgtggctacaacataagacaatatagtcgtttgaagattgaacctatatatcggtacggttaatccgtctatgtacgtgggcatgacgaacacccgtgataacgaaggattaacgtgcacaatcataaatccaaagtaggagcggtgcatgatgagaatcgctctcagtactcgacataatgaaccttacgaggtacaacaggcaggcaggcagggaccaggggccgcctttatttcaggctcgctggccccacgggcgtgctgcgtgcacgaagggcactaccccaacctctcaccgaaaaaccgcgctggatcggcaaatcaaacgaggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcggatggagctggagctcgggctcgcgccgccgaacccgcatcagccgctggctgccaccgccgagttcgtcggtctcctcagcagctcggctggctcgtgcgggaacaagagggttctcggcgacgcgttcggggccgccaaggcggccacgcttccgctcttcgtctgcgaggatggcgacggaggcggcggcgaccgcgaccgcgacggcgtcgtcgaccatgaacagcaaagcaacaagtgagttgtggttaaaaataccgaccacgtgcgtacagggagggtcttattatacccaaatccgatccgtggtgtgtgtagtgtacccaggaagaagaggctggtggggtggccgccggtgaagtgcgcgcgtaggcgtagctgcggcggcgggtacgtgaaggtgaagctggaaggggtgcccatcgggcggaaggtggacgtgtccatccacggctcgtaccaggagctgctccgcacgctcgagagcatgttcccttcgggtaaccaacaaggtgcgtacgttcccgggccgcggcgagccggccggcgaccggcggtgctgcggacgatgcctttctttcactgataatcatctgccgccatcgttctggtcccgacacgtgcccttgcttcccgttctgctcccggcacttaacttggtcgcatatactattcctgtaacctctggcagatcatgcagaagacgaggtggtggtctcgcacgagcgccgccgtcgccatccttatgtagtcacctacgaggacggcgaaggggactggttgctcgtcggagatgatgtgccgtgggagtacgtatcagtcactactactgtcgtctgtatgactgtatcgatggtgacggcaacaatataatccaattaattattcagcgaacttaaaaacgacgttgatttccttgcagggtctcggtcaagtcagtgaagcggctcaagatacttgcgtagccgacggtcggcgcctcagagacgtcgtgtggtccgtctcaccaggatcggagcagtgtagtactcctgggcgtcatctgcataataacgttgtttctgtcctgtgtgcccgtagcagtacgtactgtcctatagtaagctagctttatggggtgcttcagctttcagagcatgacgaaagcactggttagctgctgtgatcacatttggttcgtctttgtgtcgtacggtatcgctggcgtcagtgtcgcggcagcctaggtgatctaagcatacttactatctcaagttacttttggttcccttagcttgccggctgcttcgtataccgtatacgtgtgtgactcaggggcgaagctgccttaaggcacaggggtcaccggacccgatggaatttatcaaatccagtgtaaaatactatttaacactgttcatcaatatatttgatttcaataattcatggagctgaccttgtggatccattttctgtcttcgcctctggtgtgactagtattttggtttgacttttcactctgtataagatatatattataccagcgagtttatcgactgctagttttacaagaggcttaactctttcaattgcttatttttattgcaacaacacactcctccgttgttgtggtattagatgtggttctgaatgtaaatgtcattataggatataaatgtagtgtttcctagttttaccctagctttcgcatgcatagtgggaaagtgtactaactctcctcatgcagaaagaggtgtggtatacctaacaaaatcatacatcactactaatctacggataatatatataaaccgtagcgacacacgagtgcttagctagaaat

SEQ ID NO: 17226 - DNA, 1648 bp, Zea mays
aggctcgctgcccccacgggcgtgctgcgtgcacgaagggcactaccccaacctctcacggaaaacccgcgctgatcgggcaaatcaacgagggtggtgccccgtgcccactctccacgtccacggcaccatccctctgcagccgctcaccagccatgccgtgtcgcggaacggcacaaccacccccaacccactcacgaaaccccgtcccggccgtgcccgtgtcggtccgcgctcggcaacgaggcggcccgcgctgctgagtcccctggacacccgacaccctgtcggccctttgtttattcatcccgaaatctcatctgcccccacggccgactgcgctgcgccgcccggatatatatacccatcgttatcgatcgatcgatcgcgtcactcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcggatggagctggagctcgggctcgcgccgccgaacccgcatcagccgctggctgccaccgccgagttcgtcggtctcctcagcagctcggctggctcgtgcgggaacaagagggttctcggcgacgcgttcggggccgccaaggcggccacgcttccgctcttcgtctgcgaggatggcgacggaggcggcggcgaccgcgaccgcgacggcgtcgtcgaccatgaacagcaaagcaacaatgtacccaggaagaagaggctggtggggtggccgccggtgaagtgcgcgcgtaggcgtagctgcggcggcgggtacgtgaaggtgaagctggaaggggtgcccatcgggcggaaggtggacgtgtccatccacggctcgtaccaggagctgctccgcacgctcgagagcatgttcccttcgggtaaccaacaagaagacgaggtggtggtctcgcacgagcgccgccgtcgccatccttatgtagtcacctacgaggacggcgaaggggactggttgctcgtcggagatgatgtgccgtgggaggtctttgtcaagtcagtgaagcggctcaagatacttgcgtagccgacggtcggcgcctcagagacgtcgtgtggtccgtctcaccaggatcggagcagtgtagtactcctgggcgtcatctgcgtaataacgttgtttctgtcctgtgtgcccgtagcagtacgtactgtcctatagtaagctagctttatggggtgcttcagctttcagagcatgacgaaagcactgattagctgctgtcatcacatttggttcgtctttgtgtcgtacggtatcgctggcgtcagtgtcgcggcagcctaggtgatctaagcatacttactatctcaagttacttttggttcccttagcttgcatggtaattcatataccgtatacgtgtgtgactcaggggcgaagctgccttaaggcacaggggtcaccggacccgatggaatttatcaaatccagtgtaaaatactatttaacactgttcatcaatatatttgatttcaacaaaaaaaaaaaaaaaa

SEQ ID NO: 17227 - DNA, 791 bp, Zea mays
cggccgcgtgggctcacgggtagctcatggtcgagcgtagcatgcaggaacttatttgccgtgcgctcccaggtctccgctcgcgtgccttccagtctgtctcacactagctgctgtgggacgatcgaagtgggtgtgtcagctagctagctgcgccgtgaccacgcacatgaccgcagtgcgcgcggggctgatcaagggaaagtgatcggatggagctggagctcgggctcgcgccgccgaacccgcatcagccgctggctgccgccgccgagttcgtcggtctcctcagcagctcggctggctcgtgcgggaacaagagggttctcggcgacgcgttcggggccgccaaggcggccacgcttccgctcttcgtctgcgaggatggcgacggaggcggcggcgaccgcgaccgcgacggcgtcgtcgaccatgaacagcaaagcaacaagaagaagaggctggtggggtggccgccggtgaagtgcgcgcgtaggcgtagctgcggccgcgggtacgtgaaggtgaagctggaaggggtgcccatcgggcggaaggtggacgtgtccatccacggctcgtaccaggagctgctccgcacgctcgagcgcatgttcccttcgggtaaccaacaagatcatgcagaagacgaggtggttgcctcgcacgagcgccgccgtcgccatccttatgtagtcacctacgaggacggcgaaggggactggttgctcgtcggagatgatgtgccgtgggaggtctttgtcaagtcagtgaagcggccgacagcaacg

SEQ ID NO: 17228 - DNA, 2414 bp, Zea mays
taccatttttacacctgttttggcgaggggggggggcacaggcacagttgtttctgcttccctcattcataaactttatggaaattcgttcgcgccggttcttgagcatgctgagcgtcttacggaggatgtggtttctgtatttccggcagctgatgctttggagcaatacataatggcggggagggcctccgttacgggagatgatggtttggatagcctatgcagacataaactagttccatatcagattgaaagtaaatctggtacattagttttacgctgggtaaatgggcaacttgagagaattgaaacttgggttaaaagggctgctgaccaagaggtttgggaccctatatcccctcaacaacgccatgggaattctattgtagaagtctatagaatcatagaagagactgcagatcaattttttgcatttaaggttcctatgcgagatggagaattaaatagtctatgccgtggtcttgacaaggcattccaagtttatacacagctggttactgcacccctagttgataaagaagatttagctccgcctattcctgttcttactcgatataaaaaggagcttggaatcaaggcttttgtaaaaaaagaggtccaagaagttagaacagttgatgagaggaaagctagcgaaattactcagcttacaatgccaaagctttgtgttcgtcttaacagtctatattacggtatcagccagttgagtaagttggaggacagcattaatgagaggtgggctcggaagaaaagtgaaaacactaacatcagacgaaaaagtgaaaagtcaaagagtgccgtccctaatcagaagaatcaatttgatggcagcagaaaagaaatcaatactgctattgatcgtctctgtgaatttactgggacaaaggttatattctgggacctgcagcagccatttgttgagaatttatacagaaatggtgttgctcaagctcgattggacaccataactgaagtgcttgatttggtccttaatcaactttgtgatgtcattgtggaacaactgagggatcgtgtggttacagggcttctgcaagcatgcctggatggcttccttcgtgtgatactggatggaggttctactcgtgtcttctctccaaatgatgcagctttattggaggaagatcttgaaaccctgaaggaattttttgtttctggtggagatggactgcctcgtggaactgttgaaaacttggtctcgcgtgtacgtcctgtaataaatctgatcaagcaagagacccgcgtgctcattgatgacctacgagaagttactcaaggtggcaagagcaaatttggagcggactccaaaaccctccttagggtcctgtgtcacagaaatgattcagaggcatcacattacgtgaagaagcaattcaagatacccagctcagctccgagcgcctgattgattgcgaacgaaaaaacagatatcgaacaggacagtgcagccttgctcgtaacccaagaaacggtgctccaccgcccattttcatgtttgtgtaacagttattgttcatcggtaacactaggactttgggtggacgcggcagtaagcatgtatttacacaaatactaacacactggtcctgtattgattggtactagttttggaccattggagtttccccatttagggctagtttgggaacctcatttcccaaaggatttctgtttttttaaaggagaataaactaatttcttttggaaaaatggggttcccaaactaacccttagattcctgacttttttaaaccaaaactttagtatggcaatgtttggtagccagcagccatccaagcaggctccaagacttggggttcaaatacataaatactcttatctttgacctgcaagccccgaacacttgtctttggaggaaagcgccaagaagtgaatatcctatcctatcactatgcgcaagtgtgtgcaatgatatacaagcatacatacaggcatacaagtataggaaatagtgagcgcggtcaattatatactcctagttttctcgatgaccatagcccatagcatgacccgagacctttacacaattatttattgcaacacatcatcagtccatcatgaagtgattaaagtacgtatggggccacacactcatcttggatgcccatcttcaacctcccgtgcagtcatgcacacaattagcttccccatcccctagtactagtaggagtaggcatgcaatgcaaagtgccgaaaggcagagcgcaaaaactgcacaaggctacaagcaaagcgcacgccctctcatcatctcattcccatggcgacttgtataaacaacaactaccctagtagcaaatagcagtactaaaatcaccacgcatttccatccctcctgtaccgcagaaaag

SEQ ID NO: 17229 - DNA, 802 bp, Zea mays
ctgagatttattatcaggcacgtgcaatgtcgactgatgggcttagaccaactttctattggatcaacggtgtggtctatgcaattcagttgacatccggccgggtcagataattctatggttggttttatggtggaaaccagttcgagttatggtcattttgccaaagatgttctttgcaggtgtatcactatttgctgcccttggatttgttctgtatggaggaaggttatttctgatgttgcagcgttttcctgtagattcgaaaggaaggagaaagaaattgcaggaggttggctatgtgactaccatctgtttttcttgtttcttgatcagatgtgtcatgctgtgcctcaattcatttgataaagaagcagatcttgatgtcctgaaccatccaatcctgaacttcctctattacctgctggttgagatagtgccttcggctctggtgctcttcattctacggaaactgcctccaaaacgtgggatcacacaatatcacccaatccattagagagcaggccttggtggacaggcaaatgttttctggtggattgtcttatatagcgtggtaaatacagaaggcagagtgaaaagtaccacctttgctctcgagcttgcccagcttttcatacgagggaaggctttagaatctcaggtttagaaaatgcgatctctttctctcagatttagaaaatgtaaaatgtaatttatataactttaatattctcagtgcatatcatttgttcacatctcagtaatcgtttgcatgtttcattgtgtaaaaaaaaaaaaaaaa

SEQ ID NO: 17230 - DNA, 1520 bp, Zea mays
ccggccgggacgaattaatcatcccggttcagccctctccaggcgctccaccccgcgtcgcggacccccgacccgccccccgcctcgtcctgttcgcgtccccctttgcccgcgtgtgcgttggccgcctggccccggctcggggggttcctcccggtgcagcccgcccctggcgcggcgtcgtcgtcggcctcggcctcggtgctcaacggcgccgtggactggtggcgcgacgtcaacgagtcgccgctgtggcaggaccgcatcttccacgcgctcgccgtgctctacggcatcgtctccgccgtcgcgctggtccaattgatcagaatcgagtgcagggtgccagagtatgggtggacgacgcagaaagtgttccatttcctaaacttcctcgtgaacggcgtgaggtctgccgtgttcgtgctgcggcggaatgtgcaactcgtagagcctgagataatacagcatgtgcttctagatatgcctgggcttgcattcttcacaacatatgcacttctagtgctcttctgggcagagatttattatcaggcacgtgcaatgtccactgatgggcttagaccaactttctattggatcaatagcgtggtttatgcaattcagataatcctatggttggttttgtggtggaaaccagttcgaattatggtcatcttgtcaaagatgttctttgcaggtgtatcactatttgcagccctcgggtttgttctctatggaggaaggttgttcatgatgttgcagcgttttcctgtagaatcaaaaggaagacgaaagaaattgcaggaggttgggtatgtgactaccatatgcttttcttgtttcttgatcagatgcgtcatgatgtgccttaatgcgtttgataaagcagcagatcttgatgttctgaaccatccaatcctgaacttcttctattacctgctggttgagatagtgccttcagctctggtgctcttcattctacggaaactgcctccaaagcgtgggatcacacaataccacccgatccattagagagcaggccttgggaacaggcaaaggttttctggtggatagtgttacacaacgtggtaaatacagaagggagagtgaaaagtaccactcgagctttgcccagctttttatacggaagtctttagaatcccaggttgaaattgtgtgtaaaaatgcgatctctttcactaagatttagaaaatgtaacttatataactttgttattctcagtgcgtatcatctgttcacattgcattaattgtttgcatgtttcttttgggtctctgcctcaactttgctgaacaagagcagctaatgctcctggagtgcatggatgatgtgattcgctcaccatccgtatgtttggttgttaggacgagtagagcctggttcaagaccatatgcaggttgagtatatgcagactgagttgatgtaattatacagtagcatgcgtgtttggttggatgattctaattagccaggatcaacccaccctatgtttggttt

SEQ ID NO: 17231 - DNA, 2100 bp, Zea mays
  misc_feature (467)..(467): n is a, c, g, or t
gggccgaaattcaaatatgccgaccttttttggacttgggccatgttgggtggctcgaatgtacacctataaacgtgacttttaaaatgctctataatttataaataagtatattttgtaggatttagggcaacaaaatattctgctctaacattaaatcccgaaatctagattataggacagttcactgcggtgtagtatatttaagacatttgaaagattgtcctataattttttagcaaaatattatgaaataagtcactattggaatatttttttctacacggagttttatattttaatttaagatatcagcttaagatattgttggagatgctttaaatttaacttttaatttggttcgatgtctctattaactaccattgtgaggatatttctttatcttcctaatatttattatgaaccatagaatattaatagtcttaaatggatcaactcaattattntaacagccggtcgcaggagagggaaggatgaaagcaaccgaagatccggtaagaaagctaaaggagaagtgattatttttttcctaaacttagaatcatgttttcttctatagcaacttttaagggaaaaaaaaagaaagatggtgaccacacaggcacacaacgtccgaacatagtcaatccgaagacgacgaggtcggccaccgcacacggctcatctgtcaccggcccacgccagcgcagaagattttaaactaatctaccaccagctggacgcgagcacccctttgcgcgagcctgtccatgcaccgtcccccgtgatcccactcccccacgtcttgcaacactgtagacaagttccacggagggaacgcccgatcctgcacacgtgtccccgccagcctcctacggatccggtcactgcccgatgggcgtcacccccggtcacaccacgcacgcacgcaactcgaagcccaggggcctggccaaggctcgaaccttctctccttctctggcttgtcttctccttccttcctcttcctcctcccctccacgcgatcgaaaccgaagcacgaattaatcatcccggttcagccctctccaggcgctccaccccgcgtcgcggacccccgacccgccccccgcctcgtcctgttcgcgtccccctttccccgcgtgtgcgttggccggctggttccggatgagggggttgctgtcggtggaggccgctggcgcggcgtcgtcgtcggcctcggcctcggtgctcaacggcgccgtggactggtggcgcgacgtcaacgagtcgccgctgtggcaggaccgcatcttccacgcgctcgccgtgctctacggcatcgtctccgccgtcgcgctggtccaattgatcagaatcgagtgcagggtgccagagtatgggtggacgacgcagaaagtgttccatttcctgccgcgaggggatgtgattttctgtcggtttcggttgatgttcggttcgattgcgcgcgctggtttgatctgtggccgcgcaattttaagggacctgggcattgtgggacggattgagagaaggcgggcactgtaacgtcagcggggaattctgaattcgcggtgtttaatttctcttgtaggtccaattgatcagaatcgagtgcagggtgccagagtatgggtggacgacgcagaaagtgttccatttcctaaacttcctcgtgaacggcggtgagccaagcatttgtgtcgcttgcattgcttttcttgtgctgggtgtttgatttggttgactgatcgatgtgaatgctccattcctgctttcagtgaggtctgccgtgttcgtgctgcggcggaatgtgcaactcgtagagcctgaggtttgtagctgatttgatgattatactacactcgcataatgaatttgtgggaggtcttgagtaatggtttgaagcaatgtggtaacacagataatacagcatgtgcttctagatatgcctgggcttgcattcttcacaacatatgcacttctagtgctcttctgggcagagatttattatcaggtacctcgttttgtctctgatagacctctctattgttttgttaatgttgttgcgcttcttaatttttgttcatgttctgtagg

SEQ ID NO: 17232 - DNA, 1396 bp, Zea mays
tgacacgtacagatttgagtatgcagactataggctagcacaagctggtcattctattcaaggaatcaaggctaagccacataaaaaaaagaatcttatgacacagcaaattactgcatcactaaaaccgcatttgcacgactgcactttttcttaattcacttgagtcatgggctccatgtttccacttctatggatcgcaatcaaacagtttagtgaccatgtatcgatgtcttgctttacctattcccaaaaaggaagtcccaatggtataccctcggcttccttcgctgatggtagcactagtagcctcatcaatcagaagattttctactgtgcaatatttaactgcccttccactgttttaagttacttttcacattttgtatatggtgctacactgctgctactacgaaaaatgactggcggtgtacattgcaacagtaactgttttgtcaaaagtgtgtgttgacactttccaacgcaggcatatgagcattgccttgaggatgattctcagtttcgtgaagagctttggtcccacaatttcttcagccttgttggctataccacctgttggggtagaccttgaagcagagcagaggtgtttttttcttttcatctcactgaaattgtaatggattctccttcctgcctcatgcatacaacggacttgcttcacgagcgcgtatcttgctaggatggagtggtgcaatctatgtttccaagaactgaagaatgtgagcgtcagcctcaagtttctgacaaggtaaacttcaatggctctaacctcttaaggtgcagtcgcgcaacctatgtttccaagaactgaagaatgtgagcgtcagcctcaagtttctgacaaggcggcaaggcgaggttgggagattagctcaggagctcagcctttttcttcaggatctctttcaattgtcaagcgtgtaaacagtgaccataccacgacgtgcaaaatattcacgcactcaatttcctttggtcataacagatatagcgacatatagtaggatttacctctagaaagaaagaaatatacagaaactatagggtgaagcttacagggtattttctccgagctagtttgggagcatcatttttttcatagaattcctatttttctaaggtctcgtttgtttcctttcattttaaggaattagaatcttactaatataatatgctattttttttagaatatgacatttcactacttttcaaagttatcatataagcttatcttaaattcatggggtgagagatgaaaattgattttataaatttatgttattttttgatgtataacttatatcatactcttctatttgctttgctataatataaatataatatataactatctctctcatatgatttaggataa

SEQ ID NO: 17233 - DNA, 1338 bp, Zea mays
aaatcctaaccttctctccttccttttgatcttcccctctacgcgatcgaaaccgaagctcgaatcaatcctccacccgtttccagcccctcgtcccggagccccgatccgcctcccgtctcctcctgggcaggtcccccttttccgcgtgtgcgttggccggccggttcccgatgagggggttgctggcggtggaggccgcgggcgcggcgtcggtcccggcctcggtactccacggcgccgtggactggtggcgcgacgtcaacgagtcgccgctgtggcaggaccgcatatttcacgcgctcgccgtgctctacggcatcgtctcggccgtcgcgctggtccaattaatcagaatcgagtgtagggtgccagagtatggatggacaacgcagaaggtgttccattttctaaacttccttgtgaacggcgtgcggtctgtcgtgtttgtgctgcggcgaaatgtgcaacttgtagagcctgagataatacaacatgtgcttctggatatgcccgggcttgcattcttcacgacatatgcacttttagtgctcttctgggctgagatttattatcaggcacgtgcaatgtcgactgatgggcttagaccaactttctattggatcaacggtgtggtctatgcaattcagataattctatggttggttttatggtggaaaccagttcgagttatggtcattttgccaaagatgttctttgcaggtgtatcactatttgctgcccttgggtttgttctgtatggaggaaggttatttctgatgttgcagcgttttcctgtagattcgaaaggaaggagaaagaaattgcaggaggttggctatgtgactaccatctgtttttcttgtttcttgatcagatgcgtcatgatgtgcctcaattcatttgataaagaagcagatcttgatgtcctgaaccatccaatcctgaacttcctctattacctgctggttgagatagtgccttcggctctggtgctcttcattctacggaaactgcctccaaaacgtgggatcacacaatatcacccaatccattagagagcaggccttggtgttttctggtggattgtcttatatagcgtggtaaatacagaaggcagagtgaaaagtaccacctttgctctcgagcttgcccagcttttcatacgagggaaggctttagaatctcaggtttagaaaatgcgatctctttctctcagatttagaaaatgtaaaatgtaatttatataactttattattctcagtgcatatcatttgttcacatcgcagtaatcgtttgcatgtttcaaaaaaaaaaaaaaaaaaaaactcgagccc

SEQ ID NO: 17234 - DNA, 1368 bp, Zea mays
attggggccctggccggccgccgaccttctctccttctctggcttgtcttctccttccttcctcttcctcctcccctccacgcgatcgaaaccgaagcacgaattaatcatcccggttcagccctctccaggcgctccaccccgcgtcgcggacccccgacccgccccccgcctcgtcctgttcgcgtccccctttccccgcgtgtgcgttggccggctggttccggatgagggggttgctgtcggtggaggccgctggcgcggcgtcgtcgtcggcctcggcctcggtgctcaacggcgccgtggactggtggcgcgacgtcaacgagtcgccgctgtggcaggaccgcatcttccacgcgctcgccgtgctctacggcatcgtctccgccgtcgcgctggtccaattgatcagaatcgagtgcagggtgccagagtatgggtggacgacgcagaaagtgttccatttcctaaacttcctcgtgaacggcgtgaggtctgccgtgttcgtgctgcggcggaatgtgcaactcgtagagcctgagataatacagcatgtgcttctagatatgcctgggcttgcattcttcacaacatatgcacttctagtgctcttctgggcagagatttattatcaggcacgtgcaatgtccactgatgggcttagaccaactttctattggatcaatagcgtggtttatgcaattcagataatcctatggttggttttgtggtggaaaccagttcgaattatggtcatcttgtcaaagatgttctttgcaggtgtatcactatttgcagccctcgggtttggttctctatggaggaagggtggtcatgatggtgcggcgttttcctgtagaatcaaaaggaagaccaaagaaattgcaagaggttgggtatgtgactaccatatgctattcttgtttttcgagcagatgcctaatgatgtgccttagtgcgtacgatcaagcagcagatcttgatgttctgaaccattcaatcctgaacttcttctattacttgcttggagagatagtgccttcggctctggtgctcttcattctacggaaactgcctccaaagcgtgggatcacacaataccacccaatccattagagagcaggccttggtggacaagcaaaggttttctggtggatagtcttacacagcgtggtaaatacagaaggcagagtgaaaagtaccacccgtgctcacgagcttgcccaagctttttatacgaggaaaggctttagaatctcaggttcaaattgtgtgtaaaaatgcaatctctttctctcagatttagaaaatgtaacttatataactttgttattctcagtgcatatcatctgtttacatcgccgc

SEQ ID NO: 17235 - DNA, 3737 bp, Zea mays
ctccctcatgcttcttatttgtacatcacctgtagatctaagtaacatattccatattgtccttttcaaaacctttgcaggttcagttgataagactgttaaattttgggaccttgaaacttttgagttgatcggttcttctggacccgaggtaccatatctatttataacgactcacaaaattaattgttcatatccccagttgaagctattctatgttcaaaatctgaattaatatagcccttgaaggttatatagtgatctggaaaaagctatttttgagaatgctacagttttaaaaagttgtatttaagcaatagaatttggtcacatgcttgaattaataataataatggcagcgaattcgaggtctctgacgagcacgacggatgcatactgcacacgtgtgttcgcgagaaactggcgaactgcaagttagatcagaatttggaagttttgtctcagcttcaggcaaaaaaacaaaataacccaaatggggcatcgatggggacggttgacatgtgtggggacggtgaacaacttggcgaagtcgagcatggcgaggacgggggcggacgtgacggcgaccttgagcgctgtgaatgtcgcggtcgtcgcgtcgtcccaggataagccctccttgagtagggccgtcagtggtgcagcgatcgccccattgttgtggacgaacttgcggtagtgaaatagctattgttaaacatgtataacataataatttgtttgtgaaataagttgttaagtttgaggttttttgtaaaataggtacatcagtgtgcagttttttgactcttctgtagactattggcactctaaagtctaaaatagatatattggtatgcaccttttgtcacttttctttagactgttgcaaaccagatagtggcacgtatacctgctgtatttcaatttgatgaagaatctattgttactgtccattctctatataggttttcttttcctaggatataattaaccttttcttgcttaatgcagaacaaccgagaatactttgagctggtacggattctatcattaatttcttcaaatcatcatatttctcaaatttttgtgtggaaatggatgacatgctttctgtaaacaaagcacatgatctgtaatcagataaaccaattgcttattgttggtaaatgtcctcaattttcaggctagtgcaatccgttctatgaagttcaacagtgatggtaaaacaattttttgtggattgcatgaaagcttaaaggtacatatccaactgatttatcaatatcctcatttcattcttctggaaataatagtgaaacaaaggtcatctttttgcttgtaggctctttcctgggaacccaccatatgtcatgatgtgattgatgtaggctggtccacattagcagatctaactgttgacgaagggaaacttcttggctgctcatataaccaaaattgtgtcggtgtgtgggttgtggatttgatggtatgatgtgttatgcatcatttactatgatatgtattgagttgtttctttctgacatggtacttacataaaatttcagagaaatgagccttatgttgatagtagtgctggatcacacttaaatggaagtataaataggccaattcaatcagatgatagcatgtcatcagtgtttgggaggctatcgatttccagaagcccaggtactgaaagcaggaaacatttttcttatgagatctcattgttatctctgcactctaaaaccagatatgtttttgtactttccggccgggccgggccaatgaaattggatcggatactctgcttggatgctcaatgtctggttcaaaagaaagtgcctgtcttcgacttctgcatcaatgaggggattgtcaaagccacctggaaaaggggacctccggctctcaagatctatttctacacctcttctttctcctagagttagattgaacccaaatttcatattcggctcgaggaatcaggcagctactgctgtaccattaccagaaccaatagtccgctggaaagcgaatctctcttcagaggctggaatgttgtctcgcaagtcacatgcatcagcagctctcatgtatagatcaaggtccaatagttctcggtatggtattatggaatcatcttccatacctgttctggccttgaggcatagctctagaaaggatgctggtcccgttcacagtgaagctgccacaggtgagttagcagatattgagcctcaaaatatagaaaaggaaggtttagttgccaatcatggcaaagaagatggcaagttggtacctgtaattgcttcaaggagctcaaagatagtcgaagaagttggctatagaagaatcaccaatgatgtaggatgtaagagagtaaccctagaaagtggtttgagagttaattcagatatggactatagaagcagagctccagaaagccacgaggtgcagcagcttatacatctgtcagaacctgctggtttacatgggaaatttataagagaatcttcaggtgctggggacaataactgttctggttcaatatgcactgagagtgctgagtttaatgaagttgatatctggtacagggtatctggttttgataaatggaaccctgctgctgcaaggaatccagaatttgccagcatccacagaaatgaagtgatgggaataagacagttgatggagtcaagtggaaagtatgttgttgacgatcgtaagtgatctaacaatttgatattgctctattggtttcagccttcttcagaattatcacgaagctcttttgttggaacaggaccttcctcttctaattacgataacatccagtatgtgacaacactatacagctcggtatgtgtacttccaagattgtgtcattttggcactaaaagtatttttacatggaacctattacgcatcttgtattactgtttctgtagaggctgcatccttcactttctggaaaacttagtgcatctgcaagttatgaagatgatatttctggtctagtggaaaaccatcaagaattcattcatgtaatgaaatctcgactaacaaaactagaggtattaagggtccaaaataagatcatccattgagttttgttcaagaatccatttggtgttgtgggacacaatttgttatattattgagtaattgtagtcactaggtgatatctgcaggtggtttaccgttgctggcaaagaaatgatataaaaggatctattgatgctacatggagaatgttggattttgctgtatgtactctactactttcttgtagttgcaccaattacaatttctgaatattctctactcttgtaggtcactaatgatattgttaatgctctaatggagaataggaactgtatcacattagatgtttgcgcttctctcttacgtcttaccaccagtcttcttgaaagcacatatgacaggtcatttctcatatttcctattaatttatcaatattgaaattgtgagatcatttaaatttgaccttgctattgaacattggctgattattttgattaaaagctgacttaatgcccttttggagagttggaactcgcaatgggaattgaatctgattataatgcccctttcttcaaaaagagatggaattctgaatacgcagatatgaaatattgttcatggtccagactatggtcaaattgtagcactagccggccttttattcaaggctatgacacgtacagaa

SEQ ID NO: 17236 - DNA, 4376 bp, Zea mays
tttaaaacaacagattttacaaaaaaatattacatttgagagtacgataaatatgtacgtacaaaaatgaaaagtaaaatatgtctctaatatagatatttatgtacagagaacgagatatagagaatattgttagagaaggaggagatatagaggagagaattttttaaataatattataaagaatgaatatagatgatgaatttagagtgagtgacatgttgctgtcgatacatttatgcttctggcaagccgtttcaaagcttttggtcgagcacagccgagcacctgttctcacgcttaccagaaggaccaacgagcgatcgtgttcctcgttcaattccagtcccgtcgctctccagtctccacatcaaattcatgacgattgtccgattcttttaggacgccaagctagctgttcggtgacctgagcggctgagatggattcccagcgattcaatccagggaggcttgccgagcgtcgtttcgatgcaatcgagtgcatccgttgctggatcaggacatctaatccatcataattatagcagtactatcctatggctgccgtaaacgaccctgcttctatttagagtttttttaaaaaaaatatatataatgtagtagattagagacacgatgccctcgttgagtgggtccaactgtcgtgcgactgtttgtatttgctcacacgcctgactctttcagttagggtttggtacgtcgctcgtatccatccacgccagctccaaggcagtaggcagcagccgttctcgtggctccagaccgcgcgatagctggctcgcttggtcagtggaggaagtcaggaaaggaacaagagccagcgtgcgcgcgcacaccaaacgacagcaagagactttgctgttccagattggaggcggagctcggcgcggcggcgctgcagtctgcacgactctttctccagctgcccattttatggtcgctcgtcaaaaggacggcaagtcggcatacgaatacccgttgaatgaaaccaggtctggctgttgcatgttccttgttcggttgttcgcccttgcgcgggagccattaacaattttaccattgtcatttgtagactttatcagtatgtcatccgatttataaacaaatcaaaattgagagcgacaaaatagcaagtttctcgcgggcacgttgctgcaggctgctacagtgcttcctgcctgccacgagcgatgcagtatagtaggtgcaaacaaaacaatttgctagtgtaataaatgacagttggacagcagtgcccaatcccgttacggcctaatttgggtaatttagtaataaaagaaattagagtgaattgtaatgtattataagagtttttgatttattaggaatttatacattctccaatctctctaaaccacttcaatactagatatccaaactgagcacaccggctggagagaaatgtacgaagaaacaccggagtagaactcgatgggagcccaacccaacaactccgctgcagcccaagagcagagaatgccagcccaatcacggttttccttccctctgaccgaccgacgcccggccggcggcggggccccgcccccacgcctctccgcatgacgaaagagccgacgtcactcctcccgatctgggcgcggacgccaacgacgcgacggcccaagtcgcgacgccaccagctccccatcccctcggacgccatggaggaagctcgcgaccacaggctctcctccaccgccggccgccccttcctctctggcttctgcgccgcggcgctccgacgtaagcccctcggcgcccgcgcctccgccgccgccgccgccaccggcgagggccttgtgcggcagctcggcgtcctcgacctcgtgctgctcgggatcggtgcgtccatcggcgccggcatattcgtcgtcactggcaccgtcgcccgcgacgccggcccaggtgtcacgatcagttttgttcttgctggagctgcgtgcgtgctcaatgccctgtgctatgctgaactggcgtctcggttccctgctgtggttgggggagcatacttgtacacgtacgcagcgttcaatgagatcaccgccttcttggtcttcactcagttgatggtggattaccatatcggcgcagcaagcattgctcgcagcttagcaagctactttatcgagttcttggagctaatcccgctcttgaagggccaaattccaagctgggtaggccatggggaggagttttttggtggtgttgtatcaattaacatactggcccccgttcttctcatcatcttaactgcgattctctgctatggtgtcaaagaatcatcagcagtgaacacgtttatgacaacattgaagataatcattgttatagtcattgtatttgctggtgtgtttgaggtggatgtatcaaactggtctccgtttatgccaaatggtttcaaatctgtagtgactggagccacagtagtcttttttgcatatgttggatttgatgcggttgctaattctgctgaggaagccaaaaggccacagagagacctacccattggtatactaggaagccttatagcatgtgtgttgttatacgttgctgtatgcttggtcattactggaatggttccatatacattactcggtgaagatgctcctttggctgaggcttttgctgctaagggcctgaaatttattactgtattgattagtattggagctgttgctggacttacaacaacacttcttgttggcttgtatgttcagtcacgtttgtactttggacttggaagggatgggcttttaccttcagtatttgctgaagtacacccaacaaggcatactcctgtacagtctcagatttgggtcggttgtgttgcagcagtcatggcaggcctctttaatgtgcgtatgctctcacatattctttccgttggcactctgaccggttattcagttgtatcagcttgtgtgatcacactaagatggaatgacaaaggaactagtcgtcgctcccttggaagtatgtcaatttggcaagagggtgttctaagtcttgtcatagttgctctttgtggttttatagtgggactttgctatcgctttaactatgctatagcctttatggttgtagcttttctgatagctgttgctgccagtttcgctctccagtttcgtcaggtctatgtggatccacctggcttttcttgtcctggggtaccgttggttcccattatttctgttttcttcaacatggtcctgtttgctcagctacatgaagaagcgtggtatagatttgtcattcttagtctcatcgctgtgggagtttatgccggctatggtcagtacaatgctgttccttccagctcagaacactctactattggttaccatggcattccttctgaagccgcatgagctatgttcatccccggagttcttcgaacatactgtatggtaccaacatacaccatcgtcaccgaagtttgaacctgttgcttttttttttgatgttttgcacagtgcatactcttgtagttacgcttagtactcctatacctatatctagacagtgaatttcacagcctgtgttgtgcccaccacaccattcgtcaggaagcttgccaagtgcatagaccttgtaaaaatgcaaatgaaaataaagaactgcagctgcattgtttgtaggaactcattgtcatgcactatgtataattctgtgtatattgtgaagagttcatatcaaattgcactgcggccgtcttttgccgttgccctacattcctcgcgtcaaaatcctgggtccccagctcccttgttgctattgggcctcgctccttctccgcgccactccgccaccgcacagcctgccctcgggagcgtttcagcgtggacatttcactcgattttggtgttactgtcaccacactgcccgccagaccgccatgggttggacttccacgcccgtccagtgcggcccttgcattcaatggctagacgcacggcagcgatggtcatgaactcatgattgcagcagagatatacatattgcttgcatgatgtgctgtgttgattgcttccgtctaaaatacatcattcacattgtattagtaactagtaagcatagatcttaccataagtattttattttccctttcaacaacgttattcaattggttagtgtatttgttcaaaaactcatgcttggtgtccatggcaccacatagctcgtctattcttgaatttataaactcactttcattatcactcttcattttcttggtttttaattcaaactcggtttcaattttcttacaaatgatttaaggatgttgaagatttctctcttgtcctttgagagagaaaacctatgtgaaccttaag

SEQ ID NO: 17237 - DNA, 2039 bp, Zea mays
  misc_feature (242)..(242): n is a, c, g, or t
  misc_feature (257)..(257): n is a, c, g, or t
attaaaaaagataagagcttgggggtacttcaaagaaacaaaagtaggcactcagtagattccctttgaaactccctgttccactttaggcatgtgtaataagagcttgagtgcacttcagaataacaaaaactcatggcaatcaggtctacctgacaatatggttacatttttagaaagtaagacttctagtaaccgaaccaacatacatatagtatgaatgtacactccatggaaaaganataataattaacacntgaagatctaagatatgattacaaacatatgtggatacaaaatattatcaagtatataactcatgcagtagcacagagctaggaatttccttgagatgttcggtgattagataaatagtgttcgaaacctaaatcgtaagatgatgtcttacacgaatatggacatacaaataggaaagcaaatcggtgccccgtgggaaattctcaaactccacatttgcatcagtattcaaaccctcctggcacaatgtaagacctgcaaacttagggaaacaaatatttccaagggatttaacatgccttcttaactcctcggtgtgtagataaacttccagaagagtgacctctgaagtgggatcacaactcattccatttgaaatcttggaagctataccagattggcccactgaacgcctaagcctaattgatgctagtaaagtattcaatgaacagaaatagccttcgaggaccttattaactgctgctgcaaatgcttggtttactagactgtaaggccgatgctgctcagtgtctttatctccagaatcttcatgttcgtgaacttctctacttgcacagttcatttctcgactttggacaagataaaagtgcacaaacttgcaaaggaagaagaccacaagacctgtagagcgtaaagatttgagaatactccccacagatatggtgctcgaggaacgtaaccacacatttgtaacacggttagaggttctgtcagctggatttgaggagaacagcactgaaagctcctcaatctcatctaacgatgatttgacaccatacagcgcatgcaaggccagatgaatcaaagcatcatcctgcacaaaaatgatcgtcacacttaatagtggcctaatacgaaacatattgatactcttatatgaaactgtaatataactaatttcccctcctcaaatggcacaaatactgagtttcagataagaagttaaggatccaaaaagctaaaatgttcaatgcagcatagaatttcctggaataaagttccctaagctatctgtttacccaaactctcgatgaactgtcaaaattacaaccagtcaaagtaggtgagaggtagatttcactcacagtaaccgatgcgagctcgtagatcggctgcaggcgtcctccgaggtctgtaacgcgagcggcgccactctcagggatggccgactcccaggttcccggaggcgtccagggcccgtccacgcgcaaggtggagagcagcgtcgagaggctggaggcggccgcctccatcccgggatggccgagctagggcttattgccctcccgcgtgatctggagcagcacacatccaacgttccgagcggcagaatgaaggatgggagggcagaaggagacgaagatagaagtgccgtgcactggtggtggtgtgccaggacacgacgccggcgaggtgcgccggcgagggagtgaacggttggtgaaatggtgagaactgggaaatggaatttcgcgggttcgttgtccttggggtctgcagtctgcttcggctcagttgattgcggcccatatcgttccgaggcccgcgtcaatttggcctaccagatctgtttagaacacacacaaaaccagaaaaatacaggaaatagatctatatatctaagatcagagccaaaacttaatctaactactgataatggagatttttttcggttctgctcttttgcatttatcaaactgaattatatacaacctatatttgtgtaacatatactcataacaatttcacctaatgatgaa

SEQ ID NO: 17238 - DNA, 2244 bp, Zea mays
  misc_feature (1301)..(1301): n is a, c, g, or t
tgcagccttcaataataatagcttaatagtggtgccatttcaagccttctcgccatgctgactaaaatagtgttcaatgtcggtgccccctcttggctatgtacacttcattatcaatatggtttccttcagagaatggacaacacgccgccctcccgaaaatgccgcttccatggacccatttctttaaccaccacggagcacagtttcgccgtccatgagccttctgcagggatactatggccttccaccgactccacaggagaacctcacctacgaaggcactgagatggcgacgtacgctcaaggtaaatccgctagtaccattcgcttgcgttatattcttctattggcctactgagcggccgcccgggcaggacgctcaaggtcatcataggaaggctagaagcttatcgagcagcgaacatggagatggtgctgacgatgctgagaagcccataaggcggcgccagaaagccgactctgagctgacgacaggtagggaggacaatggcggttgcctcttgccaagggctgggcaagggctggccctgaggccaaaatctgggagtcgaccagacgggaacggcagccagctagatctctcggccacgtgggtgccctcgtacggggatgggctgcacaccgtgaagaaatcatcgagcaccccggagttccaagactcagacagcatcagcatcgcctcggaatggctgaagagcaagtggaacctgaagccggacgcgttcaccctcacgcttcctcctctcccgctcttggacagcatacccaagcctctcctcgacaacattcccaactccatcgctgcttggcgaaacaaggcggccaaagattagcaagaggtaggtccatagcttcgtttcctatacttgttccttcttcttcttcttgggtaatttagttggagtgcgggaaacaaagggccggccggggcctggagaagttggtttgcactgtacctcccccccagtccccagccaaaaaaagaaggcacgaacggccagacatgctgctgaaatgggatgatggataccgtgacacattgcttacactgttacacatacatgctgtactgaatctgctgagccaaagcagaagcagatgatttcaagctgggagctaggacatgagcaccctttgtggggtattcttttctttttctttttgtttgtatgtatacttataggaatgaaggcaaacacacctaagcagcatgtgtgatattcccatgtgctaataaagaaaatggcttgttcatccttacgtattagcagttgtgntttcagcctcgtttaagattcaatagaatatcaggaacctttaatctatcagcatcaacttcaatagttcaactcaaatgtcagataagctaagaatcccataaacagaacatgccaaagaagaagattaaatagaagagcagtggaaaagatgggatatgcactgtatccaccctctcaatgcatctgcaaaaccctacctcaaagaccatgtaatttgtcataaaaacacccaatatggattataggttatgagatgatccaccaatttgcaaatgttccatgtattataatagaaacagacaacagatttcagcaatcagtaacttgtccttattaatcctcacctcagtcttgaaccccaattcatcagatgttgacttaaatttgttctgtagcatggtaaactaggtttctatcaaaactactacagatgcgccaatagtttaggtgcgatgaataaggctcacgaggtaaagtaacacatgttcttgacagggatagattaaataacaagaattcaggccaacttactgtccatcaggattcaggaagctcatatgaagtcgtggcaacatttgcatatgccacatccgcatgaaaaaaatagagctgggaaatcaagtgttgtctgttgtaacataacaggaaatgtaaaaaaaaagggtttaaaaccataaggcaatgaaacaaatacagtataatttaagttgcattcaaggtacatataaaagaagccaaaggaatattgaatttgcaatagaaacagcaccaaagataacaactgctacataaatatttagttagtataccatcaaaagcagtgtctggaacctgcaaacggacccttcatgtcactagcaatagctcactgtaatacagcagatcatcattgaagcaataaaaaaagtttcaacagcgaatacaatcattatagctttgt

SEQ ID NO: 17239 - DNA, 682 bp, Zea mays
gcaatcctgcagattgtcatcctgcagtttatttacatgccggacttgataaatacggtgtcaacactactcctcaggctacccttctcacgaagaatggagatagaggctgaccacatcgggctcctgctgctcgcttctgctggttacgatccgcgtgtcgccccttcggtctatgagaagctaggaaagatcggaggagattcagcactgaataactacctctcgactcacccgtccagcaagaagagggcgcagcttctgtcgcaggccagtgtcatgaacgaggcgctgaaactgtatagggaggttagtgccggccaaggcaccgaaggtttcctctagattctgggacctgctcctctgcttgtttcaaacgcctcacaaagaggttggtggtcttgttagctgcagtagtgacggcctgtggcatcggcgttctgagtggttcagaagcctggaagagtaaactaagctatttgctcctcgttatttccagtcgttctgatgtcgaacggggccctcgtcgcttcccctagcagacgcaggatagctgcttctgcatttgtcattaggaaaaaaaggggggccccggattattgtcaataattgttggttgaccccagctccaaaaaaaaaaaaaaaaaaaaaaaaaaaaaactagagggggggcccggtaccc

SEQ ID NO: 17240 - DNA, 1070 bp, Zea mays
gcacgaggcagattgtcatcctgcagtttatttacatgccggacttgataaatacggtgtcaacactactactcaggctacccttctcacgaagaatggagatagaggctgaccacatcgggctcctgctgctcgcttctgctggttacgatccgcgtgtcgccccttcggtctatgagaagctaggaaagatcggaggagattcagcactgaataactacctctcgactcacccgtccagcaagaagagggcgcagcttctgtcgcaggccagtgtcatgaacgaggcgctgaaactgtatagggaggttagtgccggccaaggcaccgaaggtttcctctagattctgggacctgctcctctgcttgtttcaaacgcctcacaaagaggttggtggtcttgttagctgcagtagtgacggcctgtggcatcggcgttctgagtggttcagaagcctggaagagtaaactaagctatttgctcctcgttatttccagtcgttctgatgtcgaacggggccctcgtcgcttcccctagcagacgcaggatagctgcttctgcatttgtcattaggaaaaaaaagaaattaagcaccgtattattgtcaataattgttggttgacaccagctcctgtttccaaaaaaaaaaaaaaaaaaccagacagacgcctcaaatgtccgtccatgattaaaaaaaaaatcttgagcattatttcgtacgcagatatggcatctagtcaggattctaaatattcgccagtcgtaaatgacaaacaatatctcagcttttttgccaatgccacacacggccagccggcaagctttgcttccatcagcagcaacaacatactgtggagcaaggactggttggtattatctctgctcttaatatttgtcatctgttaattcatttttaaactaaaacacgataaataaataaaaaatagagagtatttggtcctgacagcgtcatgactcacgagtgattagaccgcagcctgcttgtgtcgctttcgccggatttttctctcatcggaaacggagtagtttactagtgagatttatcgat

SEQ ID NO: 17241 - DNA, 695 bp, Zea mays
catcactaagagcccctccctcccgtccctgcagattgtcatcctgcagtttatttacatgccggacttgattaatacggtgtcaacactactcctcaggctgcccttctcacgaagaatggagatagaggctgaccacatcgggctcctgctgctcgctgctgctggttacgatccgcgtgtggccccttcggtctatgagaagctaggaaagatcggaggagattcagcactgaataactacctctcgactcacccgtccagcaagaagagggcgcagcttctgtcgcaggccagtgtcatgaacgaggcgctgaaactgtacagggaggttagtgccggccaaggcaccgaaggtttcctctagattctgggacctgctcctctgcttgtttcaaacgcctcacaaagaggttggtggtcttgttagctgcagtagtgactgcctgtggcatcggcgttctgagtggttcagaagcctggaagattaaacctcgttatttccagtcgttctgatgtcgaacggggccctcgtcgcttcccctagcggaagcaggatagctgctttgcatttgtcattaggaaaaaaaaagaaattaagcaccgtattattgtcaataattgttggttgacaccagctcctgtttcaagtgtggttttgctccaaaaaaaaaaaaaaaaaaaaaaaggtccta

SEQ ID NO: 17242 - DNA, 811 bp, Zea mays
atgcatgagagacgacgcagatgctgtgttgcttgctctttctttattccttacattgtttgcctcgtacgttcctggttcagtattagtagcagcagcagcagcagcattgttgaatgctgttgagctaggaagcggaccgatcgaggaattaatctgatggagtttggttgtgctgccatggcgataatgcagccggtggtcgcgacggtggtgctgaggatcggctccacggggctccactgcgacggctgcatgaaccgcatccgcaggaagctgtacaagatcaaaggagtggagcaggtgcgcatggacttgggcaagaaccaggtgacggtgacggggaccatggacgccaaggccctgccggagaagctgcgcaagaagctgcggcggccagtggacgtggtggcgccggggtcgggcaacaaggacgtcaaggacaaggacggaggcggtggcggcggcaaggagaaggagaaggagaaggatgggaaggacgggaaggacgcggcgatcaccaaggccctgtcggctgagctggaggcgtggaaggcggccttctacgaccagcagtcgctgagcaacgccgagttcatgctgagcgacgagaaccccaacgccgcctgcgccgtgatgtgattaagctcagctctgtagcaccacaccagcacgggggtggttagattagcgtcagatagcattacaccacacagacaagacaggagaggtatgcagagtgcaaagcttctgggaagtcaaatttgaacataacaaatttgagattttggttacaatgtgatcctgagac

SEQ ID NO: 17243 - DNA, 3941 bp, Zea mays
cggcaagtaggtggcgtggcaagcatggtgcctggctatgactgcgccgcctccgtgctgctgtgcgcggaggacaacgctgctgttctcggcctggacgacgagtcctcttgggcggccgcagctacgccgccacgcgacaccgtcgtcgccgccgccgccgccgcgggggttgccgtcgacgggttcttgacggagttccccttgctctcggatgactgcgttgcggcgctcgtggagaaggaggtggagcacatgcccgcggaggggtacctccagaagctgcagcgacggcatggggacctggatttggccgccgtcaggaaggatgccgtcgactggatttggaaggtgagttcacttaatcgatggatcctttgcttgcgatgctagtgagatgcggagatgtggctcgctggatttgcgtaaaggtctatcttttacagagctcatcgtggttcttcacttgatttatgctcatcggtatcttcttccaacataaatcggcctcaaagctcactgaatccacatctttttttgctggataggtcattgaacattacagtttcgctcccttgcctgcagttctgtctgtgaactacctcgatagattcctctccacctatgactttcctgtaagtcttgcaattttagtgtcgctggaaacagccctactcaaataacttagtgctgatgggaggaagatccatatcatggcaggaaggcagagcttggatgactcagctcttagcagtggcatgcttgtctttggcttcgaaaatagaagagacttttgtgccactccctttggatttgcaggtgagccagtgcgatggatcccatcacttgcttgcacatacattgtgctgttctgattctcttttccagcaaagtaattttcgactttgtgtggcaggtagccgaggcaaagtttgtttttgagggaaggaccattaaaaggatggagcttctggtgctacgcaccttaaagtggaggatgcatgctgttactgcttgttcatttgttgaatactttcttcataaattgagtgaccatggtgcaccctccttgcttgcgcgctctcgctcttccgaccttgtcttgagcactgctaaaggtacaatttaggacttagtccagtatgattcctgaccttattgatcggcatagaaaaattctcaatttggcagcaatcaatttctaaagcgtgacaattgggtctgcaggtgctgaattcgtggtattcagaccctcagagattgctgccagtgttgctcttgcggcgatcggggaatgcagcagttctgtaattgagagagctgctactagctgcaactatttggacaaggtaataatttcagagctcgatgttcctactaaaccatatgacacttaccattggatggtatcctctgagagcagacttgtttatccatgttttacttaccattaaagcctgctcaaattgtttccaaaatagtctaaaacaccgttaacacgttttaggagagggttttaagatgccatgaaatgattcaagagaagattgctgtgggaagcattgtcctaaagtctgctggatcatcaatttcctctgtgccacgaagccccataggcgtcctggatgccgctgcctgtctgagtcaacaaagcgatgatgctactgttggatctcctgcagtatgctaccatagttcttccacgagcaagaggagaaggatcactagacgtctactctagttgtggtatgcttcaggtgtgctcctcaccgttctaggagtttttgattggttcattcatcttaaatttagtttggcctctcaaggattatggtttcgtcaagtagttgcctgaatggaacaacaaaacatgcacactactcagtgttccatataaacagagagagaaaaataacaagcagcgtcctgcgagccagtgttgcgattccagttcatgcaattggcatccgtaaggggaatgcaagcgcaagacactagagtccagggatgctggtgtaggtagagagggggaacaaggaatttacatacggcatagagatgagagctctctcgtaccattttgtaccttcaattcgcaatgaactttaggcaaggattgccttgggcaattgaacatttgtcgggtgagaagaatccaaagatggatcggcagaggaatagaacaatttgatatatttccataaactacagatatgttttattttttcttaatggtgagctgccacttgttgatagtaatatggtattcggcgttccgttttggttgcgctggggccattggttgattatgaccaatgtaccttcattggttattcttgattgcgagtatttgctactctacctgtcttgtccattctatttatcaatctggaacgcaaacatggctttgaaagaaattagaacttaaaatcgatcacatttcgaggttgcagatactaatcaaattatcaaatcagggagcataatgagatcctgtcccttaattatttgtatctgcttggtgatcgatcactgttggtgaaccctaacaatggtagattagtagtgctgataaaccttagaccttcttgcaaaacccctagaagaatccagttgccgcagagcattgtagtgtgtttggacagtttccatctgtaaacaaaactgagctagaatctccattgctttttttgccattaatctttttttaaatccatcgactgcttctgaccaaaaacctcactgcaccatttacatcgagttttcaaaaacctcactgactgactggtcaataactggaaaccccccgtcaccgtcgcctagcaatatatactggatccttcgttgcagaaccagacacatgcaagtttactcttcgaaaatatgtaatactgaacccttcgatgcagaaccaaccgatttaagcagacaagccagtcgttggtagcattatacagccatggtagattaagcatagttgaagtagcaacacgatgagtaaaaaacgcagtggcgcgagaagtttctgaacagactgacgtgcgtttcccaggagccgttgctaatgttcatagaaccgagatgggaaggcagtcacggccgcgtcggatgcgcatctcgactcgccgaatgatggaacagacagcccatcttgttccatgttgtcactctgttgcagcagcaaaggcaataagctaaaaaaaacaatgggtcgtcagaccggcgtgatctctctctcatgggataacaaaccatctagccactcactcattcttaacatcatatatcactttcatggaataaagatgtggcatttcaacgtctcagccagagaacggtttgtgatgttgacagggtggtctggtctgtgtacaaaccatctaaccactcactcattctttacatcatatatcactttcatgtaataaaatgtggcatttcaacgtctcagccagagaacggtttggaattaggattagcacgtgttaagttcccgctttctataggccaataaagtatcctgttacatcaatctctcgactaaacgcaaggcatttgcaaaacctgaacggcagctaataaaatgactccatagttagctacttagctacaccaggcttgtatgtgtttgctataaatgatataaaatcacttcacttggcaatggcacagcatggaaacattgcataaaaagtgcagcgattacaacatcttggattcaaacaccgatcagaatggatgcaatcacatccttgcaaattcccatggtccaactggttgtcaattcccgcagttaatcggatagctgcatagatcgttagacctctacatggataggcaaggaaataaacaaaaaaaaacttatagaagctcatacaagaatagttggcagagctgaatcaacatttggtgtctccgtttcaccgtagactgacacgtac

SEQ ID NO: 17244 - DNA, 2720 bp, Zea mays
ggattataatccagatcaactccggtatgcagatccacggagatcaatctgtggagactggagacacgagccaagcaaggatcactacccaatcccacccccgtcgccgtgatataaccactaggataaagttctcccggtatcttattcccattcgcgaccatacagaccgtttgccaaatgcaaacacgggttagggtataaacgttctccttgtatcccattcccaaaactcatttcccacctcccaaacccccacctgctgtttgcctgtttgagcgtactctagaccgaggaaatcctaaccagcttctaccccatccctctctctccgagtttccgttccttggcggccatgcgctttgctgccaccggaaccgagcaagaagatggagatcggacgaggtagagcggcgcggctcgaggaggccgtggcgagaggtggggcgagccgctcatagagcccgtacttgtgagggcgggcgggggtctcgcgccgctcgggaagggtcagaaccggcctccctcgatccggcatcacctcgccggaccaggggccacctcacctcgtctacctcgcggtcaaggctgcgggatggttgagcgttgcaacctggggacggcaagccgcaagcggcgtcgccattttcgtgagattacgacctcgccggagcgccgcttccagccttccactaggctccctccgatgaccagatctgttgttatgaaactcttgcgtgcgtgcgttctcgagcgaccggaaaatttggattttgtcaaagagttaatgaactagtactattaatctggattttgtcaaagagttcatataaatttctcaacgagttttgaactagtactagactttctctttaatgcaattatgcaaacgcaccctgcatcgatttcactagcctacgttaacgcagtgatgataataacggaaaaagccttgccccggctacacactccacgcaaaacacgatccagtgtcgtgcgcgcagaggatccgcgctccgaaaactcacctaggaaaatgccaaaaacaaaacaaccccaaagaagtcgcaggcatgttttacagaaaaccccctcgtttctataccatatcctctctaccatcactaggcacagagcccggccgccctacataaaccccgctctccactggtctccctccgcggccgcgtgggctgcagtggcctagccggcgtcgtcctccccctctctcgctcctctgtcctcccctctccacttgagaagaacacaattaggaaaaaaaggcaaaaaacatttaccttttttctatctgtatattatctgaataaatcaagaggaggaagaggggagggagcgagggagggggaggagtagcaaatccagactccatagcaaccagctcgcgagaaggggaaaagggggaggaagagcttcgcttgtgtattgattgctcgctgctccagtccctgcattcgtgccgtttttggcaagtaggtggcgtggcaagcatggtgccgggctatgactgcgccgcctccgtgctgctgtgcgcggaggacaacgctgctattctcggcctggacgacgatggggaggagtcctcctgggcggccgccgctacgccgccacgtgacaccgtcgccgccgccgccgccgccgccaccggggtcgccgtcgatgggattttgacggagttccccttgctctcggatgactgcgttgcgacgctcgtggagaaggaggtggagcacatgcccgcggaggggtacctccagaagctgcagcgacggcatggggacctggatttgtgccgccgtcaggtatggacgccatcgattggattgggaaggtgagttcacttaatcgatggatcctttgtttgcgatgctagtgagatgcgtgacgcgcccgatttgcgtaaagctctctcttttagagtttaccgtggttcttgacttcgttgacgcccatcggtatcatcttccagcataaatctccctcaaagctcactgaatccgcatcttatttgctcgataggtcattgagcattacaatttcgcaccgttgactgccgttttgtctgtgaactacctcgatagattcctctccacgtatgagttccctgtaagtcttgcaattttagtatcactggaagcagtcctactcaaattgcatagtgctgatgggaggaagatccaaatcatggcaggaaggcagagcttggatgactcagctcttggcagtggcttgcttgtctttggcttcgaaaatcgaagagacttttgtgccactccccttggatttgcaggtgagtcagtgtaatggatctcattctcatcacttgcctgtacatacattgtgatgttttgtttgtcttttccagcaagtaatttttagactttgcgtgcaggtagcggaggcaaagtttgtttttgagggaaggaccataaaaaggatggagcttctggtgctaagcaccttaaagtggaggatgcatgctgttactgcttgctcatttgttgaatactttcttcataaattgagtgatcatggtgcaccctccttgcttgcacgctctcgctcttcggaccttgtcttgagcaccgctaaaggtacgatttaggacttagtcggatacgattcctggtcttattgatcagcatacagaaattctcaatttggcagcaatcaattcctaaagtctgacaattggttctgca

SEQ ID NO: 17245 - DNA, 1002 bp, Zea mays
gggacccgcgctatcctcttacatcaagctaccaggccccggccccggcccctgcctgcccctgccccgccgtagcccagcaggccagcaccaccatccggcagccgccgcgcaacgcaccacactaggctcctcgacagtcgagactcgagagcccaatcgtacccgacctgattcggaaggagggttgtagccccaccccctctggttccggcgcccatggcggtggcggtacctggccagctcaacctagacgaggccccgtcatggggctcccgcagcgtcgactgcttcgagaagctcgagcagatcggcgagggcacttacgggcaagtgtacatggcgaaggagacgggcaccaacgagatcgtcgcgctcaagaagatccgcatggacaacgagcgggaagggttcccgatcaccgccatacgcgagatcaagatcctgaagaagcttcaccaccagaacgttatcaagctaaaggagatcgtcacctccccaggcccagagcgggacgagcaagggaggccaattgacggcaacaagtacaaggggagcatttacatggttttcgagtatatggatcatgacctcactgggcttgctgatagaccaggaatgcggttcactgtgccacagattaagtgttacatgaagcagctgcttacaggcctacactattgtcacgtcaatcaagtcctgcatcgagacatcaaaggatctaacctcttgatagataacgagggtaacttaaagcttgctgattttggccttgcaagatcattctccagtgatcacaatggaaaccttaccaaccgtgtgatcactttgtggtatagacctccagagttgctacttggaagcacaaagtatagtccagccgttgacatgtggtcagtgggctgtatttttgcagaactgctcaatgggaagccaatattgcctggaaagaatgagccaggcagctgacctaggtcctcgcgcgctgtggtaccctgacga

SEQ ID NO: 17246 - DNA, 7835 bp, Zea mays
  misc_feature (2825)..(2825): n is a, c, g, or t
  misc_feature (2837)..(2837): n is a, c, g, or t
  misc_feature (7769)..(7769): n is a, c, g, or t
gcacgagcactgcagtggcctagccggcgtcgtcctccccctctctcgctcctctgtcctcccctctccacttgagaagaacacaattaggaaaaaaaggcaaaaaacatttaccttttttctatctgtatattatctgaataaatcaagaggaggaagaggggagggagcgagggagggggaggagtagcaaatccagactccatagcaaccagctcgcgagaaggggaaaagggggaggaagagcttcgcttgtgtattgattgctcgctgctccagtccctgcattcgtgccgtttttggcaagtaggtggcgtggcaagcatggtgccgggctatgactgcgccgcctccgtgctgctgtgcgcggaggacaacgctgctattctcggcctggacgacgatggggaggagtcctcctgggcggccgccgctacgccgccacgtgacaccgtcgccgccgccgccgccaccggggtcgccgtcgatgggattttgacggagttccccttgctctcggatgactgcgttgcgacgctcgtggagaaggaggtggagcacatgcccgcggaggggtacctccagaagctgcagcgacggcatggggacctggatttggccgccgtcaggaaggacgccatcgattggatttggaaggtcattgagcattacaatttcgcaccgttgactgccgttttgtctgtgaactacctcgatagattcctctccacgtatgagttccctgaaggcagagcttggatgactcagctcttggcagtggcttgcttgtctttggcttcgaaaatcgaagagacttttgtgccactccccttggatttgcaggtagcggaggcaaagtttgtttttgagggaaggaccataaaaaggatggagcttctggtgctaagcaccttaaagtggaggatgcatgctgttactgcttgctcatttgttgaatactttcttcataaattgagtgatcatggtgcaccctccttgcttgcacgctctcgctcttcggaccttgtcttgagcaccgctaaaggtgctgaattcgtggtattcagaccctccgagattgctgccagtgttgcacttgctgctatcggcgaatgcaggagttctgtaattgagagagctgctagtagctgcaaatatttggacaaggagagggttttaagatgccatgaaatgattcaagagaagattactgcgggaagcattgtcctaaagtctgctggatcatcaatctcctctgtgccacaaagcccaataggtgtcctggacgctgcagcctgtctgagtcaacaaagcgatgacgctactgtcgggtctcctgcagtatgttaccatagttcttccacaagcaagaggagaaggatcactagacgtctactctaattgtggtacgcttcaggtgtgctcctcaccgctctaggagtttttgattggttcaaacatcttaaatttagtttggccgctggaggattatggtttagtcaagtagttgctgaatggaacaacaaaacacgcacactacttggtccataaagacaagaaaataactggcagcgtcccgcgagccagcgctgcaatccagttcatgcaagaccctagagtccagggggggtgctggtgtaggtagagagggaacaaggcattcacatacgccgtagagatgagagagcctctcgtatgttttgtacttttgctccttcagtttgcaatgaactatataaacaaggattgccttggggcagtgaacatttgtcggatgaaaagaatcaaaaaggatgggggtcggcagaggaatagaacaatttgatatatttccataaactacagatatgtttcctttttcataatgatgagctatcatttttgttgatggtaacatggtatttggcgtcccgttttgtttgcatcaggccattggttgattgcttccaatgtaccttcattgattatccaatttttgtttgcattgggccattagttgattacttccaatgtaccttcattgattatccaatttttgtttgcatcatgccattggttgattacttccaatgtaaccttcatttattatccttgattgctactcagcctgtactgtccattctatctattaatctggaattctggatacgcaaacaggctttagaagagacatggatttaaaattgatcacatttcaaggtcagcaaattataggcaatctggggagcatagtgggatctttcttgtcccttagttatttgcatacgcttgggggatagtatttcattagatcattgctggtgaaccctaataacaatggtagatcagtagtgctgataaaccttagatctactcgccaaacccctagaagaatcctcttgccgcgaacattgaagtgtgctgggactttgcagtatctgattgttaactagagttccatatctgtaaaacaaacctgagatccgccttctgtcctgcggtcaagcattggctagaatgaatctctagtgtgtgtgcgcgtgtgttttcctttgccatttaacattttcttatccgtcgaagtcgactgcatctgctacagatgcatccatgtgacccttgtcactactgcaccatttacatagagttttcgaaaaaaaccgtccgatagctggaggccccggcccgaagggccaattgagttttctggaaccctggtacatgctgtcactgtcgcccagcaaagatgtcaagtacacgattgttggtcgaagtggcagctgttctctaccggcaatgtagccgtattactttctaccatgtaccatcggcgcatgcctgcgccntgctggacgacntcagcttttcgtatgctgtagtgtgtagactgtcgtgagtgtacactgtatggcagtctgccgccggtgatgaacactactgtttgccccagcactggctggctagtgccgggtctacatgatcagtttcgttctgcgacagtcccagacaaatgtccggaccagctcgcaactactgctgttgctatagatccagcaccctggcccccggtcatgctgccgacaagctcctgcttggcatttgctggacgaaggcaaaatccaaaccaaatccaggcagaagctctgcacatgagagagaccttttagcttgcttagcgttctttcttccttcacacctcattcatttacaataaaaggtaactttacctcatatacggcgttcgtttttaaaaaaatcaactaaacgaggaaggataagtgataaaatggttgtgtatcaaccggctactgccggttgctgtctcctcaatcaaccgcccttttttttcctgatgggttcttgttcctcccttttacacgtgggagccaatgggaaaggcccagatcggtctgtattatagtcccttttcttctgttgcttgctttcccgagagtaagtggaaagctacaaatctggatcgcagttatatatgtatgcttcatttgaaaagaaaagaaaagaaaaaaaaagaagtgcgtggaagttatgttcccgaatccactttaattaaacatttttcctttattggttgattgacagtacgatcatttcataattcttaattcatacctgagagaactgtctattgcagaatgtccgttccaaatgtactgtttccttttatatgcattagagagagaaaaaatataatcatataaattgctaaaggcaagtagtatatatagcacatgctttaatcatgttctgcaacgaggcaaaaataccttctgtgaacccagaccgagtctgtgcctcccggggcactggtcgagcgagcctgcaacttgcgagccacatgatcattgatcaatcgaaggagccagccagaagaaggcacgcacggcgcattcccagcgatctgcgtctgctcagtggctggagtagcctaccatgattccgttatcggctcgatggaagcgcatgatgatgaggatgagcccgtcgtcctcgtcctcgtcgtcctccacagttcgtggacctcgcatcgcattgccggcaccggcaggcaaggggagtgcctccgtgggcgtggctgggctgggctggacctggacctcctcattcggcgctcccatgcctgcttcctaccacctgcatgaattcgcttgtcgcccctaccaaagccaatcgagcgctgcacatctacttgtcgccctggatctcgatcggtcgcccccgcctgcccagcagcagctcgatcatgctgctcccactcctcgttggcacgcaccgcttggccagcagttggcccccccccctactgcgctgctttgacagcaccttcagagatgggttcggagactcagcgctgaaaccacccgcgtagtccgtactccgtagcgtgccgcgtacccctgacctgctgctgcctcggcctgcagtgcactgcactgcagtcagtccatggaaaatgggcatgatctgcatcatcagatgagaccaactaggtgagtggtggtgacttcagttcggtgttgacactacactgctgtgccgtctctctccccctgtagcggacggcttgtctaaacagtgaatttgttgctgcctgctggtgaccacaaccacaccacgccattggcaggtccgccggccggcccggtacacatgaagccaactgaattcaatggtgtgttcggccggcgtacgcacgggccgtcgggccccccggcatcctcctgccggtgcagtacaaacccctgccatgcgtcacaagcgctcggcgtcgctgacggcgtgccctcggaatcctgtcagttctcgtttcacggattcatctcagaagagcgtgttacttctggtaacactttctcgcgactaacacagggaagagcgcagcgcaggcgtgccaacgcatctatcaattaggggaaaagacagatctggagctgttcggagcgaggaggcagggcgtccggcccggtcggcgacaacgccggcgcaggcaccaccaccgtaccgtacccacctcaaaatcccatggaagagctcagctcagttcgttttcaactgcgcgccgtacgtgtctacgtgacgggataacgtgcacgcgggcggatccggagaggccgccgcgatctgatctgccgtgtgctgcctccttcgaaatctggattccgcgccgcggattcgcgggtttctgcgagcgaaacggcagtgccactgctctgtgcgcgggaaagcgggcacgcacgcacgagggactccagactcactccactcatctctaattcgcgcctcggtggaccaggtttcgcttctagcttcaccttcaccccgctgcaatactattatataccacctctaattctctatgaatgcatccaaaaggataggccggtagatgttggaattaatgaagttgacatagctgttttgctaactatggatatgctacctaccacttagaatagcaaccaattagccaaaattgcaggcacttagagcagctccaacagaatagctaaacagtccgcgctcttaaaaaaagaaaaactccgtgcaaaaagcttccaacagtctcttcatcaacttcgccatcgcatctggctcgccatcgtttccccgtcgctggtcatttttggctagctctcaggactcgccatctcctagccgacgcgtcctaccctcctgcttcctcccgcactctctcgctttggttcccatggctccccgagcaagtttgtcgtctcgctgtgatgagtgagctctcccctgacgaacccacctttccattaccgttgcttcttgcttgtttcgtccctatagcttcaccacagtgacatcacattccagttgaactggttcaaaaataggattgtcaatgatactagggaatatgaatccgatgtttgaactgttcagttggcccagctcccattcagtttaatccaactgtgacagatgtgttgttatggcttcttgaacacagattgtctagtttgttgaagtggaccgaacaactttgtgtctgtattatgtgcttgaaattggcaccaaatgttgtgtctgggtgtcagaccgattcagaacgatcatgcgccatgtccgtcaactacagcagatgaaaattcatgcgccaaaaaaagaaccgtatgagttggccagttgagagttttataggtcatcatctatatttgaagagtttgttggatacactcacatattatgaacttatctattttttacagctctcaatacttcaaatttagctagaatttatacctagtctcttggagttgctctgaacccgttaaatctacaaaccccatatttgcacacagcaaaaatgataaatatttattctaatttatacttcatccatcctaaaatataattttttctatctcttttttcgtccatattcgaaagactgataataaatataaatatacatataaactatatttatagcttaattaataaatacatgtttagtttaaaatgaattatattttagaatggatggagtagattgtttcggtatttctagtacttcattctcatttatagattctttcagtgtttctagatacgctatttttagtaaagtctatatatctagaaaagtaaaaacgacatgtaatccaatatagagagtggtatcacatatgagtctaaataatctgcattaaaggtcgcatcaggaggcacattctgctctagtatctcttgctgttaaaaatgctttctgaatttgatgcttccttaattcaacctgtcttcatatcttttctcgttaattcccatcataaaaagaatacaatttttagttttgttgtaagtcgaatcatcttaaattgtccgaatttataaaaagaaatatatcaatatttataatataaataaatattattagaattgtaatatatttttattgtgcctatcaaatggtgtacatgttaatactttttcactaaacttgatcaaagttaatttaacttatgaaaaaaatatactgtctttggtacctaaattgcaaaaataaaggagagaaaaggacagaattaaaaagtaaaaaaacaaaaacttgttactaccagcttcacgtaggactgtaggagccagggagcagttcctgaggcgtccaagtatctgttctctaacaaaagtgtttaaaggaaaaacttgttactaccagcttcaggatttgtaaccgtactacacaacaaggatgcatggatgcgcaagcaaaaaacgaaatcttaatctgataccaccactgcatcaaaatcgtgtctgcactgatttctcgagataagggaaagtcaggtacaggtaggggcggacctagtatagtggagtgagggcacagaccctcgctcatttatttagtgtaagtagtagagactagattttcactataagattatctgcttatttggtgcaagtagtagagactagattttcactataaggtcacctgcttagttcaacttagatgcctctactctggtgttttaatgtttgtcttcataaatgtgccctcgctctcatttcgctctgggtccgctcttgtacaggacaacatgcagtttactgcagcactgtgattacagtgagattgatgaccacacgacgatctctggtatcatcttcttcattgactgaatatgaaagaaaatatgaaagaaatgctccgatttccttcatggccttgaggtcatatgcaatagtcagtgagctgcggatgcaaatcgcttgaagtttatttagcctacttttaaganatattttttacgacagatactaagcaaaagaggacaaaaacgatggcaagaccttttccttccaaa

SEQ ID NO: 17247 - DNA, 2052 bp, Zea mays
  misc_feature (2052)..(2052): n is a, c, g, or t
ctcgaggccggcccgggtaccgcacccacaccacaccacaccaggctcctcgacagtcgatagcctcccaagtcccaactcgacctgagccgattcggaaggacggtttgcctacctctggttccggcggccatggcggtggcggcccctggccagctcaacctcgacgaggccccgtcatggggctcccgcagcgtagactgcttcgagaagctcgagcagatcggcgagggcacctacgggcaagtgtacatggcgaaggagacgggcaccaacgagatcgtcgcgctcaagaagatccgcatggacaacgagcgcgaagggttcccgatcaccgccatacgcgagatcaagatcctgaagaagcttcaccaccagaacgttatcaagctcaaggagatcgtcacctccccaggcccagagcgggacgagcaagggaagccaattgacggtaacaagtacaaggggagcatttacatggttttcgagtatatggaccatgatctcaccgggcttgctgatcggccaggaatgcggttcactgtgccgcagattaagtgttacatgaggcagctgcttacaggcctgcactattgtcatgtcaaccaagttctgcatcgagatatcaaaggatctaaccttttgatagacaatgagggtaacttgaagcttgctgattttggccttgcaagatcattctcgagtgatcacaatggcaaccttactaaccgtgtgatcactttgtggtatagacctccagagttgctacttggaagcacaaagtatggcccagccgttgacatgtggtcagtgggctgtatttttgcagaacttctcaatgggaagccaatattgcctggaaagaatgagccagagcagctgactaagatcttcgagctttgtggtacccctgatgacacaatctggcctggtgtcacaaaaatgccttggtacaacaacttcaagcctccccggccattaaagagacgagttaaagatttctttaagcattttgatcgacatgcactggatctgttagagaagatgttgactttagatccatcacagaggatatcagcaaaagatgcacttgatgcggaatatttctggactgatcccttaccatgcgatccaaaaagcttgcccaagtatgaggcatcgcatgaattccagactaagaaaaagcgtcagcaacagaggcaagcagaggaagctgcaaagcgtcaaaaacttaaccatcctccaccacattctcgtttgcctccactccagcagcctggccaagcacatcctcaaatgaggcctggccagggtatgcacaatgtgcctcctgtggcagccggcccaggccatcactatgcaaaaccccgaggaccaggaggccctaaccggtatcctcagggtgggaatcaagggggaggctacaatccgaaccgtggagggcagggtggtggctatggcagtggcccttatccccagcaagggcgagggcctccttaccctggagcagctggcccacggggcagcggtggcagtggctatggggctggagggccaaactaccaacagggtggcccatatggtacgtccggtccaggccgaggaccaaactactctcaaggtagtggttcccgcaaccaacagcagtatgggaactggcaataatgtggcagtattatgccattgatatgtatgtgtttgcagaatgcatttgcagcacctttgcactttaagcatgttgtgagatgtatgtcatgatagtactctaattcagtccagatgtctcagaagagctgtttatgactccagatgtagattatgattatcgagaaacgttttgtacttagaacccttgattcacttattagaagtatgccacaaagacctagcagagtttgctattagccccagtttcatacttcatatccaaattggaatcaggaacgcatagaagaagcctgaagttcagaaatgaaatttgttatggttgtgtacagttttgttatcacttcgcttcaatcacattatgaagcttaaaaaaaaaaaaaaaan

SEQ ID NO: 17248 - DNA, 2500 bp, Zea mays
ctacattcaaccaatgtttcataatgtatttaaactacttaaaatcctttacatctctacccaaacacgcttttcctttgaatcctataaattaaggctaattctcagacccactgtataaacaagaaataaaaggtgcattctaagattcttggaaagttaaagtttttaaaatttgacaaaaaatatagcaaaaatcataaagatttataagacaaaataaatataatataaaatatatttaatggaaaatcttatgatataaacttcattgtataaaattggtcaaacttgaaaaaactttgactctccaaaaatcttggaatgacttatattttgaaatgtagagagtagtttttaaaaaatatctaactcttttaaaattattttaaaggctattttaaaaaaaaaatctcaacgaacaacgtcgccaacgcccaacaccgaacaccacgcgctatcctcttacatcaagctaccaggccccggccccggcccctgcccctgcctgcccctgccccgccgtagcccagcaggccagcaccaccatccggcagccgccgcgcaacgcaccacactaggctcctcgacagtcgagactcgagagcccacgcgtaccgcgacctgattcggaaggagggttgtagccccaccccctctggttccggcgcccatggcggtggcggtacctggccagctcaacctagacgaggccccgtcatggggctcccgcagcgtcgactgcttcgagaagctcgagcagatcggcgagggcacttacgggctagcccccccccccccggaccccccctcccccgagatcgtcgcgctcaagaagatccgcatggacaacgagcgggaagggttcccgatcaccgccatacgcgagatcaagatcctgaagaagcttcaccaccagaacgttatcaagctaaaggagatcgtcacctccccaggcccagagcgggacgagcaagggaggccaattgacggcaacaagtacaaggggagcatttacatggttttcgagtatatggatcatgacctcactgggcttgctgatagaccaggaatgcggttcactgtgccacagattaagtgttacatgaagcagctgcttacaggcctacactattgtcacgtcaatcaagtcctgcatcgagacatcaaaggatctaacctcttgatagataacgagggtaacttaaagcttgctgattttggccttgcaagatcattctccagtgatcacaatggaaaccttaccaaccgtgtgatcactttgtggtatagacctccagagttgctacttggaagcacaaagtatagtccagccgttgacatgtggtcagtgggctgtatttttgcagaactgctcaatgggaagccaatattgcctggaaagaatgagccagcgcccccgcccgtccgcttcgagctttgtggtacccctgacgacactatctggcctggtgtcacaaaaatgccatggtacaacaacttcaagcctcaccggccattaaagagacgagttaaagacttctttaaacattttgatcggcatgcactggatctgttagagaagatgttgactttagatccatcacagaggatatcagcaaaagatgcacttgatgcggaatatttctggactgatcctttaccttgcgatccaaaaagcttgcccaagtatgaggcatcacatgaattccagactaagaaaaagcgtcagcaacagaggcaggcagaggaagctgcaaagcgtcaaaaacttaatcatcctccaccacattctcgcttgcctccaatccagcagccagggcaagcacatcctcaaatcaggcctggccagggtatgcacaatgtgcctcctgtggcagctgggccaggccatcactatacaaagccccgaggaccaggaggccctaaccggtatcctccgggtgggaatcaggggggaggctacaatccgaaccgtggaggtcagggtggtggctatggcagtggcccatatccccagcaagggcgagggcctccttatcctggaggtggaatgggtggaacagctggtccacggggcagcggtggcagtggctatggagctggaggtccaaactaccaacagggtggtccatatggcgcgtccggtccaggccgaggatcaaactactcccagggtggtggttcccgcaatcagcagcagtatgggaactggcaataacgtggcattgagatgtatgtatatgcagaatgcatttgcagcatctttgcagtttaatcatgttgtgattagtactgtaatacagtccagatatcgtaatagggctgtttgtggcaagcccgagcgttgccaaagggacccttagcatagtctcatttttacctcatcacaaaaccaacttaaacacaataatagtaaactttccgtataaaaaaaaaaaaaaaaaaaaaaaaaaaggttctctgcgttgttaccactgcttaagggcgaatttctatt

SEQ ID NO: 17249 - DNA, 1168 bp, Zea mays
cattgggtacctcgaggccggccgggataaaattctgcgcctaaaaatggccgcgtcccactgaaccaatcgtctgcacatcctcttgctgttgccgctcgctcgccgtgccgcaatggctacggccgtcgcctcccatacgttgctctcctccgccttcgctccgcgccactaccaccgccgcctgacccggaccgcgtccgtggggccgtgccgggccgccccggtgggactggccgtgcggtgcgagaagagcgacaagcagaagaggcagccgctcgccgcgctcgtgccccgcgagcagcgcttcatgttcgagggagacgagctctgcggccccgacatatggaatacaacctggtatcctaaggctgcagatcatgtaactaccgagaagacatggtatgttgttgatgcaacagacaaagatcctaggcaggctagcatccacccattgcagtacatatcaggggaaagaatgaacccacttacactcccagtgtagacatgggagcttttgttattgtggtcaatgcagataaggttgctgtttctggtaaaaagcggtcacaaaagctttataggaggcactccggaaggcctggagggatgaaagaagaaacttttgaccaacttcagaaaagaattccagagagaatcattgaacatgcggttcgtggcatgctccccaagggaaggctgggaagaagattatttacccacctcaaggtatacaaagggacagaacatccgcacgaggctcaaaaacctgtcccactcccgatcagggataaaagaatacaaaaaactggatagagaattcatcgactgaaaaggatgcagtggcgaattcctccccagaaggttttgccctttgtttggaatgctatcctcataaccatgcttctgatcgggggaggggggagtatcaatcctctttgtaattttgatgtttaccaatgcatgaaattcagtcaaatttctgtcaatgagtagtcatgtaatatggtacggtttaaatcaacctaaaatctttattttccagttgaagtttgtaattttgacctcgtatggtatgaagtggcagattgtttcattgttcggcctgccatctggatatacgaaattgatcgacagttttcataaccaaaaaaaaaaaaaagcggcc

SEQ ID NO: 17250 - DNA, 1169 bp, Zea mays
ctcctttgggcgcctcgggcccgcccgggccgcccggatccgcttgacgctccccactgcgcctaaaaatggccgcgtcccactgaaccaatcgtctgcacatcctcttgctgttgccgctcgctcgccgtgccgcaatggctacggccgtcgcctcccatacgttgctctcctccgccttcgctccgcgccactaccaccgccgcctgacccggaccgcgtccgtggggccgtgccgggccgccccggtgggactggccgtgcggtgcgagaagagcgacaagcagaagaggcagccgctcgccgcgctcgtgccccgcgagcagcgcttcatgttcgagggagacgagctctgcggccccgacatatggaatacaacctggtatcctaaggctgcagatcatgtaactaccgagaagacatggtatgttgttgatgcaacagacaagatcctaggcaggctagcatccaccattgcagtacatatcaggggaaagaatgaacccacttacactcccagtgtagacatgggagcttttgttattgtggtcaatgcagataaggttgctgtttctggtaaaaagcggtcacaaaagctttataggaggcactccggaaggcctggagggatgaaagaagaaacttttgaccaacttcagaaaagaattccagagagaatcattgaacatgcggttcgtggcatgctccccaagggaaggctgggaagaagattatttacccacctcaaggtatacaaagggacagaacatccgcacgaggctcaaaaacctgtcccactcccgatcagggataaaagaatacaaaaaactggatagagaattcatcgactgaaaaggatgcagtggcgaattcctccccagaaggttttgccctttgtttggaatgctatcctcataaccatgcttctgatcgggggggggggggagtatcaatcctctttgtaattttgatgtttaccaatgcatgaaattcagtcaaatttctgtcaatgagtagtcatgtaatatggtacggtttaaatcaacctaaaatctttattttccagttgaagtttgtaattttgacctcgtatggtatgaagtggcagattgtttcaaaaaaaaaaaaaaaaaaacgggcccctgaaaaaaaaaaaaaaaaaagcggcc

SEQ ID NO: 17251 - DNA, 1634 bp, Zea mays
atcctaatgagtcatgcataatagcagacacaggcaacagtgccccgtgagcacatgcaggatcagcagtacgacctccgactccgagctactgctcaccctctcgggctctcggcccgcccgtatgccagtctgtctctggtacactccttcatttcatcgcctagctagctactatatagaacgacctgcctgccttgctcttgccctgtgagcagcggcgtgcgatcgatcgaggcagtcgtagtaataagccaacaaacaaaccggccggaacgccatgctggaggagtacaaaccgtgtgcggccatggtggtgacgcagtgcatctacgccgctctagcgctcttgtccaaggcggcgttcaccggcggcatgagccccctggtgttcgtcgtctacaggcaggccgtcgccaccattgtactcgtccccgtcgtcatcgcggccaacaggaagaagatgaaggagatgacgacgggccttggactgacgggcttctcgctggtcttcgtcgcctcccttgtcggggcaacggtgaaccagtgcatgtactaccaaggggtgaatctgggctcgtcgtccatggcaacggccatgaccaacttgatccccgccatcaccttcgtcatggcggcatcagtcggcctagagagggtggaggccaggaggccgaggagcctggccaagatcttcggcacggccgtctgcgtgagcggcgccatggccatggctttcttcaagggcccgaagctgctcggcgacggccccaacgctctccagctcctcctccacgcgggcggcggcaggtgggtggccggcgcgctcttcctcgtgggcagcagctcctgctggtcgctctggctcatcctgcaggtgcccatctgcaagtcgtacgtggagccgctggctctgtcggcgtggatgtgcgtcctgtccacgctccagtccgcgctgctcgtctccttcctcctgccggaccccagcgcctggaggatccactcgctcttcgagctctcctgctgcgtcttctcgggcgtgttcgggtccggcgtcacgttctacctgcagtcgtggtgcatctccgtgaggggcccgctctactccgccatgttcaacccgctctgcaccgtgatcaccaccgtgttcgccgccgccgtcctccgcgaagagctgcacgtcggcagcttgctgggcgcgatcgccgtcatcgcggggctgtacgtggtgctgtggggcaaagcgggcgacgccaacaagggcggggtggagccagagcaccactcggacgatctggagaagacgtcatcagcgcggtcggatcccaattcgacggccggcgtcggcagtggcatcgccgagcccctcctggcgggcggcgatccaacggagaagtagatgggattttgctgctcttcaagtgttctgtgcgtgcgcgcgcggtgttttcagggtcggtatgctagtgctactgtaacagtgccgtcccagttttgtcatgtacactagtggcagcttcaaatgactccgtgctgccgatgtgtattatccgcacaattttgttaagcaacgcggcgtccccgtccaaaaaaaaaaaaaaaaacggcaggccggtccgctccgctcgccgtcg

SEQ ID NO: 17252 - DNA, 3516 bp, Zea mays
gcacacaacttgtggagggatgaaatctagaaaaattgagtataaagaatgtagagaacagataggagattgttggatgcatcctctacagttggtcatcagagaccggattgggcttaacccaactaaccatctctctaatcgagcccttgattgggagggaccgggctaacctcggttcgagccccggtcacatgacgctatataaaggattagccgtagaaaaaccaacgctagtacctcgccctaaaccctaatccacataataaccttatctcctaggtgtcggagtgactagaagagcgacaccctaacggtggtatgcgagaacggaggcgacgtcggtaaggatcaaatccatctccactactgcagggcgaaggtatatgtctctctgtttatgcacatagatccaagaggatcaatctatctgttattatttagtactctctggttgattaagtgagactcagtagatccacaacttctatcaacatcatctagtagcttgcgctgagagacttggacatcgtgtgctttccctcgagtccatggctactcacgcctgagctgttcgccaccacgcattggacgttcgctgaaattagttagctcatgcagatgtttccatccccatcctcacgactttctttgtcctatataaaaagagagatcgacattgttagttaacgtggagactcgttggtctacaacgtaaacgataaagggggcggcagcagcaagcatgacgaggtcgcgagctgtagtgacgttagtgctcctgctggccgtcgccacggcgagctgcaggctgtcgctcgccgccgacgagaccatcgcggccatcttgggccgcgacctgcgggggttcatcgccagggccggcaacctcttcaggtcggacggcagcgcctggcgcgccgcgaacctcaccgcggccgaggcgaagaacctgagggccgccaggaagtcgtcctccggcggcagagcgggctgcgtgagcgccgcggcgtgcgggaagaggcgggtgatctgcggcaagaggtgctctgacgtcgcctcctcgcgcgccgccagcctcagccacgtcccgtcgcgatgcgtcgtcaagtgcagggagtgcgtgcccacctgctagatcctcggcccctctcttcgttcgttctgcgatgggtctccactccactctcgcctcttggtgctcagcgcatatgcaggcaatgcagctccgactccggtccacacttgtgtatcgtaggttcagtcatcagtggaataaaataaaagatgcagagactgttccacacggcagtaggtagtaggtacacacgtactaccagtgactatacagtgactatagtgaacagtgacttggacactgtactccgtctgtgagttctttcttttttttttggaatttggattctttttcttttcctccatgcttgcagttgttgtagctagggtatggggtaccgggcgcctatggctcctttcattttctttcagtcatgagtgagcttgcagacgactgacgggcctgacaacgggcgtgaaggctccgctgaacgaactgctaaccaccgttggatttgaaggagacgattgtgagtgagatgggctcgaccgaccattaactgagcagcaggtggtagcccgtgctcattcgccgaatccccatctcacaccaaaacgctggagctgcaatggaaagagacgtggccattactgcgtgcggtttgcagttgagagtccggcggggctgttggcagccataaaaattcttcttctgtactccaaacccgagtgctccgcggatttcagacacgcaaagttcacggcggggtgcgctcctgctggtccacaggttctgccgtcatgggtcatgcatgacgacgggcgaagtaaccttagcgtgcgcagacacgccgcttcagtgtattccgaacgggccggcggcgaacggccttgcttggcggcaggagagaaccacgcgaatgggccatgcattgtcagtgacccatgcctgccggcgcattgacattgtcacacgcgtattagtgcagtcgccatcgcgcggttgcgcattaccgctcgaccggagccgatgcggatcgatggacgtaaacctggggaaggcaagtgctttgctgcctgctactgtacgctcgcccggagggatgataggaagacgggtctcattagttgcccggccgcggcgccgcgaattgacgcgcaaccacacaacgccaccatgctgcggttctctcgcacgcacgcgcgcctcggctaacgtcgtcattaatttgattgtttcaaccaggcgactggctggtgctctgtatgcgcagctagcaggagcaggcggctgttgctaggagtgttgttgggacgatggcaggtgttaggagtggctctggagtctcaactcgatcggtctcattcatctcccagtcataggccggccacagcaggagtcaaccatgtccgtccgtgcgagagagtttcaagggattttttatttgagccgagcagccagccagctagctactagcggtcatcacgccttccttgcctccgtcgtcagtcgtcctgggttgccgggccaacgacgcgtggagaactggaggcgtccaaccatttgctgctgcctgatgatggtgccagatatacatacaatcgcagtaccacaccgtacgtttttcttttccccttccttcgtgtccttctttcgccaatcatcaactccaacgtcgactgccacaaatgcgatgtactccacgtcagtactagtactacgcattagtaccaacaacaacaatttcccttttcgatcaacatcaaaacttgattaacttgctttcagaccaaacatcacgcaaacatactaggagaatacatattaggttaggtcaaattcacgtccatatatacaatagagtagcacccacataagagcaataaacgcagcgacacaacaccaagaatgcagaccacaagagcacactttatctagaacgactgtctctactcaaatagggtgctccgatctctcagaatggcttcaaactgttgcacaagtgtttgggaacgatgctcggctctattggtgattgatgtctcgaatgtgctgtttggagaggtatttatagactcaaacccctcaaagagtcattgagtagattgctgaaattatgctttccttgggtgcgccactggacctccaatggtcaactcaatcaacgtgatctgctatgaccttgccttgctcggtggcaccggaccggttcggtgcaccacatgacccccgccatgtgtcctgccatgtcagctagatgttgcagctaaccgttgagagttgaagtttatgctggacctgactagtctagtgcacacctgactagtctgggttgccgaagttccttagtatcctctgtagacctctctggtaaagtggtatggtgtgccaggccacaggaagtcatttacagatgtctctggttaagtgatctggtg

SEQ ID NO: 17253 - DNA, 780 bp, Zea mays
ctttttagtccgtttgatctgtatccaacgatagatacaattgtggtttgttagggtttttgttagggtgcttttcctgaagctataccagggtttaagtgctaaatatgacattctgttggatctagatctaacggatcaaaatgtctgcttgcgtgcttgcacctagtacctatttgcatattaatcgttgccgcagttaatgtgtagcatattaatcgttgccgcagttaatatacccatgtagattttgcatccgctattctgcctaatctttttaaaaacggtgtaggttatgcaaccgaaacatacaaattggcagatttgaacgcggaggctcaagaatctggagatgatgaagatgataatgtgtgggaagagggttaatgctgaaaagataactggcgacccctgctccctctcgaattttgaactggtatcccgtcacacgggtcaaaattatttcactgatgagcctgattatgttgaacgcatgatcacaagaaatttttagttgaagatgtacaaaatatacttatatttgagtagcgggttaacatttttctctgttacttaaatatttgagtagcgggttaatatttgatgtgtgggggcaacttacacgcctctgtttatctgaaaggaatcagagtgaaaaatgacagatccaaacttctatacgtacatgcacgtttatgtcctgaaagtgaaattgcaatctttcgatacccacgtttgacaaaaaaaaaaaaaaaaaactcgagggggggcccggtaccc

SEQ ID NO: 17254 - DNA, 2183 bp, Zea mays
cggggcccccccgggccgccggcggggacctacgctatagccttctagagcagtagagattgacaccacgggcacgcacgtcagcgcctccaccttcctccccagccgcaagcagagcaagaaccggagctggggatcgattccgcgccgcctgatctgcgatcgggactcgatcgtgcataatccgaggttcttcctctctgtcgtctccgatccagacgggtgtgcctggtctgcatcttcatcctctgcaagaaatcacacatctcgtggcgcaccttgcatcagccgcggccggcacctctactctcgcccgccccctatgtcgtaagcgcgcaatcagaactcccgatcacccgcacgctggtgcgccagtgtcgtcttcgccaccatgaactccatcgagcccttcaacaggctggtgaagctggcggcccgcgccttctacgatgacgtctcaatgaagggcgacaaccagcccaagacctcccgcggggacaaccgcggcatggccgtcgtcgtcctggacgcgctcaccagacgaccgtgggtccgagaggaagatttggctaaagcattgaagctccactcgaaacagctgcgtcgcattctccgtttctttgaagaggagaaactagtcacaagggatcatcggaaggagtcagcaaaaaatgccaaagcacataatgctgcagctgctaatgacggtcaaacagttgctaaggagggagaagagaaagtaaagatgcacacacattcatactgttgcttggattatgctcagatatgtgatgttgtcaggtatcggattcaccgcatgaaaaaaaaattgaaggatgaattggacagcagaaatacaattcaacactatatatgtcctagctgtaataaaagatactcagcctttgatgcactacaactggtaagctacacggatgagtacttccattgtgaaacttgcaatggtgaactggttgctgaggatgacaagcttgcttctgaggaaatgggagatggcgatgacaatgttagaaagcgcaggcgtgagaaattaaaggacatgcagcaaagaattgaagagcaattgaagccattggttgcacaacttgatagagtgaagaatctgcctgcgcctgagtttggtagtcttcaaacatgggaaagagcacatattggtgcctttgcaattggtgaccctgctgcagctgattcttctaggaattcacaagggcagtatggtacaccaatgccataccttggacagacaaaggttgaagttgatatattgagtgatggtgaaaaagaaggtgctgaatcaggtaaagatggttctgaactcaaagtcatacctccatggatgatcaaagatggcatgaatcttacaaaggaacaaagaggagagaaaattgagtcacaaaaacttgaaaaatctgaagccaaagatgataagaaacaggacttgaaagatgatcaaagtgtacaggaagaatacataaaggcctattatgaggccttgaggaaaaagcaggaagaggaagaagcaaaaaacagaatgcagcaggaaggcaagatttctgtccctgattctcaaactgaacgccaagtgggcaagaaatacaagcgggacgacgatgatgatgaagacattgaatgggaagagcatcaacctacagctgcagggaatgcaaccgaaacatacaaattggcagatttgaatgcggaggcccaagaatctggcgatgatgaagatgataatgtgtgggaagagggctaatgctaaaaagataacagactattcctgtgcggctgcgcccttaggattttggtatcccaccagaggtcgagagtatttcactaatgagcttagttatgttgaacgcatgatcccgagaaacttgtcaagtgaaaagccagcccctatgcatttttagttgaagatgtacaaattatacttaaatactttatgagccggtcagcagtttcccctgttacttcgaagagctgttgtagtcttgtagactgttaatgtgtgggcaacttgcatgcctttgtttcgctgaaaggaattacacgtacatgcacgtttatgtcctgaaagtgaaaatgcaatcgttgtagttgccattccaaaaaaaaaaaaaaaaaaaaaaaaaaaacaaaaaaaaaaaaaaaaaaaaaaacaa

SEQ ID NO: 17255 - DNA, 1884 bp, Zea mays
ccggccggggccctttccccttcgatgcaactggtgtggcggcggcggctgcgggcggcgtgatacggcaccccctcctcccgcccccttatgcaagcgggcaatcagaactccgatcacccgcacgccggcacgccagtgtcgtcttcgcaaccatgaactccatcgagcctttcaaccggctggtgaggctggcggcccgcgccttctacgacgacgtctccatgaagggcgacaaccagcccaagacttcccgcggggacaaccgcggcatggccgtcgtcgtcctggacgcgctcaccagacgaccgtgggttcgggaggaagatttggctaaagcattgaagctccactcgaaacagctgcgtcgcattctccgtttctttgaagaggagaaactagtcacgagggatcatcgaaaggagtcagcaaaaaacgcaaaagcacataatgctgcagctgctaatgatggtcaaccaattgctaaggagggagaagagaaagtaaagctgcacacacattcatactgttgcttggattatgctcagatctgtgatgttgtaaggtaccggattcaccgcatgaagaaaaaattgaaggatgaattggacagcagaaatacaattcaacactatatatgtcctagctgcaataaaagatactcagccttcgatgcactacaactggtaagctacacggatgagtacttccattgtgaaacttgcaatggtgaactggttgcagagagtgacaagcttgcttctgaggaaatgggagatggcgatgacaatgttagaaagcgcaggcgtgagaaattaaaggacatgcagcaaagaatagaagagcaattgaagccattggttgcacaacttgatagagtgaagaatattcctgcaccagagtttgggagtctacaaacatgggaaagagcaaatattggtgcttttgcaattggtgaccctgctgcagctgattcttctaggaattcacaagggcagtatggtacaccaatgccatacattggagagacaaaggttgaagttgatctgttgagtgatggtgtgaaagaaggtgctgaatcaggtaaaactgattctgaactgaaagttttacctccatggatgatcaaggatggcatgaatcttactaaggaacaaagaggagagataattgcgccacaaaaacttgagaaatctgatgccaaagatgacaagaagcatgacttgaaagatgatcatagtgttcaggaagaatacataaaggcttattatgaggccttgaggaaaaagcaggaagaggaagaagcaaaaaggagaatgcagcaggaaggcaaggtctttctcccagattttcaaactgaacgccaagtgggcaagaaatacaagcgggacggtgatgatgaaggtattgaatgggaagaacatcaacctacaggttatgcaaccgaaacatacaaattggcagatttgaacgcggaggctcaagaatctggagatgatgaagatgataatgtgtgggaagagggttaatgctgaaaagataactggcgacccctgctccctctcgaattttgaactggtatcccgtcacacgggtcaaaattatttcactgatgagcctgattatgttgaacgcatgatcacaagaaatttttagttgaagatgtacaaaatatacttatatttgagtagcgggttaacatttttctctgttacttaaatatttgagtagcgggttaatatttgatgtgtgggggcaacttacacgcctctgtttatctgaaaggaatcagagtgaaaaatgacagatccaaacttctatgcgtacatgcacgtttatgtcctgaaagtgaaattgcaatctttcgatacccacgtttgacat

SEQ ID NO: 17256 - DNA, 1459 bp, Zea mays
tccccattgggtacctcgaggccggccgggattggtttcgccaaaaacctcaccggctccattcgaccattccatcctttccttatcccctcccacttcgtctcccttcctggcttcctttcttcgccatggcaaccatgtccctccgctccctcgccatggccatggccgacaccgcgctcccgcccgcccacaagctcctccccacagtttccctcccgctcctctcctcgtccacccgcgccgcgccgctcctcctcttcgccaggcgccgcctgccgctcgcgcccctcgttacctcctccgacgccgttgaggccaagtcggcagacgaggaggaggagaaggccggagagcccgtcgacatggaagctggggagtttgaggaggtgctagcctcaggcggcgagggtgaggggcagtacgctgcggtggagccgccagaggaggccaaggtctacgttgggaaccttccctacgacgtcgacagcgagggactcgcgcagatcttcgaccaggccggcgtcgtcgaggtcgccgaggttatctacaacagagaaactggccagagccgtgggtttggctttgttaccatgagcactgttgaggaagctgacaaagccattgagatgttcaaccgctatgatattagcgggaggcttctgaatgtaaacagggcatcttctaggggcactcgcatggaaagacctcagagacaatttgcaccagctttcagagcttatgttggcaacttgccatggcaagttgatgactctaggctggtgcagttgttcagcgagcatggagaagttgttgatgctaaggttgtctacgacagagaaactgggcgctcacgaggattcggttttgtatcaatggtgtcaaaggaggaactcaatgatgctatttcggccctagatggacaggaattggacggccgccctcttcgagtgaatgttgcagcagagcggccacagaggggcttttgatgcggttgtatgagagagatgactgcttgtttgtaatgagcatggagacacagagacacaatggactgaatggaggagcaatggtacaaattagcggaagcggatgctgtcacaagttgctagatctttctcccttagcttcttgacatttggttcttgccacagctttttgatgcttctcttggcagctggacttaatgttttgctattcttgtcgacatcacgagttgaattgtcaaactagtctcttatgttctatgctgatatgccttaaccaaaaaaaaaaaaaaaaaaaatgttttgttggtgaaattaggggtggaaaaaaagccccaggcgcgagccaagccgagtttgtttttcgagctcgtcgaatgagcgagccgagccgttcaggcttgctaggcttgcgcccggctcgcgagctgtaccaaattaattaatttataaaataacaatggatattgaat

SEQ ID NO: 17257 - DNA, 1553 bp, Zea mays
cattgggtccctcggggcctcgaggccgggccggggacttcgccaaaaacgaaaaacctcaccggctccattccaatccatcttttccttatcccctctccctcccttcgttcgccatggcaaccgtgttcctccgttccctcgccatggccatggccgacaccgcgctcccgcccacccacaagctcctccctacggtttccctgccgctcctcccctcgtccacccgcgccgcgccgctcctcctctgcgccagccgccgcctgccgcccgcgcccctcgttgcctcctccgacgccgtcgagacgagcattgaatgggttgacgacgaggaggaggaggctggagaagccttcgacgaggagggtgaggatgttgaggaggaggtgctggcctcaggcgacgagggggaaggggagtacgccgcggtggagccgcccgaggaggcaaaggtctacgttgggaacctcccctacgacatcgaaagcgagggactcgcgcagctcttcgaccaggccggcgtcgtcgaggtcgccgaggttatttacaacaaagagactggccagagccgtgggtttggctttgttaccatgagcactattgaggaagctgataaagccattgagatgttcaaccgctatgacattagtgggaggcttctgaatgtaaacagggcatctcctaggggcactcgcatggaaaggcctccgagacaatttgcgcctgctttcagagcttatgttggcaacttgccatggcaagctgatgactctaggctggtgcaattgttcagcgagtacggagaagtcgttaatgctgcggttgtctatgatagagaaaccgggcgctcacgaggattcggttttgtaacgatggtgtcgaaggaggaactcgacgacgctatctctgccctggatggacaggaattggacggccgccctcttcgggtgaacgttgcagcagagcgaccacagaggggcttttgatgcggcggtacgagagagatggctgcttgtttgtgatgagagcacggagacacaacgcaggaggaacggtacaaattagcggaagctgatgctgtcacaagttgctagatccctcccttagcttcctgattttggttcttgtcgacatcatcatgagttaaattatccaagtaggcttctatgtttgatctatcccgattcccgatgccttatcaatttatcatcgtggcaaatgttttgttggtaaaaccataggagcaaacggagattatttatatctgacgtataaaaccgtacccagtgtgttgcatttaacattcatctctccttgacacttcgacggtgtattggtcaaccagttctcgcttcagtctggaagcgttcccaattaggtcatgttccgttttcacggattggaggcttgaaacaatttctagccagcatttatataagttttaatgacttggaacaaattctggtcgaatcctggagaaacgaatgtatcggaatgagaccaagaactatttcagctcaaataaacatatcattccaaaaaaaaaaaaaaaa

SEQ ID NO: 17258 - DNA, 1371 bp, Zea mays
ggtaccccccgctccggccggaccccaacacgccatcctttccttatcccctcccgcttcgtctcccttcctggcttcctttcttcgccatggcaaccatgtccctccgctgcctcgccatggccatggccgacaccgcgctcccgcccgcccacaagctcctccccacagtttccctcccgctcctctcctcgtccacccgcgccgcgccgctcctcctcttcgccaggcgccgcctgccgctcgcgcccctcgttacctcctccgacgccgttgaggccaagtcggcagacgaggaggaggagaaggccggagagcccgtcgaaatggaagctggggagtttgaggaggtgctagcctcaggcggcgagggtgaggggcagtacgccgcggtggagccgccagaggaggccaaggtctacgttgggaaccttccctacgacgtcgacagcgagggactcgcgcagatcttcgaccaggccggcgtcgtcgaggtcgccgaggttatctacaacagagaaactggccagagccgtgggtttggttttgttaccatgagcactgttgaggaagctgacaaagccattgagatgttcagccgctatgatattagcgggaggcttctgaatgtaaacagggcatcttctaggggcactcgcatggaaagacctcagagacaatttgcaccagctttcagagcttatgttggcaacttgccatggcaagttgatgactctaggctggtgcagttgttcagcgagcatggagaagttgttgatgctaaggttgtctacgacagagaaactgggcgctcacgaggattcggttttgtatcaatggtgtcaaaggaggaactcaatgatgctatttcggccctagatggacaggaattggacggccgccctcttcgagtgaatgttgcagcagagcggccacagaggggcttttgatgcggttgtatgagagagatgactgtttgtttgtaatgagcatggagacacagagacacaatggaggagcaatggtacaaattagcggaagcggatgctgtcacaagttgctagatctttctcccttagcttcctgacatttggttcttgccacagctttttgatgcttctcttggcagctggacttaatggtttgctattcttgtcgacatcacgagttgaattgtcaaactagtctcttatgttctatgctgatttgccttaaccaaaaaaaaaaaaaaaaaaaaaagaagtggggcccggtttaggggtggaaaaaaagttcgaggcgcgagccaagccgagtttgtttttcgagctcgtcgaatgagcgagccgagccgttcaggcttgctaggcttgcgcccggctcgcgagctgt

SEQ ID NO: 17259 - DNA, 1793 bp, Zea mays
tactaataaactatggagtacgaatacctctatagcctatacggacagcggagcaggcagccgccaaagacgacccagatgatgtgatcaaagtcgcggtccacgcgtgccacttgctagttgccacagccccgaccgcgacgccggcctccaggccaggactccatggtctagctgtagttggaagttggaacagctcggtgccggtgggcattttcaaccatcgtttgctttgcttcacagttcacactcgccctgttctagggttattatcaacccagttcatccatcaccgaccggcgtcaccacttgccagtcacctcaccaccatgaagaatccttggctcctattcctcgcccccctcctcttagccgtgccgtcatcgctgcctcgtaccgccgccgtgccgctgcgtttccctgccgcagggcggtcgcctgtccagtgcatcggcgacggcgtctacgctgctaacagcacctaccaagccaacctccgccgcgtcgccgccctcctcctagccgaggtgtccgcctcccccggccagttttactacacgacccatgccgtcgggtactggcctaaccggttgctcgccagctccttatgccggcgccgcgacgtcaacggcacccacgttggctacccctgcgccgactgcatcgccggggccttcctcgaaatggagagagcgtgcccgtaccgcagggaggccttctatatcgatcgcaactgcagtgtcgaacttgccgagattcgcatcttcgggactggcggcatcttccaacggaacatactgatacaagccatggcttcgggattggtacttcaagcaattggatttgcttggcttttcttcttgctatttcaagaatggcgcagccggaaaagaggcaacttgatgcattccacccctcttttatctggagatgagaatgttggcagcatgtctaccaaggcgtaacggcaaatgttgcgtgaagggatcggattttctctcatcaagggaataaagattaaagaatgaatacttgctctccaaattgcaggccttcaattcggtcgtttaatttcaagccagctgaaatgttcattgttttcacacattcttatgttttcattggaatttcattcccacttgtcctgttcctagcttgaaatgtacatgtgaatacaaaaaaaaaaaaaccaaaacttgccacgattgggcagtcggcactgaaaaaaaaaaaaaaaaaaactcgacgtatatacgtaagaacgtaacctactaaaatgactacttgttctcaattgcaagatcaaaacagaattacaacctttacccctttattttacccttgagacatatttgaagcattatgagtgtgtgccagaagacgatcgagttatgtgtggtcaatgtcgtggccggccggctccactgtcctgaggtcagtcgtcaaagtcctccaccagagtgagtgaccaaacggggagttggttttgaagctctactgagtactgactaggtgccaacgacgcggctggtctgatgacggcctgcgtctggtcgcgctcgaaaatcctcgcgaggccgaagtcagaaatcttgggcctcatcttggcgtccagtaggatgttgctggctttgagatcacggtggacgaccttgagctggatgggggagtcttcgtgcagctaggtggtactgcagttcttcttcgggagggaaccgtacgagtacgaccggtctggtttggttggtgtcgcagcagaggaagaggatataatctacattctgtagcagggg

SEQ ID NO: 17260 - DNA, 3044 bp, Zea mays
gtgtaaaatcgcctctacctacagctacaacatttagtgatctgtccgctccaaccgcgaagaacgacaaggaagcagtctctgtagccacacctcggatatgttctctgatggatgttgtgtccatgcattcagagtgaagcagtcatacaccttgaatgtttcacttctgattgctaaatcttaacatccaagtcaacaaaaaatgttctagttctaactaggatcgtgtatttggaactcatccaccgaaaaacaaaagtactaacatgcgtatgttatgttgatagttagaagactcatgtacttactgagttttaaacgaatttgatgtacattgaaaaacatgagcggtaaaaaaaaaagataaaagtaaatggcatccaatttggcgcggcgtgttcttgatgatacgaaggacagccgatcgagctttacccttatatatatagaatatttctgaaaattgttttgccaaaaaggaggcccatccacgagactagctagctctgtttccgctctgcgcggcgtcccggccgacgacgacacgatgcctctctcggcagcttcttccatcctcctcctccatgccctgatctccctcacccttctcctcggcgacatgacgagcacgacacctgccgccgctgtcccggccgcggtggacgtgaacacgacggcgttcaccatgcatgactctgctgcgtcggcgtctccccatggtgccgaaaaccttgagatgtactactgcttcctctgcacggagcgccacccgctgctgattcactactgccccatctactgggacgagtgccacctcaactgttgggatggtgacacgccgacctccatggacacggtgcagggcaaggagtgctacgtcatgaagctgtacatgtccggtcgctacgtcatcgtccaacgcctgagctgcgacggcgtcgcctcgtgcttcctcacctgcggcggcggggagctggccgacaaagttgctgccggtgccatgggaaccacggcgtcggcgagcgcggtccagctccaggggaacgctctgcctttcgagctgtgcggcacacagcaggtcaaggctctcctccaccattagttagcaggagtgttagcactcacatgaaggaactcacgatctaggatttgcgatgtgggcagatgttatccaagtcttgttccgatttgttcaacagccaaatttgttcaacttgcgatgtaagtctcgagacattgattcactcattcagtatgtccatccgattgagtatgataggcactgctgagacacaattgtgaagctctttgacattggttggtattgtccactcttgaacagtctgacctttgcgagggtcaatagcatgcaatgcccttggcactaattacatggctgagaaactccatcttgttttgtgcaaacatgcacttggactgtttgaggttcaattggtggtggttaagcaattcaaagacaactttcaggtgttggatatgcagctccatagtaggactgtagacaagtacaccatccatagtatgattcataaattcctggaatgtggtcggggctcctgttaatccaaaaggcatcacttggtacttaaagtggccatcgctcctgtcttcacctgcagcctggtgtgatgatactcatggtggggatctagatcagttttgaataccaaatgttagttagcacgctcataggaaggaactgggatttgcgatgtaggcaggtgttattcctttctgtttaagtatgttcgggtttgttcaacaaccaaaagccaaagccaaaattacacgatagatgacttcatgttcttctcatcttcaggttccaggtgttccctccttcatgcttgtaaagctgtagcgcgtccagcaagctgtgactgcagtgttgctgacaaggagctcatttgcatctcaagcaatcacctacggtacttacatgcgatacgtatgctagctgccggttaggagaatcatgcacgtatcgtttcctttcctcctttatttatttatactagttagtaatttagatttattgcgctgctggattccttaatttctgagcaccaaaccaaccaagccaatcttacgactgccttgcctttggcatgtctctaatttcgacagcttcgatactcctcctccacgcctgctccctgctcgccgccgcaagagtccccgacccggtagaacatggcgacgtgaacacggcgatgcttaccaacggctcggcctcggcgacgccgtcgtcccctgacagcagcagcaacggcaacttcgagacgtacttctgcttcctctgctcgggccgcgacccgctgctcattcaccactgccccatctactgggacgagtgccacctcatctgcgacgatgacatgtccaccgccactcctactccacctgctgttgcagtgtcgtcgtcgtcgtcgtcccgccccgtccccatggtgcaggtgcagggcgatgatgactgctacgtcatgaagctctacatgtccggccgctacgtcatcgtcgaacaccggccatgcaaatacatcgcctggtgcttcctcacctgcggcggcggggagctggcggcggccgaccggaaagccgtcacggccactgcgatccaggggacctctctgcctgccgagctatgcggcacgcaggtggtcaatgctccaccatctgctgccgctggtggtgcgcaccgacggcgctagctgcctacttatccgcgaactaagggttagttttacacataaaacctgagaggattcaagggattaaaatctgtttcttattccaaaaaaaaattaaccactcgaatactctcttattttctgactcccaaactagtcctaatattgtttggttgtgtttttccttcctatctaattaatatgtttgcttcagcaaccaaattaaaggactaacagatgccaaactgaaaccatccatctctacaagataactaatattttgatttcccaactttatatgctcaaaacagattatcaacttagagcttg

SEQ ID NO: 17261 - DNA, 782 bp, Zea mays
ggaacaggcttgctagctgcatgatagcttctggggcgacgatggcagtttctcagttcatgatcttagatcaattcaggactcgttggtagcacattttgagtaccacaagaaagcaattacatccatcgagtggagcccacacgaagcatcatcattagctgtaacatctgaagaccaccagctcacaatctgggacctttcattggaacgggacaccgaggaggaggctgagttcagagcgaagatgaaagagcaggcaaacgcccctgacgatttgccgcctcagcttctctttgctcatcagggtcagagagacttgaaagaagtgcactggcacccacagataccgtcgatgatcatatcgacggcaatcgacggcttcaacgtgttgatgcctagcaacatcgatacaaccattcctggcagcacagatacagcaatgccgcctgctgagccataggttaggtgtttctggtagctcatgattccaggttcatgcggtggtgagtgtagttgccatttgtcatgtgtcgacagtgctatgctgtcgtgttggagcatgatgggaaaattttgattggctggcgttctatgataatatgattaggatttaatatgtgcatgctttttttagttttaccagcatctttgatggttgtgggccccatcatatgtcaaattatcaaccgatgttttcgttgcaaaaaaaaaaaaaaaaaaaaaaaaaaaaaaaaaaaaaaaaaaaaaaaaaaaaaaaaaaaaaaaaaaaaaaaaaaaaa

SEQ ID NO: 17262 - DNA, 1902 bp, Zea mays
tgcatgcatgctctactgttcatggctacgagcagttattgcgctggcaacttggcactgcccccgatctccctcaccgtcaccggcccatcacctaccagctgctgcttgccattaacattaacccctccgcacgagaccattacctagaacatcctaatcgaaaaatcgaccatcgagctagatcatatcgatcgccatatatatagtagggagcggctcgcagggcaagaacgaagcagatggcggtgatgagccgccgccgcgtcatccagctcgtcctcgttggcgtcgtcgtcttcctggtggccccgcggctgtcgtggaaccttccgggcggcctcgagaagctggggctgcagcagagcccggcggcggtggcggtggcctgctgggcggctgcggtggcggcgtgggcgtacgcggtgtcccggccccggcccgtgtacctggtggacctgtccgggtacgtggcgggcgcgtcgcacgaggcgtcccgcgccaagacgatcgcccacttcgggcggtgcgggcggttcagcgacgagagcatggcgttccagaagcggatgctggagcggtcggggctcggggagcagacccacttcccggcgtcgctgatcagcgtgcccgtggacatgtgcctccgcacggcgcgggaggagtcccacgccgtcatcttcggcgtcgtggacgacctcctccgcagggcgcgcgtggcgggcggcgacgtcggcgtgctcatcttcaactccagcctgctcagccccacgccgtccttcacgtcgctcatcgccaaccgctacgggatgcggcgcgacgtcgtcagccacaacctcagcggaatgggatgcagcgccggcatcatcgccatcgacctcgccaagcgcctgctccaggtgcactcggacacgtacgcgctggtggtgagcacggagaacatcactctcaacgcctacatgggcaacaaccgccccatgctggtcaccaacacgctcttccgcgtcggcggcgcggccatcctgctgtccaaccgccgcgccgaccgccgccgcgccaagtaccagctcatccacacggtgcgcacgcaccgcggcgcgcacgaccagagcttcggctgcgtcacgcaggaggaggacgacgcggggtgcgtcggcgtctccctggccaaggagctcatggtggtcgccggcgaggccctgcgcaccaacatcaccacgctgggcccgctcgtcctgcccatgtccgagcagctccgcttcctggccaccgtcgtcctcaaccgcgtcttccgcgccagagtgcgcgcctacctgccggacttcaagctcgccttcgaccacttctgcatccacgccggcggccgcggcgtgctggacgagctggagcgcagcctcaacctcagcgcctggcacatggagccctccaggatgacgctctgccgcttcggcaacacctccagcagctcgctctggtacgagctcgcctactgcgaggccaagggacggatccgcaagggggaccgggtatggcagatcgctttcggctccggcttcaagtgcaacagcgccgtctggaaggcgctccgcacggtggacggcggcgaggagggaaacccgtggacgccggagatagacgtgctccccatccacgtgcccaaggtttcgcccatcgatgagaccacctacaagttcgctgacggcgccacgtacaagatctctcttggttaaaatatattactactattgttattattattattattattacatgattgatttctcatcatcagcatgtaacctaatcaagataatttaagaagcagcagcgcgccgttattaaaaaaaaaaaaaaaaaaaaaagaaaaaaaaaaaaaaaaaaaaattaaaaaaaaaaaaaaaa

SEQ ID NO: 17263 - DNA, 691 bp, Zea mays
  misc_feature (604)..(604): n is a, c, g, or t
  misc_feature (609)..(610): n is a, c, g, or t
  misc_feature (614)..(614): n is a, c, g, or t
  misc_feature (632)..(635): n is a, c, g, or t
  misc_feature (640)..(640): n is a, c, g, or t
  misc_feature (644)..(645): n is a, c, g, or t
  misc_feature (649)..(649): n is a, c, g, or t
  misc_feature (651)..(651): n is a, c, g, or t
  misc_feature (689)..(689): n is a, c, g, or t
cctcaacgaccatcgagtgccattggagtggctccattgcttggcaagctagctagtctcctgtcctgtcctgtcctgtccttccttggcaacaatatatagaatggtgggtagggagcagatctgtgcgacgacgcaggcgcccaacaaggtggcgatgagccgccaggttttccatgtcctcctccttgccgccgtcgtccttttggtcccgctgctatccgcgaaggagaagctgctggggctgagcccggctgcggtggcggtggcctgctgggcgggcgcggtggcggcgtgggcgtacgcggtgtcccgcccccgccccgtctacctggtggagctgtccgggtacgtgggcgggccttcgcacgaggcctcccgcgccaagacgatcgcccacttcgggcggtgcgggcggttcagcgacgagagcatggcgttccagaagcggatgctggagcggtcggggctcggggagcagacccacttcccggcgtcgctcatcagcgtgcccgtggacatgtgcctccgcacggcgcgggaggagtcgcacgccgtcatcttcggcgtcgtggaacgagctcctccgccgggcgcgccgggnggccnncgangtcggcgtgctcatcttnnnntccancctnntcancnccacgccgtccttcacgtcgctcatcgccaaccgatangg

SEQ ID NO: 17264 - DNA, 850 bp, Zea mays
  misc_feature (806)..(806): n is a, c, g, or t
cattgggtccctcgaggccggccgggccccgcaacgtcgtgcaaggtcacactagcaataatgcctaataacggcgtccgcgccgtggcgacgcccgtcgcgcgagaagagccgctcctacggcgggaagacgacgcagcaccgccgaaggccgccggtggcgatgggcagccgctcgacgcgggcgcccgtgacgccggcagcttcccgtggctgccagccgcgggcgtcgtgtacctcacgctcagctccgcgatggccctgcaccgctgctggcccgaccccggcgacgtcgcgttcgtcgtgtcggcgtacgtcgacctcgtcctgctcttctgctgcctccggaggtacgagcgcgcggagcctgggtcgccgctcagggagcggctcaagctggcggtgtggctgctcacgtccgcgctgacgctcctcttctcctataaggtcgccgccgtcatgccggccgccgttgctgccatcgtctggctcatgggcctcaccaccatctgcggtggcttcctcgctttcttctgcttccagaagaaggcgtgactttcgctctatggacagagataaaaaaaatgtcggaggttgacgatggacaagattaccgggttatcaaatttttttagtgataagcaattttttggcacaaatttaaagaaataactcagtttgtctagaatataattgtatctagacatttaagaaatgaaaacaacacatgagtcagccaaacgaggaatggaggaaagaaattagtgtaaaagaaaaaaagaaaaaaaaaaaaaaaaaagcggccntaaatcatatttaataagttgctaaatagctacgggagtaaaaa

SEQ ID NO: 17265 - DNA, 3261 bp, Zea mays
  misc_feature (1014)..(1014): n is a, c, g, or t
gttgaagctgttcacccccgttatttaccttctggctggaatattaaccacaggttgtttgcctttcatatatatcttctcttgtgcgctatgcatgctgattagttgcataattgcctgaacttcctggtgcttagaattggccaagctgtagcgaatatcgaagttatagccatgtaccagtgaccttaaaagatctttctatttgtcgtaatgtctttttgtccagatttcctttcatcaccagatatttactgttatctgtatgacctcttgtgtggttcagtggacggcgggattttggtgacttcagtgtctacaagccaccaaggaaagatcctcaatctgcaactgcaagggattaggcttacgcgggtgtcatgctgtcgttggtaccctgaggttcaacttactttccagaattggttccattcccttaaacttgatcttgttgtacttgttccattcccttaaacctgatattgttgtacttgtatgtatctcaatctgtgtgtttgttcgagtaccttgaaataccaatttcatctcctatgtatttccgggcgcggggctttgcatcagttttgctgagccgtttttttatacgtgaggatttagagtactaacaatttaagtccaagaaaaatcaacagtgaagttcaactcagcagattaaatcttcaaagtgccgtttttaactgggagttgagctcaaattggtttcttcgggacaggcttgaaacttgttgcgtttggaacacagaaactattcaggatttcactggaaacgatttgattcctgtagagatgggccaaagctcctccaaattgtgatcgtagggagtatctgctattttaccgtgggatatcctgggcaggatcccagtttccccagagcattattttgttttccattcctgacaagcaaaaatggactgcggagagcgtcatattgcaaagcggtgcagccagctcggcagatccacatgatcctccccatctcgccatcactgnccctccaccactccagtggcccattgggtacctcgagggccgggccgggaaaacccaatccatccaaacccatttccctcgctcccatcccgtcccgccccttgtctcttccgcttccgcccgaccccgcgcgccgcggaccagcagccatgtcgtgctcccacctctccaccgcctggtcctcctcggcgctcgccagcagcgcctccaccacccgtcggcgctcccccccgcgctcgggtctcctggtgcggtgttccctccgtgagctccgcacccgcatcgactccgtcaggaacacgcagaagatcacggaggccatgaagctggtggccgccgccaaggtccggcgcgcgcaggaggccgtcgtctcctctcgccctttctcggaggcgctggtggaggtgctctacaacatgaaccaggagatccagacggaggacatcgacctgcccctcacccgcacccgccccgtcaagaaggtggccctcgtggtcctgaccggcgagcgcggcctctgcgggagcttcaacaacaacgtgctcaagaaggcggaaacccgcatcgatgagctcaagcagctgggcctccagtacaccgtcgtcagcgtggggaagaagggcaacgcctacttccagcgccgcccctacatcccgttggagcgcgatctggaggtgagcagcgtgcccaccgtcaaggactcgcaggccatctgcgacctcgtctactcgctcttcgtctccgaggaggtggacaaggtggagctgctctactccaagttcgtgtcgctggtgcgctccgaccccatcatccagacgctgctccccatgtcgcccaagggcgagatctgcgacgtcaacggcgtctgcgtggacgccacggaggacgagctcttccgcctcaccaccaaggaggggaagctcaccgtggagcgcgagaaggtgaagatcgagacgcagcccttctcccccgtggtgcagttcgagcaggaccccgtgcagatcctggacgcgctgctcccgctctacctcaacagccagatcctccgtgccctgcaggagtcgctcgccagcgagctcgccgcccggatgagcgccatgagcagcgccaccgacaacgccatcgagctccgcaagaacctctccatcgcctacaaccgacagcgccaggccaagatcaccggggagatcctcgagatcgtcgccggtgccgacgccctcgctggctgagcctgagtccccttggtggtgcggtgctcctgctatatataattctttttcctcattttctccactctgcctgtaattcctgataatagcacaaacgcaacggagttctgtgttccttgcgacacacaagaatttcaatccagagatgccaaaatgtataatcttgccgcaactgagacgtcgaagctcagtgtatttttatgcccaagtcttccaaatgtttggcacgaatcagataaaaaaaaaacatcctgcggcatgcaccaaacaccctacctagtacatgagtaaaggtgcaatagcaactaagacgaggctgttttgaacacacaaatctcaaagcaggcccccagggccgctttttcatgcaaaatttatcaaacttctgtgttctttttttttataaaaaaacattgttaagagaagaaacatataatgctgcagttgaatcacgtcacttcctcagaatcatcaggccggtaggggatgaaggtaaactatatatgacaccatgataacaacgccggctcatatcttggtctcatcagttatcacaatcctgtcctgtggatggatggagcatattggaatcaagcttgctatggcgacgtaatacagtgacaagcgtggtaacactgtaactcttcactattataaagtagatgtgtttaatgtaacggttgatcaacaactaattgagttagatgatcgttttagctttgcgatagagcttttatcgctctgctgtttctttgaatccaagaacagacacttttgatatatcaaagttacaccactgatttttcaatcaagaaagttccaattaaaacgccaacttccacattatcagcttggtgtatacatcacctagagctaaatacattaccatcactcgctgatgaaaggactcattaaattgggtaaaagttctacggattaatagattattaagattaatggtagtccctcttgcctaacttgcaaccactaagatagtgttttcaactacaaaaattgt

SEQ ID NO: 17266 - DNA, 871 bp, Zea mays
aaaacccaatccatccaaacccatttccctcgctcccatcccgtcccgccccttgtctcttccgcttccccccgaccccgcgcgccgcggaccagcagccatgtcgtgctcccacctctccaccgcctggtcctcctcggcgctcgccagcagcgcctccaccacccgacggcgctcccccccgcgctcgggtctcctggtgcggtgttccctccgtgagctccgcacccgcatcgactccgtcaggaacacgcagaagatcacggaggccatgaagctggtggccgccgccaaggtccggcgcgcgcaggaggccgtcgtctcctctcgccctttctcggaggcgctggtggaggtgctctacaacatgaaccaggagatccagacggaggacatcgacctgcccctcacccgcacccgccccgtcaagaaggtggccctcgtggtcctgaccggcgagcgcggcctctgcgggagcttcaacaacaacgtgctcaagaaggcggaaacccgcatcgatgagctcaagcagctgggcctccagtacaccgtcgtcagcgtggggaagaagggcaacgcctacttccagcgccgcccctacatcccgttggagcgcgatctcgaggactgccactggctcaacatcgctgcccggcctgatggcctcatgtgtggcaagcacgcctagttatagtatctgtggaagaaatgggactcacgtatatatgtgtgtgtgtatatagtgcggtgatgccatcttgtttgcttgcatatgcatactactgaacatacgatgatgaataaggtcatgccaactttagggcaaaaaaataaacatacttatgatgacgctttacatttaaaaaaaaaa

SEQ ID NO: 17267 - DNA, 1398 bp, Zea mays
gaggttcggccgagaggatgaagataacgagttctatcggctgggcaagaaaatatttgtgtgggccgtggagaaaagagccattatattagatacagaataataccgtcatgctacaggatgcattttccagaacatttaaagagccatcgttcacatgatattgtgcttctttgtgtagactgtcatgaaatagctcattcagcagctgagaaatacaagaggcgaatagcagaagaatttggaatacccctttttgtgcaaaagataatgaactcgggtgatataagtttgattaccaacacatcagtatctgaagataaattgaatggaacaggtgtctccccattgcagctgaggactgctgccatggctcttctacgtcatggatccactatgccattgaagagatgtgaagagctaatgcagattgtgaagtcatactatggtggtagagatgtgactcctgaagatctcgagatggcattacttgttggtatgagccctcatgagcgaaggcgtcttgaaaagaaaaagggatattcgtttagagctcaggctcaaactattattagaaagagcagcagcaataccatctcagaagacagtggacatggatcagaaaattgtcatgccttatctgcgcgatttcctgaggttggaactggtagtaatggtcagcaagagtttgatgagacagggaatcaaaaccagctagagaatttaaccctgagccagggaagctcaagtttgccagtcagcatggaggacaccacttctgatcatgacactgtgacactcgagaccgataccgagcagcaagcaagaggtgcctgtactcctggaaacagtcatgacgacaaggaacaatccatatgtgacaattctagtcaggtcatttccaagaatgctgagaagatatccctgttgggtcatgggcatcatggtaaacaagttgtggaacttttgttttctaatggtggagaggaatttgttaaccagttttgccaaaggtggaggcagatctttgttgaagctgttcacccccgttatttaccttctggctggaatattaaccacagtggacggcgggattttggtgacttcagtgtctacaagccaccaaggaaagatcctcaatctgcaactgcaagggattaggcttacgcgggtgtcatgctgtcgttggtaccctgaggttcaacttactttccagaattggttccattcccttaaacttgatcttgttgtacttgttccattcccttaaacctgatattgttgtacttgtatgtatctcaatctgtgtgtttgttcgagtaccttgaaataccaatttcatctcctatgtatttctttgagatgaactttgcatcaaaaaaaaaaaaaaaatttttt

SEQ ID NO: 17268 - DNA, 961 bp, Zea mays
aaccgcagctgaagctgctggccatgtgggcgagcccgtttgccctacgggcgaagctagcgctcaacttcaagggcctggcctacgagtacgtagaggaggacctccgcagcaagagcgacctcctgctgagctcgaacccggtgcacaagaaggtgcccgtcctcatccacaacggcgtgcccgtctgtgagtcgcgggtcatcgtggagtacctcgacgaagtctacagcgccacgggcccccgcttcctccctgccgacccatacgagcgtgccatggcgcgcttctgggcctcattcatcgacgaaaagttcttggcgtcgtggctaaaggcaggaaggggcaagacggacgaggagaaggccgaagggttgaagctgacactcgcggccgtagaaaccttggaaggggcgttcatggagtgctccaaggggaagcccttctttggaggctatagcgtcggctacctggacatcgcgctcggggccctggtagcgtggatgcgcgccgccgaggcgcgtcatggtctcaggctcttcgacgcctccaggagtccgctgctggagaagtgggtggagcgcttcagcgagctggacgaggtcgtggcggtcatgccggacatcgaccggctagtagagctcggcaaggtgagggaggctgctgcggctgcagcagctgccgtaaacagctgaacggaacgcatctcgcggtattgaggcggtcaataagtcggagaaagatcttgatacctgtgtgtaacaagcgaatggtgtaataaagaatacaattagggtgtcgtttagttcacatgtcggtaacgtaatggataaccgataacattaaatcatgtttgttataagtccaatcgtaatcgatctcatactacaaaaaaaaaaaaaaaaaaaaaaaaaaaaaaaaaaaaaaaaaaaaaaaaaaaaaaaaaaaaaaaaaaaaaaaa

SEQ ID NO: 17269 - DNA, 1823 bp, Zea mays
ggtaccggtccggaattcccgggtcgacccacgcgtccgcatgaccccatttcatttctctacctctccagctgcccacttctctgtgagcgcgcgcgagtgtggagagaagggagggaattcccccctttctgttcggcgcacgcacccgcacgccccacgctgcacagtgcacgccgccttttcctccgccttgctgctgcgagtccgcaaccactggaggaaaaatcttttccttcacttttcttccctttccccccgcgcatgcacgggctctgattgacgccatgggggacgccgcggcctccacgtccgctcccaccacgcccacctccatcctcatctgcctggaagacggcagcgaccttctcgccgatgccgacgatggcgccggcactgacctcgttgtcgcccgcgacgaacgtctgcttgtcgtggaccaggacgaggagtatgtagcgctgctcctgtccaaggagagcgcgtcaggcggcggcggcccggtggaggaaatggaggactggatgaaggccgcgcgctccggatgcgtccgctggatcatcaagaccacggcgatgttccggttcggcgggaagaccgcttacgtcgcggtgaattacctcgatcgcttcctggcgcaacggcgagtcaatagggagcatgcgtggggtctgcagctgctcatggtggcgtgcatgtcgctggcgaccaagctggaggagcaccacgctccgcggctgtcggagttgccgctggacgcgtgcgagttcgcgttcgaccgcgcgtccgtgctgcggatggagctcctcgtcctgggcaccctcgagtggcggatggtcgccgtcacccccttcccctacatcagctgcttcgcggcgcggttccggcaggacgagcgccgggcggtcctcgtgcgcgccgtggagtgcgtcttcgcggcgatcagagcgatgagctcggtggagtaccagccgtcgaccatcgccgtagcatccatcctcgtcgctcgcggcagggagacgcccgccggcaatctggacgcgctcaaggcgatcctgggctcatcatttccgcagctagacaccgggcatgtgtactcctgctacagcgcaatgattcgggaggacgacaagtcgccgacgcagtcgacgtcgacgtcgacgggggtggcgtcctcgggcgtctctgtcgccgcgcacgccggggggagcgggagtcccagccccccgggcgcttccgtgtccgtgggcgccaataatgccgctggcaccgccccgccggcaaccacggacaaccgcaacaagaggagacggttgcgctcacctcagcgacagtaggagcagctcagctgctggcagtgcattgcagtgcagtgcagtccagctgcgttttcttttttcagctcaccatttccttttgctgccgattgtttcttcaggggtggccgtagagtgatttggtaatttagtgccggaaagattagtgcggtgtcgcagagtgatttggtaatttagtgccggaaagatttctttgttttgaggagatctttcgcgggaccaaagggaggggggcagtgtaaagacgacagaacaagcgtgaaggcctcgagagtcgagacctcacagggtaccgcctagcgcctactggggtgaaagtgaagtcaaggagtcgggagggtgtgtgtgaataccgtttgtagcagctagtgcgtccgtctgtcttttttttttctttctgtttattaattattaatagcctgctcgatttcaaaaaaaaaaaaaaaaaactagagggggggcccgccgccctagaggatccaagct

SEQ ID NO: 17270 - DNA, 1852 bp, Zea mays
  misc_feature (11)..(11): n is a, c, g, or t
  misc_feature (17)..(17): n is a, c, g, or t
  misc_feature (28)..(28): n is a, c, g, or t
gggtacccctncgaggncccggccgagngagactccggccacagccgagacgagactagcagcagccgcttgctcagatcggcagcttcggcggcggcggagatggcgattcggtactggccgatggccggagcagccgttgggttccgcctcgtcctggttctcttcggcggggatctccaccttgcctctcgccctgaggtctccacccccctcacctcccttcgccgcctggcggaaggctactggctgaagcaagcgtccgtgtcaccgtactccggttctatgtatcacggttccccattgctcctgtctgttcttggtccattaactagtagcaggcctgacggacatcatgctcatatttactgcagtttgatttttgtggctgtagattttctagcagccatgctcatccgagcgactgggcatgaactcgaaatggcacggaacagaagtttgaagtcacttgacctcacaaaggcagtaaaggatacagttaatgtaagcgctggagatgttgcttctctcatatatttgtggaacccttgggcaatagtcacttgtgtgggatcatgtacatcaccaatcgagaatctaatggttgtaataatgatctacggatcctgttcacgtctggctcctcttgctgcttttggatatgttatggccacacacctctctctttatcctgcaattctcatagtaccggtcattctgttgctgggttatggtctagatgctcctcctccaaaagtatttgttataaaagggtcaattgccagaaaaagtgatgtgtcagacaatgataaaacaagcagacagagagttgttcagcagttttcatggaaaccagtacttcactttatattttggctgttcatctggtcgtgccatgtgttgttattgagcagcgtgattttgaagaaagttggtggcctccacgagatgtttgaaaagacgtatggttttatacttacagtgaaagacctatcaccaaatattggtgttttgtggtacttctttgctgaagttttcgacttctttagaaatttctttcttatggtattcaatatgaacatcatttttatggtcttaccattggccatccgattgaaacatcgtccgtgctttcttgcatttgtttacacggcaattgtggcaatattgaaatcttatccatcggctggagattcagccctgtatcttggtcttctgggcttatttgtcaacgaattagcagaaatgcagttcacattcttcttgttttttggatatattggagtctccctacttagccctgtcatgcataatctgtggatctggaggggcactggtaatgcaaatttctacttcgccactggtttggcttatacttgccttcagactgtgttgctggtagagagtgtaagttcaatgataaagcacgacagaaagttaaggctacttgttacaagctaatttggtcctcataatcagaagctcaagtggtggacagctccgatgcttgcaattccctacatggtgctcttgattcttgaacacaaacagctcctcatcttggagttcgtagatgtaggtcatattcgatgtagcatgttgtactgtagaccccacacttgtacaatactaggaccgcaactctttcaacaaagacaaggaacacggtagggctcgtccttggtgactagtacgtagttgtgttcgctaccgagaattgttgtggatcctggctgtgatgttcagtgatccagcttggttgaactgccctcacgtacatttaattccgtcagtctgatggatcaacaaggaaaccaacatttgaacgtttaaaataaaaaaaaaaaaaaaa

SEQ ID NO: 17271 - DNA, 3336 bp, Zea mays
  misc_feature (2844)..(2844): n is a, c, g, or t
gccaatgaaaatgctattttcattgacggttcttttatacctactgaccacttaacaagttggaaacatcaacccgccctaatgccttctagctagttggcgcggtagttaaaaccaagtcttattcaggaaccggtactgatgtacgtacccgtcctccagtgtggtgtttgttttctgatgaatgggatttgagattctttagagctcgcgctgttgtgtgatgaatcacgtacgttcccggcgagacttttcttgtgacgtgttttgcgcatcgttatattacttgtcgatcgctgggtaatgtgtttttgcgtgaacgtatatggtgagtgtgtcgccattcgtcaagtgttattaagttcctcgctcgttcacaccagggagagaggtcatgcatggtaaaagagctagggtaaaaggtctagtactagtagctaagcatagttatcaacgaaagggaagcgtttgtggcaactggtggcaacaatatacttcgcctttctattggcatcatgccattgcatgcccgaagtatattgctcaatgctgcctgctgctcgttgctgcccactgtgagctgagaaagcgagcagaacgagttgaccccaacaaatactattttaattagctcttgcttttcaacatgatctacgacgtgtgtggatgccgagatgtgatgtgctgcagaggctggacatgacaccttgaccaatcatggaagctaaggcccggattcgccctctctgtatctctgcccgcgcggaagccagattgaaatgcatgtactatacctactcgtaatgtttgcagtcaaactgcatgcatgaggaaaatggagacgatgatgtataatggagcaaggccatggacgctttcagtgcctcggtaacacgccctagagtccttttgcctctttacggaaggagctggagtgaggcagaagcaaaagccctctgcctgctcctgtgctgctgcgcgtgggcgtgggcgtgggcgtgggcgtggctgtggtttacagagtacactactcaatacccattcaacacaacagtgtgcatcgatgtcccctcccagccggccccggcccctacgattcacgcggccacaaagatttatttaccgcgcgcacatatatgtggcgaccatatctctctctttgtgctggctggctggcttcaggtgtcttgtcgtgaagaaaggtacctgcatgccttgcaaatgcctgtcacttagtcttgcccagaatggctggccttgttctgacggtatcttggccgtagcatcaattgcgcgccgcttctgctcgatcgatcgccatgcatgcagaacaaatgggctgctagctgcttttctttacaagctcttctctttaattttagtagatagatagatgcttctgcagcgcagggtgctatatatatagcagcagctagctgggtgtgctgcgtgcacatgcatgattcacttagacacaaagtgttattatctagctagtctggctcagctcctcgctacgtacaggaccacaccgccggccacgcgtacgccagcaatggagagcagtagagaccacggccgcggcctcaagccgctgccagcgtggacgacgacgacgacgccggcgggaacgggacacaggcttcagcctgggccgccggctgcttcccgtggccgccgcagaggtcgtcgccgccgccgtcggtgtcctgctacacctgcggctactgcagacgggagttcaggtcggcgcaggcgctgggcggccacatgaacgtccaccggagggacagggccaggctcaggcagtgctgctcggcgtcggcggcagcgcacccttctgcttcccttccgagccccgccctgaccgcgcgccaccagcacagcagagctccgattcccaacctcaacttctcgccgcagcactgcgccgccggcggctcgatggccgccgccgaccccgtcatctacagcttattctcgacgacgacgtcgtcgtccaccgctgtggcaacgaaggcggcagttgaggtgagcttggagctggggattggggtctgcggtagaagcagcggccgtggcggtggtgtcgtcgaggacgacgggctggatcttgagctcaggctcgggtgcgcatgggagtgatgactgatgactgatgaggcacacgtacgtagtgtgtcgtcgtaagtgtgaaccatgcatgcatgcaggtcggtgtagtgtagggttaaattaaatggtcgtcgtagctgtcattatgtgaaccttatttccttttattttattacacgtgtcctccctcgctagctctcgtccatgtatgaactatgtgcgcccccgcagcagcattgccacgactttgctaattgaagtaaaaaaaaactttataatgttagtgtggtttgtggctccaaaaaaaaaaaaaaaatttttatggagtgtctcaaatactcggcaaagtttttttacgctcagcaaagattttatcgagtgttacacttggtaaagaataatcgacaaatattttatcagcaattagttctttgctgagtattttttttctggcactcggcaaatattttgtcgagtgtcaaaaacactcgaaaaagtactcagcaaattaagaatcacaaaaaaaaacagcaaaacaattttttatatttaggggaacacccccaaccatcaccactgccctaccatcgtccttcattttcaccattcttttgaactgaattttgcgcgcaacctactcaaccactacaccactatatcacttgtgtctatattatgttttccttcctcatgtattataataaaccgagagtaaactgattatttgangcactaaagaaatttaaatgaaaatgttggcatctgtaaagttacatatcttttcaagatctacaactttcatattgatagtttcatccgaggtcatttacaaaatttgaatttaaaatttgaaaacttcaaacatatttttctatgacaagatgattttaaatcaaaaaaattatcaattaaaaagtttcataacatttcaagacttacaaacttttattttggtggtttttccatccgagattgtttgaaaaatttgaattttaaaattcaaacaaagttttgcatgacaagatgatttcaaacgaaaatgttgtcaattacaaagtttcataactttttaatacctataactttttcattttggtggtttttccatttgtggtcgttttgaaaatttgaattttaaatgtttaaaattcagaggtagtttttatagacaagatgactttaaccaaaaggttgccaactacaaaattccagaacttctta

SEQ ID NO: 17272 - DNA, 690 bp, Zea mays
tggagctcccaaactagccctaaaggtttccactcccagaagctccgttttttttgtctcttcctcacagatctgttatccatgtgggccacaggagcagggagagagatctgggtggagaaggtcctgggaggaccagatcgcagagctgaagaggaggagcgtggcgaaggattcagaagagaacctgtcgtggggcgctcgcatgcggagaagggccgaggcgtcagcagcggagtagctgcgacaagcgaccctgccaaatgcagctgtactcgtacgtagcatgtggagcgaagcgaaacggaatatattttctggtgggtacaatttggtctgcaaggtttttaaggcgtggatctaaagatgtccagatggaaaccttcagagacagacctgttacgagaattggacgtgtagctgtagtagctgtagcggtggcatctggccaggattgaggaacagcagcacctggatggagtgtggtggctgctggctgcagaccaacacccttggccctggctacataatagttgagttcctgcctggccacctgggcctggctggctgtatgtaaacgactcaactatgttactccttgagactcctgttacatctgtggcaggtccagtgtaaatgtaaatactacaagcatcaataacgaaggagcaagccagttgttcttccaat

SEQ ID NO: 17273 - DNA, 3298 bp, Zea mays
tttcatccgtttgaatatgaacaaaaacaaaagcctaaaccaaatagcatattaggatagagagtacccgttttaactcttaatttttatgttcatatttaaataaatgataataaatctaaacacattcttttttaataatggataactatatcggggatggagccaaaatctagacacgtgtatatgaatccattattttttaaagcaaaattaatttagaacagtattatatatataatatttattggcggttggcgcttaacatcggccgcccggaaaccgctcggagaaaccaaaccagcaagcgaagcccagcaagaaaaccacatgccccacctcgccgccactccccccacttcctccgccgccgccgtccccgccgcgggccgcatcgcgttccggcgcccgtggaacacgccacagccggaagcgctgcgcctgcgcctccgcctgcgcgcgcggggcgtccggcgtgaggacggcggcggcgtgcgcacggaggagcaggagcagacagcaccgcggacgttctacgacctgctcgggatctcagcggatgggagccccgatgatgttcgggcgtcctacaggcggctggcgctaaagtaccacccagacgtgtcccctccgggcgccgcggccgagaacacgcgccgcttcatcgaggtgcaggaggcctacgagacgctctccgacccaagccgccgctccagctacgaccgtgcactcgcccgcggcgtctgccgcctcgccttctccgggcgccgttcccaatcccaccacgcctactaccaccaccaggagcagggagagagatctgggtggagaaggtcctgggaggaccagatcgcagagctgaagaggaggagcgtggcgaaggattcagaagagaacctgtcgtggggcgctcgcatgcggagaagggccgaggcgtcagcagcggagtagctgcgacaagcgaccctgccaaatgcagctgtactcgtacgtagcatgtggagcgaagcgaaacggaatatattttctggtgggtacaatttggtctgcaaggtttttaaggcgtggatctaaagatgtccagatggaaaccttcagagacagacctgttacgagaattggacgtgtagcagtagtagctgtagcggtggcatctggccaggattgaggaggaacagcagcacctggatggagtgtggtggctgctggctgcagaccaacacccttggccctggctacataatagttgagttcctgcctggccacctgggcctggctggctgtatgtaaacgactcaactatgttactccttgagactcctgttacatctgtggcaggtccagtgtaaatgtaaatactacaagcatcaataacgaaggagcaagccagttgttcttccaaaaaaaaaaaaaaaaccggcctctcctttgttttcctttctcaagcatcaatattgaggttgtgggcttatgcgggagaggcaattattcatatctttaggagcatgacctttgcttaggctatggccatacaaatggccgtgcaaaatagagtgcactgcttatagagtgtaagcttgaaatgagagatgacgataagataagtaagttgttggagacagccttagagaaaaaaatcaacacgttattgctttttttcccctctgttttccgaagtttctgcgactagcatgctccaccatatagcgttagcaatttagcatggtatttttcctgtcactgtcgcctaggaatttattgtgatgattatgagctagctagagatagacggtgaaagttgtggacagggagctgcgctgctgttcctgctcgctacgtgtgtggagtggcggtgacgatagaattggtggaagttgtgattatgtagtgtagtgtcaggtgatggcggtgtacttatgacgatgtctctcggttttcctgacctggaaagatcggtaacgatggctgctacggtggtgcgcgactgcgcggcgtctctatccggacagagaaacgcaggttttgtccatgcttgggaagctgctggtttgtcttgtgtgttctcacttctcagccgccactcttttctccactcaataattgttcactgcagtgacccggccagacgccagagtgaagtcgtatactctcaccggtgacctgatataagtaacaatcatgctctaccccattttgtaatattaatatggcaatcacgttccgcccctgtccagctttcagtggatttgtagacaagacaatgatctaatcaacttaccagtcaaatttggctttgtgcgaccatggtacaatcaactggccataaaattaaaagtaacatgacgagttggatttgagatactcggtttgttggatctgccagagcggttgctggcctgctatgtggattagatgggccgttactgaccgtggacgcgtgtggggatacgggcctcccggctcctggcccgctacgatcaagcccaccgcaaccgaagcagcacaataggaagcacctataaattttagtaccagttttctaagaatcggtactaagtcagattgaaggaaggaaccatcttaacagttccagtaatgattttaactgctaggagatttagtactagttagtggcttcaaccggtaataatatcaaagcttaccggttgaagatgcaaaccggtattaatacaatcaagtaccagttggaaccaccaatcggtactaaggacatgttaattggttacatcatttagacttaatcctcactcatatgttttgtattatgtgtgaaggtattataatgctttgtaagagtggaggtgatgtctagattttcaaagaatttgttaaaaatttcacccatttaagtgtgaaaatgattagcaagttcaccgtctcgtatagtatagttttttttgtttagatttccacaattttgtggctgattgtgtcatctatttactacaaagattatgttaacaatgttttatataaataatgtagatggaccttcaatggatgtacaacatggatcgaggctctaaaggatatattgaaggtgttcactattttctaaagacgaccgagagacacaagcctagaggtttcatgtgttgtccatgtagagactgtaagaacaagagagaatgctcatcattgaaagctctcttgtgggttttggaggtttgcatgaaaacccaattaaaggactgacctgtgtggctaagtgttgaacaggtgcttagtgcaaaacttatagggttcaacacaagtgttcaagtgtgatggtctaaag

SEQ ID NO: 17274 - DNA, 1367 bp, Zea mays
tgggtacctcgaggccggccgggccggaccaattccccaatttttttgtttccattccacaaaaccacaaccgcgcggttttctccctcccccggctcccgcggcgcaagcgcagcccacccaagcgccatggccgccgccgcccccgacgccgacgcctacgatatcccgtgggtggagaagtaccgcccctcccgcgtcgctgacgtcgtcggaaactccgatgccgtcgcccgcctggaggtcattgcccgcgacggcaacatgcccaacctcatcctctccgggcctccggggaccgggaagacgacgagcatcctggcgctggcgcatgagctcctcgggcccagctatcgtgatgccgtgctggagctcaatgcctcagatgacaggggtttggatgttgtgcggaacaagatcaagatgtttgcacagaagaaggtcaccctacagccagggcggcacaaaatcgtgatcttggatgaggctgacagcatgacatcaggagcacagcaagctctgcgaagaacaatggagatctattcaaacaccactagatttgcacttgcatgcaacacatcatcaaagataattgaacccattcaaagccgatgtgctatcgtcaggttctcaaggctctctgatcaggagatcctcggtcgcctcatgattgttgtggcagctgagaaggtgccttatgcgccagaggggctggaagctatcatatttactgctgatggtgacatgagacaagctttgaacaacttgcaagctacatttagtgggttccgctttattaatcaagaaaacgtgttcaaggtgtgcgatcaaccacatcccttacatgtcaagaacatggtgaaaaacgtgctcgatggaaagtttgatgaggcatgctctgcactgaagcaactttatgatctgggatactctcctactgacattatcactactctcttccgtgttgtcaagaattatgacatggctgaatatctgaagctggaaatgctgaaggaaacaggatttgcacacatgagaatctgtgatggtgttggatcatttcttcagctttctggtctacttgccaagtttgcgcttgtgagggaaactgcaaaagcaccatgaactcgttgtattccagatgataatagcttgtgtcatgctgtgctatcatggtaacctagttcagttaatagcgctgtcatgcgtggcttaatgtctacagacgtgatgtatctctgtaagatagtgctttctgaagaaacaactatcatgtttacccagtgtggcagatctaaaaaaaaaaaaaaacccatccttactcttagggcttgtttgggagctgcttagcccctccaatcccctct

SEQ ID NO: 17275 - DNA, 836 bp, Zea mays
gtttcccccttttggtcttttgccgctcctgtcgtctccgttcctatctcctttcccctctgtctcccctcatcatacttttcttgctccttcgatcgaggcaaaaagttagctagggaaagctataaagataaaaagatggcgacggctgatcacgaggcgacggacgacagtagcggcggcccgctcctcgtttgggactgcggcagcatgctctacgactcgtacgagctcaccgccttcaagcgccagctcgacgccgctgtgctctccagcagccgctcgctctccatgccgcacctcacggccagcgtcgccacaacgtcgctgcccaccaccgacgtacagcagcagcagggaaggcggcgcaggaggaggcgcctgcccgccctgctccggaggctcttctccagggtgctcccggctgcggctattcccagccaccggggcgcggggcgcgcactactggacgggagacgaccgaacagggtcgccgtggtccggcgccctcacgtccatcccggaggagcagagctccagcagccctgagatggcggagtccccggtcgttgagcctgcccagagcaagctgcgcaagacacagtcggagcgcttcatcggcagcaaggcggcggcgcccatggtgcaattcgatgtcgtcttgtagcagcaacacgcaattcactagtagttactactctacttatataaaagtaagcacttatttgtaattttatacagtactcactatttagtcttttagtttgtaaattggaaacaacggaaggtaacttcatgtgaggaacttctactcgatcgaaaaaaaaaaaaaaaaa

SEQ ID NO: 17276 - DNA, 3391 bp, Zea mays
aaaaggtacgtataggccacggcactagaggctggaccgctagagcctgcagagaaagcgaaaccattgtgagaaaagtcagaaacaaaagaaaggattcagcagaggaagcccgccggagccatatttattacgtacgtacgcgcgtagagcagaggagacctgaagaaaaggcggccatgattttagtttgcgtttcgccggcaccggccgggccggtagggaggagcgtcggagagacatgatgccgggcctaggcgcgggagcggccgggcacaattccggccgtagcccgacgagacaggcaaggcgcagagcacggccgcgtcgccgtccatccgtcatcagtcgtatcgaacgtccatcgctgctgcagcgccatgcctttgcaggctgggccgctgcggagcgcgcgcgacagcgagtgtcctgcctcgctcgcggcaagcgccgggcgtccttgccgtgcctcccgttccttgtgccttcggtggccgcgcaccgtgctcggcggccggcgccaccgcgagctcgaaacgtggcgtcgtggcaggcggatgcatcggaattggcttcgaggaggcgctggcgctggagcggcagtggctagtggccactggccacgcccccaccccactgcggcactgccccagcccagtccgacccactcgccatttggcaaaggcacactcagcccccacccaccagccaccatgccgtaaaaaaagttattcgtatcggctcatacgtgctaactgccataacgccaagtcagaatggcggataaactagtttgataaccatatttttttctaacgagacgtttagatctttttattttagaggaattgaaatttcacttaataaagtaacctatttagcttgagatttcatattccattattttcaaaattctgatataaacttatctcaaatttgtgggtagaggatgagaaatgattttatgtattactagaatttgtttctactctgtaacttgcaagatgatcttcgactcacttctttatagtaaaaataaagcaaataaacatctcctacatcttgctaataatagtatattgatatattttgcataaaattgaattagtttaattgatatatgtctaaattactattattataatggaattcaattccaatgatccaaacaagacgtaaaagatttctattttatcaagaaaaattaatttatttttcattgtgaaaatattaatcacttagaaaaatggagttatcaaactagctccaaatgttatctattgcatgaatacttaagttgtattgtattcgtggacgctgacaccttcctggctcataaccataaccagcagcaaatatatacggatatacaatgaagaaatattaaacattagtgaaaaataagtctgttagagaaactccaaaagaagatgtaaatttatgtcaaaactgatttttgttactccaacagccctcttatccttctcaaaaaaaaaccgcatcctagtacagttctatacccatcaataacgaagcaataaatcaccatggtacaattcttacctaagatgatttattaggtaaatgtctatttcttttagaggtaggtgtctatacccatcaataacgagacgtatatcaatcactttttaaatctcagggtttcttggtacagttctatactcattgtctattattaattgctgatcaagtgctgctagatagatgtttcaggcctccaacacggtatgtctaaagacgatttctaatcagcccatgggccgtgagggaaaaaataaccctagcagcccaagaagaccaccaaagcagacggcaagtaccctgtagcacccccacccctccgcctcaaaacatgttcttcttccgctgcaagatagcaacacaggcgaggatcccaagacccgagccgtgtaggctgctacagtctcttcctccccgtcaagccgcggcggtcgttgccccggccctcatataatatagtcgccgcctccttgtcaccgccgattcgattaggttgatacagggaggagtcgcgaggggacgtagatgccgacgctgacaaagctgtacagcatgaaggaggctgccctccacaacacgcccgacgactgctgggtcgtcgtcgacggcaaggtagcgccagccgccactgtatcccttcctcatccgcccttgctgtagataggtatgtaggtgcgctgtatgcagcggtaggtagagatgtaaacccgtggggagggagggagggagggcatactgttcgaagttccgatgctatttctctcgcaacgtgttcgatggaatgtctgggaggcctttgctatcatgtgcggcttgttgtgcatctgatcttgccaatactagcggcattctggtggcgaggtttggccgtttgggagattgggatggcgtggtaaactagctatggttgatcgtgctgctgtctcagaatttcctctggtttctcactaattgccagcgcagttgcatcaattgaagcatcatttcaagtagagttgagatatggtgcactgaacttatcgctacataaactgattgtctgctggtacatgcgatgcagatttatgatgtgaccaagtatttggaggaccatcctgggggcgccgatgttctgctcgaagcaaccggtgctgcttccctggttcacttttcctgcacttattatccatgtggtattagtttctgtattatggtttgtttgactcggtgtcattctgtctgaaggttctgaaggtaaggatgctacagaagaatttgacgatgcagggcacagcaagagtgccaaggagctaatgcaggactacttcgttggggagttggactcggacccaactcctgagattcctgagatggaggttttcagaaaggaacaggacacgggatttgccaggaagcttatggacgacgtggtgcaatattggtcgatcccagccgctgtaattgggatatcagctgttgttgccatattgtatgcgcgaaggaagtgaaagccgatgtgcatgtgccgagcttgggcagatgaccccttttagagggatcagcccatggtgcatggatatatcatatatcatatctcctgtccagaaccaaattacattatgatgttcgattcttaaacacttaatggcaaacatttgccggattgatggcattattttgtcgacacgacaatcaattgatggatttattactcttggaaccaaaaaaaaaaaaaaaaaaaaaaaaaaccatcacgcttgctggcgtaaatatgttccatgccacctttgatgcttttgaacgccatggattggcattcaatctttaacttttatctcaactgaattcggtgttaaaaaaaaaaaaaaaa

SEQ ID NO: 17277 - DNA, 881 bp, Zea mays
  misc_feature (874)..(874): n is a, c, g, or t
ttggcttccgcgaccccgcgggcaaaacatgttcttcttccgctgcaagatagcaacacaggcgaggatcccaagacccgagccgtgtaggctgctacagtctcttcctccccgtcaagccgcggcggtcgttgccccggccctcatataatatagtcgccgcctccttgtcaccgccgattcgattaggttgatacagggaggagtcgcgaggggacgtagatgccgacgctgacaaagctgtacagcatgaaggaggctgccctccacaacacgcccgacgactgctgggtcgtcgtcgacggcaagatttatgatgtgaccaagtatttggaggaccatcctgggggcgccgatgttctgctcgaagcaaccggtaaggatgctacagaagaatttgacgatgcagggcacagcaagagtgccaaggagctaatgcaggactacttcgttggggagttggactcggacccaactcctgagattcctgagatggaggttttcagaaaggaacaggacacgggatttgccaggaagcttatggacgacgtggtgcaatattggtcgatcccagccgctgtaattgggatatcagctgttgttgccatattgtatgcgcgaaggaagtgaaagccgatgtgcatgtgccgagcttgggcagatgaccccttttagagggatcagcccatggtgcatggatatatcatatatcatatctcctgtccagaaccaaattacattatgatgttcgattcttaaacacttaatggcaaacatttgccggattgatggcattattttgtcgacacgacaatcaattgatggatttattactcttgggaaaaaaaaaaaaaaaagcggccgcttttttttnttttttt

SEQ ID NO: 17278 - DNA, 2655 bp, Zea mays
gccggccgcggccgggccccttcgctgtcctctctggctaaaaagaaccgcagaaagatcgttttttttccctgtccccgttcttgcactcgagttcttcagttcttaggaatagtcagacggaacaactcgagtttgccatggtggtgatctggaaccggggtgtgctgccccctctttgattccctgattggtctcgctccagttcgacgcgggatttggacgggacgggcggaagttgggagagcagagcggccggcatgtttgggtccagggtccaggatgaggtggagatgcagaggaggcctaacaacaggatctttcccgacgagagacaaaatcaatctaagtcattgtatcaaactacacgggctgacagatttggcgcaaatagaatagatctgaagaatcctgagaagcttaaggtgttaaatgaaagcaacaaaccctggcaccagcgtattctagaccctggaagtaatattgtactgagatggaacagggtgtaccttgtggcatgtttgtttgctctttttatagatccttttttctattaccttccattgattagacaaaatggcaatggatcttcatgtgttgccaaggaccagggactgagcataagaatcactgtcctacgatcacttgctgacttattttacatgttgaacatagcaatcaagtttcatactgcatatgtggatccaaagtccagagtccttggaaagggagagcttgttgtggatattaagaagattcaacgaagatatataagaactgatttctttgtagacatacttgcagctgtgccacttccacaggttactgtgtggttaattatgcctgcgataaaaagctcagattataacatccggaacactacatttgctctcgtaattgtaattcagtatgtcataagaatgtatctcatcatccctttaagcaatcagattatcaaagctgttggagtagttgcaaagtcagcttgggggggagcagcatacaatcttcttctctacatgcttgcaagccatattactggtgcaatatattaccttctctccatcgaacggcagattacatgctgggatcagcagtgcgttgctgagtacaatgatacacattgcaactttagttttataagctgtgagaataatggttctaatgattattctgtgtgggcaaataagacaaaagtatttgccaactgtgatgccacgaatagtagtatatcatttaactacgggatgttttctagtgcactgagtaaaggtgctgtatcatctccattccttgagaagtatttcttttgcctatggtggggcttgctgcagcttagttcaagcggaaatcctctcgtgacaagtgcatttatcacagagaatgcatttgcgatagcaattggtgctatcagtctcatactctttgctcagttgattggcaaaatgcagacatacctgcagtctatcagtaaaaggcttgaagagtggaggctgaggcaaagggacatggatgagtggatgagacaccatcaactcccatctcatcttcaagaacgtgtgcggcggttcgttcaagtcaaatggcttgctacaagaggagtagaagaagaatccatcttgcaagctttgcctgctgatattcgtcgggatgtgcagcgtcatctttgtttggacctcgttagacgtgtaccttttttctctgagatggataaccaacttctcgatgccatctgtgagcggctggtgtctttcctgtgccctgagaacacgtacatctctcgcgagggtgatcctgtgaacgagatgctcttcattatacgcgggaaactagagagctcaacgacaaatggtggccgcagcaacttcttcaactccatcatcctgcgccccggcgatttcgcaggcgaggagctgctcacgtgggccctgctccccaagaccaacgtccacttcccgctctcgacaaggaccgtacggagccacacagaggtggaggccttcgctctgcgggctgaggacctgaagttcgtcgcgaaccagttccgtaggctccacagcaagaagctccagcacacgttccggttctactcccaccactggaggacctgggccgcctgcttcatccaggccgcttggcggcagcaccagaggaggaagctggctgagagcctcagccgctgggagtcgtactcgtggtggtcggcggaggaccacccaaccggcgataagcccaggcaggagggcacctcgagcggcggcggcggcacgaggacgatcgctgaaggtgccatcgcccatatgcacaagctcgcctctgcttccagaaggttccgcaccgaggacatcgctatccgcaggctgcagaagcctgacgagcccgatttctccgcggaccattttgattgaaccttcttaatattgtgcttcgcagctgggagttgcatgttgtacgaacgatcgcagccgtagcatatatactctactgtaattttactgcacagccatcttaggtgtcgtgaattgtaatagaaaaaaagatgtatcgtgtaattctaaatccagaatctaccctgtataggcttaaccttttgtgcagtgcataaacttgagtatttcgaagcgtcaaaaaaaaaaaaaaaaaaaaaagcgcccc

SEQ ID NO: 17279 - DNA, 659 bp, Zea mays
aagactatagccacgacaagattgtttccaggggaccaaaaaagtacgcagaagatattgaaagtggttcttctgatgttgaagcaaagtacaagaaaatgtatgaggatgacataaacccgtttgctgctttttcaaagaaggaaaaggatcagcgttataaggaacttggtttaagagacaaaatcacacttagtagtggccgttttgtccttggtaacaaatacgcacggacgtttatattcttctacagcatcggattcatctccttgtatttacattactgtacagaatgtcagctttgagctatctcaacacaacaactcagcaggataaatcattctggatgctggtaatcagaggctaacgcacatgctttaggccaagttccatataacagtagaaaaagaggctctctgggttttgatctatagaatctttggacaggatcgttgctgagattgctattgatttgtttgctttgtacccttaagcgcgcgccttgatatgtttctgtagataaaaagaaaaaaaaaacctgttttgggggcaggcgtgggtgcggcatgagctttgaactatgtaatactgttgtactgccaatttaccattttgttggtaaatgaaagcacacttgtcacagaaaaaaaaaaaaaaaa

SEQ ID NO: 17280 - DNA, 3281 bp, Zea mays
tgaaagggctcaagcacgattagtcagtcttgagagggaaaagggggatctgcgttcacaattgcagacaactaatgaggatgcaagcaaaagtagtgactatttggaatcaagtgatatacttgagagttccttgaacgccaaggagaagattatttcggagttgaatgcagaacttcgcaacattgaaagtactttatcaagtgagagagaaatgcatgtgaatgagcttaagaagttgactactttactcactgaacaggaaagtgctcttatggagttgaagaaagaactccaggaaagacctacacaaaaactggtagatgatctcaagaaaaaggttcagattttgcaggctgttggttacaactccattgaagctgaagactgggagcttgctactaatggtgaagaaatgagcaagttggaagcattgcttctagacaagaaccgtaaaatggagcatgagctaacacaactgaaggttaaaatatcagagaaaacaagtgttcttgaggaagctgaaaaaaggattgttgaactaacttcaaaggttgaagagcagcaaaagctgattttgaaacttgaggatgacatactaaagggctacagttcaactgataggaggggctcactcttgaatgactgggatattcaagaaatcggctcaagtgaagcatccgagggctctgatccaaggcatgcatcggcagatcaagatcaaagttcgatgctcaaggtcatttgcaaccagagggatcgtttccgtgcacgtctgcgtgaaactgaggaggaactgaggagactaaaagagaagcatgagatgctgactgttgaactggaaaaaactaaagctgataatgtgcaactgtatggaaagattcgatatgtccaagactatagccacgacaagattgtttccaggggaccaaaaaagtacgcagaagatattgaaagtggttcttctgatgttgaagcaaagtacaagaaaatgtatgaggatgacataaacccgtttgctgctttttcaaagaaggaaaaggatcagcgttataaggaacttggtttaagagacaaaatcacacttagtagtggccgttttgtccttggtaacaaatacgcacggacgtttatattcttctacagcatcggattgcatctccttgtatttacattactgtacagaatgtcagctttgagctatctcaacacaacaactcagcaggatgaaatcattctggatgctggtaatcagaggctaacgcacatgctttaggccaagttccatataacagtagaaaaagaggctctctgggttttgatctatagaatctttggacaggatcgttgctgagattgctattgatttgtttgctttgtacccttgatatgtttctgtagataaaaagaaaaaaaaccctgttttgggggcaggcgtgggtgcggcatgggctttgaactatgtaatactgttgtactgccaatttaccattttgttggtaaatgaaagcacacttgtcacaaaggtatgcggtatgccataccatcactgcatcgtttagagtgaaatgcctctaaacttttcctgcattctcttctagctctatgaactcatggaatggtcattcgttattttttttcactttttaagtggttcatttgaagtgtgtttagatccatgattgggtctagagtacacttaaaatgaacgtgaacccatttgacttttcaagtagtccattcgaaatgtgtttagatctacgattggacgtagagtgaagttgtaatgaacatggatccatgagaacgtagaaaaagtttgccaggatgcatttcactcataggtagttgcatgattcctgaagttttttttgaaggagctgaagaagccataaattacaactcctttataaaaaagcacagcttagcttctttactatttaccataagacagcttctagatttctctagcatttactataaaatagcttcacctcctagaaggtttggcatagctccttcatagaagttgaagtcagaatcggagctgtgtcaggctctaagttttagagctgtgtcaaatagtatctaaattttagaatagaagttgctgttagaatcacttcttaagagtagtaaatgaactgctctaatatactaccataataaaaaaaagcagagtactacaatacagtatagaaaagaagtcgtcaagacatcgagttccgttacgtggttgttcactgatcactgccatcttgtgtggccctcacaagcggcagcaacagcgaccgaacaggcctgcaaaagcggcgattccaagtatgagatcggcttcgctacggccaattggtgcggaagcggaaggcaccaaacgccgagcacgagcagccatcaacgactagcactggctgagctgccgaatagccgcagatcgcagcctctcgccggcacgggaggtgggctccggtgcggtggtagtacagggaggtggagtggtggaggtcacggctgatttttttttttttttacacccagcgtgtttttttttttggattttagtctcgatattataggttgtgccgctgggatcgagctccatgttatatagatttcggtgcatacccctctattatctatagcttttagcatataaaatataatagaaaatatattattttgataagcatgcaacaactttattttagatatgaggctttagctctcactagcatctttggagcactagtacgttacgtagcacgcccatgctaggctttggctctctcctagcattttccgtctccatagccaaagccaatcttatttgcctgtcagcgatcgcacaatctgtttgactgtcccatttttgttgcactgcactccagtccagtgtgcagtcctccgtgttgctggtcgtgcattgaattcaatcggataattgtgcgactggggggggtcgattcatccaaagtggccggggacaagtggacgcagccacggaggccatgccgccatggtcattttttggaaaacgacctccgttgtccgtatattattgtcgaccatacacaaatccatgctcccattcctcgccttttttttcttttctatttgcgtgcagcgatagagcaggtgatgtgcatgcatggaggatgaattgagaagtcgtcgttatccctgtgtctatacatgaggtatgtatagacagatactatagtaaagtgttttggttaattagaaagagccataataatgacttacacaagaaagaaaacaag

SEQ ID NO: 17281 - DNA, 667 bp, Zea mays
attcggctgctctcgaccgatcggcgccacgagtgctttgctttctggctgctgggagcgccatggggaggtcgccgtgctgcgagaaggcgcacaccaacaagggcgcgtggaccaaggaggaggacgagcggctggtggcgtacgtccgggcgcacggggaggggtgctggcggtcgctgcccaaggcggcggggctgctgcgctgcggcaagagctgcaggctgcgctggatgaactacctccgcccggacctcaagcgcggcaacttcaccgacgacgaggacgagctcatcatccgcctgcacagcctcctgggcaacaagtggtccctcatcgccgggcagctgcctggccggacggacaacgagatcaagaactactggaacacgcacatcaagcgcaagctcctcgcccgcggcatcgacccgaagacgcaccgcccgctcggcgccggcgccgacgccgccgcgccacccggcgtggtcgcgcaccgggcgctgctgcaccgcgcagccctcgtcgagctcgccgtgaagccggcgccggcggagtcatccgacgacggcggccggagcagcggcaccagcagcggcggcggcggcggcgccagcgtggaggagccgcggtgccccgacctcaacctcgacctgtccgtgggcccgcc

SEQ ID NO: 17282 - DNA, 1416 bp, Zea mays
acctcgaggccggcccttggccttggcctggcgctcgcacctcacagcagcagcagcaacaacaacctccactgccgcaacccaccgagaggcgagaccggcggcggcaaaaggacgatacaaaagcagccagggttgctggcaacagcgtcggtcgcccgcccgctcgccatggggaggtcgccgtgctgcgagaaggcgcacaccaacaagggcgcgtggaccaaggaggaggacgagcgcctggtcgcgcacatcagggcgcacggcgaggggtgctggcgctcgctgcccaaggccgccggcctcctgcgctgcggcaagagctgccgcctccgctggatcaactacctccgccccgacctcaagcgcggcaacttcacggaggaggaggacgagctcatcgtcaagctgcacagcgtcctcggcaacaagtggtccctgatcgccggaaggctgcccggcaggacggacaacgagatcaagaactactggaacacgcacatccggaggaagctgctgagcagggggatcgacccggtgacgcaccgcccggtcacggagcaccacgcgtccaacatcaccatatcgttcgagacggaggtggccgccgctgcccgtgatgataagaagggcgccgtcttccggctggaggaggaggaggagcgcaacaaggcgacgatggtcgtcggccgcgaccggcagagccagagccacagccacagccaccccgccggcgagtggggccaggggaagaggccgctcaagtgccccgacctcaacctggacctctgcatcagcccgccgtgccaggaggaggaggaggagatggaggaggctgcgatgagagtgagaccggcggtgaagcgggaggccgggctctgcttcggctgcagcctggggctccccaggaccgcggactgcaagtgcagcagcagcagcttcctcgggctcaggaccgccatgctcgacttcagaagcctcgagatgaaatgagcgcgcttctaccctctctgtgtagcttctcccccccgtcgtcctcgtttttgttttgccacacctcacatggatgatgaattgatgatacgtggttggttagttttttcgtaggtgaaaaatacgcgatggtgagcgagtgaaagagagattttgtgccctgggtcctcctccctgctctctcttgctgctccattttgcctccctctgtcctctctctctctctctctctctctctctctctctctctctctgtatctctgtaattaccatcgccaaatgatcatgggggcaatatcttgctgggtctctggaaattgacgctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 17283 - DNA, 8353 bp, Zea mays
aaactttctcatcccattccctaatagagaaattccccacggggaatcggggatcgggtccccgttgccatctctactcctagtcgcgtggagcgaaagctggtgacggttaaccgcgcgctttcgatgattacgcttacgcccacgagtcgaagaacgaagcaagttttagcgtagtagctgaaagcacgtagcagtgacctttttttttcttacgagcgcgcgcgcggattcggaggtgtggtgtgactggtgaggaacatgaggaggagatcgaggccaactgcggagagtgcagtgcggacacgcacaaagccgatctataaaacgacactgacgcgtcacgcgtgcacggggacggacgtatagacgtatagtcgtatacatatttgcatggtacagatgtctgcacacatggcaccatggcagcacagcagcagcagcagcgaagcaagcagaaaaagcaggtacgtacggtacgatccctggacgggacgagttcttatacgccgtacgtagaggacgttgcaaagggtgtggcggcgtcgcaccgcatggtgatcattggcggcacaccacgggcacgggcacgggcacggacacgggcacggcacgagcgtgggaaaaggctagcgagcgagcgagctcggtctagctctgtctccgaccgggaccggcacgccgacgcctagctagctagctagggctctgcttttgccggtggtcggtgggcggagggctacctcagctttcgttcgcctttccacgcaccgcagcccggatggggtaatactgtccctactgctttcgtgcgccggcggcgcgggcgtggaggggatcaggggaaggccagcgatcgggagaccgggagctagcgcagcgcaggggacgacccgacccgacccacccgggccgccgcggaattcggccttggctctcgctcaagtgacccaataaaaaaatttatgtatttatttatttatgttattgggataagacaagatagacgacgagcaaagcttgctgagctaatagggtcagctccgtccttttgcgccggatggatcaccaacaaacgttgcagttgccagttgaaacgaactcggttccgccgctgacgtacgtatgtatatgtatacatctcagagagttcgctttgctgacatgaggaccacacgtctcctgtctactagtactcgtgagatgtactggtagctgtacgcttccactcagttcagtttcaatctgatgtacagctttcgagctccatccatgattccatgtacgctcgctgctgctccaacctccaaccacgtccgtgccagactttccactgccactagagtagtggtggactggtggtagaggagcgctcccatcccacgtccgctgtccgctctcggtgctggcgggagcaaacagcaaggacggtcaaggtcaacaccatggatcggagacgcggcgcaggggaacggaatgatgagcgccaggccaggccaggcagcgagcgagtcgagatcgagacgagagtgcctgcctctgctgctctcccggctcccgcggaggacaagacaaccccgccagctgtgcgcattacggaccagtagtactgcttattatatcacgtggcccactcgagcgaccccactcactccaccggtccactcccgcccgtctcgtgtcagtgtcactgtcacccagatctcgctctcgcctcgcgcgcgtataaaacggcggcggcgtccactcctgcctctgcctctttgccaccgtccattcccccgttccatccatccatccatccacccaaaagccacacacatggacagcagcggaagctaggcctaggcgtcgtcgtcccgtccagctacgcacgcagctatagcctacagctcctccctcccgcaccatccccagcaccatgtcgtcgtcgtcgtcgtccagggcgcggcggggcgggagcgggagcctgcagcagttcccggtggggcggtggcggcacgtggcggtggtggacgccgggtgcggctgccgcccgcgccgggccacaaccaggctgctgagccagctgccgtccttcctccgcccgtccccaaagccgccgcagccgccgccgccgccgcgcagcagctcgcgctcctcctcgggcttcttcccgtcctcggccgcctccaccgcctcctcctccgccaccaccttcaccaccacccactcctcccactccaactacgactcctcctacacccaccaccccaccaccaccaagcacctggcgtcggccgccgacaagccgccagcagcggcggcggggaggaggaggcagcagctgcagggccaccaccaccaccaccaccagggcagcaggaggaagaagcggtacgagaagatgggcggcccgggcgcgggcgcggcggcggacgcggacgcggacgccgccgcagcagaggcggcgttgggggcgtggccgtggagaaggagtcctccgacccgcgcgccgacttccgggagagcatgacgcagatggtcctggagatggggctgtgcggctgggacgacctgcgctgcatgctccgccgcctgctcgcgctcaacgcgccccgccaccacgccgccatcctcgccgccttcgccgaggtctgcgcgcagctcaccaccgcggccccgccgtaccacgccgccgcctacgactacgactaccactaccactactgaaaaataaataaataaataaacacgggtggcctggctgggctccgtcttctggtcccgagatcctggcaccacccggcggccgggctccacctgctgcaggggtggacggtggtcatgtccgccgccgccgccgcctctgcccctctgccaccgggtggtgataggatctcgtgaaggagagattaaaccaccaccttattactgttagcttcaccaggtgtcatcagtgtgtgtatgtccattgtccagtaccagtacgaccaggtgtccaccgtccaggtcgtccttgtagcgtagccgtagccgtagtgtgtgctttgcgagctcgtctttttcttgggtttcttccttgctctgtttgctagctagcttctcgctgttcctacctactgtatgtctcgcaggagcaagcagcatagcagtgtgtgtgtgagtgtgtgttcggctggcctttcgttttggatgaaggccgtgtccacgaagaagtggtagttagctgtgtgagagatttagaagcaggtctgctttgtgtctacttgtgcttgtagctaagctgctactagtaatgaagatttgagacgcgtttcttgcccaaaaaaaaaaaaaaagctacgtattgtcacttgtgcctatgaatatcgctagtacatggaacaccattactgtttttaccgagaggtagtaccgtagtagtatatagttcaatggtactgtatttactgaggtaaatgcagtttttttttttttaaaaaaaacccccgcatggtcaccgtactggtggactactggccaattgtttaaacaggctcgaggtaataaatcagtacccctgcactggtggcctgagtgagtgaggcagctggggcttcagtgtagtagttactgccagcctgaatgtgcattcatcgctgaaacagagcctgcactccacacaggacaggcctgaccatggacggcgtctatatcttcagaaggcgaggaattgaagggagggacagacgtgtgcgcatccaacccaaacgccgtgatcccgtgacgagcctgtcgtcgacctttgtggtacggccagtcggtcggtattgtacgtgaagcagggacactagctagtgtcgagtggccgagttccgacctggtcggtattgtacatgaagcagggacactgtactactcacggcttgtttgcttctcatgattttgctcatgctgcagcttgcaacaaccgaccaagaaggtggccatcagcccaccacccccggtactactggtaatgatgccgttagttttcgtagcactgctgcactagaaagaccccggccgaatcggttctgcgcgtgacatttgtggaatgatgcagagaggctggttccacccgattattagagtttagtctccgccatattaaatatttaaagaataattacacatattaagggcatatttagatggttgactaacttccccaattttgtctaacttttgtgactaaagttagttatttaattcgaacgaataattttagacaaaatgtggcacagttagacacgaaccaaacaagtcctaaatatagtctaacataaacttacttacacggataaatattaaactttatgtgataaacttaattatacgaatgcaggggtgtaccttgtttctcgtcgccaagatacgctaccatggtttttttctcagcagaggctgctgggtgggtgcgtgcgtgcggcaggccggcagcacacggcctcgcgcttcgagctccctggggcttgtgggctgagggagtgggagtggcgagtgccggcgtgggcgagtggcagggatcgtcggagcttttcaggtgctggccgggcaccgggcaagcacgaagggacggacgaccggtatgatgatgcggtgcccgccgcccggcactaaccgcgcagcgcatgatgacgcatctcgaggatgacgacgagctgcctttaccaacgccgtctccgactctccgtgcagccggtcaactgcgggcggcggacgtactgctgggccgggcgtgcttcttctactctgggcctccgtcgctccagccaccaagcgtatttggaggtctggagcccaagctgacgagaattaaatttaaccggaccggaccggaccggggcgtcttggtccgggggcgcggcttgcgtcctcctcgatggcgacatggatgaatgcgccgcgccgcgccgcctctccgagatcgatgcggtaccggaactggatccgtgcaggtcaaccgtctagagcacgcgaggcagtcacacagtcgcaggcggagcgcggcgtgacttgcggccctgcgtgcggtggcttcggactcgggcgatgcatgcaaagggcgcctccgcggtacacgcaacgtaagcgtggtcaaggtatcacagcatcaccatggacacacttgtgaacagtcgctgcgctctatgaaaagcattttttttcttttgtgctcctgataacggctagtccaaccctaattaaccagcggatgcatgcatggcgctgctgcagctgcacggagtcggtggaccggtgaccggacgatccgatgggacgcaacgaataaaccgcgctatccatcacttgtgccctgctgccgctcttgtcacgtctccgcaagttgagagcctgggacctcactcgaacgatggcaacaatttgtggtgtgtgcagctgtgcgcccccgccccatatacgtgaactagcggtgctgctcacacttaattaatggcaggtgggggccgccggtcctgtgatcttcggcaggcagacgatgactcgcctaattaatcatggctttgtagtagtactactactactgtgcaactatatatatacatactatactatatatgcatgttcagtaggagtatggtgtttcagtatgcacgcacataaatacacgcacatgcatgcttccatcagctgctggtacctaccggtcgtcgtcgtcggcctcaccgtacgtacctaccggtcggtgcggtgcctgagactgagatcaacctaaactaggccccggggattggaggtgtgatagcatgcaaacaccgacgattaattatgctcagtcagctggcaggggtcgttgttcggcggccaccggtttcatttgccataaataccggagctgctggcaggagtagaaattaaggtctttatacatttatacccgtactggaaataaaaaccgttgatttttttttctctccctctctcgagagaaaccctctacctacactacactacacgtacaggtacagttacttgtacattgcattggatccttcgattcgatccgcaccaaccaactgctcctactactactaactctactattgctacgcgcacctgtactacatggcgagagagtgttagtgacagcgtccagttaatttaatcatcctgttgtcgttagaacactaaccatcagcagctgcaggagccaggaggtaaaggtctggagattagcaggtcatctactcaagcgatcgacaggccacgcgcagtgggtggagcactactggtggtggcgcggactgcgggcacgaccgatcaccgtcgtcgctgccagcagtacagggccagcgcttgcatgctgcctcctcatcctccaccacgtgcacctgaacgtcggccggaggcggcggcggcggcggaggctgtgacggcgtcgccggcgacactgccacagctggtggtcgtagcggcggcggcggcggccgtgcagctgcagctcagctgcagccggtgctggtgctgctcgtggtggtggtgctggtctcggcggcggtgctggagggaggggaggaggaggaggagggcgaggacgtggacaggccgaggagcaggtccacgaaggcgcccacgatcaggtggtggtgctgcttcccgttgatccggaggtaccacgccaggagctcctccagctgcgcccagtcgcggagcccgtgcgccgacaccatctcctccatggacgcccggaagtcgccgtacgggtcgcccgagtccaccgccaccgccacgctgcgctccgccagagacgacgacaccgctgccgccgccgccgccgccgtcgtcggttgccgctgcttcttgacgccgtcgccctcgtccgcgtgcgttgccgttgcgtcttcctcctctgtcggccctgggactgggaccgggaccgtcttcttcctcgccggcgtctcggcggcggccgcggccgtggtggcgaggatggagttggacgccggcagcgggccaggctgcgggtcgaagaagaagcggtcggtggacgtgcggcccaggctgcggatcacggcctcctccgaccactcctcggacgccgtggtggtcgagaacccgtcgtcgtcgtcgtcgtcgtcgaggtagagccccgccacctcctcctcgtcgtcgccgtcgccggcgagggagaagaagaagtcgtccgcggcggggtcgtccaggaagaccgagttgaccgtcttgtacatttcgccgggcggcgcgccgcggcccatcgcagccggcttccggtggacggatcgactggctgctgctgctgctgctgctgccgtgggcggcgtcgccgtgcagcagggctcgtcgtcgccgccgcctgcgcctgcgcggaaggaggtcgtctgagggttggtaccgcaggccgaccactgccacggcgtggcggcggcggcggcggacgtggaggtgggggcggcggagtccacgagccgggagaagatggagaccaggccgttcttgcccatttctgggactgggacggggaggaggaccgctggatggatcgacggggtggatggaatggatcggagcgaattgttgccctcgagttcagctcgaacgaattgaagaccagagagggcagagagggcgaggagctcaggtggttgaggagatgggtgggagcagcaacagcaagcggccggagaggaggactgaggcgaggcagctgagcgcgtgcaagcaagctctggctggctggctgcaattaagggaggaagcgagaagaacatgggggtgggcccgtggctcatgcatatgatgcccgtacctgtgcttctgttcgttaattagatggtgattagcagactggacgccattgggcgcaagagacgactgtgccatttcttcctttgtttttcaaagagaactgtgccatttttcctttttcttttggtagacgagacacagcttctccagcacaagggatgccaagttcaaaatttggcaagttgtttcgcaccaaaattcacctgtaagagcatctccaagagaatcttcatttttgactatctatttgactctctatttatcttttcatacgtattatactatatatgtagcatcttcattctaacagattatctatctagtttcactagtaaggtggctaaccaaatttggctagtgagggagccaatttggagagttgaatagtttgacgagtcagatagctagtctgttagagagttattttattgttgaatagctaaaatttagcttggtgggtcatttagctagtctcttggagatgctctaaccatcacaccgctgagtcctctgctcacgtattcggtattcctgcgacagaagcggctgcaggcatgcaagc

SEQ ID NO: 17284 - DNA, 1289 bp, Zea mays
gcacgatcctggctcaggatgaacgctggcggcatgcttaacacatgcaagtcgaacgggaagtggtgtttccagtggcgaacgggtgagtaacgcgtaagaacctgcccttgggaggggaacaacaactggaaacggttgctacagtattagttaacaacgagggaaaggagaaactgatgtgattagcaagcacgggcacggtaaagcagagagcctcttgctgttagtgaactaaggcgacggagaccgcgagggcggcgaactaggctgggcagcgatgatggcgacctcggccagcggcgtctccctcctcctcctcctcgcccatccggcgccgccaccgcaccccgccaacggcgccagcagcctgtggcgcggcggtggcgccgcgctagctcctcatcctgctcgcttcgcggccaagaggaggacgctccggttggttaacgtcagcgtcagctgcagcgccgaggcgctgcgctccgacggcgctggcgcggagccggcggtgccgcggtctgtgccggtgcgcgtcgcctacgagctgcaacaggccggccaccgctacctcgacgtcagaacggagggcgagtttagcgccggccaccctgaaggagctgtgaacatcccatacatgaacaaaaccggctcaggaatgacgaaaaacgctcactttctcgagcaagtgtcgagggctttcgggaaggacgacgagatcatcgtgggctgccaaagcggcaagaggtctctcatggcggcgaccgagctctgctccgctggcttcaccgctgtcaccgacatcgccggcggattctcgacctggagggagaacgagctgcctaccgtccagtgacggtgatttcagcctgcctcgccggcgtcgtaagtgtggttggagcttgcccagcgttttctgtccaagcctgtacatatgtcttcctgccttctgctatagttctggaataaagagtgctggggaatggaatggagcatgttgtaaagtaaagcacaacgagtaggcttctttcttttttacgtcatgcttcatctcatgcataggacattcttatctgctcggtactccctgcatgcggatttgttcatagtatgggtttcctcgtcgaactctgaaactagacaccttacccctctgaactctcaagaccactcagacgagtcagatcaccttctgtcttggtttggaatgattttatccttttttatagccaaaatcattaaatacatgagcagtccccatttctattaaaaaaaaaaaaaaatggacg

SEQ ID NO: 17285 - DNA, 1619 bp, Zea mays
gaccggcccgggatgtccaccggactttcgcagctctctggcggcgtcggcggcgaccggggctcctcctcctccgccggcccccaccaccagcacagccaccacccacctcccccgccgccgcccaagatcctcctcgccaagccgccgctgccgcacgcctcgtcctcgggcgccgatgacgacggcgggaccggggtcgcgggtggccgcgcgcgccaggcgccgcagccgggttcgctcagcctcgtctccgacgcgtgggaggcccacaccgacaagatccttccgtatctgacggagaacaatgatttcatggtgattggggtaattgggccgcccggtgtaggcaagtcgaccatcatgaacgagctttatggatatgatgcgagctcacctggaatgcttcctccttttcctacacaaactgaggaaaccagattgatggggaaacactgtactactggtatcgacatcaggatatctaatgagcgagttatactccttgacgctcagcctgtgtacagtccctctgttctaatcgatatgatgaggccagatggttcatccacaattcctgtccttaatggtgaacccttatcagcagacttagctcatgagctaatgggaatccagattggtgttttcttggcatctgtttgtaatatagtgttggtcgtgtcagaaggtatgaatgatttgtccatgtgggagctcatgcttacagttgatttattgaagcacgggatacctgatccgtccgtgttgacgtcatcagcttcccaagacaaggaaaacaaaaacgaagaccaaacgggctgcgaagactatatttccgatctctgtttcgtgcatactaggctgcaggggcaagatttttctccttcaaagttcatgcttctaaggagaactcttgagaagcacttcaactcatccacttttagagtcgggagctctaatgcaacgggtcatgcttctgattcgctggttccttcaagcacgaaagttgaagatttaacctccagtcggcaggacatatttcttcttcccctgagagggcacgacgactcgacaaagtttgagtatggaacgtactcgtgcatgctaggcatgatccgtgatcagatcctgtcatggccggcgaggtcattctcgaagaacctctcggagcgtgactggctgaggagctcagcgaggatctgggacatggtgaagaagtcccccgtcatctcggagtactgcaaggcgctccagagctcaggatggtttaggaagcaaccgtagtagtgtctagcagctacttgttgggatgcgcccgctttggccggcttggaaaaccagagaatcgccatcagatcaaatgaattcgcttgctctgttctgttcaatcagtcgactctgatgagataccgtgcatgtgtttgttagtttgttgggctttgtgtaatgagctcagagccagcgacagcaggtggcagtcagtcgtgtacggctcatgcttctctgcgtgtcctgtgctatgatttgaggctgtttcatgcgacgtctcataaatttcatcttctaaaaaatatatatttactgttctttaaaaaaaaaaaagaaaaaaaaaaaaaaaa

SEQ ID NO: 17286 - DNA, 2366 bp, Zea mays
ctcctcatcgcctcatcgtcatctacctcgctcgcaccacacgcgaaaccgaacaaactactcgtacaaactacaaagagaagagacctcggggccggccggattaatcattagtactattgattagtattattgaaacagaggcattgccgatactcacgccggcgaccgatgggatcggagggtgagatcaccggcccgctcctcgcgtcgggcgccggcgcgccggcgccggaggcggtgcccccgtggcgggagcaggtgacggctcgggggctggcggtcagcgccgtcctgggggtgctcttctgcctcattacgcacaagctcaacctcaccgtcgggatcatcccctcgctcaacgtcgccgcggggctgctcggctacttcctggtccgcacctggacggcggcgctcgagaggttcggcgtcgtctccaagcccttcaccaagcaggagaacaccgtcattcagacatgcgtcgtcgcctgctacggcctcgccttcagcggggggtttggaagctatatgcttgcaatggaccagagaacctatgaacttatcgggccagattatcctggcaacagggccgtggatgtcaagactccttcactgggctggatgattggattcatgtttgttgttagcttccttgggctgtttagtcttgttgcactacgcaaggttatggtaattgattacaagctgacttatcccagtgggacagccacggctatgttgataaatagtttccacacaactactggagctgagcttgcagacaagcaagtcaggtgtcttgggaagtacttgagcattagttttatatggaactgctttaaatggttcttcagcggtgttggagattcttgtggtttcgataatttcccttctttgggacttgcagcatttaagaatacgttttattttgatttcagcccaacctatattggatgtggtcttatttgtccgcatattgttaattgttctacacttcttggtgccataatatcgtggggtattctttggccatatatctccacaaaagctggggactggtatccagctgaccttggaagcaatgacttcaaaggactctatggatacaaggtttttatatctgtatctgtgatacttggggatggtctttataacctcatcaagatcatttatgctactatcaaggaaataatgaatgcacgggctaagcaaggaagactgccactagcccaagttcaggatggcgatgaaggttcaaatttatcagctgaggaaaagcatctgaatgagacattcataaaggacagtatccctccctggttggcaggatctggttacattggccttgcagcaatatcgattgcaaccgtcccaatgatctttccgcagatcaagtggtaccttgtcctctcggcatacgttgttgctcccctcctcgctttctgcaactcatatggcactggactaacggactggaatcttgcgtctacatatggaaagatcggcctcttcatttttgcatcatgggttggtcagaatggcggtgtgattgctggcttagcagcctgcggtgttatgatgtccatcgtgtccactgcagccgatctcatgcaggacttcaagaccggttacctcacactctcttcccctaggtccatgttcgtgtcgcagttgatcgggaccgcccttggttgtgtcattgctccactcaccttttggctctactggtcggctttcgatattggtaaccctgacggcgcattcaaagctccatatgctgtaatcttccgtgagatgtcaattcttggcgtggaagggttttctgcactgcctcagcactgcctagcgatctgctcgtttttcttcattgcatctctagtgatcaacctcctcagggacgtcaccccaaagaatgtctccagattcatcccaatcccgatggctatggccattcccttctacatcggtgcgtacttcgccatcgacatgtttgttgggacagttatccttttcgtctgggagagggtgaaccgcaaggagtgtgatgacttcgcaggtgcggttgcctctggcttgatctgtggtgatgggatctggactgttccttctgcgatactgtcaatccttaggattgacccgccaatttgcatgtacttcaagccatcccttagcagctaaagttgggacaagtgttatccattttctgtatatcaaaataggacctaattgtgtatatctttaatttactacatgtaaactgttctaggaagaaaagctgtagcctaatgcaatctgttgattcttatttgcgtatgataatccagcattcgtttatcctggttctgtgttcgacgcggacgccggcc

SEQ ID NO: 17287 - DNA, 999 bp, Zea mays
aagggcctccctactccacctgagcgaggcccgctggaacgagggcgacatgcacggcacgctgctctcggagaacgtgatcggcgtcatccacgaccactacgtgaccttccgcctggacatggacgtggacggcgccgacaactcgttcgtgcgcgtggagatggcgcggcaggagacgggccccggcgatgagtcgccccggaggagctacctcagggccacccgccgcgtggccgagaccgagaaggacgcgcgggtgcgcctcagcctctacgatcacccggcggagttccacgtcgtcaaccccgccaagaagacgcgcgtcggcaaccccgttggctacaaggtcgtccctgccggcaccgccgcgagcttgctggacccggaggatccgccgcagaagaggggtgctttcacaaacaatcagatatgggtgacgccctacaacaagagcgaggaatgggccggcggcctgttcgtgtaccagagcaaaggggaggacactctggatacttggtccgagagagaccgtccgatcgagaacaaggacctggtgctgtggtacacgctggggttccaccacatcccgtgccaggaggacttccccatcatgcccaccgtgtcgtcaagcttcgacctcaagccagtcaacttcttcgagagcaaccccatcctcaagcagcgcccgaccaaggaggatgatctgcccatctgtactgcctccaccgccgcgtagcctactaggagggccgggggcgaactgattaaccggggacccatcaatcagcttgcatgcattgctgtgtgttgtgctcttgctaagctttattagtacgtatacgtacgtaccacgaacctaatgcatgggccatatcttatttgtcgcggtttagttatgggtgacaaataacctagaacggagatattatttgttatgttatataaatgagaactttgatatgatctgctaattaacccgtggagctagtggttgtg

SEQ ID NO: 17288 - DNA, 728 bp, Zea mays
gccgcgataccctgtggatcacaattagcaaatcacccatagataacagcgatcgagtcagcgatggccgctgtccgtcatgccactgtcatcttcctcttcctcaccatcaccttcgccgccatggccaatggcgctggagagaccgacccggaccccgcgcgcgtcgagaaccccgtggactgcatgatagggtgcgcctcgcggctgatcggctacgccatgcagacgatggagtgcgccgtggggtgcgcgggagaagggagggggagtgccgttgaggagaagcacgcggccgtctttcgtgaggccggccgtcgtcagcacgggctggagaattagtgtactgcaatacgtgtgattaatgtgaatcttttttttttttgaaaactgctatatactgtattctcatcctgccccggtagcggaagaaaattaggaggggacggtcctcatgcatagagcaaccgtggacatctctatggtagatttgcgacagttaaaaatgaattaaattgtcgtgggtttgcaacgccaaggactagattggaaacttgaatcggcttcaggattttttagagtggctagattgaaaacataaatcctcttccatgttccctagagttgagtgaaaaattagcttatttttccctcaattcccacgaatcacagagaagatttaaatttctaagggctagctagctccattgccaaaaaaaaaaaaaaaa

SEQ ID NO: 17289 - DNA, 1210 bp, Zea mays
aatgtaaatgaaaccatcattagtccactcacaagtgacaagatatatcttagacattttaagtttgataatggatccaagatatgttactttattcatcttcttagtacttgccttacatggagatactactttggcagaaacttgcaggcagtttgttaaagtgcatccattctgctttaaagcaatgtgcaaggcaaattgtgctatagagggaaaattctctgatggttcctatgtaaaggattacagatgtgaatcaggtggatttcactcggtgtgcgtttgcattttgtgcaaacattagttatctaaagacaagcggagatatcttcttgtattcctatatgttatttaggagtattgtccaaataattatacggtagcttagttaactagctagtttgtttatttatagacatatgtagcactagttaactagttgttatttcttaaattctcagctatataccaggaaacatgttttcagcgcttcaataatatatctttgttctcccttattataaagttcaatactttttgttaacttctggtttataatcttatttactcaaaagttctatatatatatatttcaatgtgtccatgatatagttgtacaagtagaatcacatgttcatcatgtcccgccccacgcctgtccacgagccgcatcacccagcactagatgtggtcattcgggttacccgaaaaaatagggtcaggtaattcgagtttttcaaaatacgtattttaaaaaccgctacccgaagtgtaccaaaataagcagatacctaataatttgggtacccataatttcgggttcaggtaatcccgatttacccaatcagctttcatccactgcaatatattaatatttcaaacaaataaagaactactacgttaatatattaatatttcaaacaaataaagaactactacgtaaacatataacataacttctacggatttacctaaaattaaatgatatattggagaagaagatgatgtcgacttcaattagagcccaaattgtaaatcatatcaggctcacaacgacagggcaaaggcttccaaattcgtcattacatactgcaccagacgcaaagaggcagccatgattgtcttacactactgtcttccactataagtatttttaattattcattatcaaggtagtataagccagcttagggaccaaaacaaataa

SEQ ID NO: 17290 - DNA, 546 bp, Zea mays
atcattactccactcacattcgacaaaatatatcttagacaggttgagtttgacggtaatggattcaagatatgttaccctatgcattttcttagtacttgccttacatggagatactactttggcagaaacttgtaggcagtatgttgaagggcagccattctgctttaaagcaatgtgcaaggcaaattgttttatggagggaaaattctctgatggttcttatgtaaagggttacagatgtgaatcaggtggattccactcggtgtgtgtttgccttttgtgcaaaaattagttgtctaaagacaaggggagatatcttcttatgttcctatccattatttaggaatattctctaaataattatacgatagcttagttaaatagtttctttatttatagacaaatgtagcgctagttaactagttgtgatttttaaaatttctcagctatatgttaggaaatattttttaacacttcaataatatatctttgttctccctttaaaataaagttcaatactttttggccgaaaaaaaaattaat

SEQ ID NO: 17291 - DNA, 8379 bp, Zea mays
  misc_feature (8061)..(8061): n is a, c, g, or t
  misc_feature (8068)..(8068): n is a, c, g, or t
  misc_feature (8086)..(8086): n is a, c, g, or t
ggcaggatgactttgttaggtttccaacgaacagaggcagggtgcgcgcatgcagaaaagggcattgggcaaggctgccggggaacgaagtgagcggccgtatctccgcatacaggctccctggatgcatgctacaaagaacttggatctccacatacagggtcagctcggctaggctgctcccgccagacaaccaaacatacatgaagtcaccacatatgccttgttatcaatgggagcgttgtataccaatcaaagtatagaaacattaaactctaaattaatttaaaaatatgagcaccatgccaagttggtttgaacacacagttacactgataggttggtttcactaaacaaactaaaccaagtgactttaaaaataataaaatttggatttacggtacacgccacttatgttttcagatagagtacaactgtactgtgttaataggattgccgttgtcccacggtacaatttctcgtcatcgtatcaaaaaaagtatcatgatgtaattgtaaaaagctgctccgttgcaaaacctacaaaaatccgttgcacccgctctcactcgaacctgatgcccacgcttgcgggacccgcctgctctgcctcccgagacgtggtcccacgctctgcgggccgtaacagaagtgggtaacttttcggtgggtgcggtgcggtcaggctcagcgacgcagactaatatagatatagatgaaaataagatatagatatagatataaatgaaaccatacgtctagctccagatccatcgttagagcttctcgggaggattagcataaattctaaggacttataatctacaatacaatcacttcttgcgtggatgattcttttcccatcatgcacacacaggaggacaaaaatgggagaaaaaaataaactaaaatcgattgcatccgtatagctttacgccataaagtacgtactctgtggcgtaggcggtaggcgtacgcgtactgcgtgagagcacgaggaccaagcccacttgatccgccgtaaacgctgcgcttcattgctccgtatatcccaacacaatacgctagcatgtgacccccatggcccaccgtccagacgctgtgatacctgacacatttcaatacccatcaagacatcgacgacgtactcacttgtcggaggggttctgtgaataccctactagcgccactgacatatgagccccccaagtttcagagagccgtgtcctctcctctcccaccgcacagtcaccacaccagaatgggctcaagcaagccggctgatgccgaggcgcgtcggcgcgcgcgcgcgcgtgagctgaacctgacccctcgagctcaacctcaactcctatgcttgccacacacctcctacttcgcttgccccgaagctttctttaagcacccccaagtgcccggccaaaataatccgtgcactacggcgacagtggtgctcgcctgttgtataaaagaacaaggcgaacagcgggtgctgctcgaggaggaagaagaggagcggcttttgagctctgaggtctcggtcaccgcccccccaccccaccaccaccaccaccactgggtttttagatccaatgccaaggccgtgaggaagctagctcttgcgtcgggaggaagagccgaccagagaagctcggagcgcgtggcaatggcggagggcgatgcgggaaaggcggaggcggggagctgcagcgccgccgccccctccggcgccggcgggtgcgacgcggtcaagaagcggccggagcagagcgtggcgttccacgagctgttcggcttcgcggacccgctggactggctgctcatggctgcggggagcgcggggcgccgtggtgcacggcgccgctatgccggtcttcttcctcctcttcggcgagctcgtcaacggcttcggcaagaaccagcacaacctccgccgcatgacggacgaggtgtccaaggcacgtattgttcgctcgtggctctccgatccgttctggcttcgcttgctgtttctctactacgccgctatatggttattgactgacgctgacgctctcaagcatctgcttccagtattcgctctacttcgtctacctcggcctcgtcgtctgcgcctcgtcgtacctaggtgggtgccctcgcgcttgcctcctatcctagccggcgtcgcggccggcgtcatggtcttaaagcctccgtgcttccctgctccgtttgcgcgcagagatcgcgtgctggatgtacacgggcgagcggcaggtgggcgcgctgcggaggcggtacctcgaggccgtgctgcggcaggacgtgggcttcttcgacaccgacgcgcgtaccggcgacgtcgtcttcagcgtctctaccgatacgctcctcgtgcaggacgccattggcgagaaggtgaccaagccaagccccccttgccctgccctcctagtcctgcctcgccacctcggttggcatgattccggccggggtgcctaaagatctagaacaacgtttgcttgcaggtcggcaacttcatccactacctcgcgacgttcctggccgggctggtcgtcgggttcgtctcggcgtggcggctggcgctgctcagcatcgccgtcatccccggcatcgccttcgccggcgggctgtacgcgtacacgctcactggcctgacctccaagagccgggactcgtacgccaacgccggaatcatagccgagcaggtagcgcgtctctctcccccgaccactgatacgggcacgcactatttccatgccaacaaatcgggatggctgggcgggcaaggtcactgtggagtgtgggctcgttccggtcaaagagtccaatgcagggaggtagctgggcacatggcatcaacatgatgtcgttttggatcctttcaagctttcttgttagatccaaccagctcttttcggaggataatctcccgttcccatgtcgttttgcacctttttcacgaagtagctctacttggctactacttgctatttgggtgacaagccaaaatgtgaaaagaaaatgcacttcctttatgcatatttgttagcaattctgatgccaaggtttccacctttctatcgcctaggccattgcccaggtgaggactgtctactcctatgtgggtgagaccaaggccctgaattcctactcggaggcgattcagaacaccctgaagctgggttacaaggccgggatggccaaggggcttggcatcggctgcacctatggaatcgcctgtatgtcatgggcgctggtgttctggtacgccggcgtgttcatacggaacggccagacagacggtgggaaggccttcactgcgattttctcagcaatcgtcggtggcctgtcagtacccaaaaaaaaactgccttttctgctttcgcagcatgaaccaatgtaaaccaactcgttgatcgcaggagcctggggcagtcgttttcgaaccttggagcgttcagcaaagggaagattgccggctacaagctgctggaagtgataaggcagaggccaacgatagttcaggacacggcagacgggaggtgcctcgacgaagtgcatggcaacatagagttcaaggaagtggccttcagctacccttcccgcccggacgtcatgattttccgagacttctccctcttcttccccgctgggaagaccgcggccgtcgtcggaggcagcgggtctgggaagagcacggttgttgctctcattgagcggttctacgatcctaatcagggtgagcaaatgagctgcgcgcctcatgtttgttgtcactagtcagtctatttagtttctaacaagtggtcgtgattgttgcttgctgcaggcctgcttttactcgacaatgtggacatcaagacgctgcaattgaagtggcttagggaccagattggcttggtgaatcaggaacccgcacttttcgcgactacgattcttgagaacattctttatggcaagcctgatgcgacaatggcggaggtcgaggctgcggctacttcagctaatgcccatagcttcattgctctccttcctaatggctacaacactcatgtgggtcctacttgtacttctactccaatttctaatggtatttgcgcttcattgctgttttgatttcgaagcccttgatttcttgtcgatcacacaggtgggagatagggggcttcagctctccggtggtcagaagcaacgcatcgccatcgcccgcgcgatgctgaagaacccgaagctcctgctactagacgaggccaccagcgcactcgacgctggttcggagagcatcgtccaagaagccctcgaccggttgatggtcggcaggaccaccgtcgtggttgcccacaggctatcgaccataaggtgtgtcgacatgatcgcggtgatccagcaaggccaggtcgtggagactggcactcacgacgaactcctcgccaaaggaagctcgggagcgtacgccgcgctcatcaggttccaggagaccgccaggaaccgcgcgtgcccgtcgacccgcaagtccaggtcgtcccgtctgagcaactccctctccacccggtcgctgagcctcaggtcggggagcctgaggaacctgagctactcgtacagcaccggcgccgacggccgcatcgagatggtttccaacgccgacaacgaccgcaagtacccggcgccgaggggctacttcttcaagctcctgaaactgaacgcgccggagtggccctacaccatactgggcgctgtcgggtccgtcctgtccgggttcatcggccccacgttcgccatcgtgatgagcaacatgatcgaggtgttctactaccggaaccccagcaagatggagagcaagaccagggagtacgtgttcatctacatcggcaccgggctgtacgccgtcgtcgcctacctcgtccagcactacttcttcagcatcatgggcgaaaacctcacaaccagggtgcggaggatgatgctcgccggtatgtatggatccacagggcacgtttctggattaaacatgagtacgttttaatttattgaaaaatttcccccattgcagtgattttgaggaacgatgttgggtggttcgatcaggaggagaacaactcgaaccttgtcgccgctcgcctctccacagacgccgccgatgtgaagtcggccattgccgagcggatatcggtgatcctgcagaacatgacgtccctgctcgtgtccttcgtggtgggcttcatcattgaatggcgggtcgccctcctcatcctcgtcaccttccctctcctcgtgctcgccaactttgcccaggtaattaattaaccacactggaacactacgtactcgcgtttacttcaattgcttactcagccatggcgacttcgagtttataacaagttgccggattccgctcagtagtttagctcagtagtcatcgcgtttacttcaagctcgccaacgccctcacctgcgctcaggcagccgttgaagctgggcttgtgaatgagctggagacaagagggcgcaatttaaattcatgagcacgtcatggtaggatccatggcccatgccgcgtctgcctctgccgcaactggcatggattactgtgcgcgacatgtgcgcgcccactggcaagcttgctctcacccctcctttaatcccatggccatcggcaagtgcacgttctttgttcattgaactcggtgcaaataactcgccaaaggacggctcccgacggagttttaggcacggcgccattgatcgcggccgcgagcaagcagacagctttgtttgcttgcccaaatgtgtttgtttttcagagcgacgaggaaggagaaggacccaaggacgcggtgcacggcgccctggtccatggatagggttcctggcttttcaggtttctcacgcccgtggctgcctgtcgtggtcctcccgtccttgggcctgcgtggcctgccgcgtctgtgtctgtttgcacggacgcctcgtgcacgggaatctgggggctttgcctgcctctgcttgctgctgcagcggctttacgactggcagtcccgcacatggccgtctcgcagtcgcaggctctctgcggccgtgtcctgttgccgtgatggcgtcgtgtctgcggcggggacagtgccggcgcagagcgcgcccctgccctctcgttttcgcgccacagggccatgccccttgctcgcaataatttgctgcggtgattcgtagagatcgcgtgacgcgtgcttaaggcttaagcgtgcatgggatgggagccagccatgggccctctggttcgttttcggtgatgggcatggtccatgggccgggcagcacttccagagtttcggacgaatgcacatcgctgaataattgcgtcggtcgtacactgcatttttttttcgtgcttgcaattcgcatgtgtatgctactgtttgctttttctgtatatgtggatgacgatgacgactaacaaaccgactgacgcttggtttccggccatggcagcaactgtcgatgaagggcttcgcgggcgacacggccaaggcccacgccaagacgagcatgatcgccggggagggcgtgagcaacatccggacggtggcggcgttcaacgcgcaggacaagatcctgtccctcttctgcagcgagctgcgcgtgccgcagatgcacagcctgcgccgcagccagatctccggcgcgctcttcggcctctcccagctctccctgtacgcgtccgaggcgctcatcctgtggttcggcgcgcacctggtccgcacccacgtgtccaccttctccaaggtcatcaaggtgttcgtggtcctggtgatcacagccaactccgtggccgagaccgtcagcctggcgccggagatcgtgcgcggcggcgagtccatccgctccgtgttctccgtgctcaacagccggacccgcatcgacccggacgacccggacgcggagcaggtggagtcggtgcgcggcgagatcgacttccggcacgtggacttcgcgtacccgacgcggcccgacgtgatggtgttcaaggacctgagcctgaggatccgggccgggcagagccaggcgctggttggggcgagcgggtccggcaagagcaccgtcatcgccctcgtcgagcgcttctacgacccgctcgccgggaaggtgatgatcgacggcaaggacatccggcgcctgaacctcaagtccctgcgcctcaggatcgggctggtgcagcaggagcccgtgctgttcgccaccagcatcctggagaacatcgcctacggcagggacggcgcgacggaggaggaggtcgtggaggcggccaaggtggccaacgtgcacggcttcgtcagcgcgctccccgacgggtacaggacgcccgtgggcgagcgcggggtgcagctgtccggcggccagaagcagcgcatcgccatcgcgcgcgcggtgctcaaggaccccgccgtgctgctgctggacgaggccaccagcgcgctggacgccgagtccgagtgcgtgctgcaggaggcgctggagcgcatcatgaagggccgcaccgccgtgctggtggcgcaccgcctgtccaccatccgcggcgtcgactccatcgccgtggtgcaggacggccgcgtggtggagcagggcagccacggggacctcgtgtcccgccccgacggcgcatactcgcggctgctgcagctgcagctacaccatggctgatcctgcgcctggaatagatactggagggcgcacggccggtgtagatactggagggcggtgttagcgtggcgtggctcaaccgtggccggagaagacgtgttttgatgtgaacgatcaggattgtgccgacaaacaagtgatgccgtattcttcttgcactcctgccggctctgccaatgtttagatcatcccctcctagtaattctcacacctttttttttcttcctttgagaagatcctagtaattctcagatggacccaattgtttgatgtgtaacggtcagaagccagggttcgtctttgctacttgtctaggagttgttgcctctaataattgggcttcaaacctttacgaagggnatgctgncttggaaacagcccttgncagttgcagcagccacggagagcgtcactggatctgggtgtccgctgccgccgacatctctagcggagtaacgagaaagcctttggatcgatccataattcgtgcaggctgctttgtaagcacgttatacagcttaaacctctatagtaatatttcgtgcaggtaccttatgttgctacggtttctctatattatatataggtctttttttacatgtgatagttattcaaatattttaaacctatatagtaatattaaccatgaaaataatatcttttacaagtgtaccgtca

SEQ ID NO: 17292 - DNA, 893 bp, Zea mays
acagcgatctagaacacgcaaggagccaaggacccacgagaagcgaagagtcggagaatgacgttgcgatgggcgacgcggcgccgtctcattcgcctggcaccgttggcggcgacgagagggcggtggtggtgtacggagacggcagcagcagcaggcagatcgacgccccgcgcctcgccctgcgcgccggtgtggacgcggattggatccgtgtcatgttccgggaggcgaacagcaggaccgtgcgtgagctgctcgccggcgccgccttggaacggagatctgagcccgatctcgccctggccgtcgtaccctgggtggcggtggcgccgacgacggcggaggagaccgcagaggcgtccaccgccgttgaggcagcggacgacggggccgacggcgagggtgcggctgcgatggacgtcgagcaagacgaggggcaggaaggcggccggacctggaccgacgccgccgttggggaggggttggtgtacaggtggccgcagcactgctgggctagcccggtgatgtggtcgtgctgaacgtcgtgtggtattgggtgtgtgctgccgactgccgtagcagtagacagattgtagagcagccacgtgtcgagtgattccagctgggaatggggatgggaccggtcgccattgccgatggcatgggaggccttgtcgttctcgccatgacctgttcgttgccgagatcgatcaggattcgattagcctggttgctggttgtttttcgttcagagtcgcacgggtactttcgacaattccgtgctctgggggctggggcagtgttgctgctgatatttagtagtgggctcaaagcagagcctgtcgctagcgcaaatcatgatcttcttctgagcgaaaaaaaaaaaaaaa

SEQ ID NO: 17293 - DNA, 566 bp, Zea mays
accacagcgatctagaacacgcaaggagccaaggacccacgagaagcgaagctagtcggagagcagaggaggggccctaccaacaacgacggaccaaggtagttgtgcgagtgtgacggcggcggcgatggtagtgctcacggaggagttccacggcctgtcgctgaagcggaagggcgcctacgagccgggcctcttcgacggcgccgacgaccgctcctccgggctctcgctcccctgccgcgccaccaagatgcggcgcctctcgtgtcctgatggccctagcgacggggacgaccagaccgtgacggcggcgtcggaggatgacgttgcgatgggcgacgcggcgccgtctcattcgcctggcaccgttggcggcgacgagagggcggtggtggtgtacggagacggcagcagcagcaggcagatcgacgccccgcgcctcgccctgcgcgccggtgtggacgcggattggatccgtgtcatgttccgggaggcgaacagcaggaccgtgcgtgagctgctcgccggcgccgccttggaacggagatctgagcccgatctcg

SEQ ID NO: 17294 - DNA, 579 bp, Zea mays
actaggtaggaaatatcctggcgccgggaggatctgatccaggacaatcatgggccagatgcaaagctgatgtccgaaactgtacttccacacagattgaagcactgaatgggttccggaggaacttgttgaggatttgaaggttgctcaacacaagaggggctgggggctgttcatcgattcatgcttcaaccactgccaaacgccattcggggccacctggcattcgcccatctccctgagactcggtaacaagacgatcgctgaagctgttgcggattggtacgttggtgagaaccatggagtggaggagattgactgcgcgtttccatgcatcaaccccacatgcagcagccagctcgatctgtaaacaagtggagttttgctcttcgcaactgcaaaccagaaacgaatcgaatggcctgtaataagtggagtcttctgtcttcctcccacagagtcttcctgtgtgctgtggcatgcagtagtgccggtcctgatattttagaggtctggggcaaaatttataatgaaggtccttgataatattaattattacgcttaaaaaaaaaaaaaaaa

SEQ ID NO: 17295 - DNA, 1468 bp, Zea mays
cgcagctgcgactggtgtgcatgttgcattgttggctctcaaacgaacgcgtggttgctgcgtgcacgcaatgatgctgccatgcatcgtttgggctcggttgcccggtcgtttctactcgtcaatccaccagccaaatttggagagcggccaggcggtttcgccgccgccgaccccggcgagcccccgtcgcagcgcacgagaccattacctagaacatcctaatcgaaaactccacccacgccttccttccgcggcatccgatccatcttgggcgggcgccgcgcgtcgagggccagccaaagcttgccatggcggccgtccggtccgacagggtccaccaccaccaccgccgctccgaggcgtcgtgtccggcaacctccgcggccgtggcggcggcgagggccgatgacgccctgcgccagcgcccgcgggggctcgtgcaggtccgggagcgggaccagggcccgctgtcgacggggcaccagcacctgcaccaccatcaccaccagctgcggcggtcggcggcgttcccaccccgccgcccggggccggggcgccgccctcctcagcgctgcgaaagcgacctcaacatcagggagcaccgctcctgcagcgaggtggccggcggcaccgcggcgggctgcgccgctgtgtgctgctgcttcccctgcgtcatggtggaggtcgcggtgctcgccacggtgcgcgcgcccgcggcgctgtgccgcaaggccgcccgcgtgcgcaagggccgcaggcgctctgcctccgcgggccaggccacggagatatacgagctcctcgtggacgacaccggcgtcgtcgaggtggatgccggcgccgccaatgcggtggcgctgcccgtgaagcccgccttgcagctggaggaaaagggggagctggagaaggaggtgtgggcgaggttctacggcaccggcttttggaggagcccgtcgcagctggacgacaacgacgacaggtgatcgggacaggcccgcgagcgagctatccacaagctcctccggcgatgcgtgggcttccttcgttttccgcgggaagaagagaggatcgaggaaagggaaacatgattgtgtgttcgatactacgattacgaacttcgttttcccttcttttttgtttgtttggaaggggaaatacttctcttctattctacaacaatgtcacgtacatgcaatgtaataataaaaaatgtatgtgatatatttaacaatgtgattgatgattgataaatggaaatggaaaatgcttgggcaaaaaaaaaaaaaaaacgaccacgacaatctggagccttggatgtgcgccgcgcacattttctcgatcgatcgaaagttttgtccatccatcttgttcaggggtctctaggtctggatgtcaggttcatctatcagcagccttggtacaggctttcccaattgggcctagggcctcatatgtcatatctaca

SEQ ID NO: 17296 - DNA, 800 bp, Zea mays
gcaccagtcaacatcagaggggtaaaaggcaaaggccaagctctctaatggagcgccggctgctcgccccccccgtctcaatgcgtgataagcgaaacgctgcgcgtggccaacctgatcagcggggtgttcaggcgtgcgaacaccgacatccacttcaaaggctacgtgatcccaaagggctgcaagatcttcgcgtcgttccgagccgtgcaccttagcctggaccactacgagaacgcccggaccttcgacccttggagatggcagcagggcaagagcaagctgcagagcgcggaaggggccagtctgttcacgccgttcggcggcgggccgcggctgtgcccgggctacgagctcgcccgggtggtggtttccgtcttcctccaccacctcgtcacgcgctttagctgggaggaagccgaggaggacaggattgtcttcttccccaccacgcggaccctcaagggataccccatcatcctacggcggcgaccggattgcgatgatctctgacctcatggctatgttctccccccttatcttcttcggatcaaggccgaaggctaagcattagatagagtaaggtggatgtcgtggctagtaggtgcatggtggtttctgccactcactcactcactcactctgttgtctgtttgttcctgttcctctctgttttctcttgctctgtaacctggacctggtacgagtcagcagccagcagcaaactcgcgttttgcctgtaaaatctaaaatctgatatgagatgcagatgcccccgcgactgagacggaaaaaaa

SEQ ID NO: 17297 - DNA, 1906 bp, Zea mays
ccacgcgtccgatctgtcactccccgacacgcgcacgagctccactccccactccgcacccaacccaaggcgccactgccatggacgcgggcggtccgccgccgctgttcctcctgggcgccgtgctggccgcggcgctggggtggctgctcgtggtctggcgggcggcggcggggcggcggcggtccgcgtcggcgcggctgccgccggggagcacggggctgccgctcatcggggagacgctgcggctcatcgcggcgtacaagtcgccgaacccggagccgttcatcgacgagcgcgtggcgcggcacggcagcggggtgttcacgacgcacgtgttcggcgagcgcaccgtgttctccgccgacccggccttcaaccgcctgctgctggccgcggagggccgcgccgtgagctgcagctacccgtcgtccatcgccacgctgctgggcccgcggtcgctgctgctcacctcgggccccgcgcacaagcgcctccactcgctcacgctgacccgcctcggccgcccggcctcgccgccgctgctggcgcacatcgaccgcctcgtcctcgccaccatgaggggctgggaccgccccggcgccggcgccatgcgcctcctcgacgaggccaagaagatcaccttcaacctcaccgtgtggcagctcgtcagcatcgagcctgggccgtggaccgagagcgtccggcgcgagtacgtgaagctcgtcgacggcttcttctccatccccttccccttcgcctccctcctcccgttcaccgtctacggccaggccctcaaggcgaggaagaaggtggccggagctcttcgggaggtggtaaggaagaggatggacgacaaggcggaggacgactgtggcgccagtaagaagaacggggagaagaaggacatggtggaggagctcctagaagcggagggcgggagcttctccgtggaggagatggtggacttctgcctgtccctgctggtggctgggtacgagaccacctccgtgctcatgacgctcgccgtcaagttcctcaccgagacacccaccgcactggcgcagctcaaggaagagcacgacagcatcagaggggtaaaaggcaaaggccaagctctggaatggagcgattacaagtcgatgccgtttacacaatgcgtgataagcgaaacgctgcgcgtggccaacctgatcagcggggtgttcaggcgtgcgaacaccgacatccacttcaaaggccacgtgatcccaaagggctgcaagatcttcgcgtcgttccgagccgtgcaccttagcctggaccactacgagaacgcccggaccttcgacccttggagatggcagcagggcaagagcaagctgcagagcgcggaaggggccagtctgttcacgccgttcggcggcgggccgcggctgtgcccgggctacgagctcgcccgggtggtggtttccgtcttcctccaccacctcgtcacgcgctttagctgggaggaagccgaggaggacaggattgtcttcttccccaccacccggaccctcaagggataccccatcatcctacggcggcgaccggattgcgatgatctctgacctcatggctaggttccccccttatcttcttcggatcaaggctgaaggctaagcattagatagagtaaggtggatgtcgtcgtggctagtaggtgcatggtggtttctgccactcactcactcactcactctgttgtctgtttgttcctgttcctctctgttttctcttgctctgtaacctggacctggtacgagtcagcactcagcagccagcagcaaactcgcgttttgcttgtaaaatctaaaatctgatatgagatgcagatgcccccgcgactgagacgggaaaaaaaaaaaaaaaaaaaaaaaaaaaa

SEQ ID NO: 17298 - DNA, 1815 bp, Zea mays
ctataaataaataccgcccaccaacatctggtggtatcaaagaatctcctctgtatctctggcagccgcatcgtctcaatctcagtcactcccggacacgcgcacgagccaccccgcacccaactaaccaacccatggacgcgggcggaacgccgccgctgctgttcctcctggccgcggcggccgccctgctgggcgcggcgctcaggtggctgctcctggcctggcggtcggcggcgaggacggggcggctgccaccgggcagcacggggctgccgctcatcggggagacgctgcgcctcatcgcggcgtacaagacgccgaacccggagccgttcatcgacgagcgcgtggcgcggcacggcagcggggtgttcacgacgcacgtgttcggcgagcgcaccgtgttctccgcggacccggccttcaaccgcctgctcctggccgccgagggccgcgccgtcagctgcagctacccgtcgtccatcgccacgctgctgggcccgcgctcgctgctcctcaccgccggccccgcgcacaagcgcctccactcgctcacgctcgcccgcctcggccggccggcctcgccgccgctgctggcgcacatcgaccgcctcgtcctcgccaccctgcgggactggggccggccaggcgccggcgccgtcgtccgcctcctcgacgaggccaagaagatcaccttcaacctcactgtctggcagctcgtcagcatcgagcctgggccctggaccgagagcctccgccgcgagtacgtcaagctcgtcgacggcttcttctccatccccttccccttcgcctacctcctccctttcaccgcctacggccaggccctcaaggcgaggaagaaggtggctggagctcttcgggaggtgataaggaagaggatgggcgaggaggccggaactggccctggcgccggtagaaatggggagaagaaggacatggtggaggagcttctggaagcagagggtgggagcttctcggtggaggagatggtggatttctgcctgtctctgctggtggctggctacgagaccacctccgtgctcatgacgctcgccgtcaagttcctcaccgagacgcccactgcactggcgcagctcaaggaagagcacgacagcatcagacacaggaaaggcaaggacgagcagcctctgcaatggagcgattacaagtcgatgccgtttacacaatgcgtgatcagtgagacgctgcgcgtggctaacttgatcagcggggtgttcaggcgggcgaacaccgacatccatttcaaagattacgttatcccaaagggctgcagaatcttcgcgtcgttccgagccgtgcacctgagccccgagcactacgagaacgctcgagccttcgacccctggagatggcagcagagcaagaaggagggagtactagtagtagggcaggacgcgcagcagggggccagggccagcgtgttcactcccttcggcggggggcctcgcctgtgcccgggccacgagcttgcccgcgtcgtggtctccgttttcctccaccgcctggtgacgcgcttcagctgggaagaggctgaggaggacagggtcgtcttcttccccaccacccgcaccctcaaagggtaccccatcatcctgcggcggcgaccgggttgggatttctgacctagctcatcatgttacaatagagtcgatccatctatagttgttacactcatctctctctctctctctctctctgtctgtaataacactactgtctaatataaacaagcatctccgctctattctgttcagaaaaaaaaaaaaaaaa

SEQ ID NO: 17299 - DNA, 1363 bp, Zea mays
gcacgagaccattacctagaacatcctaatcgaaaaaaagcggtgggccgcgcttccttcctcagtcctcactactcactcgtccccttccagttccgcttccgatctgcgcttcgatctccctcttcgcagagttgtagagcaatgcttatgaattttgacgagtccatatgtaagttgacaaaatttgctagggagagggactgcaggtgcttgtgagcatgtatctgctaggcaacaaaagtggaaagaagaaagtgtatgtcgattatatgaatgtccctctaccgtatgccatcgaagagaattacggtgggcgcttctttgacgacgacgacgatcttgcccaagttcttcaagatcaggaaatattgtatcatttaattcaaggaagtaatggtggtggttcatctagaactcattcgattccaagttctagctatggccatgatcggacatcaaatgcacaaaaattgtcaggagatgtaaactgtgagtgtgagttgcaactagcagttgatgaagctttagctagagagttgcatgaaatggagagcaaactagccaacacttcacttaatgacaataatcgaagaaagacaacatcatcttcagcatttgatagaggcaataattctgcaagtagacctcctcaggtattggaggaggatgtgattgatccagataatatgacgtatgaggaactgcaacagctaggggaagccattggtacccaaagcaaagggctgcctgaaagtgtcatagcactcttgccaacttcaacttacaaaactgggatattctccagaaaggaaaaacatgatgaatgtgtgatctgttgtatggcatacaagaaccgagataggctgactaaattgccatgtggacatcactaccatcaagcttgtgttgctaaatggttacagatcaataaggtatgccctgtttgcaataaggaggttttcagctagcagtatcaaacagtgcagattcgtctgatggccaactccagcaaccgtctgtagtactgcatagatgtgcattatttgtataagcatgctgccctgttgctggcaggtaatgcgccgcattgctcaaggaccatatcacggccaaattagtgatatctccagcgaaagcaataagatctctgcttttgaactttttgacattcagagtttcagacttggtgccacactacagtcctttttatcatcgcctgtatactattcatttcagtatcttgtctccagtccattcagcatactttctggaatgttgcaacttggattgaaacagcgagaaatgttgaaatttaggcactggtatttttttaaagtgaaaaaaaaaaaaaaaaaacagg

SEQ ID NO: 17300 - DNA, 1263 bp, Zea mays
cattttcagccaaagcggtgggccgcgcttccttcctcagtcctcactactcactcgtccccttccagttccgcttccgatctgcgcttcgatctccctcttcgcagaggtgcttgtgagcatgtatctgctaggcaacaaaagtggaaagaagaaagtgtatgtcgattatatgaatgtccctctaccgtatgccatcgaagagaattacggtgggcgcttctttgacgacgacgacgatcttgcccaagttcttcaagatcaggaaatattgtatcatttaattcaaggaagtaatggtggtggttcatctagaactcattcgattccaagttctagctatggccatgatcggacatcaaatgcacaaaaattgtcaggagatgtaaactgtgagtgtgagttgcaactagcagttgatgaagctttagctagagagttgcatgaaatggagagcaaactagccaacacttcacttaatgacaataatggaagaaagacaacatcatcttcagcatttgatagaggcaataattctgcaagtagacctcctcaggtattggaggaggatgtgattgatccagataatatgacgtacgaggaactgcaacagctaggggaagccattggtacccaaagcaaagggctgcctgaaagtgtcatagcactcttgccaacttcaacttacaaaactgggatattctccagaaaggaaaaacatgatgaatgtgtgatctgttgtatggcatacaagaaccgagataggctgactaaattgccatgtggacatcactaccatcaagcttgtgttgctaaatggttacagatcaataaggtatgccctgtttgcaataaggaggttttcagctagcagtatcaaacagtgcagattcgtctgatggccaactccagcaaccgtctgtagtactgcatagatgtgcattatttgtataagcatgctgccctgttgctggcaggtaatgcgccgcattgctcaaggaccatatcacggccaaattagtgatatctccagcgaaagcaataagatctctgcttttgaactttttgacattcagagtttcagacttggtgccacactacagtcctttttatcatcgcctgtatactattcatttcggtatcttgtctccagtccattcagcatactttctggaatgttgcaacttggattgaaacagcgagaaatgttgaaatttaggcactggtatttttttaaagtaaaaaaaaaaaaaaaaaaaaaaa

SEQ ID NO: 17301 - DNA, 1334 bp, Zea mays
gctcactcgcccctcctcttctcctcgctcgcagcaagccgggaacgtacgaacagcacgagcaggggggaggggaagaagaggaggagacctaccataccatagattcagagccagatacccaatcagtatcctgctgtaccattaccaccaggcacgcaccagcaggttaccaaaatctcgtgtggagggaaatggcgcccagcagctacgaggtggcggcttccatcctcctctgcgccgaggacagcagcagcatcctggacctcgaagcggaggccgaggaggaagcgctactggcgcggagcggggagccccgcggcggcgcggagttccccgtgccgtccgaggaatgcgtcgccggtttcctggagactgaggcggcgcacatgccgcgggaggactacgccgagaggctgcgcggcgcggggatggatctccgcgtccggacggacgccatcgactggatttggaaggttcacacgtgctacggtttcggccctctcactgcctgcttggccgtcaactacctggaccgcttcctctcgctctaccagcttccggaaggcaaggcttggatgacacagctgctgtccgtggcgtgcttgtccctggccgccaagatggaggagacctacgtcccttcgtccctggacctgcaggccggggacgcgcggtacgtgttcgaggcgaagacgatccagaggatggagctcctggtcctcagcacgctcaagtggaggatgcaagcggtcacccccttgtcgtacgtcgactacttcctccaccggctccgaggcggcgccgcgccgagcagacgcgccgtcctccgatccgcggagctcatcctgtgcatcgccagagggacgcactgcttggatttcaggccctcggagatcgccttggccgtcgccgccaccgtggccggcgaagagcgcgccgtggacatcgacagggccttcacccaccgtgtacataaggagagggtgtcgcgatgcctcgaagcgatccagcaggccaccgccaccatggccctgccgcagccgctgaaaagtgaaggcccgagcagcagcggccgcagggcctcgtcttcctcggccaccgtgccgcggagccccaccggggtgctggacgctggctgcctgagctacaggagagccgccgccgccgccgcctcgcacgcgagctccagctggcgcgacgaggacgacgacgactgccccccggctgtctgcagcaagaggaggaagattagcagatgattaaagccaatgatggacggatgaaaaagtcaagcggtttttgatcgcactgactgaaaaaaaaaaaaaaaa

SEQ ID NO: 17302 - DNA, 1027 bp, Zea mays
cgctcctcctccactcctcgccttcctcggtcgcatcaagaacacgagcaggaaggagaagcggaggagtcctatcagagccagacagccaatcagtatctgtaccattaccgttcgggcaccagattaccaaaatcctgcagaggggaatggcgccgagcagctacgagatggcggcttccaccctgctgtgcggcgaggacagcagcagcatcctggacctcgaagcggggggccaggaggaggaggaggaggtgctgctggcgcggagcaggacgcgcggggagcccagcgtggtcttccccgtgccgtccgaggaatgcgtcgccggtttcgtggaggcggaggcggcgcacatgccgcgggaggactacgccgagaggctgcgcggcgggggcacggatctccgcgtccggacggacgccatcgactggatttggaaggttcacgcgtactacggtttcggccctctcaccgcctgcttggccgtcaactacctggaccgcttcctctcgctctaccagcttccggaaggcaagtcttggacgacgcagctgctgtccgtggcgtgcttgtccctggctgccaagatggaggagacctacgttcctccgtctctggacctgcaggtcggggacgcgcggtacgtgtttcgaggcgaagacggtgcagaggatggagctgctggtcctcagcacgctcagatggaggatgcgagcggtcacccccttctcgtacaatcgactacttcctccaccggctcaaagacggcggtgcgccgagcagacgcgccgtcctccgatccgcggagctcatcctgcgcgtcgcgagaggaacgtgctgcttgggtttcaggccctcggaggtcgccgcggctgtcgccgccgccgtggccggcgaggagcacgccgtggatatcgacaaggcttgcacccaccgcgtgcacgaggagagggtgtcgcgatgcctcgaagcgatccaggccaccgtgcctgcacagccgctgaaagctgaaggcccgagcggc

SEQ ID NO: 17303 - DNA, 1870 bp, Zea mays
actcctatgggcgattgggaccctcgaggccggccgggatccatataccacaggtaccctcgcccgccgcccgcctaccccacccccccacacacacacgccgctcggaatcggagcttgcatccgaccgcgagcaagcggaccaaatcctcctccatattctatcgcgtgcacgcatctggccgcctcgaccctcggcggcggcggcggcgacggcgacgacgacgatggggctggagatggaggcgatggcggggtcgatcggcgtgtcggtgcccgtgctccggttcctgctctgcttcgcggccaccatcccgacgggcctcctgtggcgcgcggtgcccggcgccatggggcgccacctctacgcggggctcactggtgccacgctctcctacctctccttcggggccacctccaacctcctcttcgtcgtgcccatgacgctcggttaccttgccatgctcctgttccgccgccacgccgggctcatcaccttcctcggcgccttcggcttcctcatcgcatgtcatgtgtactacatgagcggggatgcgtggaaggagggaggcattgatgcaactggagctttaatggttttaacgctgaaagtcatttcgtgctcaataaactacagtgatggtatcttgaaggaagagggtttacgcgatgctcagaaaaaaaaccgattgactaagcttccttctctaattgaatattttgggtactgtctctgttgtgggagccactttgctggaccggtatatgagatgaaagattatcttgaatggactgaaaggaaaggaatatgggctagcccaactccttcgccattgttacctactttgcgtgctctagttcaggctggtatatgcatggggttatatttatacctgtcacctaaatttccactctcacggtttagtgagcccctatattatgaatggggtttttggcaccgactcttctatcagtacatgtcaggctttaccgctcgttggaaatattactttatatggtcaatttcagaagcctcaattatcatatctggtctaggctttactggttggtcggaatcttctcccccaaaagccaaatgggatcgtgcaaaaaatgttgatgtattaggtgttgaattagctggaagttcagttcaattgccccttgtgtggaatattcaagtgagcacatggctacgatactatgtctatgagaggttaattcagaaaggaaagaaaccaggtttccttcaattgttgggtacacagacagtcagtgccatctggcatggactatatcctggatatatcatattctttgttcaatcagcattgatgataaatggttcacgagttatatacagatggcagcaagcagcgagcagttcattcctgagcggtatcctggcctttctaaattttgcttatacattgctggtgcttaactactcctgcatcgggttccaggtactgagcttcaaagaaaccttggcatcctaccggagcgtatattatgttggcacaattgttcccattgtgtgtcttctgctgggcaatgttatcaagccagcaaggaaggcgaaggctcggaagaccgagtgaggaaatactcactcaagtgacctttacatagaagaaagatggtgaagcttcaacgaagataaggacattctagttttcaatttatttattctgtctttttgtacggtatcaaatttagcataaggataatgtggtgaccccggttctcctacctcggaactcgattgcgattgatcaatcattaaaacgtgacataaccactggattttcctttacttaatgactactcatacgtgtgtgcgaatgattttagacccacgcgaccgaaa

SEQ ID NO: 17304 - DNA, 2312 bp, Zea mays
  misc_feature (2312)..(2312): n is a, c, g, or t
gctctgtttagtatagtttcaagcaagctgccttgcttgttccttttcacgcataagatcaagtttaataatacaactgtatagttgttagggcatgtaaacctagaccacttggatcgttttttagatatatcagcgagaaaatcccttcaatgccatattttcagtgagaaaattccttcaattctatattttttattctgatttaaaaccaaatagatcgaactaatttctagtaccattaaaggggtcggtatagattttgatgacattagggagattcgttttagatggaactaacgatgttaactttaaaataacaacgatatttaagggattaaaatttaaatttgatgatattaaagtgaagctataaattttgatgttatttaagagattggtataaatttggaggtcggtgaagagattttctccttattctcgtcatctcgtggctttgaaataccccgcgggccgcggccccgcccaaatccaaccgccctaccaacgaccatctgctctgctctcgccgctcctacccttccaaatcccctcctcgcaacaaccaggcagccatcttccccatcagcaggcgatggagctcttccccgacggtggcttcgtgcggctgcagaaccgcgcgaatagaaggtacgtccacgccgacgaggactgggtgggggtctcccttcgtccgaacgggcccgtcccatccctgaatgcggtctggcgggtggagcattgggtctccccgttgtggccgaacgacggggacaccttcgtcctcctccagaacgcagcctacggccgctacctctcctcctcgatggacgaggcgccgcacggccaccttggccagcgcgccacccagcacaaccgcgacgacccccaagtgctggacatccaccccccgtggatatggagcgtcgagaggctgcaccccccggacaatgactacgtccgcctgcgccattacgcccacaacctccgtgccaacggcaggtacaaaatctggaacatcggcgtcaccgtcgactacaacctgcaatatcccgcttccagtaccatgatacagtgggcggtccacgccgtcgaagcgagcccgtcaccacaacctcttccgcttacacttcagcatcaggtgcatggcttcaccctttatccttccttgcattgcgttggaatgcaaaactctcctcgatccgctacctttacttgggccaccaatcatgggtgcgttggttttgattttcgccttcacaaaatcctgattgccgcatcgaaatctttgcgtttatccttgcccaaatctgaaactatccgtttcttccgatgcaagactactgagcctgttaattcttcctgacaagttttaaacgttcttgtgcctctgcatctggttcgctttagggagcagttcctgaggacattaatccacaaggcattttcacttcactttacgaatttatctgtcattcgttaaatctgcgttgaatcatagtatgcgaaaagcccaagctctttgttacgatgtatacttgaataatttggccttcatttcataccggatcgatcgcaattgttttttcctatttctgtgatagattccgaaagaatttggttgtctagccatttgatttcctttttcctaaacacagggagctcgccgtggcctgttcttttggcggcgcaccaggatacgcggccccgggatagttcgacaggcggggcggaggatccggcatgtacgggcaagcgatgaagggaacttcgaccagaaccagtacaactggtcctcgttctttttctacgacagctccttggtcaacctgaggtacgagctggggcgacggcaggatgactggaacgaggacatgctcgccttcacgctgtgcatgcggcctggctcgcatggccggttaatgccaatggtcaccgacctgcctggcagcttagaccccatgagcatcgtcgtcttgaggaccggatcaccagctgctgcggcattagtgtatccggaccaaaccgtagatgagaggagagcggaacttctgacaaagttgaaattcatctcttgggcaaccaaaagcatttaagaacgctgcccctgatactgtgacatgagaattggctcatagtttctgaaaattctgctacccatctgtaatggtggatagatttgatgtggtctactgaccggaatcgttctgaaataaccattcagtttcagaacataaaactgctgaaatcgtgatgcggaaaaattcttctgcaaagtaacactgtttgtagttgactgatggaaataatan

SEQ ID NO: 17305 - DNA, 1214 bp, Zea mays
  misc_feature (1047)..(1047): n is a, c, g, or t
gggtacctcgaggccggccgggccttaattccgccgccccgcgtccgctgcgcctgccggcacttgaagcttcctccgcggcgtcccgtcgagcaaccatggcggcggcggtaaccctcctccgccttcctctcgcccgactctcctaccacctccgctccgtaccttcctctcgtctcccgtccccgcgcctccgtatctttgcctcccatcgccttttctcctccctggaccatggctccgcctctgcttccgcctccgcggccgtggccgaggttgtaggcgtgccggacgcggaggaggagtcggtagaggaggaatctgcggccgaggccgaggcggaggcgcccaggtcgttcgtgctcccacggctgccgcggccgaagctgagcgtgaaggagcggaaggagctggcctcgtacgctcacggcctcggcaaaaagctcaagtcgcaacaggtcggtaagagcggcgtcacaccgaaccttgtctccgccttcagtgacaacctcgagtccaacgagctcctaaagctaaaaattcatgggaactgccctatggagctacctgatgtgatactgcaacttgaggagtcaacaggatccatcgctgttgaccaaattggtcgctctgttattctgtataggcctagcaccagcaagatgaaaaagaagcaacaggttgatgaaaatgctaggaggttttcaagaactgaagaaggaaacgctaggcggtttgcgaaatccgaagaatcgtttgaagaacgccctagaaacagaccaggcagaagatctgttggacctggatccacatttaagggggctcaacagaagagaagaccgatggcatccaaggggtcttcttcatatggcccgaggatagcagtggcataaaacactatatggctgggggtttttttttcgtgttgtctgtgctccggaccctggagcgttcatgtaaagttctcgacgaactggttggagcacgtgccagtgtttagttctagttttccccagtaagttgtggttccaggtctcatcaactgcncaatccccccccccaagatactttatgtgtcagctaagaaaaatttggtgcaagactagcacaggaacatggagtttcttccagtgttgtccgtagacctcttccatctggtccttgaaatcacagcaccgccccatcaaaaaaaaaaaaaaaaaaacccccccacc

SEQ ID NO: 17306 - DNA, 1854 bp, Zea mays
ctgcgttttggtttataccttattggtcacggacttgtgggccaagtccttaatttcttatcccctcgtcctctgcgtcttgttgcacttgaagcttcctccgcggcctcccgtcgagcaaccatggcggcggcggtaaccctcctccgccttcctctcgcccgactctcctaccacctccgctccgtaccttcctctcgtctcccgtccccgcgcctccgtatctttgcctcccatcgccttttctcctccctggaccatggctccgcctctgcttccgcctccgcggccgtggccgaggttgtaggcgtgccggacgcggaggaggagtcggtagaggaggaatctgcggccgaggccgaggcggaggcgcccaggtcgttcgtgctcccacggctgccgcggccgaagctgagcgtgaaggagcggaaggagctggcctcgtacgctcacggcctcggcaaaaagctcaagtcgcaacaggtcggtaagagcggcgtcacaccgaaccttgtctccgccttcagtgacaacctcgagtccaacgagctcctaaaggtatgtccccattggccctctctgattgccaaatccacaatgcacgtggtttttttaaatacaagtaaaaattgcgtgttgtctcagcttcagtgcatgcgaaacaaaccgcatcctgaaatatacatcgggataagaaaaggaagtgagaccattgtaagatttcttagttcatcgttgccacatgataaaggacttagttcagttacaagcattgctgtcgtatggatagggtttctggcgccatcgtgctgctgatctgatccagctacagctggcaagttgaaatcgaccgatagtttggttgacgaaggaaagtctatgaaacttagggtataaaccaaaatggcaagtagaagctaatgtaatgctgaaggcacaaatggtagaagctaaattggacacactcagtgctggttgctcccacatgaatgggatctggagaaaaaaaaaccccgaggcaaaccttacctctgcatttttatggagaggttgtgtcgaacacaggatctttgacttattggaaaggcttctaccattgagccatgtctgtctgtccttctgttacaagctaaattggcaacaaaaatttaaaatggcaagacttttattcacatgagttgcaacaaatatgaactctaaccctgcaattctcaggggactaccaatcaccttccattttactgtcctccattttcttggcactcgcttttcttcctcctcggcagtttacttgaccaagaagctggatcggagtggaggtcactcttgtatatgaaactgtgagactgattgtggcagtaagcatcagtctttatgcctctatatgttcctgtgaaaatccactatctatatcccatagcccttctcttttgtatagcttcattaaattctagatttaggcggaccaagaagcaaattaatcatagcagtaggtcccactaaacctgatcatatgagttgaagctcatgatcaatgtacacgcatgagtgtgatgctagaagattctctaattagctaaggaatccaccgattattattcatcaatattagattgaggagctggtatttctaaccctaatttcttaaataggtagccccgttatccaatgttggagtttctattttgtttaagtgattggaatgggcaataaattggaacattgtgggccatggattgttgtgataacatgatgggctattttgtgtttgtgtacggagattacacccaattattgatctttgtatcaacaccggatcctcatgaagaattatgattggttacttacatgtag

SEQ ID NO: 17307 - DNA, 1514 bp, Zea mays
gaaaaaaaaacaagtccttaatttcttatccccttcccctcctctgcgtctttgttgcacttcaagcttcctccgcggcctcccgtcgagcaaccatggcggcggcggtaaccctcctccgccttcctctcgcccgactctcctaccacctccgctccgtaccttcctctcgtctgccgtctccgcgcctacgtatctttgcctcccatcgccttttctcctccctggaccatgtctccgcctctgcttccgcctccgcggccgtggccgaggttgtaggcgtgccggacgcggaggagtcggtagaggaggaatctgcggccgaggcggaggcggaggcgcccaggtcgttcgtgctcccacggctgccgcggccgaagctgagcgtgaaggagcggaaggagctggcctcgtacgctcacggcctcggcaaaaagctcaaatcgcaacaggtcggtaagagcggcgtcacaccgaaccttgtctccgccttcagtgacaacctcgagtccaacgagctcctaaagctaaaaattcatgggaactgccctggggagctacctgatgtgatactgcaacttgaggagtcaacaggatccatcgctgttgaccaaattggtcgctctgttattctgtataggcctagcaccagcaagatgaaaaagaagcaacaggttgatgaaaatgctaggaggttttcaagaactgaagaaggaaacgctaggcggtttgcgaaatccgaagaatcatttgaagaacgccctagaaacagaccaggcagaagatctgttggacctggatccacatttaagggggctcaacagaagagaagaccgatggcatccaaggggtcttcttcatatggccgaggatagcagtggcataaaacactatatgcttggtttttttttcgtgttgtctgtgctccggaccctggagcgttcatgtaaagttctcgacgaactggttggagcacgtggcagtgtttagttctagttttgacaagtaagttgtggttccaggtctcatcaactgcacaatgaaataggcacaggatactttatgtgtcagctacgtgcaatttggtgcaagactagcacaggaacatggagtttcttcagtgttgtccgtagacctcttccatctggtccttgaaatcacagcagaggaccatccattggactgtcatgtttttgcgacttcgttgagcagctgtctgttgatgtttcactgacagtctcaggctggtgcagagccaagtgcttaacatccatattgcccctgtgatgagttatgaccatggttccaagaaccatctcagcaatattgccatagttctgactacaagtgtgggggggccccttagcaacaatgtgaacttttatttttttttaagccggcgagccggttagctccaaagcagtctagacggatgtggtgcgcacatgtgctttcttcgactgatgtcattagctccattcctgatagtcaataaatgtccagatatttggttt

SEQ ID NO: 17308 - DNA, 1013 bp, Zea mays
ggagacggccattgctgcaactactgcgccccctcggccctcccgggctttctccggatgatctagcttgtctgaactacaatgtgccttctcttagttcaacagaggttgagacatcagagagtgctataggagttataacagaaaataaattagatgatgtgactgctcaagatcccaatggcttagaaggcaagcaaattgtgtttgagagcaagaaggatccattacaaaggcgacatgaactgttgataaaaagtgagcttgccgaggctctcgttcagtcatgcattgaaaatgttggagaattacttcgaacaaattttggcaaagaagtattgtatgagatggctgttggtggtaaagacaacgttctggatggcctcaccgataggatccacatgttgcacgatgcaatagcgtctgatgcggcccaaccgaagattgaagatatggaacatgcatttgaaaacttcttttccagccgtgtaatcagaagaatggtaatcgactgcccagcgtttgcagtcactctctggagaaaggctcttcagggcaagtgcaagatatgggctgaaggacacagttcgaaggtggttgcgggtttcctggagtcgccaagtacggaggtcaaggatcttgcaaaacctgagttgcagccgctggttgatgctggcatccttaaagtgccagaccctaaggttgttcaaaaatgactcgtgcgcgggggcctttttgcgccagtaaatgactcaaggaccatcccttgtttaagggatacggataggttttttgaagctcgttctgccgataaaaattgttaagtcactcgttcgtgtgtacgccagtccgttgtacacttaccctggatatatggtgaatcggatacgttattttgttttaaactcggaatgctcctttttatctatattttttgggaggagatttgtgttcttgtcctccttgggatccttttttggaagaccaaaaattattttaatcttgttttcttt

SEQ ID NO: 17309 - DNA, 1468 bp, Zea mays
cagctgtaccccggtgacgaagccaccggccgctcccggtcacccgctatataatgcccggcttcgccttccccttcctccagccacggatcgagacgtcccaatcgagctaatctcacaccgccagtgccagtgccagcggcagctgctaatccgtgccgtgttccagcagcgatgggagtggagtcggagtgcgacaggataaagggcccctggagccccgaggaggacgaggcgctgcggcgtctcgtggagcgccacggcgcgcggaactggacggcgatcgggcgcggcatcccggggcggtcggggaagtcgtgccggctgcggtggtgcaaccagctgtcgccgcaggtggagcgccgccccttcacgcccgaggaggacgccgcgatcctggccgcgcacgcccggctgggcaaccggtgggccgccatcgcgcgccttctcccggggcgcaccgacaacgccgttaagaaccactggaactcgtcgctcaagcggaagctcgccaccgccacggcgacctccagcggcagcgatgctgagcgggcgtgcaagcgcgcaagccctggcccggggagcccgacggcgtcggaccgcagcgacctcagccacggctgcggcgccgcgcaggtgttccgtcccgtcccgcgcgccggaggcttcgacgccatcagcgccgcagacgtgcgccctccgcccccgccagcagtcgcagacgaggacccgctcacctcgctctccctctcgctgccggggctggaccagtcgccgtcgggcttccaccacgacagcgcccggagccacttccaggagctctccccctcgtcgtccccgtcgccgcagtctactccacccgccttccctccgcaggcggctccgtctcagtcgtcgtacgcgttcagcggcgagctggttgccgcgatgcaggagatgatccgcgccgaggtgcgcaagtacatgtccggcgcggggctccgcgccggatgcgggcccggggccgtgggcgaggtgtgcatgccgcagctggtggagggtgtgatgcgcgccgccgcggagcgcgtcggcgtcgtcacacggccgtagaaacccggaaacggaccaaatcagatctgatcaatgcgaagcattgtgttaattaagatcccgtccgtcctgtgtagcagcgctacgtagactactactactactagtcgttctctggccgttgtatttagcagaggagctcgcgtttgtttattcttcggcggctgtcgctctgaatccagaaaggaacagagcggcggtgtaaagccgggagcggaagcggaggttggcaataatcgagatcgagcctgccatttctataaccggatgtggccgcggcttgctcagaaaggggatgtgatttgtgctgatccgccgatgccaatgtgcgcccaaaaccgacgcttggttgcgttgcgccaaaaaaaaaaaaaaaaaa

SEQ ID NO: 17310 - DNA, 1749 bp, Zea mays
attgggtacctcccgggccgtaacataacatctcggcaagaggagacaggaggtcggtagtttagttttcagaagccaaattaaattaaaggctgtctgtctcactcactcactcactcccagaagagagaagaccacaccacacaaacaaacacctctttggtttctacaaatagaggacgcactgactgagctacaccggtaaaagctgccaaggatatatatcccaccagtcaggaatgcccgcaaccagacatttcagtacataacaggagctgaacaactaacgtacaggctgacagcagcagatgtatcatcagcaacagctccacacccataaccagcacctgtcctcgtcaaggccgggcttacctcctgagaagcagttcctcctgcacggagcaggaggcggcggcggcggagatgcagggctcgtcctctccaccgatgctaagcctcgcctgaaatggacacccgagctgcacgagcgttttgttgaggcggtgcatcagctcggaggcccagacaaggccacgccgaaaaccatcatgaggctcatggggatccctggactcaccctgtaccatctcaagagccatctccagaaatacagactcagcaagaacctccaggcccaagctcatactgccagcgcaaagaatgcgttggtaggctgccggacgggagcagacaacgccctatgccaagggagtgcttcaccgccgccaccaccgccgccgccgcacctgaacctagatccgccgcagataaacaggtcaatgcacataagtgaagccctccagatgcagatcgaagtccagagacggctgcatgagcagctagaggttcagagacacctgcagctgcggatcgaagcgcagggcaagtacctgcagtccgtgctggagaaggcgcaggaggcgctggccaagcagagcggcggcgctgacgagacaacgacgacgcagcagcagatgctgccggatctcatctcgagagccacggcgacgaggcgcggccatgtccagcaggagcacctccacctgcagcaccacctcggaggcgacgggtcggtggacagctgcctgaccgcgtgcgaggggtctcggtgccagagggagagggaccaggacctgctgtccatcggcctctcgtccgctccgcctcccccccccactcccagcagaggctacaacgacagaggaggaggcggcagcgccagctgcgaggagttcctgcagtttcttgacgagcccggcagaagaggagcaggaggaggaggagggtcctcggatgagcagcaggagctggacctcagcatcagcggcggcaggagcaatccaaggcctcgcggcagccaaagccaaaggatcgacctgaacggatccagctggaactgaatggtcgttcttttagcgatggtctccttcctcgtagctttagctgcagtagggaaaatggcgaggatcacagcaggtgccctgtgtgtgggtgcacttccatgccctgcagccatttgcagcaaataactaagcagtgactgatgatgacggtgaattggcatgcgagaaagagaacccatatgcacgttctcctttgacgtctgattgattagttaactctataagtagatctgtattccagacatggaaaagtacacggctgagatcctctcatcagtttcaggaatgtacagagctcccagcggatgcacacgaatccatgctgctgcttctgccttggcccacc

SEQ ID NO: 17311 - DNA, 4107 bp, Zea mays
  misc_feature (3740)..(3740): n is a, c, g, or t
cttatacttcacatgaactcccacctttggtgagtttatgcacattattctccacaacttgttgagctatgatcttatgagctcacccttgcgatatataaactccccataggagaagaacaggtggtccaggagaagccttacaacgaagagtacgagctcatttaggtggcgtctctcagtcggctttatgggattgatatttaattctctttattattatcatttattttttgcaagacttccgctatgaaataatgatacttgtgacatttatctctatatacttcgtcgttatatgtgatgttctttttttagcgtacatatgtcagttaaatccggatgtgacattttgtttgggctccagtgcaggccggtagttgcaaagaatgggctgggctggctgcactggtcactgggccggacggttggtccaatcaaattgtttttaaccttttttggattggaggtcgttgccgcgtcatcgggcctgcggatgaccttatcgcgtagcggttgacgtgcgacgcgctgattggagggagcaaatcccctctcgtctggcgccggcagcgcccacacggccacacgcctcccgccacgaccacacgcacgcaccgctggcgggacgacgggccaagcaagcaagcacgcagtcacggtcgaaaccagcggacgactactagacgaggaggaggtggagggaaactgaaactgaaaactagcggcggccggagaaagagagctgcgttgcgccgctggtctccatccatcgatttgttttgttggcttcttcgcatgtgattccgccagtaggagtgttgcttatctacccctcctcctcggctcctccacaacgtccagatcatcagagccagagggtaaaacggaatagtctattcccagtagtgataaacaaaacaaagaatcttctctgtcttcgtgcggtgtgcctgccatttccaggcccagctgttcattctcgaggctccttctcttgtagttcgtcgtccttgcgcagcagatcgagaggctgaggggagagggatccatggagctgggaaagcccctttcggcgcacagatgtagctacaccgctacctacacccactgttccataggcttctcccctcgggtcgtccgtaccagctggatccgcgcggcggctgagggcggcgacggcggggcagaccggcgacggagaggtgccagcttcgccgccgatgggcccagggtcgtcgaggtcgccgctgccccggtggctactagcggaggcgccgccggagcagccgggagcgcggggttcggagcacgggacgcggaactcgccatgtgggacaagctcggggcggtcgtcaggctcagctatggcattggtgaggctcagctatccatgcattcaaattcaatcaatcctcccggctaatctgtcgatgtctgcactgcacagggatctacggggccatggcactcgccgggagattcatatgccaaatggccgggatagactgcacggggggctcccatccgtctctcacggcactcgtcgagggtcttggctatgcagctccaccaatcatggctctgctcttcatcctcgatgtatgtacagcgtcctcccatttccagctccagtcagatcagctagttgatttgccttttattatctctgcttaactcgtgctggtagataacttttgcatgtggcctgctaatttctgctttcaggatgaagttgtcaagtattcgcctcacgcgcgtgccatccgtgatgtggaggatgaggagcttcgcagcttcttctgtggcatgtcaccatggcaggtacatcaggttctaaatagacttagagatcaacatgaaacgtggaatcactcatctagtgatattatcctaaatttgtcagctgttatgtagaatggcttggagctcctagctaaaaccaatatatataaaaaaactaatcttttcttatacctgtagttcatcctcatcgtggctgctagctcaattggcgaggagctgttctaccgcgccgccattcaggtatgtgctgcctgtctccattgtcgttatgtaagtttactcatgtaattagcatagatatgttttcacttcatttgatctgctcatatcgttgatgatggtaaaaaaaacattgaaataattgtagggagcattggccgatattttcctgagaagcacggagctaatgaaggatgctcgagggattgcatcactggtataaacacatatatgctttttcagctgaatcgagatgaaactgaattttgcgatacacaagaccacctaatacatgtctctatgaaactgtgccggcgcaataatgcagagtggtatcgttcctcctctggttccattcgctcagacgttcgcggcagtcatcactgcagccctcacaggaaccctctactacgtcgccacaactccgaaaggtgacccagatgtcctcctgacgacgacagtcctgattcgcgtgactatgttaatttcttttggtttttttcttatctccaggctccagctaggtagtgttaatcttgaaatctattaaaaccctatatatgtgaggtgacaatgcgctgttcactcaaaattttcagaccctacgtatgtggtgacaccagcgatgcgttcgcgcacagggcgtgagaacctcaagaaactatttgcaggtttgtttggtcatatatctactatagattctttttaaatttgtagccgtggtgatgttgcaaagtagttagatttttagcctttgacatatgcatgcatggatttgcagcttggtacgagaggaggcaaatgaggaagatatactcgccgcttctggaaggaatcttggctttctaccttggcttcgaatggatccaggtacgcatatatagcaggtccagcccatgcatgatatcagatttaagttcatcgtcaggtgtatatataattcatgcaacaaattgacaatgtatatctgcgtgtggcagaccgacaatatcctggcacctatgatcacccacggcatatactccaccgttgttcttggccatgggctctggaagatccacgaccaccggagaaggctacggcagcggattcagaaggtcaggagtgaagggagtagctctgcagacgacacattgtaactgcagcatgtagatcggcgtggtctactgctggatagctagctgctgattgcacgcgcgtactgggtgatcgatcgatctaccgatcagtcagaagaccagaggcgtacgtctcacaagttttgatctacttaattaatatcaacaaggtaggtataagattgggcaaaaatatatatataatgcatgtagtcatgtaatgtagatacaatgtgtacatatatggataaatatatgcaggctgtaatcaatataggaagtatatagtgtacgattgcgacatccaagtatgttataatcctagtatcacgtatgcatgcaaggaatataccagccacatcctttctttctcgtccctctcccacacttgcaatgttacatctattcggaacatccatgcacgagaaggctcgatctatggtctaatagttcgatttagtttgtgagtcttagaaagaacatatatgttcaccctatttaagctcttgctggatcctttcactactgctatgctaaatggaaagaaaaagagaaatcaaggccctatttgcatcatctaaaattaaactattaacntttaggagggttaaaacttaggtggtggtaaaagtttagtccggtgttgtttgaatacaatgattacaagtgaaaaactttccaagacaaagactcatgtatatcccttagtccatattagttcatatttatcgactaatagactaatggatagttaggctagaaactaaaaaaaacagtttacgctttgaaaatctaggcctaaagtttagtcatggtatccaaatatatcctgaactttgactagtaaattcttcatcataataactacatgagtccttttattgtaataattattctagagctagatcaaagtcatgattgttctctttagggcttgttcggtttaaaggggtttgagggggat

SEQ ID NO: 17312 - DNA, 1716 bp, Zea mays
gcacgaggccagtaggagtgttgcttatctcccccgcctcctcggggccccccccgcgaacgtccagatcatcagagccagagggtaaaacggaatagtctattcccagtagtgataaacaaaacaaagaatcttctctgtcttcgtgcggtgtgcctgccatttccaggcccagctgttcattctcgaggctccttctcttgtagttcgtcgtccttgcgcagcagatcgagaggctgaggggagagggatccatggagctgggaaagcccctttcggcgcacagatgtagctacaccgctacctacacccactgttccataggcttctcccctcgggtcgtccgtaccagctggatccgcgcggcggctgagggcggcgacggcggggcagaccggcgacggagaggtgccagcttcgccgccgatgggcccagggtcgtcgaggtcgccgctgccccggtggctactagcggaggcgccgccggagcagccgggagcgcggggttcggagcacgggacgcggagctcgccatgtgggacaagctcggggcggtcgtcaggctcagctatggcattgggatctacggggccatggcactcgccgggagattcatatgccaaatggccgggatagactgcacggggggcttccatccgtctctcacggcactcgtcgagggtcttggctatgcagctccaccaatcatggctctgctcttcatcctcgatgatgaagttgtcaagtattcgcctcacgcgcgtgccatccgtgatgtggaggatgaggagcttcgcagcttcttctgtggcatgtcaccatggcagttcatcctcatcgtggctgctagctcaattggcgaggagctgttctaccgcgccgccattcagggagcattggccgatattttcctgagaagcacggagctaatgaaggatgctcgagggattgcatcactgagtggtatcgttcctcctctggttccattcgctcagacgttcgcggcagtcatcactgcagccctcacaggaaccctctactacgtcgccacaactccgaaagaccctacgtatgtggtgacaccagcgatgcgttcgcgcacagggcgtgagaacctcaagaaactatttgcagcttggtacgagaggaggcaaatgaggaagatatactcgccgcttctggaaggaatcttggctttctaccttggcttcgaatggatccagaccgacaatatcctggcacctatgatcacccacggcatatactccactgttgttcttggccatgggctctggaagatccacgaccaccggagaaggctacggcagcggattcagaaggtcaggagtgaagggagtagctctgcagacgacacattgtaactgcagcatgtagatcggcgtggtctactgctggatagctagctgctgattgcacgcgcgtactgggtgatcgatcgatctaccgatcagtcagaagaccagaggcgtacgtctcacaagttttgatctacttaatatcaacaagataggtataagattgggcaaaaaatatatgtaatgcatgtagtcatgtaacgtagatacaatgtgtacatatatggataaatatatgcaggctgtaatcaatataggaagtatataccgcgtgattggtagactgcatgaccactcccgtggatacgtaaagttgtatttgtttggttcgcttctttag

SEQ ID NO: 17313 - DNA, 1940 bp, Zea mays
gccggccgggtcgggattcattcgcactactctgctcgctccgcgctctcaggctgggctgtacctgtacgtatataggtcgtcggcgacccgggcccggccgggactccacccacgcctccaccacagagagcagcagcagactcgcaagggggtagggttgtgtactctgcgcctgtgcggacggcggccggcggacggcgaaggagatggatcgcctgcccgagtcgacccggagcatgaggaagtacgcgtcggaggccggcggcctgcgcgcggcgcggcagggcccccacgggcggtcgctgacggcgcgcacggcgcacagcatgtccacgacggcgctgcgcaccaagtccaagtcggccgcgtcgctgctgcgcagggtgcccttcgcgccgctccgccccgtcctcgccaacctgcaggaggtgttcctcggcaccaagctcgccgtgctattccccgccgtgccgctcgccatcgccgcccagtgcgcgcacttcggccaggtgtgggtgtttacgctcagcctactcggcctcatccccctcgccgagcgtgtcagcttcctcaccgagcagatcgcgatatacaccggccccaccgtgggcggcctcctcaacgcgacgtgcggcaacgccacggagctcatcatcgcgctcttcgcgctcatggggggccagatcgaggtcgtcaagtgctccctcctcggctccgtcctctccaacctgctgctcgtgctcggcacgtccctcttctgcggcggcgtcgtcaacctcggctccgaccagccgtacgacaggacccaagcggacgtcagcacgggcctcctcatcctcggcgtgctgtgccagtcgctgccgctcatgctgcgctacgcggtgggcgccggcgagcactccgtcgccgcggccaccacggtgctcgacctctcccgcgcctgcagcgtcgtcatgctgctcgcctacgtcgcctacctcttcttccagctcaagacgcacgcgcagctgttcgagccgcaggaggtggacgacggctgcgaggcggaagaggacgagcaggccgtcatcggcttcgccagcggcttcttctggcttgccttcaacaccgtgctcatcgccatcctgtccgagtacgtggtcggcaccatcgagcctacctccaaatcctggggtttgtccgtcagcttcatcagcatcatacttctacccatcgtggggaacgccgcggagcacgccggagcaatcatttttgctctcaagaacaagctggacattaccctcggagtagcgttggggtcggcgacccagatctccatgtttgtggtgccgctgagtgtcattgtagcttggatcgcgggtattcaaatggatcttgacttcaagctcatagagaccggctctctcttcgtctcagtaatagtgacagcattcaccctccaggatggttcgtcacactacctcaaggggatccttctgctgctgtgctacattgtgatcggtgcatgcttctttgttacgaggcaacctgcaagtaacaacaatggcgctgggctgtcgctgccaactggcactttgagtgcacaagctgcatgatggttcaagggtcctgcctgagcctgaacaaatgagcatccaaggcagcaacgcagttgtgagtcagaaacaatgccgtgcaaaggttgatgctttcagaagcggtgaaatctcagccggtggctcagtgctatgggagaaatgaaggctagctgctgttgcaataagggtagcgaatatgcatccggtctatgtatatgatgctgtgttgtttcatttattatacagcttaataagatatatgcagagggtggatttgtataaaaaaaaaaaaaaaagggttgtgcgcgtgtacaaggcgattccaaaaaaaaaaactcgagaccggccctctcctcgtgc

SEQ ID NO: 17314 - DNA, 2447 bp, Zea mays
ggtactccgagccctccccttatttagagaaatggaaggtatcttgcgtgagaggaacctgaatctcccgtcagtacaggaaataagcgctttccgtgtgaatctattctctggtatccggcgtgagagtgcgattgcggactacgacgctttttggcgctccttactcgaggagattcacacacctcagggacgtagttgttttggtcagagaatacaagatctgcacgcccgaatgtctgccgagggcaactgggactacttgattgcccaacaaggcagagggtattttggtaacctacctaatctcaacagcccgttggatcaatatcaatttggaattcacccaattctggatctgaatattggtgagtactatgtctcattcacaaatctatccttgtctatgtctatgctactcactctcggtttggtcttacttctgaccaaagtatttatggaatcgtccggccagaaacggggaagagcccatgctgtcgtagaggcctcgtcgagtgcttccgctacgcctaattctgaggatgatgataagcggaaaaaagtgtcccgccaagacgccaatggcaaagagtcagagccgcccataaatggggcgcaacctgaagtaccatccattgcgttcttaaagaaaagaattaaaacagttctaaggtcctgtcgagataggaaccctagggagagcacattacgctctacttacgaggatcttcaccttgaaacggcgagcgccgagaagcgggtaaaaatcgcccaggccctagaaaatctgtacaggcgaagccaatatttccggagtaacaaaaggcagcagccccataccgacttgattattcaaatctgcgattgggagcgtacgaagaggtaaagaaattcactggtgtaggcataggaaaccgaggccccccaaacccatctactatacggttgaggtgagggggggaaagaagagtgggcatgtgggcttctttcactgtgtcaaaaaaaaaaaaaaaaaaaagccgcaaaacaacaacagactagttgctgattcaatagctgacttcctttcaaatatgatatgataacacatcagctcggcacccttgtttcccaaactaactactcatctagctagatccggatcagaaatggtaggaactagatcaaggaattcgagacttttccttcactggaaactcccgagcccgagtcatcaccctagcccgactcatccattgaagcgagccaggtggcaaatccattaatataacttctggaatcccagcaatagagctggcaaggttgaagtgaagctggaatggatccgatcttcagtgtggaaagagcttcaatcctctgtagcaaggaaaagccgatccgctcttgtcttgccttaaatagctggaagcgaaagcagttctcgaggaaggagtgccgtagtcttgttcgaaagtcaagtcattctacgagtttgaatcggttggcttgaaaggaataggttcagtatatcggtcaaaaagaaagtctagatgcaccgaacttgtctagttgttggaaagggatagctggaattcccactagtcaacatgcaaatagtatccaaccaagggatcaccgagagagaaagaagtcactgctaaactagagagagaaagaagtcactgctacactctagaggtatgcgttgcgtatggaatcagaagtagtataggctttttcttgctactagaaagatggagcccggtggtcagcgaataggggtctagacctaagtaagtatgtatgaggggacaggcaagtcaccagctagcggagcagcacgaatagctagtcaagaaggcagagctcttatttgattcgattcaggcaaccttggcacctttgcaagctcttcgcaacaggttccagggaggaatggatacgagtagcaacatcgggagatggaagctgacagacctcgtaattgaagcggcaccaagctgatgaagaacgaggcgtgggaatgctatgcaaatttccaaccaacggcgccaatcgatagaagtttccttggcatgggaggaactactagactctatcccctaatggtgagaagcaaggtcaagaagtaggagagataccaagccgggcaacttcccctagtcactacggaacacaaaagccaaggtgacccagaacaatgatttcacggatttctaggaacggatttcgagtttcagaattgtgtgtggtatcttttttcccctcctcggagcgcaccatgggatgctttgtgaacagccccctctgttcaataccgatacctgtcagattccatagctgatgaatctctttctttttccactcttttccccgtcacgccagacgcttttctggcacaaacctagtagttatttgtcctgtgctgatcttgggtgaactgatgacactgatgctccaagaccaag

SEQ ID NO: 17315 - DNA, 1837 bp, Zea mays
ctcgaggccggccgggaaaaaaattctcccctccacctccaccacagagagcagcagcagactcgcaagggggtagggtagggttgtgtactactctgcgccgtgcggacggcggacggccaaggagatggatcgcctgcccgagtcgacccggagcatgaggaagtacgcgtcggaggccggcggcctgcgcgcggcgcggcagggcccccacggccggtcgctgacggcgcgcacggcgcacagcatgtccacgacggcgctgcgcaccaagtccaagtcggccgcgtcgctgcttcgcagggtgcccttcgcgccgctccgccccgtcctcgccaacctgcaggaggtgttcctcggcaccaagctcgccgtgctattccccgccgtgccgctcgccatcgccgcccagtgcgcgcacttcggccaggtgtgggtgttttcgctcagcctactcggcctcatccccctcgccgagcgtgtcagcttcctcaccgagcagatcgcgatatacaccggccccaccgtgggcggcctcctcaacgcgacgtgcggcaacgccacggagctcatcatcgcgctcttcgcgctcatggggggccagatcgaggtcgtcaagtgctccctcctcggctccgtcctctccaacctgctgctcgtgctcggcacgtccctcttctgcggcggcgtcgtcaacctcggctccgaccagccgtacgacaggacccaagcggacgtcagcacgggcctcctcatcctcggcgtgctgtgccagtcgctgccgctcttgctgcgctacgcggtgggcgccggcgagcactccgtcgccgcggccaccacggtgctcgacctctcccgcgcctgcagcgtcgtcatgctgctcgcctacgtcgcctacctcttcttccagctcaagacgcacgcgcagctgttcgagccgcaggaggtggacgacggctgcgaggcggaagaggacgagcaggccgtcatcggcttcgccagcggcttcttctggcttgccttcaacaccgtgctcatcgccatcctgtccgagtacgtggtcggcaccatcgagcctacctccaaatcctggggtttgtccgtcagcttcatcagcatcatacttctacccatcgtggggaacgccgcggagcacgccggagcaatcatttttgctctcaagaacaagctggacattaccctcggagtagcgttggggtcggcgacccagatctccatgtttgtggtgccgctgagtgtcattgtagcttggatcgcgggtattcaaatggatcttgacttcaagctcatagagaccggctctctcttcgtctcagtaatagtgacagcattcaccctccaggatggttcgtcacactacctcaaggggatccttctgctgctgtgctacattgtgatcggtgcatgcttctttgttacgaggcaacctgcaagtaacaacaatggcgctgggctgtcgctgccaactggcactttgagtgcgcaagctgcatgatggttcaagggtcctgcctgagcctgaacaaatgagcatccaaggcagcaacgcagttgtgagtctgaaacaatgccgtgcaaaggttgatgctttcagaagcggtgaaatctcagccggtggctcagtgctatgggagaaatgaaggctagctgctgttgcaataagggtagcgaatttgcatccggtctatgtatatgatgctgtgttgtttcatttattatacagcttaataagatatatgcagagggtggatttgtatatatttgtggcttgccggcttgtgcggttgtacaaaaaaaaaaaaaaaaaaaactcgag

SEQ ID NO: 17316 - DNA, 975 bp, Zea mays
atggtttccataattccacaataattattattcgcccactgcccacagcgagcgcgctctcaggctgggctgcacctgcacgggtcgggggcgcccacgggccccccggccccgccactccacccacgcctccactacaccacacagagccgcagcagactcgcaagggaaaggagatggatcgtctgcccgagtcgacccggagcatgaggaagtacgcgtcggaggccggcgggcttcgcgcggcgcggcagggcccccacgggcggtcgctgacggcgcgcacggcgcacagcatgtccacgacggcgctgcgcaccaagtccaagtcggccgcgtcgctgctgcgcagggtgcccttcgcgccgctccgccccgtcctcgccaacctgcaggaggtgttcctcggcaccaagctcgccgtgctattccccgccgtgccgctcgccatcgccgcccagtgcgcgcacttcggccaggtgtgggtgtttacgctcagcctactcggcctcatccccctcgccgagcgtgtcagcttcctcaccgagcagatcgcgatatacaccggccccaccgtgggcggcctcctcaacgcgacgtgcggcaacgccacggagctcatcatcgcgctcttcgcgctcatggggggccagatcgaggtcgtcaagtgctccctcctcggctccgtcctctccaacctgctgctcgtgctcggcacgtccctcttctgcggcggcgtcgtcaacctcggctccgaccagccgtacgacaggacgcaagcggacgtcagcacgggcctcctcatcctcggcgtgctgtgccagtcgctgccgctcatgctgcgctacgcggtgggcgcccggcgagcactccgtcgccgcgggccaccacggtgctcgacctctccgcgcctgcagcgtcgtcatgctgctcgcctacgtcgcctacctcttcttccagctcagacgcacgcgc

SEQ ID NO: 17317 - DNA, 1391 bp, Zea mays
  misc_feature (105)..(106): n is a, c, g, or t
  misc_feature (237)..(237): n is a, c, g, or t
cactagctgtttgggactaaagcaatccattaatccttggattggagaaagttcctgtaccctggggaaccagggtttcctttccctggacttttcactctttcnnccatgtcccaggaggaagcagaattgttgaggaattatttgaagcagataagggaggaaacaacttgccaagatggggtctcaagtgcttgtcccattcagaggttgtgaggatctctcctcgccacctgnaagattatgggtgacttgggtcagattgtgcccatgaaataccatccgagagatgttgattcaattaaggctgttatggccaagtcaaatgtggttattaacctcataggacgagagtatgaaacaaggaactacagcttcgaagaagtaaaccaccatatgcctgaacagcttgcaacaattgctaaggagcatgggggtatcataagatttattcaggtttcttgcctaggggcgtcaccgtcttctgaatctagaatgttgaggacaaaagctgcaggagagcaatcagtcttcaaagaattccctgaggctacaatcatgaggcctgctaccatgattggcacagaagatcgaattctgaacagatgggcacaatttgcaaagaattggggtttcctcccgcttgttggtggtggatctactaagattcagcctgtgtatgtaatcgatgttgctgctgctattgtgaactccctcaaggatgacggcactagcatgggaaagatatatgaacttggggggcctgaaatttacactgtccatgagctggctgagctgatgtacgagacaatccgcgaatggccaagatatgtcaatgtccctcttcctgttgcaagggctattgcttccccaagggagatgctgctcaataaagtgccgttcccgcttccaacaccatccattttcaacctagaccaaatcaacgcatttgctgtggacaacctcgtatcggaagatgctctgactttcgaagacctcagcatcatgcctcagaagctaaaggggtacccggtggagtacctggtgtcttacaggaagggcgggccgtcgttcggctcgaccgtgagcgagaagatgaggagctcggagatgtagggagcctcgtaccacctctgaagatactgtagattcgtatgatcatttggctgccattgttccggccacccgtcgccgtctcgccggttggagcagcaggaccaaattcccttgcgtggctcctgctctttgccttgtttgtttgtacctcggccgcgaccacgctatccgtgcatgtgaagagaagaaagaatcgttccccagttttacagctgaggggttttttccgtaaaaaaaaaaaaaaaaaaaaagaaaaaaaaaaaaaaaaagcggcc

SEQ ID NO: 17318 - DNA, 3332 bp, Zea mays
gtgtttatcttagtacatatattgtattcagctttttcatgatcaaatctttttttgactttgttaactctatttcaacaggacgagagtatgaaacaaggaactacagcttcgaagaagtaaaccaccatatgcctgaacagcttgcaacagtatgtcctgtccattttacttcctgttgcagatctgctatctaaatatgttgactttttttctggaaaggagaagtatgtaagcagtaagctatttcttcaaacaagggccatttaaaattaggatttgatgtgaaagggtctctagctgagttggttagttagtctgagtagtactctttaggtcctgagttcgaatcccagtggaagcgaatttcaggctgaggtttaaaaaggtcactcgctggttcccctggttgtgtgcacatgagatgaactgacctatgaggggcgaatgcttgtgtaggggctgggagggctcaaagcacaagtaaagatccggcctatagcagacggatcctcatattgcacgggggccagctttcatgaccgattgagcttcttcttaatatagtaccgtgggagtgatctttcccctacaggccgagttttttaagttaggatttgatggtgcccagccatagtgaaaaaacttgagcctgggcccctggctcaatgatgaacatcgcatcatcaccgatcttctcggttctcttgcacatgaatgctaagtttgggttgccacttaccaggatcgcataattcatggttgttgatttccacactgtacctgtgtacttgacttaggctaggctgcagtgctgcacccagatccagcataccaaatcaaagatatattagccttttctattctgacattgtgtaattgtagctgaccttttggttaacatgaatttttctatcacacttgtgtcctttttttaatgcttgtaggaaagtaaataacgtgtcagttactctgtcctctcactgggccattgcgtcgttggtctgtcagtttagggctatgttggcaggttctggtacagaatcgaaccgctgcttatgtatgagttttaccctgaggaattttctgattacataatttcatcatcaaaccactgccctgaggaatttcctgattacataatttcaccatccactagctattaatgctgcataaaaaattggaaagaattctattgtttatgtttcatatgtttgcaatatgagaatacaacttgtgactagacttccagtggtgcctggttagtaactgcatgatttggattctacacagattgctaaggagcatgggggtatcataagatttatccaggtttcttgcctaggggcgtcaccgtcttctgaatctagaatgttgaggacaaaagctgcaggagagcaatcagtcttcaaagaattccctgaggtgatcatcatttttttagctttagtaatgcgccaagctatgataattattgcttgagaaccatccaaaggccaaaaccagcagtagataatatcctttttctaagcagtcagtttaactgaaaactatttctatccgtcaacaggctacaatcatgaggcctgctaccatgattggcacagaagatcgaatcctgaacagatgggcacaatttgcaaagaattggggtttcctcccgcttgttggtggtggatctactaagtaagttttgcctgttgactctcctgatgcctgacctgaaaatgagttcggggcatgaaatgacctccttttgttcatgttagaagttctttgccagcagttaaattacgtaatgttcccttttgcaggattcagcctgtgtatgtaatcgatgttgctgctgctattgtgaactccctcaaggatgacggcactagcatgggaaagatatatgaacttgggggccctgaaatttacactgtccatgagctggtaactgttactccaacttgtggcgatgaatatgttttaatttgcatatgtgaagggaaaaagagatgtgaccatgattgggtgtatgacaggctgagctgatgtacgagacaatccgcgaatggccaagatatgtcaatgtccctcttcctgttgcaagggtatgaatttaattaccaggccagtacatactggccagaaaacggggcatcaggtagactctcgtactgacttatgtgtgtctcaggctattgcttccccaagggagatgctgctcaataaagtgccgttcccgcttccaacaccatccattttcaacctagaccaaatcaacgcatttgctgtggacaacctcgtctcggaagatggtgaggatctcgcctacaaaccgagcaacaccctcccatttctctctttgctcgctcaagtgcttctgatacatccctctgcagctcggcctttcgaagaccgcagcatcatgcctcagaagctgaaagggtacccggtggagtacctggtgtcttacaggaagggcgggccgtcgttcggctcgaccgtgagcgagaagatgaggagctcggagatgtagggagcctcgtaccacctccgaagatactgtagattcctatgatcatttggctgcattgttccggccacctgacgccgtctcgccggttggagcagcaggaccaaattcccttgcgtggctcctgctctttgccttgtttgtttgtacgccaataaggacccaaatttccgtgcatgtgaagagaagaaagaatcgttccacagttttacactgaggggtttttttcgtacacagcatgatacaatataacccttgtttctggattcatacattgttcgttctgcccaaatgtctctgcatgttgcagctgcttccgctctgctctgcgccggaccgaacagaaacgggaagcttgcaagctgctctggactgtctcccaacaaccaagctgactgtctgacgaaatctgatgtggcctctctggttttacgcaaggatcaaggccaacctgaagtggacttggcagcgtgcgtgtttttttttaaccagcaaagatcagcagtggcgccatcacgggagaaggatgtgccaccacctcccggagtaccggtagagtggcgaagaaaatagaccagcagagccgcaatcacgcagtgatcacatccgtctctgctgatgtgctgctatggttctggttaccggagccatcagtcacgcagctgtcctgccgctgaatctgatgtgatgcgtcaacagaagcaggtaccacggcggtgttggtatccattttcagtttccgttccgggcacgtttgtctgtttgtttgatctactaccatcgcattgaatgaaaattctgtctgagt

SEQ ID NO: 17319 - DNA, 1754 bp, Zea mays
  misc_feature (1713)..(1713): n is a, c, g, or t
cattgggtacctcgaggccggccgggggcagagccggacgccaccgggcctcgagccggcccggaccattcctttctctccctctcgccgtcgtcgccaccgccactttgccccgcctcgtcgcctcctccgacgaccaccgtccaccggcgacaaggacagcgacgatgcagtcggcggcgtggaggcgtcacctcctcgaccaccacctctccccttcaacctcggctgccatcgccgccttcagatccgcctcccagcccgggctcgctccccaagggttgtttggagcggatggcgcaagatgcatgtctgcgagggcgccggcggtcaaggggtccgggcatctcgtccgcaagggcaccggagggaggtcttctgtgagtggaattgtagccacggtgtttggagctactgggtttcttgggcgctatcttgtgcaacaacttgccaagatggggtctcaagtgcttgtcccattcagaggttgtgaggattctcctcgccacctgaagattatgggtgacttgggtcagattgtgcccatgaagtaccatccgagagatgttgattcaattaaggctgttatggccaagtcaaatgtggttattaacctcataggacgagagtatgaaacaaggaactacagcttcgaagaagtaaaccaccatatgcctgaacagcttgcaacaattgctaaggagcatgggggtatcataagatttattcaggtttcttgcctaggggcgtcaccgtcttctgaatctagaatgttgaggacaaaagctgcaggagagcaatcagtcttcaaagaattccctgaggctacaatcatgaggcctgctaccatgattggcacagaagatcgaattctgaacagatgggcacaatttgcaaagaattggggtttcctcccgcttgttggtggtggatctactaagattcagcctgtgtatgtaatcgatgttgctgctgctattgtgaactccctcaaggatgacggcactagcatgggaaagatatatgaacttgggggccctgaaatttacactgtccatgagctggctgagctgatgtacgagacaatccgcgaatggccaagatatgtcaatgtccctcttcctgttgcaagggctattgcttccccaagggagatgctgctcaataaagtgccgttcccgcttccaaccccgtccatattcaacctagaccaaatcaacgcatttgctgtggacaacctcgtctcggaagatgctctgacttttgaagacctcagcatcatgcctcagaagctgaaagggtacccggtggagtacctggtgtcttacaggaagggcgggccatcgttcggctcgaccgtgagcgagaagatgaggagctcggagatgtagggagcctcgtaccacctccgaagatactgtagattcctatgatcatttggctgcattgttctggccacccgtcgccgtctcgcctgttggagcagcaggaccaaattcccttgcgtggctcctgctctttgccttgtttgtttgtacgccaataaggacccaaatttccgtgcatgtgaagagaagaaagaatcgttccacagttttacagctgagggtttttttcgtacacagcatgatacaatataacccttgtttctggattcaaaaaaaaaaaaaaaaaaagcagccagggccaagaaaaggtacccaaaaaaaaaanaaaaaaaaaaaaaaaaaaaaaaaaagggggcggccgtttta

SEQ ID NO: 17320 - DNA, 1911 bp, Zea mays
aggatttcttcgttggcacgagaccattacctagaacatcctaatcgaaaaaaaccctaatcctcccccgctacacgttcgcttgatctttacggccgccgctactcgttcgccatggctgcctgctcctccaggctcctatacctcactctgagctcctctttcctccgctcctgccgcctcgcgtccagctccctacttcccaccgcctcccgctgccacccggggtcgctccactccctccgcttctgctctgctgtccccgagtttgtcgatgtcgccgccgaccctgccgaggcggctgtatcctccggacacccgtggccggagtggggcaacttccttgataagctgcgggccaaggggtacttcgagcaaggtttgccctccagcgtgagttctggcgagggagccgccggagatggggatccagcaactgcatctgagaacgcagcaacggctgcttccggtaatacggtggtggatgcggaggatagcgcggtgacctcggaagatatctatcattttctcaaggacgagaacagggtgaagaatgcgtgcctcaaatttgggcgagaccgcttcgatctcctcagcttgcttcccaagcaggatattcaagctattgttatgtctggctgtcctaataacaatcggaagcccgtctattctgcaaaaaggttgagagagtacgtgcaggtcaaagaagaagatgcatgcagcatttgcaaatttaaggcatcttgtgatagagcttatgtcactccaaagggtgaggttgaagttaggactgttgatgttgttcgtatactgttaagttatgcaatggataaaaaccattcaggagataactctgttatcgaagaaagtgtgcaagaatctgcaaaaaagcttctctcaaagcttactgaatttagtgacacaacaatcgatccatctcttccgaaacctgcatttcaagttgctaggaaggctcagggctcagtggggaaggggagagaaacgactgcagttgaaatgaagaagggtgactggttgtgcactaactgtaacttcttaaattttgctcgcaatcgtcactgtctcgaatgcaaagcagatggaccaaagaagatagaagcggccgtggatgcaatgaaaatgggcgattggatctgcacacagtgtcagtttatgaacttctctcgcaacaagatatgttttaaatgtgaagaacctcacccgaagaggcaactcaatcctggagagtgggagtgcccctcatgcgactttgttaacttccgacgcaacgctatctgcaagaagtgcaatcaggaccgccccgaggatgatacccgagatagtcagcggggactgagaaaaaccagaggggctggcaagtttagaagattcgactatattgatcagaagagcgatgacgatgatgacaatgcctggttccagaagcgtggggcaagcatgaggtcgaaaccggaccagagaaccaccactgccaagagcagaggctctgacggtctggatgatattcttgttaccaccaagcgtagaagcaccaagcaagacgaggacgacgaggtcttgccgtacgagggtgcgcgcaagcatgttgtgagcagaagggcaacgccttcccagaggaggttcacggctgcccgtaaccagtaataatacccgagcttggagctttgatgactccgttctgtgaacaaatttcacagcgtcgctcgctctgctgctgtgatgcagacgaatagatgatggacataacacataagcgtgttcgatctgtagtgttattatacaaactagtaactatcgcgcgcaccgcgcgcctacgaaaacagacaatataaatgataatactattataaagtatttgtcattgtgattaaaagaaaaaaaaaaaaaaaa

SEQ ID NO: 17321 - DNA, 2927 bp, Zea mays
cgctacttctaatagtcccttattgttataatagtacttatatttaattatttattgcatatattttaacaaaagataaatagtctttttattatttggtttatttaatatactgaatagattaaattaaaatttttagtctattcgagtttgttcctaatattattttaaaaacttcgattatatattttaaaacccaaaaaataaaaactcccaatacgctggaccaaattaacctacccgaacgcccacccctgtcacacctacccacccaaacggcccaaacctgaaaattccccacgtgatcggcgcccacaccagccacgtattgatctagctagcacaggccgcctcctccccaccggtcaatccacaaggcttgccgctgcggccgcgcgagggtccacacgccagtctccccgttccgtcctgttcgcccgcgtagcccacctgcgcatgctttccatgccacagccccgcagaggaatcgtgtacggatggatggaaggcaacagctttggatgtgcttcgctctcgcgcccccgtcttataaatacgcgccctccactccggccgggcggcaaaccgcaccacaaaacaaatcggccaaagcgagccaagtgattcagacagacgagccccgagagaagaggagataaagcagagcgccatggcaacagcggtcagcggcaggtggacgcgcgtccgcacgctgggccgcggcgcgtcgaggcgcggtggtgtcgctcgccgccgacgccgcctcgggcgcgctcttcgcggtgaagtccgcccccgcgggggccgcggagcagctgcggcgcgaggggagcatcctgtcgtccctccggtccccgcacgtggtcccctgcctcggccaccgccccgcggccgacggcgggtggcagctgctcctcgagttcgcgcccggcggctcgctcgcggacgtggcggcgaggagcggcggcgggcgcatcggcgacgagcgcgccgtcgcggcgtacgcagcggacgtggcgcggggcctggcgtacctccacgggcggtcggtcgtgcacggcgacgtcaaggcgcggaacgtcgtggtgggcgccgacggccgcgccaagctcgcggacttcgggtgcgccagggccgtggtgggctccgggcgccccgtcggcggcacgccggcgttcatggcgcccgaggtggcgcgcggggaggagcagggccccgccgccgacgtctgggcgctgggctgcaccgtcgtcgagatggccacgggccgcgcgccgtggagcgacgtggacagcctccccgcggcagtgcaccggatcgggtacaccgatgccgtgccggacgcgcccgggtggatgtccgccgaggccaaggacttcctggcccggtgcttcgccaggaacccgcgcgaccggtgcacggcggcgcagctcctggagcacccgttcctggcgtcagccggccgcggcgtcaaggcggaggaggctgcggcggcgtctcccacgagcacgctggacgccgcggtctgggagcccgactccgatgacgagggcgatgcgtcagagagccccgcccagagaatcaaggcactggcctgcccctgctcggtcctgccggactgggattccgaagagggcgactggattgaagtgctcgacgagcaatgtgaagccaccaacttggtgccggtaccaaccaaagaggcggccggcgatgacgagtgccagctcccgagtgtggcgttggaaacaggggtcgacttcatcgacgccgatgcggagggcgaagatcccgggtgttgtgtagctgtaggatatgatcccgggtgttgtgtagccgtaggattaactactgctttgtcagttgggctgttggaagagcagtgtatgggtgattacagtaacccaactgtatttctcgcttacagtattgaaatatcaaagacctctttactgcgaaactgtcccctctttgtcctgttctactaccactaccgtctaccagtttcacattgtctacatagaaaaagcctctacaactgcctaactggtgcgacgcgacaattccagaaacattgttctagaccgaggcggcgacggtgacggcgaccgcgaggcgtgagctgggaatggccgggagagcacatccccctctcctcccatggggggccatggcgctaatgctaaagcagtggacagaatggacagatcacgccagtagaaaggcaattgggaagcatcgcaatctggggattcctggccactctgtatctcatcaaccaccctttgctttcctttccttttcttttcggtcagggcattggcctctggccactatttttacaaaccgtgaaatcctcacccattctcctccagctgataacgatgagctccggcggccttgatggtggcgtccgagtcccgatcgatcgagctagcgaaacggagcactcctgctgcgtaactaccagtggggtctctcgtctcgtcggggacgctggccatgagctactggcaaaattaaaatttctactactccgcttcatctggataagtctggacatgtgtggcgcgtggcctgatgcgcgatgcgagtgacggccaagtggcgctttcttccaaaacctggtggtgtgggcgtggtgtgctcctcatgcaaagatgaaagatatatatattaaaaaaacgaagttggcgtacacgtttgttacatacagtaggtgctacctggcacacgtgggaaccgattcgggacacggggagagagatcttgagactgtgcagtacagttcctcacggtttgctcaccagtcaccccggcacgtgtcacggcctctcggctcgggaagctcagcttctgggaaggctcttcgctggcgttttgggaaagaagatgaaagccgcagcttagcatagaagtagagggat

SEQ ID NO: 17322 - DNA, 3521 bp, Zea mays
gtttcaagtgaaatgaaagtggacgacatcgactagcatgtaacatgtttcaagcgaggtgaaaatgtttaggttctgactgacatggactaacatgtgttagcatcgggttcggctattggacaaacatcgtcaaaaaaaaaacagaactgaacagcgctcgtttcctccgttgccaacaagaacagaacatgcccacaactttactgtttcatcacacccaactaaccatatgatcctctcaagcacgcagatacaacatagatttttttcccccaacacatggtaccaaatccagatataaatatttgccaaacaaattcgaattttcccaatgacaacataaattattttcctcccaaaagctcaccccaaccgttgattgatctgtcaggcagtccatttgcttgtttccgttgattcgatcaaccgtagaagatcagggaacgcagctatggcattttgtctcaaccagtatatacctgatcttcgatgaaaaatccacaaacagaatcttctcactgctacacaatgacaacataaattatgcgcatatacaagcgtgtctcaacttggaaggagaaggcccgctaaaggcccaactactacggacgacaactatccctaatcgccagttcgccaccagcctccgcctctcccctcccactcggccactcccagtgccagccgccgtgcgctcgctcgcgcgcgctctctttctgggacgaccagtgggatatctccaccgccgccttacgccaggtgcggaccttcgccgatctcttcgccagcgaagagcgtccatcaggtattcttcccatccccctctattccctgtctgctgtgcgagaccgagttcccaaatctaacctcaggctatatggctatgcatactaacttctacaaccaaaaaacaatatagggtttacatggaccggcccctggatgtgttacattgtaatcgataaaagtgtagctaggtgcgtgcacatatcctgcaatagacattcttggcccagttgtgttagctgatctcccccagtagttgcgttgttctatctgagctcgcaggcctgcagatgtagccattccgtgctcctaattagggtttgttcgttttgctttcaatccatgtggattgggtggttttaaatccccaacaagtcaaaatctttcatcatttttctaatccggataggaacaaccgaacaaggcctagattgtgtaaagacataacacatgagggtatttcttatgatgctggattaaaagtccacagtttgagaaagttcaattccatctttttgcacattcgtgccaaagctttcttatgcatatttgtggtgctggattaattatgttgctttgttaatttgcaacatgttgaacttgctggagatccatttgtaattttttgggttatacctgaagaatttggactagaggccaaatacataacctgtacacaactatgtgggaactgactagttatttgtattctttagttgccgtttagtttatatatcctgtgataccttgcccctatgtttttccattttagctgtgttcaactgtgtggttcaagttccacataacattttgttttagtttcaggcaggtcaaacttagatgagtgctttgtggaattttagcttcacctctgcctttcgtagcttttttttgtatcaccgtcattttggttcttttaatcattattagcttattttcgtttgtaacagtaaaaatggtggcccttgcaaatgaagaggccttggcccatgatgaagatatcatggatgatgttgattctgatgttgaagaatcggactcagaagacgattcaggtgaagaagctcaggataagccttcagacaaagctatatacaacaaggaggccatccttgaaaaacttgaagatattgcctggcccaagtatgtggactggatacacaagctcaccattgagcatgatcagggggaaaaggttgatgtgaatgatgatcttgctcgtgaacttgcgttttacacccaagctttggatggcacaaggcaggcctttgagaagctgcagtcgatgaaggtcaggttcctcaggccaacagattactatgctgagatggtgaagactgatgcacacatgcacaagatcaaggggaggctgctgtcagagaagaagaggatcgaggaggctgaggaacggaggaaggctagagattccaggaagaaagcaaaggaggttcaggctgagaagaagaaggagagggctaagcagaagaaggagcagattgagtcagtcaagaagtggaggaagcagaggcaacaagggggattcaccaagggaaatgatgatgcaccagaccttaattttgaaggagaagaaggatttaaacaatctaagaaaaggagacctggtgtttctcctggtgacaggtctggtggtcttgctaagcgaggtaaagaaggaaagaacaggagggcaaaggattccatgtttgggcacggtggtcgtaaagggctgaagaagcaaaacaccgctgagaccactaatgatttcagaagctttaaccaggggggtcagtctcaaaacaagaagagaaagaggttttgaacttttgatggatatattaagaatttgggtgagtctcaaaaccagaagaggaagaagttttgaacttttgtgttattactattcccccctgcggcattattttgttatggtgtgtgccagaaggaaaaatagtctagggaagcagtccaaacataagacttaatgttttgctttatctggtaatggtcttcttttatcacggaatgcggattatggccctcttcggtttgagggactaaagattagtccctctattttagtctcatttagtctctaaattaccaaatggtgggactaaaacatggactgaactgatttagtctctagtccctcaatgagtggctaaaagagattaaactatattaattttacttttttgtggggtattttggtcttatgattcatttaatgcgtcctgaaaacttttagtatctagaaccaaataggatagaaactaaactttagtcccctaataaaacttttgtccttggactaaaagaactaaacagaccctaaattttaccctcgcttgatgtgcttccttttttattccttctgttctgcatttgttttggttaatatgcatgtgctggttgggttaaaggggtgataacattgctgttgtccgtgagtcacattttcctttaccaattttgatgatatacagtttcctcaccgcaccgattaggatgagataggggatttaatgacttaagtggatgtctggatgaacacactggagactgaaatacaggattcgatcaaataaaatgctcttaaaaatctaaatcaggcaacatacatgccagcatgtccagcgttcctgctagtgtatctgaacctgcataacaaagatctaaggggtgtttgataatgggttaaacatggagacgccacctcccggcaagcggag

SEQ ID NO: 17323 - DNA, 1324 bp, Zea mays
ccattacctagaacatcctaatcgaaaaatccctaatcgccagttcgccaccagcctccgcctctcccctcccactcggccactcccagtgccagccgccgtgcgctcgctcgcgcgcgctctctttctgggacgaccagtgggatatctccaccgccgccttacgccaggtgcggaccttcgccgatctcttcgccagcgaagagcgtccatcagtaaaaatggtggcccttgcaaatgaagaggccttggcccatgatgaagatatcatggatgatgttgattctgatgttgaagaatcggactcagaagacgattcaggtgaagaagctcaggataagccttcagacaaagctatatacaacaaggaggccatccttgaaaaacttgaagatattgcctggcccaagaatgtggactggatacacaagctcaccattgagcatgatcagggggaaaaggttgatgtgaatgatgatcttgctcgtgaacttgcgttttacacccaagctttggatggcacaaggcaggcctttgagaagctgcagtcgatgaaggtcaggttcctcaggccaacagattactatgctgagatggtgaagactgatgcgcacatgcacaagatcaaggggaggctgctgtcagagaagaagaggatcgaggaggctgaggaacggaggaaggctagagattccaggaagaaagcaaaggaggttcaggctgagaagaagaaggagagggctaagcagaagaaggagcagattgagtcagtcaagaagtggaggaagcagaggcaacaagggggattcaccaagggaaatgatgatgtgccagaccttaattttgaaggagaagaaggatttaaacaatcaaagaaaaggaggcctggtgtttctcctggtgacaggtctggtggtcttgctaaacgaggtaaagaaggaaagaacaggagggcaaaggattccatgtttgggcacggtggtcgtaaagggctgaagaagcaaaacaccgctgagaccactaatgatttcagaagctttaaccaggggggtgggtctcaaaacaagaagagaaagaggttttgaacttttgatggatatagtaagaatttgggtgagtctcaaaaccagaagaggaagaagttttgaacctttgctgttattactatccccgctgtggcattattttgttatggtgtgtgccagaaggaaaaattagcttgtattagtctagagaagcagtccaaacacaaggctttatgttttgctttatctgataatggtcttcttttatcacggaatttagattaaaaaaaaaaaaaaaa

SEQ ID NO: 17324 - DNA, 1784 bp, Zea mays
  misc_feature (7)..(7): n is a, c, g, or t
tcgagtnagcacgtaggccccccccccccccaccgaaaactttccactgctccagcctccagcgaaggcacactgccggcgctctatcttccgctctctctcctactcgcgctcggcaaggcggcggcgccgctcaggctcgggctacggcgtcagcggcatcccctccgcctctcgccagtcgcctcgcgccctcgcctccggtcacaccggccggtgactctgctaaaaatggtgttcctttcaaatgaagacgcctggatccatgatgaagacatcatggatgatgttgattcagatgttgaagaatcagactcagaaggtgattcaggtgaagaagctcaggctaagcctgcagacaaagcgatatacaacaaggaggctattcttgaaaaacttgaagacatagcctggcccaagaatgtggactggatgcacaaactcactgttgagcatgatcaaggggagaaagttgatgtgaacgatgatcttgcccgcgaacttgcgttttacacccaagctttggatggcacaaggcaggcctttgagaagctgcagtcgatgaaggtccggttcctcagaccaacagattactacgctgagatggtgaagactgatgcacacatgcacaagatcaaggggaggttgttgtcagagaagaagaggattgaggaagctgaggagcggaggaaggctagggagtccaggaagaaagcaaaggaggttcaggctgagaagaagaaggagagggctaagcagaagaaggagcagattgagtcagtcaagaagtggagaaagcagagacaacaagggggattcacgaagggaaatgatgatgtgccagaccttaattttgaaggagaagaaggatttaaacaatcaaagaaaaagaggcccggtgtttctcctggtgacaggtctggtggtcttgctaagcgaggtaaaggaggaaagaacgggagggcaagggattccaagtttgggcatggtggtcgtaaagggctgaagaagcaaaacactgctgagaccacaaatgatttcagaggctttaaccaggggggtgagcctcaaaacaagaagagaaagaggttttgaaccttttgatggatattgtaacttgtaagaatttggatgtgtgccaaaaccagaattaaaagatgttcgaacttttgctgttattactattcttgttgcagcattattttgttatggcgtttgctagaagcaaaaaatatctaatgttagtctagggaatcagtcaaacacaagactcgatgatttgctttatctggttatggttttcttttatcgtggattgcagataaatcttacccccactgcaagtatactcgaagttgctgctgttcttcctgttgttattccttctgttctgcatttgtttgggttactatgcgcgtgcaggttgagttaaagtggtgatagcatttcctttgtcggtgagtcacatctccctttatcaattttgatgatatacagtttcctcctcacaccaattgcgatgcagaataagggtgtttcctcactgagaactttagaactgttcatcctgagtgctatgggtgtttgcatgcatctcagataacattatcaaatatctgggttgtcgatgtggagatacttgtgtattagttgtgacataattgtacatttttaatgagctatataccttgccaaacatattttgcaaattgttccatgtctggtgataattgccttatagtagtagtgtcatgctgttgtgaatatttgttacagaacaattg

SEQ ID NO: 17325 - DNA, 513 bp, Zea mays
ggtctctagaaccagatgtgaaactacattctagagcagtatgtattctcatgaaattctttccgtttcctttttaaaattggatactgacagaatcatccttacaaaataattggactgaagaagagttctttccttagcatttgaaggcaactatccaatggttgtggagcatagagctgggactggttggctaactgttttcagtacaaattttcttcaatttgaataccgaattacctaagtagaaacttattcaatctaatataataatgtagcatctgtaattaactaggctttagctgtatcctgaatgagatttcattgttgactgtgttatccaaaggtttctgtacgattttcttgcaaatgaagctgttttcttcattcaagccctatgctttctcatttttttgtcaatgcaaattatttatcctgaactcctgatcttcgattttgaaggttgtggttgctaaagaagcagtaggagatttaggatgcttggtcaggcag

SEQ ID NO: 17326 - DNA, 813 bp, Zea mays
acatcctaatcgaaaaatcttcctcatcgcagcaatggcgtcttccttctcactcacgagtttcatctcctccatctccccattcaaacctcagaccaaacctgctcctcctcctccgagcctcgctctccctactccaacagtctctcacaggcggaagaacgatctcgccatcgagaaacctccttcttccaccgcttcgctctcctcggagctcgctcccgtgatatgcccgtcgcttgcgtactcgaacacgctcttcttcagcagctcggggtacaacgtgcaggtgtttgttgaagataacgagtctgaggagaggctggtgaatcgtttcagaagggaagtgatgagaaccggagttatacaggaatgtaagcgaaggagatacttcgagaacaaacaggatgagaagaagcgtaggactcgtgatgctgctaagcgtaacaagaaaaggcgtccttttgcaaagtttactcaagagactagagaagaagcagcagcggcagcatccaagagtaagaagaaggatgaagaagaagacaactgggagatgcctgatggagatgtaccttcttgaacactctttcagtatatagatcttcttccttttcggttataagttggtacattgtaacttcagatgagcatataacttgttttcggtgatgagttcttgccaatgttaaggcatctatctttgccaaaaaaaaaaaaaaagctatcgataccgccgacctcgaggggggcccggtaccaatttcgcctatagtgagcgtattaccgcgctccctgcccgcgtttacaacgcgg

SEQ ID NO: 17327 - DNA, 1186 bp, Zea mays
acagccttttgcactctcaccaggtcttgctgctgcttgcaagttgcaacctcaccctcctctccgggagagcctctcgccttcagctcccctgcccttccacgccacgccgaccaaggcgccaaaagcaaacgctacgccagtacgtggtgagggagcttgtcacggctgcgttgcttgccacctcgtcttcgcggaggtcctcgccgcgacgacgacgatggaggttgccgaggcgcccgacgaggacggcctggacgagcgtggcgtggcgctgcacctgcacctcccgaggctgctggccggcgtcgtctccggcgccctcactggcctcttcgctctcgctggagctctgacgggggcggtcaccggcgcggtggcgggcagggcttccgacagcggcggcgttctgcggggagctgggctgggggcggtcgccggagccgtcctctccatcgaggttctcgaggcttctcgcgcctactggtgctcggaccggctgcggctgggctcgcacggcgcgtcgtccatggctaatttcattgagcagcttcttcgtgcccggtttgtgcaagagcagtttacaccttcaggatatgcatcatatcgctggcaggtgagcatatcggattttggtcacgatgacctatacgacatattcggggacatctcatcgaaagggctcccacaagagtcgctgaagaaactaccacactatgtggtcactgaccagacgcgcgcggactcgttcggccagatcctgtcctgccctatctgtctacaggacatcgtagccggcgacacagcgaggaggctgcccagttgctcccacactttccaccagccttgcgtggacagatggctcgtggatcgcggatcgtgccccgtctgcaggcaggacgtgtgagataggtgaccctgcgttgcgtagatggagcaatagctgggtgatgcgaaatgtttgctcctacacctaagttcatatatatatatatagctactagagagaagatacgtactgtggtgtaaattagcagagaacctgcctgttcccactaccagccagcgtaaacggccgtgcgcatctgacttcgtttcttgcacccggttccaacgtgtaatgaaataataacactgctgtttcgaagcagtactacctgattctgtggaaaaaaaaaaaaaaaaa

SEQ ID NO: 17328 - DNA, 1159 bp, Zea mays
gggtcccgcgcggccgggcggcaccaggtacctcaccctcctctcccggagagcctctcgcctccgctccgctcctctgccctgccctgcccttccccgccacaccaaccaaggcgccaaaaataaacgccgcgccactgcgtggcgagggagcctgtcacattgcttgccgctgcgccctgccgcctcgtcttcgcggaggcctcgtcgcgcgacgatatggagctcgccgaggcgccggcgcccgtgcccgacgaggacgggctggacgaacgcggcgtggcgctgcacctcccgaggctgctggccggcgtcgtctccggcgccctcactggcatcttcgctctcgctggagctctgaccggggcagtcaccggcgcggtggcgggcagggcttccgacagcggcggcgtcctgcggggagctggactgggggcggtcgccggagctgtcctctccattgaggtccttgaggcttctcgcgcttactggtgctcgtcggaccggctgggctcgcacggcggagcatcgtccatggctgatttcattgagcagcttcttcgtgcccggtttgtgcaagagcaacttactgcttcaggatatgcatcatatcgctggcaggatgacctatacgacatctttggggacatttcatctgaggggctctcgcaagagtcactgaagaaactaccacatcatgtggtcagtgaccaccagacgcgggacttactcggcgaaatcctgtgttgtcctatctgtctacaggacattgtggccggtgagacagcgaggaggctgcccggctgctctcacgccttccaccagccttgcgtggacagatggctcgtcggccatggctcgtgccccgtctgcaggcaacgcgtgtaaaagatatataggcgacctgtgtctgtgtacgtagatagacgtggagtgaagagaaacgaccgtgcgcatctggcaatctcacttcgtttcttgcaccccggttccaacatgtaatggcaatggaataagattgctgtcggagcagttcctgtttctgtagaatttgtttgtccgcttggcgctccgatccgcgtgcggcctgaacaggctccgggcgctgttccgcccgtgtcggcgatattcttgctgtcctcgttctaaaaaaaaaaaa

SEQ ID NO: 17329 - DNA, 1237 bp, Zea mays
agaaacaaacagccttttgcactctctcgccaggtcttgctgctgcttgcaacctcaccctcctctccgggagagcctctctcgccttcagctcctctgcccttccacgccacgccgaccaaggcgccaaaagcaaacgccgcgccactacgtggcgagggagcttctcacggctgcgttgcttgccacctcgtcttcgcggagggcggagggcctcgccgcgacgacgatggaggttgccgaggcgcccgcgcccgcgcccgacgaggacggcctggacgagcgtggcgtggcgctgcacctgcacctcccgaggctgctggccggcgtcgtctccggcgccctcactggcctcttcgctctcgctggagctctgacgggggcggtcaccggcgcggtggcgggcagagcttccgacagcggcggcgttctgcggggagctgggctgggggcggtcgccggagccgtcctctccatcgaggttctcgaggcttctcgcgcctactggtgctcggaccggctgcggctgggctcgcacggcgcgtcgtccatggctaatttcattgagcagcttcttcgtgcccggtttgtgcaagagcagtttacaacttcaggatatgcatcatatcgctggcaggtgagcatatcggattttggtcaccatgacctatacgacatattcggggacatctcatcgaaagggctcccacaagagtcgctgaagaaactgccacactatgtggtcactgaccagacgcgcgcggactcgttcggccagatcctgtcctgccctatctgtctacaggacatcgtagccggcgacacagcaaggaggctgcccagttgctcccacactttccaccagccttgcgtggacagatggctcgtggatcgcggatcgtgccccgtctgcaggcaggacgtgtgagatagccagataggtgaccctgcgttgcgttgcgtagatggagcaatagctgggctgctgggtgatgcgaaatgtttgctcctacactaagttcatatatatatatagctactagagagaagatacgtactgtggtgtaaattagcagagaacctgcctgttctgttcccactaccagccagcgtaaacggccgtgcgcatctgacttcgtttcttgcacccggttccaacgtgtactgaaataataacactgctgttgggaagcagtactacctgtttctgtacattctccatgtatgtttggcactc

SEQ ID NO: 17330 - DNA, 6280 bp, Zea mays
  misc_feature (59)..(59): n is a, c, g, or t
  misc_feature (98)..(98): n is a, c, g, or t
  misc_feature (2602)..(2602): n is a, c, g, or t
tatcagtttctagggtgatatatgattacattacacataaaccaaatatggtttacgtnatctgttaccgttgaccttacaaatacgtgaacctgccnacctgaaaagagagggaaaggttgccctgcttgtgttgcgagtttggactctccgcacccctgacgcgtgtccacttcgcctctcaccatccgtcgtgaacagtggatcccgagcgcgctgggcgttcccgcttccattccatctaaccagttcccagccacgaaaactccgcaaacatcgcacgcacgtacgccgtttccatgccatgcatggacaccacgcgctagttaacccgagatcggccccccatcgctgatgccaggaccgatcacccgacgacgcacaaacaccactccgcacggattagccgacgccgacggtgagcagcccatcagagcgcgacgatggcgggcgtcttttggggaggcgggagggcggacgaggtggctgacttcgacgagtacgaccccaccccctacggcggcggctacgacatcgccctcaccttcgggcgtccgctgccgccctccgaggagacctgctacccgatctccaccgcctcctcgtacgaccgtccgcagcagcacggaggccggaggcccggggccgaggagtcccacggctcagctgcagggtacggtggaggcggcggcgggtacgcgggggcggggcggcctcatcagcttcataaggaggaggagacccacggctacgggaggaaggggggacacgacgacgaccacgagcagcaggcgtaccgaaagccgaagccctcgtacgggcacggggacggcgacgacgaccaccaggcgtacaggaagccgaagccgtcgtacggggacgagaggcccagctccggccggaagaagaagaatgtgagcgtaggctgccgaatggccgatgggccttgaactcgtaatctgggctgttttaaacatggtgaaattacaggacgacgacgatgactctgatgacgacggcgcgaggaagccacgttacaaaaagaaagacgacgacgactcggatgacgatgacaggaagaagcgctacgagaagaacgaccgccgccgccgccacgactatgacgattgagctatatgcatgcagtctcgtatatacacatgtgctcgagtcacgcgttatgcaatgtatcatccccagtgcatctcctactagcagtactgtagtaaataagcgaagctgagatgcagggggatgcatatggtggacacagttttgatttcaagtgacgccgctttacagcctactccttccttgtttttgttcttcaccttttctactgttctgatggtaacctgtatactcgcgcggttacttgcgaccattgttttttttttgaacaaaatattactgtcgattttcaggttcacagtaactaaaaaaaacgtcatatacatgacatgctatgctacacaggtgctgttcttcatagctggtgaacttgcattcttcactgacatacatacaccaatttcccaataatcctaaactcaataacaaaagtgcagttagaaatgacattattcatccatcgatcgcgtagcgacgactactttatttgagaaagtgcatgctctaattgcatcgtcttccatgctagcacagtatgtattggcaatgctgtctaatactaggtacactcatcctctgttctgagctggaaagcatgctggggtggctatttgatggcgcgcggtgctgtgtcttcccgtgtcgtacgtttgtgtcacgcacacttgttttggcctctctcgtgccaagctagccaactttcggtttcatgcggtgcttgcatgcatgatactagtacgatgtttctttcttcaagtttttggagattttcttgtttttacgaatagggtacggatatcatcacaagtaatgtcttgctatctggttcagtacgtacgtgttgatgtgaccggtagttgttggatcttaatttgctcttcttgcgtacgttgtggcctgtagtctaaacaaaccaccgatcgttccaaggaacacatcgcatcaaggccatgcatatgcttgcaaagtcaccagcatggttgtggaggatacgattaggatacacgccggtacggtgtctgcagccccgccgggggcggatcggaggcacgtacggtagtagcccgatcgagagacagctcgggatgtgtattcttgggccggaattcaatgcaccgcatggatagctctatcttcttctccaggtccaggatgggaggagcaggagagcactgttcatgatttggtgcatgtcgttggtcgtattccccagaacggtgctcgcgtcgtgagcttaattaggccagtcccaacctgaaaatagtagtatcaatcatgccaaataacacgcacatgagcccgacacggtggaatgtttctaggatgcgttggaccgaggcgctatggtgtctgatgaccttgagtcatagggcctgatgatccaatgtgtaggcgtcggaccaaactctcgatggtttgatgaccctgttcctcagtgtatgatgtctacggaacaactaaaatcacttcnaatttaaagtatttgtttaaaatggtttttgagccttcttctcttaactatacaatgtaaaaaaaaatctaaggacttgttcggttgcatctgaattgaaggggatcagatgagataaatttctcactagtaaaaaatgaataggactagtttgatgaccagagaagtgtggagatctatggataggaatatctttgctattcaaaaattgaataaaaagagaatttctctctcattgacaactctatttctctggtcaccaaaccagctctaaaaggtgtttaatcctcctcaattttcttagatccagacatatccgaacaaggcttaataggcactttttataattggtcagccacgtatttaatttgagaaagtactatccatctcgatactacaaacgaacgctaaaatttgcagcagataatagacgatggcaatgctgaattgccgaggcagtgtcttacctgagtatttccgagaaacaatataaagcctgtgtttgctggtctttcggggagaaagaaataaagaaaaagaaggcgagattcttttacccaatcattgcgcgagttagaaaatatatggataaatgatctataatactaatcaagtaatcaactagtactatatgttcatattcttccgtgcaaggaaaaaaaaagcctcaccaaacaccaacctttgaggtacaaaacagaaaagccacgcgaaccagaaaagagaaagcgaccgaacaaatatgatttcacaaggcgtccgtccgctgaaacccacagccttttgcactctctcaccagggcttgctgctgcttgcaacctcaccctcctctccgggagagcctctcgcctacagctccccagctgcccttccacgccacgccgaccaaggcgccaaaagcaaacgctacgccagtacgtggtgagggagcttgtcacggctgcgttgcttgccacctcgtcttcgcggaggtcctcgccgcgacgacgacgatggaggttgccgaggcgcccgacgaggacggcctggacgagcgtggcgtggcgctgcccctgcacctcccgaggctgctggccgccgtcgtctccggcgccctcactggcctcttcgctctcggtactttacttgcactgtcgcacatgctcctcacgcctcttgccccgttttagccgtcctgaggctgagagctcgacgttggctttgtggtgcatgtgccgcgcccccccgcgcgcgcgtaaagctggagctctgacgggggcggtcaccggcgcggtggcgggcagggcttccgacagcggcggcgttctgcggggagctgggctgggggcggtcgccggagccgtcctctccatcgaggttctcgaggcttctcgcgcctactggtgctcggaccggctgcggctgggctcgcacggcgcgtcgtccatggtatatagtaatatataagcttcttttcttccatgcccggtctttgctctgttcagctgtgtttgctttcggttgcgtattcttgtaaattacggttcttgattgggggcgccgttggaatggacgttaggtgtgagcgtaaatactaggccatctcttcaacgtcatcgtgtagtatgtcagtaggtgtgagagtgactgttactagtagtacttcatgaggttcccttttgtttcattaaaaaaaagagcttctcttgtgtgcactactattgcttggtcgtttgaggcctactgtatatcataaatatgagttaatttggtgtgcaggctaatttcattgagcagcttcttcgtgcccggtttgtgcaagagcagtttacaacttcaggatatgcatcatatcgctggcaggtcagtagcactgactggagtatgattttgatagcaggaaagtacataaaacatgataatggattctcgccattgtgttcgccacataatgatgatatagtgcctgtttggacgctggcattgagcgccacaccccgcctaagatacggcggccgattcggccgccataactgcggcgcacaaagtgtggcgcggcgtgctaccagcggcggtgatccaaacacgcccatagactagtgttttagtagtcctttttctttttttcttgtcaacggttcttttgaattattgtttttgttgttgttgttataaagaaatccaatggtaatgccgcagagaagaagaaaaaaacaatagccacagttaacgggttgtctgtgtgtttctgctttgtactaaattttagacatttgttcatggcaggtgagcatatcggattttggtcacgatgacctatacgacatattcggggacatctcatcgaaagggctcccacaagagtcgctgaagaaactaccacactatgtggtcactgaccagacgcgcgcggactcgttcggccagatcctgtcctgccctatctgtctacaggtacaatactgccacggagtagttgtcaatgaaaattacagcctcaatggggacaactgcaattagcgattcccataccgggatttgttcgctactaaatgcgacgtttcttctcctcatcaactgccgacctgacctgacctaacctaacctaacagcgtcctcttcgtccgtcttgcaggacatcgtagccggcgacacagcgaggaggctgcccagttgctcccacactttccaccagccttgcgtggatagatggctcgtggatcgcggatcgtgccccgtctgcaggcaggacgtgtgagatagccagataggtgatcgacctgagtagatggagcaatagctgggtgatgcgaaatgtttgctcctacactaagttcatatatatatatagctactagagagaagatacgtactgtggtgtaaattagcagagaatctgcctgttctgttccactaccagccagcgtaaacggccgtgcgcatcggacttcgtttcttgcacccggttccaacgtgtaatgaaataataacactgctgttgggaagcagtactacctgtttctgtagaatctgtctgtatgtctgtttggcactctgcgtagtttctggaacagattccattccacccgtgtcggcaacggcgatattcttgctgtcctcgctcgttcgttcttgcagtgtaggcactgtgtttggaatcaagtgttcgatatttctggaacagattccgcgcgctgttctgcccgtgccggcaatattattgctgctctcgttcttgcagatgcagaccctgtgtttggcatcgagtgtttggtgactggtctgttttcggtcctcatggccatgtatgtatactccagtgcccatctgcttgcttggaaggtctgaaaccgatggcgttagtgtccaatccagatagagcactgttgataggacatcggcatgataccatccattcatccttgatggagaagagagcagcggccctggtccactgctgtcctgaatcaattgcttgaatttgatggggttaattatagaatttgggacacggacaccactccatgctggtatagatgtccaaataaacgggccgtgagcacggctaggcccggcacggattgagaccatatgccggccggtctggattagctagcgggccgtgacgtgccatccaacgggccccaagcgaggcccaggcacagcccgctaggttaataatcgtatcggggcgttca

SEQ ID NO: 17331 - DNA, 2841 bp, Zea mays
tgcctccatccaccttgacctccactcaagattcagtggtgacgactgacgaaggagatcctgccgaactggctttgaggatgaacagtctgcacgcgctcatatagctcaaaacatgatgtattcataaactgatactttacaaacttatgtgtgtttgttaatatatctttttgttctttataaatcttgtaaccttttcgttcggtgacaatcacattcgtgttgatatggcatgcccctcgtaaagaaacttcgaggagaaggacctctatatgacagaaagaaaactgtgtttgttgggattgaggaaccttccatttgatgtaaaggtgatcaattttttcattcttatactatgctttctttagttttatataaaataaattaagcaatattttatttctgcctacattaacctagaattgctttgtgacatattaggatgaagaggtctactaggtgttctgcagttccaagagatcaaaaggtgatgttgaggctatacatgttatcagtcatcagagatcaaagttcaggctctaaatacaagggctaacaaattcgcatgtgtgctccactgtcatctcaaaggtaggaagatattcacctatggggagttttgagcttttagatggatgaaattcttgaagaaggtgtgggaaacaaagatagtggacgttttgtgttgttggtattgaacaagaatattccccgcatgacttttttttaacaacaatgacaccttaaactatttgtccacacattcctatttgtggtagttgtaggttgctttgaacttgctggaaatgtgaggttctatggtttctacagcaacagaatctagagtctcagtgctctgcaaggtgctctgaagaaggctacggagcacatgtccaccttaaaagctaataccccatatactaaatttcaccataggcaatgaatgtttttgactcatttccatgcattaaagcaactgaagcatgtattagtgttcttgtgatttaacacaacattgtgattgcacaaaacaggcgcaaagtttgtcttggcttgccctgatactagaggtcaagtacactccttagccactcaaacacgaacacatagttaaaacattgaacttggtctgatcgatctatatttcacctgcaggttgtctacattttgggtcaagtgcgtgctatggacaacgagatgctactgaggatcaagcagtatggtcttgacatgatgccaaagatccttattttaagtgtgatggctaatatggtaaaaggaaaatgtagcggctaaattggtgccataaggagccttatttgattttttacgcaggtgaccaggttgctccttgatgcaactggccccacttgtggccagcatcttgagaaggtcctcggcactaagcactgcaatatcatttgtgtgccattcaggacagaaaatggaaccattcgcaagtggagcatcttcaagtatatgtaagttcgtacccaaatggtttatatcttggtagtttttcacaataggatgtcaaactttgcattcactgtttcttttttcatctgcttgggcaatagggcacatacttctgatcatatatcaatgtgattatgccccttgaaaaggtttgtgaatccaattgttgcaaacaccaattacttgactaggatcaaactatttttgtcccactcttgatgagtttgtagttttggcactgactgatgcacacatgttctacattttatatagtagtatagcctttaggatccaatctgcaagtgggggatcacattccttttatttgagtgcatttattgaaccttggtcaacggatgactggaaaaattactggtacaagagagggggaggttgtgtcggtgtttgacccgagggtcttaccaactacagttactccatggtaaactcttttcacatctcccattctgataaaaaaagaactgcaaacttgctcaaattcgcaacgaaaatctcaacatcaactttctttttgtttattcaaaaggatttatatttatgttcaccagtttagccataggttccaaacacttgctcagataagactacagaaacaatcgaagcagttagcagagtggaacactgctgccttctcatctgaacttacagctactaaacacaaagaggtacgccatcttttctatattaaacctccttggtctgagttctatacaatatattattactgctaccttctctacagctgtagatgacccctaaggattctaaactggtgatgctaaaaaactggtgatacactacaaccaacaaggtatgtatgcattctgtatttaaaaaaatcaattacacttctcttccagcatgaacttactgctatttcctttcttctacaccttggtgtgtgtttttatgcagttatttaataacactattacactactttccttttcaacagattgattcgcagcaagtgtttggctgcatataagaagctttcatctaatgaggtctcccggtgggttgttgaaaggatggtcagtcttcatgaccaatatgaagaagactggatcatcagatgttttttgatcttggcttgtaattctttgttgttcccaacaaccagtttgttcatttctggcaaggactatattgtaactgaaagtttagaggaagtaaagaattatgactggtgtcagagactctgtgatgatattgttgcaaagtctgagaagttcatgttggagagagcaaggcatgttgcaacaccccacatccaaggatgtattcttttttatggtaataacccttcagttattttttcacagaggtttagtaatt

SEQ ID NO: 17332 - DNA, 2381 bp, Zea mays
caggtcaataacaggtaccacaagatggggcgcatggaggatgttgtgatgtgttcgtgagaggtctaggtcgtcgtctcccagtcaactttgggttgatggatcgttgtttccttacgatgtaatttatttattttattttgtacataactcctataatatagtaaagttgtaacattcatttctgtaccataattcatcatatgtgtgagacttggtcccagcacacctggtgattatgttcgcgtccgggtccctaaaacccgggtgtgacaaggatccaagaccaccacacccaagagtccaccaagcaattcaaagagatcaccccgtcaactccatacttggtgacatccacaagcgggtaacaactcaatctcgagttgctcatttttgtgaacattactcttttgtgtcttctattaagccatataagatagaggatgcactaagaaatctagactgggtggtggcaatgcaagaggagctcaacaacttcacgtggaatgaggtatggtatttagttccacatcctaaccaaaatgttgtaggtaccaagtggatattccacaacaaacaagatgagcatggtgtggtgaccaggaacaaagctcgacttgttgcaaaaggttattcacaagtcgaaggtttggatttcgatgaaacctacacactcgtagctaggcttgagacaattcgtatattacttgcctacgctacttaccatgactttaagttgtatcaaatggacatgaagagtaccttccccaatggccctatcaaggaagaggtatatgttgagcaacatcctggctttgaagatagtgagtaaggcaaccggtccggttttccccgctcgacccgcgcgtcctcgcacttgtgcccagacagagctgagctctaagcatcgtcacttgacatctaccctaattgcgaaaaggctattggggacattgaagggtcagccaaacttgaaggtgaagtcaattatgaccatgacttgggagctgtttcgtcttcaggatcaagtatgggaaagcatggagggcaaagcagcgagcatggaagatgatatacggggattgggaggagggttacgagaagttgccagcattgttcaatgcaatcaaagctaaaaacaccaggcatgcattacgagtacatccctaaacccaacgaatggaggaatggcagagagatcttctttcgtgctttctggtgtttctcgcaatgcgtagaggccttcaggcattgtcgtcccgtgctgtctattgatggtacttttctgcttgggaagtataagggcacattgttggttgccatatcatgtgacgcggacaacacattggttcctttggcatttgctttggtggagagggagaacagagagagttgggcttggttcttgcgacttgttcggatccatgtcgtgggccctggtcgcgaggttggtgtcatatctgacagacatcagggtattcttaatgcagtgcaagagcagattcctggctacgcacccatgcaccacagatggtgcactcgacatctagcagaaaatcttcttcgaaaggatcgtagcaaggctaatttccccctttttgaggagatctgtcaacagttggaggtttcgttcttcgaggacaagttgaaggaactaaaagatgcaacaaatgttgaaggtaaaaattggattgctagattactgagggaaccccagaagtggacaagggcctacgacgaaggtggatggaggtacgagttctagactagcaacatggccgagtcatttaatagtatgctgaagggtatacgtggcatgccagtaaattctatagtaacattcactttctataggcttgtggcatggtttaatgagagacacacacatgccaaggcaatgcagacgcgaggtcagagatgggcacctaaaccaatagcacatcttaataatgcaaaggaaagggccaatagacatgaggtacaatgctttgatgaggagttgggaaaatacgaggtaacaacgatgggttttacaacttctgacggtgaggtgcggccttcgaggacacatgttgtgttacttaatgcattctcgtgtggtcgtggtaaacctagatagtaccactttccatgttctcattatgttgccaccgcacgtcatcgcaactttgcattcgagagcaggatcccttcgaagttcagtgtggagagcttaatacgtacctagagccctcgttttgagccatttcttgacgagtcacagtggccaacgtacatcggtctgatatacattgctgatccagcgcatcgttgggacaaatgtggtactaggaaaaggagtcggtgcaacatggtcatggatcaggtttccggccgcacta

SEQ ID NO: 17333 - DNA, 3229 bp, Zea mays
attattgagttagtaatccatttttgcaatagatggacagcctagtaacactataccatggaggaagggtggagattgatgcttatgggagtgttacttttgatggtatgaggatcgtgaccatgttgttcgttgaaagaccatcttttgaccagcttttggctcgagcttgtgaggagattagttgcgacataaacgaccctagaatatcaattcagggtttgttgtcccatattacatatggaacagttgtccggcggttgatctccattacctcagaagatgattgggtgatatatttaagaattgtgaagacgatggttccaccatgtttggatgtggttgttcaaaagttacctgttagtcaatgcgaagggtccagtcgggttatctccacaaatgccaaatgcatctcgtattgaagctcctttggtagagcttcatgaagaagtcgttgttgtgcccgatgctcaatcgggtccgcacgagtatgggatttctcgtcctattcccggcgtttgtggggcttctaatgcggtggtacccccccaagagatcccattgacccaggatccagttgacgatcatcctagtaagtgtcttcgacacattgttcgtatccatcattatttcgtttgattagactttttaatgtggtttttcttgctccgacccgatgcaggatctccacatatcaataatgctgatgttcagattgatgtgcctgtgtcatataatatggacaacatatgcagggcatcgaatagtgttgatgttcagattgaggatgaggaggagccatatgaggctgcacgggccgtagattctgatgatgaccgtccggttcaagaaatgaccgagcaagaaattgaactcataagacgtttgtgtccggagcgagaccctgcagtacatgaatttagcagtttaagtcattccacccgtgcgtatgctgaaggacgtgacgatgaactgctagaggctccggataacgccgacagcattgagattaaggttggcttacttttcaaggatctgcctacactgagacgatggctacaggaatattctgtgaaccggaagaggccgttcaaggtgagacattcgtatgcacagcgtcgttacactgttgtgtgcgaggtgccagaatgtaattggagggtatgtgcccgaaggcagaaggacaccggaaagtttaagatcaccaaaattgtaggtccacacacttgtgcccagacagagctgagctctaagcatcgtcagttgacatctaccctgattgcgaaaaggatattggggatattgaagggtcagccaaacttgaaggtgaagtcaattatgaccatgacttcggagctgtttggttacaggatcaaatatgggaaagcatggagggcaaagcagcgagcatggaagatgatatacggggattgggaggagggttacgagaagttaccagcattgttcaatgcaatgaaagcaaaaaacccaggcatgcattacgagtacatccccaaacctaatgaatggaggaacggcaaagagatattttatcgtgctttctggtgtttctcgcagtgcgtagaggccttcaggcattgtcgtcccgtgctctctattgatggtacttttctgcttgggaagtataagggcacattgttggttgccatatcatgcgacgcagacaacgcactggttcctttggcatttgctttggtggagagggagaacagagatagttggtcttggttcttgcggcttgtacgcatccatgtcgtaggccctggacgcgaggttggtgtcatatctgacagacaccaaggtattcttaatgcagtgcaagagcagattcctggctacgcacccatgcaccacagatggtgcactcgacatctagcagaaaatcttcttcgaaaggatcatagcaaggctaacttccccctttttgaggaggtatgtcgtcagttggaggtttcgtttttcgaggataagttgaaggaactaaaagatgcaacaaatgctgaaggtaagaactggattgctggattgctgagggaaccgcacaaatggacaagggcctacgacgaaggtggctggcggttcgagtttcagactagcaacatggccgagtcatttaacagtgtgctcaagggtatacggggcatgccagtcaatgctatagtaacattcactttttataggcttgtggcttggtttaatgatagacacgcgcaggccaaggcaatgcagacccgagggcagagatgggcacctaaaccaacatcacaccttaataatgcaaaggaacgtgcccatagacatgaggtacaatgctttgatgaggagctgggtaaatacgaggtaacaacactaggcggcataacttccgacggtgaggtgcgaccttcgaggacacatgtcgtgttacttgatgcattctggtgcggttgtggtaaacctagacaataccattttccatgttctcattatgttgcggccgcacgtcatcgtaactttgcatttgagagcagaataccttctgagttcagtgtagagagcttagtacgtacctggagccctcgttttgagccatttcttgatgagtcacaatggccaacgtacaccggtccggtatacgttgctgatccagcgcatcgatgggacaaacgtggtagtaggaaaaggagccggtgcaacatggttatggatcaggtttccggtcgcagtaggagaggttgagcgtccccctttctcgtggacccagagcagaatgaatgcggaaaatgcgggagacttggccacaactcatgtacatgcatttggacacttagtcaggtgtgatacattttaatattttattgtaaacaacttttattctaatatgtcgatgtttttgttacacttagtacacaacttttattgtactatgccaatgtttctaatatttttactaaccttgatatcttaatttgcaggatggcgcagttccacttgctggaccctcactacgacgagcaccacaggggccgcctcaccgcagagggagaggtaatattttgcacaatatattaaattttcgaattaacatatgcgacgtatatttgactaatgaaattactttgattgctaggtgttgcccgttctgcgggtcggacccacgaccggtttctagaggagatgaggtacaatgagaggtacactcctctcctacacagggctagctttggac

SEQ ID NO: 17334 - DNA, 1429 bp, Zea mays
tgagataggcttatatgataactttggaaagtggtggaatgtcacattttaaaaaaatagcctattccaatagtaagattccaattcctcaaaataaaaggaaacaaacggggcctaaaggattttggccctctcagtcccttccattactctcaaacaagcactaagtgtctaacatacaaaaatggacgccaacttttatgacagctcttatatgaataattattccaccctccttccacatgaaacaggattatctactgaacaatgcaaccaatctagcgctagcaaggggatcccattttatctcatcagcatcagattgctagtgtgccatccactgtttggttttcgtcgtcggaggtgaaagacttcgatttggacgtagctctggaaaatccatagccaagagaacttcctgacgtagcacacaactctgtaagctctgacagatgacgattccggaactcgttgatggtttcctgaatctctgacattgggagttttgcttgtgcaaggacagcagcagctagctgaagacttggctccaaggtctcagggacaaccgccgttgcaccagctttctccaaattaacaccatgatcaacatcatgtgctctaacaaatgtcttcacatttgggaaatatttgttcaacgcccagacagctctgtagtttgcaccaggagtatccaaagtaattgcagcagcacaagctctttcagctccaattttgtgcagtacctctctgcttccagaatcaccaaaatacactggaagatcaagtgcacgcccagctgcaacccgatcacttccagcatcaagtgcaacaaaaggaattaaccgctctgacaggagttgtgcaatgatctgcccaacacgtccaaagcctaatataatgatatggtcttgcaaatcgtcagtctcactttccacgggcaataaactcctcacatcatgctgctcaaattttgatgccagaaactgccctccagcagctaaccatggtgtcagagccattgaaatgccaacgactaaaaatagcaacgatgttaattgaggtgatagaagaccctggttgacagcttctccaaaggcaacaaaagcaaactcaccaccaggtgcaagcaagaggccaacacgaatggcagctatagcagaaaccccaaacgccctgccgacaaatgtaactaacaatgtctttccaattatcaagagactcaatatcacagagatcgcagggaagtttgacagaagcagctttgggtcaatagacattccaaccgtcataaagaaaagtcctaacagaagaccacgatagggagctatatctgactcaacctgcaatgagaactctgtttctgctagtaacagaccagctaaaaaagctccaagtgccatcgataacccagcccgggctgtaagaagac

SEQ ID NO: 17335 - DNA, 2300 bp, Zea mays
  misc_feature (2272)..(2272): n is a, c, g, or t
  misc_feature (2298)..(2298): n is a, c, g, or t
cttgcatgcctgcagcccgcaaatgagaatcgcttatgcgaaaataattcaaatcaacatgaatgttgaatatgtctagtcattgcgacgggaaatctaccacttcctaaaatttaaatcgtacagatcatttcatctttctccgcatacaagccccgcgatccccgcgattagacctaatcatggactacctgactcagaccaacccgatctgacccgctcaaaaaaatccaacccgaccaataagatggacaagtaaaagtcatagttttttaccctcaacaatccacggacaagatatatgccatgatttttgaccctgactcaactccaaaaaatctgactcaaagaagaaaaaaaaacgaaaacccgacacgtttaatagagagacacagtccaacctaatctggcactatgcacaggtcaaacgtagaccgtgccaaactacccacaacaagatcttaaccctatgcacaggtcaaacgtagaccgtgtcatatgacccacaatccgatcttaacccagcgtttgaatagatcaactagcgatatctaaattcttgtgacagttagattatccaaaattctagatttttagaaaagctctttaaaaaactgtcccaaacacacccaaaaattgtactaaacatacccaaagccaggtcccaaccgtccaactggcctgactgtaccatatgctcctttgagcaaagcatgggaagtattcagcattctgacatctattttcttccctgcttacaagggtctcattttcacgtgcactgctagagtgtattatttttctttgtgaagagttgtatgcaaacaatttttttgggggagagaagaaatatataagtactctaacatacaaaattgcacgccgacttttgtgacagctcttgcattaatttttattccatttttctacatgcaacaagcttatctactaacagtgcaatcgatctagtactatcaagggatcccattttatctaatcgtcttcaaattgctagtgcgccatccactgtttcgctttcatcatcggagctgatagacttcgatttggacataactctggaaaacccatagccaagagaatttcctgacgtagcacacaactctgtaagctctgacagatgacgattccggaactcgttgatgctttcctgaatctctgacattgggagttttgcttgtgcaagaacagcagcagctagctgaagacttggctccaaggtctcagggacaaccgctgttgcaccagctttctccaaattaacaccatgatcaacatcatgcgctctaacaaatgtcttcacatttgggaaatatttgttcaatgcccagacagctctatagtttgcaccaggggtatccaaagtaattgcagcagcacaagctctttcagctccaactttgtgcagtacctctctgcttccagcatccccaaaatataccggaaggtcaagtgcacgcccaactgcaacccgatcacttctaacatcaagggcaacaaaaggaattaaccgctctgacaggagttgcgcaacgatctgcccaacacgtccaaagcctaatataataatatggtcgtgcaaatcgtcagtctcactttccacaggcaataaactcctcacatcatgctgctcaaattttgatgccagaaactgccctccagcagctaaccatggtgtcagagccattgaaatgccaacgactaaaaacagtaacgatgataattgaggtgatagaagaccctggttgacagcttctccaaaggcaacaaaagcaaactcaccaccaggcgcaagcaagagaccaacacgaatggcagctatagtagaaaccccaaataccctgcccacaaatgtaaccaacaatgtctttccaattatcaagagacccaatatcatagagatcattgggaagtttgacagaagcagctttgggtcaatagacattccaaccgtcataaagaaaagtcctaacagaagaccacgataaggagctatatctgactcaacctgtaaggagaactctgtttctgctagtaacagaccagccaaaaaagctccaagtgccatcgataacccagcccgggctgtaagaagacttgtgccaaaaataacaaggagtgtatttgctgaaaatatctcagcattctgattttcagcaatttgcttgtaaataggccgaagcaacagacgacctccagcaattatggcagttatagcagctactgctttgactgcagccattcccatggcttnctgctattgcttggacgccggccctncc

SEQ ID NO: 17336 - DNA, 967 bp, Zea mays
ctaaggtttttttttttttttttttgtgttggctgttttttttttttttttaccggtatactgcattattatctccatgatgaataaaataatgaatgaatcgatcaatttatacctcccaaaaagaaagaaagaatagctaaaacggcttgtgatttgagacggtgtcgtgtcgcacgttgcacgcgacggcctgtgcccacatcctgagcaggtccttcatctccgctgccgactgcaccctcactagcgctggccgctgccacgcctccgacaggtaaggacgccggggactggtcgtctgcttcttgctgcgccgcggctcatttccactactgccgccgccgggcgtcctctgctcagcctcggccttgtgcgagtgcctgagcagccccatggccgtggcggacgtggggacgggcatggacggcgcccggcgcagcgccgacctgcctccctccgccagccttgttcgcaggacgccctcgtagatggagctccagttgaggtcgtcgtcgtcatccttgttgttgttggtgggcaagggcaactccgtcgtcatcccgacgcgagacgacgggagcgacggcgtccggagtagctgccggcctcctagcctggccggcggccccgccgaacccgaggccttctcccctgtggctgtggctgtggctgtggacggcgacctgggcaggtgcggcggcggcttcttcttcttcttggcgctgctattggtgacgagggtgttgccgaagaaccagtgctcgtccagcaggtccagcgccggggctatcgtcggccgggcggcgtcgtgatgatgctccagcggcggcggcgagctgcagctcatgatgatgcctgatgctctctctctctcgtctctttcaagtcttgtccaccagcttagctgatcctggtatggtaggaacaggatccggcccgggggaggtctcatcggtttttccag

SEQ ID NO: 17337 - DNA, 720 bp, Zea mays
tggccctaaattgtttaagggttgttgactgcatccctggtgcgaataagcgcagcaaaatcctaaggagtcaggtggcacttcagctgctgaagatcagctttgggcttaaggtggcgaatgttgagaagattttgaagctagtcccatccatcaacgtgaaggagaaagaatgtgacttcttcaggctttatgtgtatctagtattgatggacaacttgctcttctcaagtgatgcatttagagataagactgggatggttgatgcttggcggaattatctgcgcaactgttccacccaaattgggtgcacggactggagattctatgctccaaaggcccgaaacaaggcttcttatcttctgcaaggttcaatcttgaaaaaaagcagtggcgatggtaaaagttgtgtccggtaatcaaaggggaccaaatgtctggtgcagcagtgcccaggttgtggttccattcgatgggcaacggcgaagtgctcatatcattccatgttttatgtacaattcttttttagttgttgtgttttagttcaaaaatgaactagcgagcgacaaatattcgagaacagagttagcagccagatttagaggggtgttgattgatgtatctgtgggggtgcttctgcttggttgattgacagaaacaaaaaggaaagagagcagcaagggatgattgggtgcaaaaaaaaaaaaaaaattttgtttt

SEQ ID NO: 17338 - DNA, 1750 bp, Zea mays
gcaatactggctagatatttccggtcctcaaagctcccgcccgccctccttccctccctccctccggcgccagtccaggcacaggcaggcttcagtctccagagatggcgaggaacgagcccctagacttcgagaacgaggacgatccgctcctccccgccccgcgccccgccaagaggagcaaggtcatcggcatggatgatctcctgctggattactttcaatctggtaaaaaggacaagctcaaagttaaggctgccaagtctaagcatggccccaaaggaggatatgattcaggtgaggaagacgacagggctacacagcaagagattacagtctgcaaaatatttgaggaagttcagcaaaagggcaaagtgatggatgctagagacgatgtacccccatggggtcaacaattttttagatgccagaaccccccctcaaatcttagcaatggcggagttgagaattgtcatctcctgcaatcattctctgcaattgaagatataggttttgatctagagatgcatcaaggagaggggttcctcgaaggcatgctgttggatggatggcttctgaatttggttcgcatatgtggttttgttgaagactctgtagcatcgtggacgctgaccaacttgttgcattcacccaatgagaaattacaagtttctgcagctgacttttgggatggcattctttccttggatgaggctggtgaaccgttggtcaaccttgggtattttccaagttactctgttctaaaacgggctatgctgagctatggatatctatttgatacttcaggcactaaggcttcaatctctggaagcactgctgcaggtggccctgatgatagtctgcctcataacatcattgcttggttaagagttgtatctgcttgctgcaaaatcagaaaagtgcattccatcttctcgccttctgaggcagaagaacttcttgctattgccatttccctctttttggaccgtcgacttgaagggttgctgcttgttttgggagactgcctgaattcacttatattatacttcaatacgagtgagtgggaaactagctgtgtgatggtggctgaatcaattgctcagagggtcacactggacctcaattgtttaagggttgttgactgcatcactggtacgaataagcgcagcaaaatcctaaggagtcaggtggcacttcagctgctgaagatcagctttgggcttaaggtggcgaatgttgagaagattttgaagctagtcacatccatcaacgtgaaggagaaagaatgtgacttcttcaggctttatgtgtatctagtattgatggacaacttgctcttctcaagtgatgcatttagagataagactgggatggttgatgcttggcggaattatctgcgcaactgttccacccaaattgggtgcacggactggagattctatgctccaaaggcccgaaacaaggcttcttatcttctgcaaggttcaatcttgaaaaaaagcagtggcgatggtaaaagttgtgtccggtaatcaaaggggaccaaatgtctggtgcagcagtgcccaggttgtggttccattcgatgggcaacggcgaagtgctcatatcattccatgttttatgtacctcggccgcgtccacgctagaagatgctttgcgacgtttgattgaagttgttatgccagctaattagtcctaaaaaaaaaaaaaaaaaaaaaaaaaaaaaaaaaaaaaaaaaactcga

SEQ ID NO: 17339 - DNA, 3838 bp, Zea mays
atagtacctgataccatgcaagcaatgtaggttgcaagatatagtagatgtattgttgagaaacaatgtacacaaatatataggcaaggacaagggtggctattagaaacagaaccaacctccattatccttgcctaatattactcaatctacaggatcttggatttatagtccaaggaaacctcctgagatatggcaggctgggctacataaggctaagcctatggcccatatgtatataaacttgtctaacactttgagcttttccttaatcatatccacccatctgtcgtttgatttttttttagcaatgatacccagctctgctgcatgtttgaggaaaaaaagcatactgtttctgtcttgtatcattgcgacatagttcttcagtagactattttatgctaactttgttgagtgtttgctttataggttgttgctgactacacatataaccagtcaacaaaagaaaatgtcttgagcatgctggggtcaatgactaaggttttgcagtcatcttctgataaaacatctttagacactaaagaggaaaataagttttttgagtccgatatactggataaagtgtggcacatcctttatgatgattgtctgtatgctcttggtacttgtgtggaaggggaactcaagcatttccacaaggcgagatacaagcttgcgcaaggatattatagaagaggtgaagcaggggacctggaacgggctaaggaagagctctcgttctgtttcaaatcttctcggtcttcctttacagtaaacatgtgggagattgatggcactgttagaaaaggaaggtaaagttcaacttctctgtattatgtgataattttttattgatatatagtggtacgtttgatgttaatctgtcctcagaaaaaaactaaattcttggatgtacaataaccaatggtggattaaagttcaaacagtttgatatgtattctggatgttatttatttcagcctggagataatataagattaatagcttacctggaaatttttgttgcatctaggaggaaaaatccaaatgtgggtggatccagaaagaatctggaggtcagtttgtcagaaagttcacggaaattcattacgtgcattagaaaatatatgatactctatttaaacctgctggagaagaacacggacctgtggactcttgagaaggcttatacttatctgcgaacagataagagggtacctcccaactacactaactatgcgaggctatactttttctgcacattaaagaattccttttcctttctcttctgtagtttgcattgtgtttaggtgatattgttcctgttggtcttgggaagtatattctagttctaacggcagcaattcataatcctgagattcgtcgagcttctggtgatgcttctgttgagcaattacttgagaaaatgttcactgtattcatggatcatgcgaacatgtgggctgatataagcaatataccagaggtgaacagtccagaattatcagaaagcaatctttacaggtaaattactcaatcgtagtgccataaagcgttcttaaattcatggttttcaaatagcacttctttgtggcagctatatccaccagtacatccatttgctcgagagtgatgtacgactagatgttctagaaggactaaacgagaagataagaaagcgtttcaagacaccgaagttatcaaatagtaacttcgctaagatatgcaagcatgcttctctggcatggtgccggtgtattctcatcaaactggcctcaatcactccactgcctgaatccgcagatgcaaccaatcagcctgcaccattatccaatgggcttctactctatgttgacttgcaacctgatgagcttcttatctcatcccctgatgggcctgctcaattcaaagggcttgacatgaactggtttgagacacttaacagaattaaaaacatcccggtcaagcaaacatccgaagataacttggagactgctgttacgttaatgaagagcacttataacttttatcgggagagcccttgtggaacatttccttcaggtatcaatctctacacggttacaccatcacaagctcctattgaagggctaccgccaaccgctgctgtagttgagacgctcgacttaagtattccaagaaaactccttctgtgggtatacactctggttcatggtcgttactcaaatatatcctccgttgtaaagtattgcgacgagatgaaggtatggtgtgcatttgttgtgttgggatgtttgctccatgtagtgttttcttcatccttatagtcaggtttccccttttttttctggttgcagttaagaagtaaaagaggaaccccagctgcgtctgcttcgtcacaagttgtgcagccagtgtcgcatagtaccgtttcttcccaaggttttccaaacagtccctgacatctggatgtgcttaacatagctaccctttgggtttacactgatatctttttttttacagttgtatctaaagaaaagagctcccaagttgaacccgctgaagcagcacaaaatccttctgatctagctgccacttgcgttcctgcataccaagaagttggtggtgctagtgcctcgcaaagtgccattgaggcccagaaagctactgctgcggcatctcagctcactcgcagtggttcatcaagggcaatggaaaatgcacaggacggcggggagaggaagtaacgagatagagttcgtttttttttatcgtctatgctacatcttatggatgcatatgatcctgcctgacgattctcaggtctcagctctccgtggctccgtgtgcaaatctctgccacgggcgtgttttaacgcctgattggatggttgcccgctggcgcgcccggccagcctcgtacggccacttcggacgcatctgcatcttcggaggtacccgcagatgtagatgaatggccgtaaaatggtttggtctgcgtctctttacatataaccaaataaaaactcagataaagttaactcatgtggtggtctatgttgagatgatgcgggtaaccaatcgaacggttaacaaattcaggtcgtatgtatatcctggtttacagttagtgtttcctaagtgcatttgtagattatagagctgtcaagattgaacgatacatctgtaaggtgttacaaatgctaaatgctaatcctgattttgtggctgatgctaaaaacctgtggactcttaattaccacagactgaactttccctcattttggcccaacaaatacaatagcagaggaagagtttcagttggatttggtggaacggtaggagcgtaaaatatcactttagaatcataaataaactgaaataaactatctaatgctaacttatttaacttatttataatctaaaagtaatattttactcttctaccctttcgctataatccaacttatataatttaagaggaaaacaaatataacctcagtcttgctagctttgatgtactagcaaacactagatattttgtacgattgtacttggtcacttccttttggttattatgaggtatcaaaaacaaggcaaacacaagttaaaagattgaaacattctcccttcttttacctcttctttgaagagataagggagaagacataaacaaagggtgtaaatgaagtaaaaaagtataagaatgcaatgaaagacgaagtgtgttactcttctcatatgtcttagtatttttcatttcattcttcagcttataagataaatatacaatcgtaccttcggctttacacgggaaccggctcaaagatattggaaggctaaggaaaacgaagct

SEQ ID NO: 17340 - DNA, 1888 bp, Zea mays
gggagattgatggcactgttagaaaaggaaggaggaaaaatccaaatgtgggtggatccagaaagaatctggaggtcagtttgtcagaaagttcacggaaattcattacgtgcattagaaaatatatgatactctatttaaacctgctggagaagaacacggacctgtggactcttgagaaggcttatacttatctgcgaacagataagagtagtttgcattgtgtttaggtgatattgttcctgttggtcttgggaagtatattctagttctaacggcagcaattcataatcctgagattcgtcgagcttctggtgatgcttctgttgagcaattacttgagaaaatgttcactgtattcatggatcatgcgaacatgtgggctgatataagcaatataccagaggtgaacagtccagaattatcagaaagcaatctttacagctatatccaccagtacatccatttgctcgagagtgatgtacgactagatgttctagaaggactaaacgagaagataagaaagcgtttcaagacaccgaagttatcaaatagtaacttcgctaagatatgcaagcatgcttctctggcatggtgccggtgtattctcatcaaactggcctcaatcactccactgcctgaatccgcagatgcaaccaatcagcctgcaccattatccaatgggcttctactctatgttgacttgcaacctgatgagcttcttatctcatcccctgatgggcctgctcaattcaaagggcttgacatgaactggtttgagacacttaacagaattaaaaacatcccggtcaagcaaacatccgaagataacttggagactgctgttacgttaatgaagagcacttataacttttatcgggagagcccttgtggaacatttccttcaggtatcaatctctacacggttacaccatcacaagctcctattgaagggctaccgccaaccgctgctgtagttgagacgctcgacttaagtattccaagaaaactccttctgtgggtatacactctggttcatggtcgttactcaaatatatcctccgttgtaaagtattgcgacgagatgaagttaagaagtaaaagaggaaccccagctgcgtctgcttcgtcacaagtttagcgtggtcgcggccgaggtaccgtttcttcccaagttgtatctaaagaaaagagctcccaagttgaacccgctgaagcagcacaaaatccttctgatctagctgccacttgcgttcctgcataccaagaagttggtggtgctagtgcctcgcaaagtgccattgaggcccagaaagctactgctgcggcatctcagctcactcgcagtggttcatcaagggcaatggaaaatgcacaggacggcggggagaggaagtaacgagatagagttcgtatttttttatcgtctatgctacatcttatggatgcatatgatcttgcctgacgattctcaggtctcagctctccgtggctccgtgtgcaaatctctgccacgggcgtgttttaacgcctgattggatggttgcccgctggcgcgcccggccagcctcgtacctgcccgggcggccgctctccatcttcggaggtacccgcagatgtagatgaatggccgtaaaatggtttggtctgcgtctctttacatataaccaaataaaaactcagataaagttaactcatgtggtggtctatgttgagatgatgcgggtaaccaatcgaacggttaacaaattcaggtcgtatgtatatcctggtttacagttagtgtttcctaagtgcatttgtagattatagagctgtcaagattgaacgatacatctgtaaggtgttacaaatgctaaatgctaatcctgattttgtggctgatgct

SEQ ID NO: 17341 - DNA, 1042 bp, Zea mays
atgcgttcgtccactcgttcgtccacgtcgttcgtccacgcgttcgctctacacggtttacaccattcacaagcttcttatttgaagggctaccgccaaccgctgctgtagttgagacgctcgacttaagtattccaagaaaactccttctgagggtatacactctggttcatggtcgttactcaaatatatcctccgttgtaaagtattgcgacgagatgaagttaagaagtaaaagaggaaccccagctgcgtccgcttcgtcacaagttgtgcagccagtgtcgcatagtaccggttcttcccaaggttgtatctaaagaaaagagctcccaagttgaacccgctggagcagcacaaaatccttctgatctagctgccacttgcgttcctgcataccaagaagttggtggtgctagtgcctcgcaaagtgccattgaggcccagaaagctactgctgcggcatctcagctcactcgcagtggttcatcaagggcaatggaaaatgcacaggacggcggggagaggaagtaacgagatagagttcgtttttttttatcgtctatgctacatcttatggatgcatatgatcctgcctgacgattctcaggtctcagctctccgtggctccgtgtgcaaatctctgccacgggcgtgttttaacgcctgattggatggttgcccgctggcgcgcccggccagcctcgtacggccacttcggacgcatctgcatcttcggaggtacccgcagatgtagatgaatggccgtaaaatggtttggtctgcgtctctttacatataggcaaccaaatgaaactcagataaagttaactcatgtggagatggtgcgggtaaccaatcgaacggttaacaaattcaggtcgtatgtatatcctggtttacagttagtgtttcctaagtgcatttgtagattatagagctgtcaagattgaacgatacatctgtaaggtgttacaaatgctaaatgctaatcatgattttgtggctgatgctaaaaacctgtggactcttaactaccccc

SEQ ID NO: 17342 - DNA, 897 bp, Zea mays
tcacgttccaactttattgtgtcgaaacaccataccacaccattgacgcggcaagtcggcagaaactcatcaaaagcgcacaagctcgagccagaacacgagcccacgatggccggcattcgccgcgcccccgcgctcctcctgctgctcgccctcgcgtgcacccccgccctggccgcgcgcgacgtctccagcagcgccgccaaggcgaagaccaagtacccctcgggcccggcgcccggcaagaagccggccaagccgtacgtgccaccagccaccaagccccccgggtcgggcgccgtcgacggaggcgggatgcccgccatccccggcttcggcaccatccccgggttcaccgtgcccgggatggggggcgggtggggcgggggctacggcgggcccgacggcgggtactcgcgcggcggcgtggcggcctccaccaccgtctgctccgagaagggcccctgctacaagaagaagctgacgtgccccaagaagtgcttctcctcctacagcggcgccggcaaggggtacggcggcggcggcggcgggggcggctgcaccgtcgactgcaagaccaagtgcatcgcctactgctgagtgctgatcgatcgtacgtacgtacggggagctcggcggctccttggcttccatggtcatcgatggcgccggtgagcaccacattatacgtagctatcttgcgtgatacgcagaggaggcgcatacggctgtatgtttcctccccgatgtcgttctagtcggctgtaatatcgtcgcctcatgggtgtcagaattgctatgaactatgaagtgtatgagcaaataaacatagagatattactcttgggtcttgctgtttcttcaaatgcagtacatttcacaaaaaaaaaaaaaaaa

SEQ ID NO: 17343 - DNA, 888 bp, Zea mays
  misc_feature (59)..(59): n is a, c, g, or t
  misc_feature (95)..(95): n is a, c, g, or t
ttttttttttttttttgaactcttggatgtggttttttcttattctctctcaaaaaaanttataggagcttaggaatggttagagatgctctaanatgctctaagcgtggagctaccgagggccgaggccaaataatacaatcaattattgcgctcaacgtttgagggcacgtttgagatgtgcgtctttttgtagaacccatcaccatcagaccagactgctgttgcctgtcccagaaagccagctatgtcgtcgtcggcgccgcagacggagccgcacgtggtggaggactgccgcggcgtgctgcagctgatgagcgacggcacggtgcggcgcagcgcggagcctccggcgctgttctcggcggtggacgtctcggaagacgagtgcggcgtggagtggaaggacgtgacgtgggacccggcgcacggcctgaacgcgcgcctgtaccggccgcggcacctgggcgcggccaacgacgcgcggatccccgtggtggcctacttccacggcggcggcttctgcatcgggtccgggcggtggcccaacttccacgcctggtgcctccgcctgtgctccgagctccccgccgtggtgctctccttcgactaccgcctggcgcccgagcaccggctcccggccgcgcaggaggacggcgccagggccatgtcctggctgcgctccgccgccgccggcggcgacccctggctcgccgacgcagccgacttggcgcgcgtcttcgtggcgggcgactcggcgggcggcaacatcgcccaccacgtcgcggccgggctcggcagggccggcctgagacccggcgtccggatccgcggcgcgctcctcctggcgccggccatggctggcgaggcccgcacgcgcgcggagca

SEQ ID NO: 17344 - DNA, 2879 bp, Zea mays
ctttttttttttttttttttttttttttttttttttttttttttttttttttttttttttttttttttttttttttttttttttttttttttttttttttttttttttttttttttttttttttgtttgatatttaaatccactcaatcttacccaatccatgaatatggattgatagcaaaaccaaccagcgctaatagtgtcgtaacgttgatgagtcatttacaccaggcattaggctgttcagcagcgacagcaaactatggcctgtccgtgagcgatgttttttcaccaaacaaaaattgccttctatcggaataaggataggccgtgtaaaactaattataattcacagaacagcttttgcatgatcactacaaacgcaccaactaaattacatgtgacggtaaatatttctcattgaagatttgcaacatcttcaatgcgctaatgctaagcagctttcttggatggcctagagatgctcgtaccactatcttcactgtcattatcttcaaccttactagtgccatctctgtctgctgtcttctggaagtagcctgaatacagaacagaactaggttcattatgatgaatccgtgattccatgactaatgaggatgaacatgagggaacattgaacgcactatcactgctagatcttttccttgtcactttcaagttagcagtagagcatgtgtcatccatgtttgagtcattcatcatatcatctcgaataatctgtttgtacagggccttcacttcagtaggctgcgacttttcgtccttgccattagtagacagcaccctgtgctccatggatgaagtgcttggtgataatttcttgttcaaaaccacctttgggatatcaaaattcctgatattattcagattgtcgtcaacaacttcaccatctagttcagcaagttttgcagctgtgtccaattgccacattgtggagatggcgtcatctaaacattcccgcgccatatgaagttctactatgggctttgggtagttaaagcccagctcaactccagcaacttgtaatatagagtttggcgcagcccatggactatggatccattctgttggcattctagcaagttcaggaatccaagttcttacatattcaccgtccggatcgtacttttgaccctgaacctctggattatcaagacgactgagctcatgtccatcaggcaaactcccagatatgtactgccaaccaagaatatcactttctaggtctgcatccagaagcacatcccaaaagtacttcattccccaaatccagggtatctgtagaaattttacagcgaaacttgagacaatcactcttatccgattatgtgtccaaccagtagcccagagttccctcatgccagcatctactaatgggtatccagtcattccctgtctccaagatttgaaacggccctcatccaatagccaaggataatgcttcaagttacctaaaaatgatctctcatgtgtgaatgggtagttaaagcataagtaccgtgaatattctcgaaaaccaattgatcgtaggaacaatcgaacactctcctcagcttcagattttccttcattttgccacttgacttgacgcattttaacaagttgataaatcatccttacactcaactccccgaaatggagatacggtgacaataatgacgtagtacttcccccaaccttcataccatgttctgaatattctggaagaccataagacacaaattcctcaagcatgttctctgcattgcgccagccaggagaccaggccctgcttagcaaagcattgcttgattccacatccttactagattcaagacctagatcatcaatcgaacaacagcgaacatttgctagacctggcgctgccaccagccttgtaggtgcaagatattgtgatatctcaataggtaggttcatacatttctcccagtacttgttaaaggttgtaaatgcctgcccattctcatcataaacatcccacggctcgtaaagtaaatcaccattgaaactttggacagaaattccatgggctggaagctcattcttgattttgttgtcaagcacaagtgaaatagggtcgtagagacgattgtaaaccactctagtggcactgatggaacgaacgcactccaaaagagctgcaagagtgctgtcctccgcacggatcagcacgagtgggcacccgagcagctctaatgacttcccaaggtgggtaagagactgcttgagccaccaccgggagcaccttccagggtagtactgcccgtagtctgaggggcaccatatgaagatagggaggacagagccccctttcgccgccgctgccaaggccgggttgtcctggatcctgaggtctctcctgaaccaaacaacagtcttctccggtccagccatgctcagcaaccaatcctactgttcccaatcgaccatgacaagcccaaggacggggattaccatgtaacagaacttctcaaacccacctcgtcgaacatggcccgtgcacatgcaccaccggaggaaccagcacgcaaattgcaacagaagtatgactcaaggacaaaggatggattcgatggctgcgccagagatctgcgaatcgcaacttgtgggtaggagaacaggatcacgagctaggcggccacagcagcatgggcgcggggcaatctggtgagtagcgacaagtgatggagtgtggcgggtgagaaaggggcttgaaccagcgtcccatagcggacaagcaaatcccacgcgcatcaactgggaaagagagcctggttgcccatccctagttgtcagttgatcagtttgattgtggtaagtttggggatggaaagacgattgcccgtcctaagttt

SEQ ID NO: 17345 - DNA, 2903 bp, Zea mays
gggggggtgggttaggttgaagaaggtgacgagtaataaggtctcggacggccgcgcgcatatatatcagatccgatccaatggcacacggtgcaaacgaaaagcacgaaatttccaccagcttaattagggagagaaaaatagagcaccagctgatgagtgaatgaatgagatagacgggacacagagggtccagcaggctagcctactctggccgccctaaatagaagtcagtgccgtgacgacgcgcaaacttcttttgatcggctgcggaaataatatactgtaacgatttacgcacctgctgggaattgtaccgtacgtgccccggcggaggatatatatacctcacacgtacgcgtacgcgtatatatacgtgcgctgctactcatttgcgcgggaatacagctcagtctgctgtgcgctgcaggatgtacatacatacatgcgcaggtgcatagtctacgcgcgcgggcaatgcaagcccctggcgtagttgggccatgactgagatcacgcctcatggtcatggaacgaaacaccgcgtccggccgggctgcccctggcgtcacgcgggaggcagctgctagcgttagcgtacgtacccaccgtctcgtacacaccaccgcagggagagagaagagcgatgcaatgcacatgtacagcatccgcatcatgcatagatactcatatcttcaaggccacacatgcagcagtgtcgtacgctacgttgtttcaacggaggaggaggatacatacatagacacccacagccagcctagcatatagcagatagcatacggactcccgggtgaggaaaaatggagggcgaaccaaaccaaccacaaagaagcagcagcagcagccgctgcccctgcggctgctatcaccactcaccaactccaattaaagatctctctctctctctctactggccggccctgtcagtgccagcgcccggtttgttgctagctgagctgcgggcgtcgctcttagatatagcccaaaactcactccaccaccactcgttccatggaaccctagaccaaaagtactcgcgctctcggctctcgctctcgccctctccctctccgcagcaaaagagatccggccggccgagaagggcgcgcgctagctgcccggctactagctggcgcccgcccgcgcatatatctgtgtcatcgccatcacccacaccatggcccggccggccaacaccgccgtattagctctgtctgtcgctcgtccacctgcgaccgactgagcgatcgatctccaccgagctctccgctaagcgctgtccttgccgccgtcctcccctccgtcccctacgcatccatttccgtgtgctcgtgtgtgcgcgcgcgggcactcctgctcctgctccctccggcccctcctcccctcccaggctcccagctagccgcgcccgcccgcgcgacctgcacctgcacagatcgggcggccgggccgaccgatcgatcgagatatcgtgtcaacgtgccggccggggcgtgggaagatgatgaacctatcggctgccgccaacggccgcgacgagttccccccctacgtcgtgccgtccaacgcggccgctccgcccccttccctgctcccaaccatggagcagcagcaggagagcagcatccacagggagcatcatcagctgctgggctacaacctcgaggccaactcgctggccctcctgcccccgtccaacgccgccgccgcccaccaccacaccaccttcgccggcggccacagcccccacgacatcctccacttctacacacctcctccttccgccgcctcgcactacctcgccgccgccgccggcaacccctacagccacttagtctccgcgcccgggaccaccttccaccagacctcgtcgtcctactacccgcccgcggcggcggcgcaggccgcgcccgagtactacttccccaccctcgtcagctccgccgaggagaacatggccagcttcgccgccacgcagctcggcctcaacctcggctaccgcacctacttcccgcccagaggaggctacacgtacggccaccacccgccgcgctgccaggccgagggctgcaaggccgacctctccagcgccaagcgataccaccgtcgccacaaggtgtgcgagcaccactccaaggcgcccgtcgtcgtcaccgccggtggactgcatcagaggttctgccagcagtgcagcagattccatctgctggatgagttcgacgatgctaagaagagctgcaggaaacgcctagcggaccacaaccgccgccgccggaagtcaaagccatcggatgctgatgccggagacaagaaaagggcacatgcgaacaaagcagctgcagctaaagacaaagcagagagtagcagcaagaacatggatatcggagatgggttaggcgcacagatactgggaagtgcactcttgtccaaggaacaagatcaaaccatggatcttggagaggtggtgaaagaagcagtggatcccaaggggaaggcatcaatgcaacagcattacggcttccccttccattcgtcgtcagcaggatcttgcttcccccagacccaagccgtctccagtgataccacatccaatataggtcaagtgcaagagccaagcttagggttccaccatcagcaccaccaacacagcaacatcttgcagctcggccaggctatgtttgatctcgacttcgatcactagtcaatatgtgatgcacatgcaccctctctttctcaccccaccccacccctcccctcccctctatcttgtttgtgcgcgtaatccgaatatttttcctttttaaattatctgtgttaattactgtaacgtggacataataatgatagtctatgcttgccatgcaatcatctatattatagtt

SEQ ID NO: 17346 - DNA, 1219 bp, Zea mays
ttttttttttttttttttggaggatctggggaggcatcatcccattgttcattaaagcaaggattaccatgatgagcaacgactggttgcagcaacacgatcacaatagagcttcggcaggtttacaaaaactaaaaccttagcctgcgattctgcctctcgaactcaatacaacacacaacaaaagaggaaaatctgtacagaaatggccgggttcggcctggtctcgagttactatcttccggaggggatcagcgagccattctcagatcccagagtgagcggctgcgtcgcggccgcgggcaatggcatccatgggccgccaatggaggcagcttccatctggatagcctcggcgatcggcaccagcgtcggcttctcgttgtaggtgaattccaggtccctgtttgccgccagagccaagagctccgcctcctcgagcccccgcgccgggccgaggctgcacctgtccggcgagtgctttgcgagggcgtccttgaacttcttgatggttgcatttgtgcagctgaagctgctgaccctgccctgggctcccctgtagaacctgaagaaagggaggacatggacatggaggctgtagcacatggacttgtgcttctcgtagttgacttgcaggaacagcacgtccggattccgctcagcgaactgcgcaatcttggggtggagagcgcggcagccaccgcagccgggggagaagaagtcgacgacgacgagcttgtcgccggcgttgagcagggagtcggcgaggtcttgcgcggactcgacctccctcatattggggtgcgtcaccttctcccaccacctcatggccttgccaatcgtcaggttcccgttcatctgtccagcagccgccgccacttggaggccccggcgcaggggcctgtccgccagcgccaccctcccggcggggaaggagctcttggcgcggtacccggcgcccatcggcaaagactccgcgagcgccgccgcggcgcccaagtccccgcacggcgccgccacgctgccgctgccgccgccgcatagcgcgctggccatggctgccgagcagaaggaagagcaggaagagggagcacgagcacagagagagggggggggggggggtctcgggggagaagagaggcggggagcacgagtcacgggcaatggcggatggggagatgcttttcgattgtttaaacacaataaagttggaacgtga

SEQ ID NO: 17347 - DNA, 861 bp, Zea mays
ggccctccgcggccggcggaactcttatatccgcttccagaacttctcccgtcccgtccctccagccaacctcccatctccgtctcgcgtcgcagcggcagttccactccctcgccatgggcaagattaagatcggaatcaacggtttcggaaggatcgggaggctcgtcgccagggtcgccctccagagcgacgatgtcgagctcgtcgccgtcaacgaccccttcatcaccaccgagtacatgacctacatgttcaagtacgacaccgttcacggccactggaagcacagtgacatcaagctcaaggacgacaagactctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaatgaggacaagtacacctcagacgttaacattgtctcaaatgctagctgcaccactaactgccttgctcccctagctaagatcattaatgacaacttcggtattattgagggtttgatgaccactgttcatgccatcactgccacacagaagaccgttgatggtccctcgagcaaggactggagaggtggcagggccgcaagctttaacatcattcccagcagcactggtgctgccaaggctgttggtaaggttcttcctgagctgaatggcaagcttaccggtatgtctttccgggttcccactgtggatgtgtcagctgttgatctcactg

SEQ ID NO: 17348 - DNA, 974 bp, Zea mays
cggccgctcgggccggcgggccgggatcgcaatctcgagtagccgtcccgatcctcgatctgttctcaaccctccctccgtccgtcgcagctccagatttccttccccatggctccgatcaagatcggcatcaatggtttcggccggatcggcaggcttgtggccagggttgcgctccagagccccgatgtcgagctcgtcgccgtcaacgaccccttcatcaccaccgactacatgacctacatgttcaagtatgacactgtccacggacagtggaagcaccatgaagttaaggtgaaggactccaagacccttctcttcggtgagaaggaggttgctgtgtttggctgcaggaaccctgaggagatcccatgggctgctgctggtgctgagtacgttgttgagtccaccggtgttttcactgacaaggacaaggctgcagctcacattaagggtggtgccaagaaggtcatcatttctgctcccagcaaggatgctcccatgtttgtctgtggtgtcaatgagaaggaatacaagtctgacatcgacattgtctccaacgctagctgcaccactaactgccttgctcctcttgctaaggttatcaatgacaggtttggcattgttgagggtttgatgaccacagttcatgccatgactgcaacccagaagactgttgatggtccttccagcaaggactggagaggtggaagggctgccagcttcaacatcattccaagcagcactggtgccgcaaaggctgttggcaaggtgctcccagagcttaacggaaagttgactggaatggccttccgtgttcccactgttgatgtttctgttgttgatctgactgttagacttgcgaagccagcaacctatgatcagattaaggctgctatcaaggaggagtctgagggaaacctcaagggcattttgggttacgtggatgaggacctttgtttccacctgacttt

SEQ ID NO: 17349 - DNA, 1693 bp, Zea mays
atcattccaaacgagactgtgaaccctcccagctcaagcccacctccctgctcaagcccagccgtccactgcctggctccctcgtccggtcgttcccgtctccctcctcgcgtcgcgtccaccattgttcctgtcgacgctgcgccgcacggctcacaccgccgacagtgcctcagtcctatcgagcctccctcttcccagatcaggccctagctgggctacagccgccgccgccgctgccgcatccgtcaccttcacaccgcgtgcgcgcgcgcgctctctctctctctctgcgacgactggacgggctaccgcagtcgcccccataggcaccacgcccttcgctgatctattcgctggcgaagaacgctctcaatgtattcgcattctcacccccttcttctctctacccgctgtgcgaaaacgagttcccgaactctaacctaactatttgatgtctactaacttctaattttgttttttactgccatactggtccacccctgatacacatataacaaatccactaacgtgattcttttttttttgggtgcaaaatcattgtgggacagtagaagatcgatggagtgcgtggtgcagggaatcatcgagaaccagcatgtcgatgctcttgaggttcttctccagggactctctggtgtcccgaaagagcgttttagggtgcatgagctctgccttaaaagtgggcccaatctaggtgttgtcccatcggaggttcgtttgttgtgtgacttagctcagcccacaccatcctggaccataagacatgttggtggtgccatgagaggtgctggtgcggagcaaatctcagttctggttcgtacagttgtggagagcaaagctagcaagaacgtcttgcactacttctacaccctagggtacaagctagaccatgaactcttgaagagcggttttgcatttcgtttccaccgaggtgcccaaatcactgtcactgttacatctgctaacaagatgtcaaggctccatgcaaccgatgaagctacgtcagtcactcctgccatacagctagtggaaatcacagctcctgctgctgctgataattacaatgatgttgtttcagctgtcactgcgttctgtgaatatcttgccccgctgctgcatctgtcaaaaccaggacactcgacaggaatcgttccaacagcagccgctgctgctgcctcactcatgtcaagtggcggtggcaaaaccttgtaatgctgctaggacagccaaagtccgttctttgagatgagtgggcgtggctaatgaggtggccttcttcgtgccgagcatttgagcagtcagttttgcctgctagtgttgtccatgtctgacacatcgttgtgccaaccttgctcttggtttgactggttgcatgattgctgatgggtaatgccctgccttgtagttgcagggtgtaacactctagtattaccaatattaaaatttctcaaaaatccaaaaaaaaaaaaaaaaaaactcgagaaaaaaaaaaaaaaaaaaaaaaaaaaaaaaaaaaaaaaaaaaaaaaaaacagaaaacccaaaaaaaaaaaaacacacaccccacaaaaaacaccaaaatacccaacccataaacaaaaccggggggggccgtttttagggatccattttttcgtccccgggggtggaaagtataggctttttttttg

SEQ ID NO: 17350 - DNA, 1292 bp, Zea mays
atcattccaaacgacactgggtaccctcccagctcaagcccacctccccgctcaagcccagccgccactgcctggctccctcgtccggtcgttcccgtctccctcctcgcgtcgcgtccaccattgttcctgtcgacgctgcgccgcacggctcacaccgccgacagtgcctcagtcctatcgagcctccctcttcccagatcaggccctagctgggctacagccgccgccgccgctgccgcatccgtcaccttcacaccgcgtgcgcgcgcgcgctctctctctctctctgcgacgactggacgggctaccgcagtcgcccccataggcaccacgcccttcgctgatctattcgctggcgaagaacgctctcaattagaagatcgatggagtgcgtggtgcagggaatcatcgagaaccagcatgtcgatgctcttgaggttcttctccagggactctctggtgtcccgaaagagcgttttagggtgcatgagctctgccttaaaagtgggcccaatctaggtgttgtcccatcggaggttcgtttgttgtgtgacttagctcagcccacaccatcctggaccataagacatgttggtggtgccatgagaggtgctggtgcggagcaaatctcagttctggttcgtacagttgtggagagcaaagctagcaagaacgtcttgcactacttctacaccctagggtacaagctagaccatgaactcttgaagagcggttttgcatttcgtttccaccgaggtgcccaaatcactgtcactgttacatctgctaacaagatgtcaaggctccatgcaaccgatgaagctacgccagtcactcctgccatacagctagtggaaatcacagctcctgctgctgctgataattacaatgatgttgtttcagctgtcactgcgttctgtgaatatcttgccccgctgctgcatctgtcaaaaccaggacactcgacaggaatcgttccaacagcagccgctgctgctgcctcactcatgtcaagtggcggtggcaaaaccttgtaatgctgctaggacagccaaagtccgttctttgagatgagtgggcgtggctaatgaggtggccttcttcgtgccgagcatttgagcagtcagttttgcctgctagtgttgtccatgtctgacacatcgttgtgccaaccttgctcttggtttgactggttgcatgattgctgatgggtaatgccctgccttgtagttgcagggtgtaacactctagtattaccaatattaaaatttctcaaaaatccaaaccat

SEQ ID NO: 17351 - DNA, 975 bp, Zea mays
  misc_feature (960)..(966): n is a, c, g, or t
aatctaggttagtttgtgattagtctactcctccattcctacacatgtggcgtattaactgacgtcttgcaatcatacaggtgttgtcccatcggaggttcgtttgttgtgtgacttagctcagcccacaccatcctggtaaccgagacaagctgctgaaagtctaccttttgttatgtttatcattaattgtgacaagattgtaggaccataagacatgttggtggtgccatgagaggtgctgctccggagcaaatctcagttctggttcgtacagttgtggagagcaaagctagcaagaacgtcttgcactacttctacaccctagggtacaagctagaccatgaactcttgaagagcggttttgcatttcgtttccaccgaggtgcccaaatcactgtcactgttacatctgctaacaagatgtcaaggctccatgcaaccgatgaagctacgccagtcactcctgccatacagctagtggaaatcacagctcctgctgctgctgataattacaatgatgttgtttcagctgtcactgcgttctgtgaatatcttgccccgctgctgcatctgtcaaaaccaggacactcgacaggaatcgttccaacagcagccgctgctgctgcctcactcatgtcaagtggcggtggcaaaaccttgtaatgctgctaggacagccaaagtccgttcttgctgctaggacagccaaagtccgttctttgagatgagtgggcgtggctaatgaggtggccttcttcgtgccgagcatttgagcagtcagttttgcctgctagtgttgtccatgtctgacacatcgttgtgccaaccttgctcttggtttgactggttgcatgattgctgatgggtaatgccctgccttgtagttgcagggtgtaacaatctagtattaccaatattaaaatttctcaaaaatccaaaccataatttcttttctcnnnnnnnaaaaaaaaa

SEQ ID NO: 17352 - DNA, 2428 bp, Zea mays
cctcgagccggccgggactactaaaaaatgtgattgatcactcgtttatcggcaaagatggtttctttgggagtgaataccgagaggctgagatcaccactgacggccgctgcagccacacggtttgcgtataaataagtagtcagtcgctcatcttgttccttgtgaacatcgcagtgctgtagcctccttcgtcttgagcgagcatggagatgtcagccatggaggaagccctccccaaggcgatggagaggaggaagggaggcctcagaaccattccgttcatcatcttaaacgagatattcgagaaggtggccacgttcgggctgtcggccaacatgatcctgtacctcaccgagcggtatctcatgaccaacgcctttgccaccgtcgtcctctacttctggcatgccttctccaacttcctgcccatcttaggcgccgtgctcgccgacgcccgcctcggccggttccgggtcatcaccctcggctcctgcgttagcctcttcgggatgtgcctgctgtggctgacggcgatccttccggtgtacaagaacaccccggagtgcgcgccggggcggccggtagggtgcgcggtgctgccgtggcagctgccgctcctcttcacgtcgttcgcgttcatgtccctcgggtcgggcggcatccggccctgcacgctggcgttcggggccgaccagctggacaagcgggacaacagcgccaataacgtgaggacgctgcagaccttcttcaactggtactacacggtgctgggcctctccatcgtgttcgcgtccaccgtcatcgtgtacatccagcaggccaggggctgggtcgtcggcttcgccgtgcccgtcgtgctcatggtcaccgcgctcacgctgttcctcctgggctcgcccttctacatcaaggcggcggccaacagcagcgtcgtcatcggcttcgtgcaggtgctcgtcgccagctacaataaccgccacgagcccttgccgccggagactgccgactcctcgagcttctacaacaaagcaggctgcaaacctaggactcccacgaacaagctaatgtacttgaaccgggcttgcgtgctcaggaacccgagcaaggagatcagccccgacggggcggcgtgcgatccgtggaggctgtgcacggtgcagcaggtggaggacaccaaggccgtcatccgcgtgcttccgatatggtcgacggggatcatgccgggcgtggtcgtcgggcagcagatgttcccgacgctgcaggcgaagacgatggagcggagggtgggcaagctggagatcccccctgcctccttcggcgtcttcgccatcctgacgctcaccgtctgggttgccgtgtacgaccgcgtgctggtgcggcccctgtcccggctcaccggccacgcgcgcgggctcagcctgcggcagcggatgggcgccggcctggtgctcttcgccgtggccatggccgtggccgcgcacaccgagagcgtccgccgagccgccgcgctcgccgaggggctccgcgactccaacccgctgacgggggagcgcccggtgcgcatgtcggccatgaatctggtgccgcagcactgcctcacggggctcgccgagggcctgaacctgatcgggcagatcgagttctactactccgagttccccaagaccatgtccagcataggggtgtccctgctcgcgctcggcctcgggtttggcgccgtgctgggcagcgccatcgtcggggtcatcgacgcggggacccggagcggcggcagccacgacggctggctgccgagcaacctgaacagggggcactacgactactactacttggtactggcggtgctatgcgccgccaacgtgctgtacttcgcagtgtgtggctgggcatacggcgacgaggggcaaaaccgggtggtggccgccgacgccgcggtggacgacgtcgacgacaaggaggaggagcaaaaggcggtaatcatctaggcttaggccacggtggactttgagcagagcactaggaacagtatagcgttgatctgggatgatctcttgctctagtgtgtacctcgtacatatgctaatcaatatggtgacatttcaagagtagataatcttgaaatgttaatatggacagtaagtactgtcgtgtagcgtgtcaaaaatgccgcatgcattctctcttcctaattaggaggtagagagaacttcagtgatccagtattccagtggtcgcccactcgcccatacgttaacccactttgactttctcatttccctcatccgtctccttcccctcaagttcaatgccactgctagtgctaggtgtcagctgccccagcctattatgaactcatggaatcaggggttaagattattcacaatgattctctttctctctatatcatacatttaaatcttacttt

SEQ ID NO: 17353 - DNA, 3618 bp, Zea mays
  misc_feature (1640)..(1640): n is a, c, g, or t
  misc_feature (1733)..(1733): n is a, c, g, or t
  misc_feature (1885)..(1885): n is a, c, g, or t
  misc_feature (1908)..(1908): n is a, c, g, or t
ctgttgcaggacccaaaaaaatagaggaactgaacacctagaatagatgatacatctttctaagttttaagaccacatgtatatttactcatacaaaaaaatagtattgttaactaacaataacgtgtcctagcttagaggcggatctatagaatcacaagttattattgatatatgatgtcacctccaataaaccatgacaaacatgattttgcaaaggagaacataacaaaaaaaaaaccactgctctgtcatgtcacacgtgacagcataaaaatgggggcaccaggggtggtcacatcaggcgtgggagcttcttcgagccgaagaatggatatatatagaaacttgctgtcacggcacatcacctcgcgtcgcgacgccagcggacgagacgataatggagagacgtacgtacgacgaacggacgaacccttctctccaagttgcacgcgcccgctgtcatgtgctgctgtgcattcatctcgcgcatgcaagttgcccatcgcacattatgccgcctcagctccccggatatggcgattggcgaccacaactcgaccgacgacggatcatatcggtgcattaatctctgcacacaacgaacgccgtgccggcgacgtacgcgatcgatacacggacaggtagcacgcacggcacatgcatttcagcttgcaggcatatcgatctatcatccgtctcgtgcactctccgcgccgccggggcggcggcgcacctagctgctacttgacaccaccgaccgcgagacccatgcatgcattatggccagagagctgtgcgctgtgtgggcagccacgcacagcgggagggtttgcatgtgtggatggcacggcagcgacggcactgtgagaggagagggatcggacggggacagccggggatggacggcggcgtgcgtgttggttccttgtcaagagggggacagaggcaccaactggccgggcagcgatcgaaagcatgtctggtccggtaccggtaccccttcctccgcccggtgccagccgcgctgcgctacggcaccactagcttgctgcattgctttcctttctcatgcgtcggcgtcgtcgtcgccgccgcttcggccggctgggctttgcattgttttgatgtgcatgcatgtgccccatgtatcctatatccctaggcgactaggccctagctagctacgtagcagcagcccgcgacatgcatgcatgcgcgtgcgttgcgtgatttctctttgcgtgcggttgcttgctcggctgttgcatgctctcgccgttgggccatgccggcaatgccgcgctgtgcatgcacccccccatcggcatccgcatccgggcagcgagcgatcgactcgcgtggcgtacgtggccgtatcattgatccgtcttgtttctgctctcaggccgcgcagatgggcgagcgagatacggggatcgatagatgctgcagccttgcttgcttgttgatcgatgatgcgtgtacgtgttagcctgttctaatcccaaacgtatactatctctgttctcgaatatttatgttccgttaatttatttttactaaaacataataaataaataaaaaagagggacgcgtttcggaacgtctacgtcaccagcagctctgcaactcttctncatgaggtgccgggaatctacacttgtacagtaccgtcgcgtcgctacgtacctctctaccctacgcggtgccggagggagcacgcgccgccngcgtggcccatgagctggctggcggcctggcgtttgcgcgcccacggcccacgggcggccccgtcgtccatccgtgatccatccatccaagcgagaccaggccacaccagactggccgggccgcgacacgtgtgagccccgcacggtggcancagcagcaacaaggaatctatancactggcccaccgaccgccgggccccgctccgcacacccacatgcgcctgccgcgaccgaggccacgggcatcgcaaggaatctactatattctactagcatccgacctggtccacctcccgggacccacctgtcggctgggccccggctgcgcaccaccgacccgggacccggccggcctccaatctccaatctccatgtccatgtgacccctcactcggaaggggcgttgtgtgaagacgtgtcgtggatggcacgagctgcgctttgcattgcattgagtttgcaactgggccggctagactggtgcggtgcacgcaacgcaactgctaccagctgcaaccgcttctatatatatgccgagcctccaaggcacgcaaccgagcagtgcaagccaagcattctccgcacgcgcgtacttccgccagcgcagctagctatagctgttcgcctgttctcttctcgcgcgccatcatctctcgtctgtgatcaacgtcggcgcgcggccagcatggagatgatcgacgcggagctgcgtcttggcccgcccgggagcaacaacagcgacgtcgtcgtcaccgtcgtgccgcctgcagcggcgaggaaaccggcggcgccggcgccggcgtcggcggcgaaacggccgtcctcgtcggtggtgaagagcgacgacgcgtccgggacgggcgaccatgacgacgacgccgcaccggcctccaaggtgcgggcggcggggtggcccccgccgcgcgcgtaccggaagaacgcgttccacgcggcggcggaggcggcgaggaggaccaataataagggcgaggagctgcagggaggaggaggcctgtacgtgaaggtgagcatggacggggcgccatacctccggaaggtggacctgcggacctacggcggctaccgtgagctgagggacgcgctggacgcgctcttcggctgcttctcctcctcggccgacggcggatgccagttcgccgtcgcctacgaggacaaggacggcgacctcatgctcgccggcgacgtgccatgggagatgttcatctgttcttgcaagaagctgaggatcatgagggggtccgaagcaagataaccaagcaacgaggatgcaagaaccctgttggatgcatatgcatggagaggccggccggactcatggtgtcatgcacgagagagaagaagaagaagacgacgacctgctggaactgaaggcggttgggtatacctgcatgcatggggagggagcccacgcatgcacgcgcgcgtcgtcgtgttctagccaccagaccggccgccggcccatatgctcaccacggagatggaggtgatggttcaaggatcacggcggcgtacgcgtcatcagtcacgccgtcgtcctgtcatcagatgagagatggaggggtgatgcatgagggcagtgctgtcgacggctggctggacgtgcagatcggagcgagattgtactgtgcacgcacatgagctttgtaattcattctaggggtgcagccgcacccacgtagaaataaataagaataccgccgtggttagagccaaattttttgccatttatattgttagcgtctcgtcagcgcagagaggagaagagaagaatcgggatgcgtggagaagaagaatagtgtagcgacgaggggaaatgtgtaatgtaagtatatgttcttttgatgcctaaaaaaaaaaaaaaaa

SEQ ID NO: 17354 - DNA, 1016 bp, Zea mays
  misc_feature (845)..(846): n is a, c, g, or t
accgagcagtgcaagccaagcattctcctcacacacgtacttccgccagcgcagctagctagctgttctcttcttgccatcatctctcgtctgtgatcgaacgccggcgcgcggccagcatggagatgatcgacgcggagctgcgtcttggcccgcccgggagcaacaacagcgacgtcgtcgtcaccgtcgtgccgcctgcagcggcgaggaagccggcggcgccggcgccggcgccggcttcggcggcgaaacggccgtcctcgtcggtggtgaagagcgacgcgtccgggacgggcgaccatgacgacgacgccgcaccggcctccaaggtgcgggcggtggggtggccgccggtaagagcgtaccggaagaacgcgttccacgcggcggcggaggcggcgaggaggaccaataataagggcgaggagctgcagggaggcggccgcctgtacgtgaaggtgagcatggacggggcgccctacctccgcaaggtcgacctgcggacctacggcggctaccgggagctgagggacgcgctggacgcgctcttcggctgcttctcctcctcctcctcctcggccgacggcggcagccagttcgccgtcgcctacgaggacaaggacggcgacctcatgctcgccggcgacgtgccctgggagatgttcatctgctcctgcaagaagctgaggatcatgagggggtccgaagcaagataaccaacgcagcgaggatgcaaagaacatgttggatgcatggcatgcatggaggtccagctagctatggtccgtccaactcatgcatgggacagagcacagagggagagagagagacagaaaaaaaanngaggtctttatatcggccatccaatggaattggaggcgcggcgtatggtatatacctgcacagggatcggaggccccatgcatgcatgcgcgcgtcgtcgtgttctacggccagcccagccggctcataccatacacaccatggacatgcacatgatcagatggagcatg

SEQ ID NO: 17355 - DNA, 1281 bp, Zea mays
  misc_feature (17)..(22): n is a, c, g, or t
  misc_feature (1152)..(1152): n is a, c, g, or t
gcaccaggagagagagnnnnnncactagtcccccccccgcccccgacccaatttattctcggccggaaagtctcttcttgattattgtccagggattgcaacagagagaaagtaacgatgccggcgaaacagaggacagctaaggtcaacaggaatcctgatctgatcaggggagttggtaaatactcaaggtctcagatgtaccataagagaggtttgtgggcaatcaaggccaaaaatggaggcgttttcccccgccacgacgctaaatctaaggttgatgttccggtggagaagccaccgaagttctatccagctgaagacgtgaagaaacctctccccaacaggcgcacggcaaaaccagccaagctcagagctagcatcactccagggacagtgcttatcatccttgctggtagatttaagggcaagagagttgtcttccttaagcagcttgcctccggtttgcttcttgtgactggaccattcaagatcaatggtgttcctctgagacgtgttaaccaggcctatgtcattggtacttccacaaaggttgacatttctggagttaccctcgacaaattcgatgataagtacttcggcaaggttgctgagaagaaaaagaagaagactgaaggagagttcttcgaggctgagaaagaggagaagaaagagattccacagggaaagaaagatgaccagaaagccgtggacgcagctttgatcaaagctattgaagcagttccagagttgaagacttacctcggagcaaggttttcattgaaacaaggaatgaagccccatgagcttgttttctagatttcattactttttttctgaggtttctagtgtatctgtctcctgaagttttacactccaactggttggttctgttctcgtccactgaccagagacataaaatcttggctgctgctatctggatttctgtcttatatggataatttatcaatcctgtttttgaaaaaaaaaaaaaaaaaaactgccagagagaactagtctcgagggggggcccggtacccaatctcgccctatagtgaggcgaattacattcactgcccgtcgttttaaacgtcgggactggaaaaccctggggtacaaacttaacgcctgaagaaatccccctttcgcagntgtgtaatacgaaaagcccgaccgatcggcttccaaaattgccaacctgatgggaatggaattgtaaggtaaattttgaaaattccggaaattttgtaaacagccattttaacaaaagcgaatcggaaa

SEQ ID NO: 17356 - DNA, 1600 bp, Zea mays
gggtacctcgaggccggccgggccgcaccaaagccctagctcggctcacttgctttcctggccgccgtctcctccgcggctcttaacgccgcatccactcgccggttcttaacgccgcccgccgcctcctccgcggctctgccctcccgccgctgccgccgcctacccaggaatcaggatgcgggtgaagaagcggtcgaagcaccgcaaagcggtcaagttctacgccacatgcttcggcttccgcgagccctataaagtcctcatcgacggcaccttcgtccaccacctcctcacccagcgcctcctcccggccgacgaggctctccgagacctcctctcggcctccaggacgccagccctcttcacctccaagtgcatcctcgcagagctcagacgtctcggcaagtcacatgccgaatcatttgacgccgcgcagcttctcaccacaaccaagtgtgagcatgacaaggtggtcggtgcagttaactgtgtccagtcactgataggtgataaaaatcctgaacatttcttcgttgccacccaggatcctggtctccgagaaaacttacgagagattcctggggttcctgtgatatatggtctgaagaactctttatgcatagaacggccctctatgcagcaacgcaagtttgctcaattggatgaggagaagcgtctcaatatggatatctctgaatacaagaagttactgaaggctgcatcagaaggaaagacaattgccagtgaaaatggaagtggcgaagaacaacatgagatgcctattagttctcttgtaaaaaatgcacttcatgttactgataaaaccaagtttaagaggaacaaagcaaagggtccaaacccactctcctgtaagaagaagaaaccaaagctccccacggctattcaaaagcaggcaggtacggctgatggcgaggcaaagaggaagagggttcggaagcggaagagaggccaaaaagataacaagcaattggaggctgcgaactagaaggatgggcttgcgtaggaagtttcagtgctcttgctagacatccatcctgactccggagcaagtcaactatggaggagttcctttctcccacacaggattcagtatgccatgccataccatgctcattatatgttgaagatgcttcttgcaacgtaacacttgattggttatggtgatcgtgaatccttctctagaggatgttattggatgtttcttttgtcgcaagatgcaactttaaatgttttttgaagcaaaagtttgatgccagtagctctaccaggttcttgcttgccctgctacatgtgtgatcccattcttcaattgtaagatgtgtttgttgagaatatgtataatagataatacttctattattttagattttagacagtagtaaccttagtttatttggacctcgagacaaatgtttaaagtacctaccattagatagggatgaaagtggtaattcgaactgttagaacaaatttaatattttaaaatagatatgtataaaatttaatgttgatcttttcttatgttatcaagcacattagtacaaatatgaataaaatattatataagttgttttat

SEQ ID NO: 17357 - DNA, 3636 bp, Zea mays
  misc_feature (49)..(49): n is a, c, g, or t
cgtacgtagagatggcaacaagtatatacccctgtcgggtagtatcatnccatacccgtacacaaaaaatcctacacatcggattacctatataaggtcacggatataaaatcttacccatacccacgcgggttacttgtacccactagaaaagcctaaaatactaatggaccaatcacccaaaatgtcaaacaagcacataaaaaataacttcaaattaaaatacaacaaaccatatgattacatagcgtaataagtaaacaaacaataatcgaagaagtattttcttttagctaagatggctttgattacatggtaaatagtgatatgttgcgaatatattttatcccatgagtacacgggtatggttagtacccacctatactcgtatctagctgtccaacggatagaagttctcgcccattagggtagcttcatcagcttactcatctttatacccatagttaaactacactctatgaacagtacactctatgtgcaaaatagaattttgggtgaccatataagtgaattgatggacatggtcttaacatactcgcgggtaaagatatcattctatacccacttttatatcggtaaaacctgttagatattaagattttgagtatccattgctatatctatttgtacatgatatatgatgtataacacataaaattggtggttttaagtagcatagatagagatgatggttttaaatagtagagatagagatttcgggtatatgtagcacgagccaagcaaatatgcgctacgaagtgggctagctggctagcctatacgtcgcgcgggacaaaaaaaaaggtcatcagcacgatgctaagcacaaataacccatcaaatccattagcacgaaccgtttgtggctaatcttatttattctaatctagtcaaccatatgtataaaactaactcgatcataactttcaagttaatttcgagttatcttaaaaaatgagaaaaataagaaaaatagaaaaaataaattatttcgatctctgttaccagacaggtcttaggcccctcgatacggtacggcacaatagcccatacgatactgcacaatagctctgtacgatctatttaaaactagtcgggtcatgtttagacttatactttggctcacgaacacaacgcaacccgatatttatgggtgttctgtctttggtccgattaaaccagcaaaacccagcacggactcaggcccgtgggagcacgacagccaaagtatagctgcatgcgactctagtcggcgtatacgacgctccccttgaaccagcataattcgggccaatctgaaaagcccaccaaattttttggcctatcagagaaatgtgatggttggtcagaaacataaagtgggctctatcaggatgcgggtgatgcaccaaagccctagctcggctcacttgctttcctggccgccgtctcctccgcggctcttaacgccgcatccactcgccggttcttaacgccgcccgccgcctcctccgcggctctgccctcccgccgctgccgccgcctacccaggaatcaggatgcgggtgaagaagcggtcgaagcaccgcaaagcggtcaagttctacgccacatgcttcggcttccgcgagccctataaagtcctcatcgacggcaccttcgtccaccacctcctcacccagcgcctcctcccggccgacgaggctctccgagacctcctctcggcctccaggacgccagccctcttcacctccaagtgcatcctcgcagagctcagacgtctcggcaagtcacatgccgaatcatttgacgccgcgcagcttctcaccacaaccaagtaggtttctttcttttcactttgcagctagtaccattattttttattgtcagccccgaactttcaattctgctccacttgacttaatcctgttgctacttggcttaaagttcaccgcttgatttcttctccgtcacctctgtcgcgtgaaacattaatttgattttgtcaaagccagagagaaaaaattagaacatcgttcagttctgtaatgtactcacatgaacataattatcgagttcatacttcagagaaccaaattgtagttcttgcatgctacttggagtctgagtaaccaatttggttgtctggaactggaagtggaacctaggccgcagttcgaatttgtgtcacttcatgattcatttttatttttggtagcctttgtttggcccagggcctttcactgatgcttttatagcctttgtttggcccagttcgaatatgtgcttttttttaggtttgcttggacccatctcatgtttgtttgaggaatagatccattcccgaatctagtctttcattctcagcttgatatttgcatacgggatcatgatcactgacttgttttcctggatttcacggtgttactaggtgtgagcatgacaaggtggtcggtgcagttaactgtgtccagtcactgataggtgataaaaatcctgaacatttcttcgttgccacccaggatcctggtctccgagaaaacttacgagaggtattgataactctcatctgccgtgtgtaaactctactttttaagaaaattgagtggatcatatctacgaccttgtctgggtcacagcaatttgctcatgtactttgtatacttccatgtagattcctggggttcctgtgatatatggtctgaagaactctttatgcatagaacgggcctctatgcagcaacgcaagtttgctcaattggatgaggagaagcgtctcaatatggatatctctgaatacaagaagttactgaaggctgcatcagaaggaaagacaattgccagtgaaaatggaagtggcgaagaacaacatgagatgcctattagttctcttgtaaaaaatgcacttcatgttactgataaaaccaagtttaagaggaacaaagcaaagggtccaaacccactctcctgtaagaagaagaaaccaaagctccccacggctattcaaaagcaggcaggtacggctgatggcgaggcaaagaggaagagggttcggaagcggaagagaggccaaaaagataacaagcaattggaggctgcgaactagaaggatgggcttgcgtaggaagtttcagtgctcttgctagacatccatcctgactccggagcaagtcaactatggaggagttcctttctcccacacaggattcagtatgccatgccataccatgctcattatatgttgaagatgcttcttgcaacgtaacacttgattggttatggtgatcgtgaatccttctctagaggatgttattggatgtttcttttgtcgcaagatgcaactttaaatgttttttgaagcaaaagtttgatgccagtagctctaccaggttcttgcttgccctgctacatgtgtgatcccattcttcaattgtaagatgtgtttgttgagaatatgtataatagataatacttctattattttaaattttagacagtagtaaccttagtttatttggacctcgagacaaatgtttaaagtacctaccattagatagggatgaaagtggtaattcgaactgttagaacaaatttaatattttaaaatagatatgtataaaatttaatgttgatctt

SEQ ID NO: 17358 - DNA, 975 bp, Zea mays
aagaaaagaaaaaaagaatggctaaccctcgcattggccctgaatcacgggttcggcccacgggtggagtgccccacgaggcccaactactcgcacaacaccgcgccgacaggcgggccccacccgcctgtctccggccgtcactggctcgtgggcccgttgggtcagccccacctgtcgggcggcttcacagccccgcgtgcaatccagtgctcttcctcactgccttgtgggtccggggagtcagctcgatcccctcaacaacctctcccgagcatggcgggcgcacaggtacctcgtggggtggttcgtggccgaatccctccccacctcgcctctataagggccgtcgcgcatcctagtcgactcctttttcatctccgcgtgcaccaacgagcaataataccgtgtgtgaggagatcccgtgaggagagtgttaagggaggctgccattggtgattcgagttccctaggagtctcggccatgattgtgacctgggggaagtccacggaacacgacgggtgtgttcgcgaagaaatcaagggcagagcatctgggcggcgtggcggattcctcatcggcgtgcgctgctcgtcgctgggccgccattcctcgtcggtggagcatgacacttcacaatccgagcataagctattacgaggagcttcgtcttcacgatgtaagtcttttcctcatgataaaggcatacaagatgaaaatatgatctaaggataataagaataaataccgaagctatcgctagattgatagcttcggctcgtaatcgagatgaagtatgatgatgatactgaccgaagggggaaaagactacttagtccttaatgatttgttttacgatcataagtgaatattggggacataaatgtacttttatccgggctgcgtctcgtgcctataaatagatgaacagtagcaccgtactgttcacgctaatttgaaaaaaaaaaaaaaaa

SEQ ID NO: 17359 - DNA, 1849 bp, Zea mays
ggcgtgcaggaatgtattggtgggatctactcttggtgctggcatctgctatccacttggtattttcatctcgtcatgaactcaagcacaaatttccgcactctgcactaaacaattaagggtgtttatcatcttattacctaatatgggctgataatggaatggtcagttagtcatagatgccctagtgttccaggacagtgattagggtgaagtgaaccctcctagttagataattgcactagcttctttggctactggcttgcttcacattggggaatagaccctcatatgtaccccaattctaatttggcctgttagctgaaagcttctagtagacgaataccctctttcatctgtcaccaacctatcgtttctttattgtagaggtgttctagaagtgaaatcatggttagcatttgaagtgcacccatcacagtatgggagtttgttgcacgaactttgtgtttctgtgggtctatttttttacaacatatttggtcacggtacattgctacaatgcagcaaaatttggtgttaattttcagtggttgattctaatctgctcttggtgccggcatctgctatccacttggctgggtacagttgaagctggcagaaaaggccaatcttgagattgcaaattcaaaaccatcatccgatttgacagagggaaaaggaaatcaaagccgtgtgggtgctgctatcgaacgacttgagggtagtatgaagaagtgagtgaagcctacgcatcgatggcatttttctcgttgtcttggttccataaatgtagcagctacaaggactgggctgcactgactattgcttcttttctcgcatgttatatggacttttatttcgagtttgcagtaggtatcgccgtaccgcactggtaacttgtatctttcaagtcacaagttattgagttcgcagttgctattctaaaaggactgggaaatgcaaaatgtgtttttttttttactttttttcaaaagctggaaaagatgtctgttgtactgaaacagtagataagtcattgtttgagttttgtttggcacagctttgtccggcgtcgactctagctagtgcgtgaaggaaacgggtgaaatatagggcatgactgtttctgtttggcatgtctctatagctacgctgagcaactccaatattctatgagaaaaactttttaaactcatgtttagcaagttgctaaataactattaaaaataaaaaatagctagatctcttaacagtttttaatatttagagggtaattcgattttgaatctatttttgcaaacctgctcctgtcgaacttggctggcagagggtggagaaggctgatcggcatgacctgtaagggagcagtggtctgatgaagcgacctatggggccacaatgaacaatggttcgacgcggagaagtttgtgtcgcagcctcgcaggtgtcggacgtggctgccttactgcgtgggaaatggaaaaaaagtgcactggacctagctaccttgatgtagagaaaggggaaaaagagcatacgggtgtgaagggattgacaccaattgcgtttaaggagtgcccactggagccgccgccgctaagttttgaggcccaaactcagcaaaacccgtcatccgtagcgctggatggttttgaggcccaaaccaccagaccgtcgtgagtatcacaccgcgtgcacatcccccacgtcttggacacgtgtcccgctattcctcaaccacgtcggcaacacggcccacgtgtcctaggtgtcagccaccacggttggtcacctggctgctccggtccatcagccaagacccgcatgaccttcaccccagtaatcgacc

SEQ ID NO: 17360 - DNA, 4570 bp, Zea mays
  misc_feature (698)..(698): n is a, c, g, or t
gtcggcagccgcaagccaactcatacgcctgtcttaactgccatgcgtcctcattattcgcgatgcttgcgttgcgttcttggttgttcgtaccttccttccagcaaccgctgataattcaggcctctcttgctagctctatccatgtttcttcaggaaaagaatttttttttttgtgtgactggaggccagcgaccgggaacactacacgcgctcaagattttttgtgtgccagccaatcgaaactggagagggagaacggacctgctggaaccgtttcctgttcatgttcctgttccttgtctctgtcagaccaattaacgtagcatgcaacgcccctccgtcctctgactacaagctctttctctttctctgaggcagcaaaacgataatctttttgtagatcctcttttttatctcctttttttttatcgcagtttgagagaggtttctacgaacaatgaatgccaccttcaggatcaaacccttgatcacatcgtggaggcatcaaaaggtcaacgggacccggccggcaccttccggtaacacggagtcaacgacgctactcgcattgtgttgtgtggctctccccatcccccagaaccccagccggtgtgttgaaccagcagaccgattcagcggcggtttactagcacggttgacccagtgcacagtttgtatatgtatgatcacatatntccaccccccccccccccccccctcctattaggtgctaaatttcgggagttttttttgggtagagctaatgtctagtcgactaaaaaaaatctattggttgatttgctaaaaatgactaatagccgaattatcagctagcatgtttagatatcttcgttaattttatcagctaactattaactctaatagcactcacttacacgcccgcgagctgaaatctggttgtccaggttttcgaatttgatttgaccggttgaaagtggggcgcggttagctgaaagttctccgtgcgtgagatgaaagcgtccgaattttttttaagaaggaaggaagaacgaagaagagaagaaaaaataggaacaggcacacatgggcggtttcgccggtttgccttttgctctttctcacacacgcgttctgagtttctgaagagacgaccagcgccacacggagaagacggagggccggcagacagtagactcgctgagcagcagcagtatataagctcacggctcacccaccgctgggggccgcacagccagctgctcagctccgtccggcggaactcggaagccctacgctacgcctaccctcgctgtactactagctgccttcctacccgcttcccctctcctcccgacgccgtctccctccctccctccgcctccgccgtcgccgccgggacacgcgaaggtgcgtcttgacggccggattcggctccccctcgcgccccctgctccccaaaggcgccgcctttgctctgatccgtcgctctgcgcgctcgtggctgcttgtgatctctcctctgcggggcggtttcccggccggttactatcgcgggggggcggaactgggtcgctgggccgtggttcttggtgtcccggagcgccgaatctggcgcccctggaggaggagcgtgggagggtctcccgcgccacgcccgcggccggtcgatccggaattcgttcagttcgtctgcttaggctgtcttctttttcaactccttgcgaaattcgtagcatctggagcttggggaaagttccgtcgtgtgatctaatcccgtgcttttttttcccttcggtttgttcgagggaaacgttcttctgctctcggtattttggtcgtctgttgcaagcaagcaatttctggtttccgggtgtccgggaagcagcgttactgtccccatcgccgtcggggattaggggaaaattgcgccttttcctttctttttgcaagctgtgtcccactccatactggcttcgattggattggattggatagatagctcgtccgtggcgtggcacagtgtagcattgatagcccagcggagtgatgcttcgctgctgaagcaatcgcaggtttggcggagctaaggaaagagctgtagcgagcacgatgttagccttttgaattggcctggccctgttccatgagctggcgtgtgtgagaatggcgtgagtgtgagctgtgggcacgaggggaaaggtgagaccccccttggtgctggactgctggtgctgtggggggagcggcagtgcatgagatgcatgtgatgcggcattaaattttagtgtagccacgattgagatgaatctataggtgaagcgaatgaagtgactaatgtggtttcatcagactcaggaatttgttagtattcgtccattgccaaagctgactggtggatgtttaatctagtcgtagcaatagatttccaaccaatgtgtgtaattattgtctcgagctaaggtggcaagaaacttatggcgtattaagaattgtccaaggttttccatgcagaatgagctgttctttgatcaagcttcgtagcaactggtgacctgagtagttagtaccttcctgccacgtatattttaatctacctggggtggttgggaaacaataaaggacaaaggattgcataaatcgtttgcatcatgtgggtcaaatttggttgccgtgcacctgtgttagtctcacatttggtatgtgaagataatgaatgcggaactgcagacaggggagaaggggtagagagaatttgtacatggtcttgtttggtgcaatgagtgcatgacccttgtaaccaggttcctggatcaatgaggtcgaagaacggaaacatggtacgtggtaagataccccccccccgccggccccggggcgtggacgaaattgttcccatgttcccggaacgaggaacgtggcggtttctaagtgcatgacattgatatcggttacttaatggaattggttgcttgctttctaagtgatttcgtttcctttgttcgtttttctgaccggtgctatattgctgccgcctctaataaaaatgtgtttgatttcagcttcaaggtcttgtctttgggtagaacatgtcgtgctttgcgtgctgtggtgatgaagatacccaagtaccagacaccagggctcaatacccaggacaccatccagcgagggccgatgcataccgcccttctgatcaacctcccaagggtcctcagcctgtgaaaatgcaaccaatcgcagtccctgctattcctgtggatgagattagggaggtgaccaagggttttggtgatgaagctttgattggtgagggatcctttggcagagtatacttgggtgttctaagaaatggtaggagtgccgcgggcaaaaagttggattctaacaagcagccagaccaagagttcttggcccaggtctctctggccctgtttatgaaatgcagtgcatctattttatcccgttggattctaacaagcagccagaccaagagttcttggcccaggtgtctatggtgtcaaggctgaagcatgaaaatgttgtcgagttgcttggttactgtgctgatgggacactccgtgtccttgcttatgagttcgctacaatgggttcccttcatgatatgcttcatggaaggaaaggggttaaaggggctcaacccggtccagtcttatcgtggtcgcaacgtgtgaagatagcggttggggcagcgaaaggcctcgagtatcttcatgagaaagcgcagccccatatcatacaccgagacatcaagtctagcaacgtccttcttttcgatgacgatgtagctaagatcgctgactttgatctgtcgaaccaagctcctgacatggcagctcggcttcactcaactagggttctcggaacattcggataccatgcgcctgagtatgcgatgactgggcaactcagctctaagagtgatgtatatagttttggggttgttcttcttgagctgttgactgggaggaaacctgtcgaccatacattgccaaggggacagcagagtcttgtgacctgggctacaccaagacttagcgaagacaaggttagacagtgtgttgactcaagacttggaggggactatcctcctaaagctgttgcgaagtttgcggctgtcgccgccttgtgtgttcaatacgaagcggacttccggccgaacatgagcattgttgtcaaggcgctacaacccctgctgaatgcgcatgcgcgggcgactaaccctggagaacatgctgggtcataagctttgcgtttgcttctctccctcctcttgttcttgtatgataggtaaggtatatgactcgtcgatgtcgttgttgcggacatgtggctggcagcgtgtaatgtctgtgattattcttcccctgagctgtaaacaagattcttgtatccccacagtatttgattctttctattggtgccgtttttacctaaaaaaaaaaaaaaaaaacaagcaatcatccggccaggccctacaagtcaagttgagcaaattgcgggtaaaaggaatctaatttttttaaattcctctgaacagaatgcctccaggctccggtgaataatc

SEQ ID NO: 17361 - DNA, 1727 bp, Zea mays
ggagggctggcagacagtagactcgctgagcagcagcagtatatacgcgccattgggtacctcggggccggccgggacagccagctgcccagctccgtccggcggaactcggaagccctacgctacgcctaccctcgctgtactactagctgccttcctacccgcttcccctctcctcccgacgccgtctccctccctccctccgcctccgccgtcgccgccgggacacgcgaagcttccaggtcttgtctttgggtagaacatgtcgtgctttgcgtgctgtggtgatgaagatacccaagtaccagacaccagggctcaatacccaggacaccatccagcgagggccgatgcataccgcccttctgatcaacctcccaagggtcctcagcctgtgaaaatgcaaccaatcgcagtccctgctattcctgtggatgagattagggaggtgaccaagggttttggtgatgaagctttgattggtgagggatcctttggcagagtatacttgggtgttctaagaaatggtaggagtgccgcggtcaaaaagttggattctaacaagcagccagaccaagagttcttggcccaggtgtctatggtgtcaaggctgaagcatgaaaatgttgtcgagttgcttggttactgtgctgatgggacactccgcgtccttgcttatgagttcgctacaatgggttcccttcatgatatgcttcatggaaggaaaggggttaaaggggctcaacccggtccagtcttatcgtggtcgcaacgtgtgaagatagcggttggggcagcgaaaggcctcgagtatcttcatgagaaagcgcagccccatatcatacaccgagacatcaagtctagcaacgtccttcttttcgatgacgatgtagctaagatcgctgactttgatctgtcgaaccaagctcctgacatggcagctcggcttcactcaactagggttctcggaacattcggataccatgcgcctgagtatgcgatgactgggcaactcagctctaagagtgatgtatatagttttggggttgttcttcttgagctgttgactgggaggaaacctgtcgaccatacattgccaaggggacagcagagtcttgtgacctgggctacaccaagacttagcgaagacaaggttagacagtgtgttgactcaagacttggaggggactatcctcctaaagctgttgcgaagtttgcggctgtcgccgccttgtgtgttcaatacgaagcggacttccggccgaacatgagcattgttgtcaaggcgctacaacccctgctgaatgcgcatgcgcgggcgactaaccctggagaacatgctgggtcataagctttgcgtttgcttctctccctcctcttgttcttgtatgataggtaaggtatatgactcgtcgatgtcgttgttgcggacatgtggctggcagcgtgtaatgtctgtgattattcttcccctgagctgtaaacaagattcttgtatccccacagtatttgattctttctattggtgccgtttttacctatctcaaggcgcaactgctcaagcaatcatccaaacaggccctacaagtcaagttgagcaaattgcgggtaaaaggaatctaatttttttaaattcctctgaacagaatgcctccaggctccggtgaataatcatattcatttgatttgagggtgttcaacaacaccatatatttctaaaaaaaaaa

SEQ ID NO: 17362 - DNA, 1014 bp, Zea mays
  misc_feature (1005)..(1005): n is a, c, g, or t
gcgttttttttttttttttggaaaagaaggcgaaaataaataaatgggtcaaatcttgatatgatacagcgggcatcaaaactgcaaccctaccgtgcaagctagccaacaggaaagcagacatataggatcatcctttgcttgtttaacttcaagccacaggtatcacccagattgttgagaagttgccagtataagcatatcctagcagaaaagctgcagctatccatcgtttcaattggcagatgaaaaatctactgaatcacacactcacatttcctgaaaccctcattttccagttcatcatctgacaaacttccatcactggcttcgaattcccttatctcaaaaagctcctttccacatgtatcagtccattgaacttttctccgttccataccagatttcaaggtttgcacctcttccagtgactcacgtggttcttcaccttcactcaccactatacagtgctctgacgaatccctttttgagttgctcttaagacaaccttttctctcatctccagttatggaaccattagtggtaaccttcttctttgttgaacgggatggctcctccaaagagtccaaagtgttgcttgaactcagtttcggaggagacgccccttcgagctccaaagcagtgctaccgaagcagatgaagggagcacatttacggggagcttggtttttcgtggaagccagatgacaaacatgctcagcttccccatcgactagtcggtactgactccatggtgataccttgacaggcttctcttcttctttccgtccaagcagcaaaagagcgaggccatgactgtatcctgaagctgacgatgagaaaaaacctcctccttccacagccagtagcatttccacttctcatccaggaaccattaactatattcttctgctctgcttaataaacctccccttcattgactagtctattgttctggggaagagctattggcgcagcggggtttgtggttttcgaataagatgntctaggtaa

SEQ ID NO: 17363 - DNA, 2056 bp, Zea mays
aatccatctccgtaatcctgcctttctctctcttctgtcttctcccctgattctccaagccgagctcgagcttccaaaccctaggcctcaccggggagccatatccgccacgccagcgatgcctctcgccgcagcggcttgacggggcctgcccccaaatctacctcttcagcggagaggcgctgcgtggttgctgtgggaggcgcggcgcgggtcggaaatggagccgaggaggatctcggcgagcccgcgcccgtgcagcgggcggcgggtggtggccaggaagaggccgaggcaggaggcggtggtgagcagcgtgcggaagctgcagcgccgggagatcagctcacgccgcgaccgcgccttcgccatgagcgccgcacaggagcgctttcgcaacatacatctgcaggaagagtttgacactcatgatccaaaggagaacactttgctactcccttacttgaggaaaaggtcaaaaattattgagatagtcgcagcgcgtgatatagtctttgctttatcacagtcaggagtatgtgctgcttttagtagagaggcaaatgagagaatatgttttctgaatggaagtccagatgaagttatccgcagtttattttacaacaagaataatgattcactcatcaccgtgtcagtatatggttctgaaaacttcagtgctctgcgatgcagaacaacccgaatagagtacattcggcgaggacaaccggatgctggtttcccgctttttgagtccgagtccttgaaatggcctggatttgtagagtttgatgatgtcaatggaaaggttttgacttactctgctcaagacagcacttacaaggtgtttgatttgaaaaactacacattactgtattcggtgtcagataaaaatgttcaagaaataaagatcagccctgggataatgctattgatttatacaagaacaaatagctcggttcctctgaagattctttccattgaggatggtacagtattgaagtccttcagccaccttctccatcgtaacaagaaggtagatttcattgaacagttcaatgaaaagcttctggtcaagcaggaaggggagaatcttcaaattcttgatgtaaggaacttccaattgacagaagtgagcagaactgagtttatgactccatctgcctttatttttctgtatgagctgcaactgttcctgacgttccggaatcgatcagtagcagtttggaactttcgaggtgaactggtcacatcatttgaagatcacctgttgtggcaccctgactgcaacacaaacaacatatacattacaagtgatcaagatcttattatttcatactgcaaggctgactcaactgattcctcttcagaagaaaatgctggctctataaacataagcagcatactgaccggcaaatgcttggcaaaaataaaccctggaaattcgcgcaagcaaaaggatccgtgcaagcagaagaaagtatggaggttccagaatacagtctcggaggccctcgaggacatcacagctctatactatgacgaagatcgtgacgagatctacactggcaaccggcatggccttgtccatgtgtggtcgaactgaaagccgaaatagtggcggctttcacccacagcatggtgatcttcacctgtatgtgtattaacagcttgtacctcacatggcaggggggcacgaagacggcccccccagccaccaggtacggacgtgatgcttcattgttgaggcaattcttatttatcccaccagcgtggcaagagctctcaccacataggcacccattcagaaatcagaacaccccctccccgatttgttgtaggattgacaatcgttgtgcgttttaaatatagcatgtgtgttaattttttgttgttgttgggaatgtcgattatgtcccacaactcagtcagtgagttcaagtgttacggatgtaccttgcaagtaatgagattcattcgttgagttgtgatttcgttcacaaaaaaaaaaaaaaaaaactcgagactagttctctctctctctctctcctcgtgc

SEQ ID NO: 17364 - DNA, 1938 bp, Zea mays
ggccggccggaaaaaaaaaaataaaaaaaaaaaaaaaaagtttgcccggtttatttcctttcatccatctccgtatccctgtctctctctcttctccccctcccccccaatctccgaggcgagctcgagctcccaaaccctaggcctcactggggagtcacctccgccactccagagatgtctctcgccgcagcggcttgacggtgcctgcccccaaatctacctctccgttagagagcgcggcgtggttgctgcgtgaggcgcaccggggtttgcaaatggagccgaggcgcatatcggcgagcccgcgcccatgcagcgggcggcgggtagtggccaggaagaggccgaggcaggaggcggtggtgagcagtgtgcggaagctgcagcgccgggagatcagctcccgccgcgaccgcaccttcaccatgagcgccgcgcaggagcgcttccgcaacatacagctgcaggaagagtttgacactcatgatccaaaggagaacgcttcgctactcccttacttgaggaaaaggtcaaaaatcattgagatagttgcagcgcgtgatatagtctttgctttatcacagtcaggagtatgtgctgcttttagtagagagacaaatcggagaatatgctttctgaatggaagtccagatgaagttatccgcagtttattttacaacaagaataatgattcactcattactgtatcagtatatggttctgaaaacttcagtgctctgccccgcgcgtccgctcgaatagagtacgttcgccgaggacaaccggatgctggtttccctctttttgagtccgagtccttgaaatggcctggatttgtagagtttgacgatgtcaatggaagggttttgacttactctgctcaagacagcacttacaaggtgtttgatttgaaaaactacacattactgtatttggtgtctgataagaatgttcaagaaataaagatcagccctgggataatgctattgatttatgcaagaacaagcagctcggttcctctgaagattctttccattgatgatggtacagtcttgaagtccttcagccacctcctccatcgtaacaagaaggtagattttattgagcagttcaatgaaaagcttctggtcaagcaggaaggagagaacctccaaattcttgatgtaaggaacttccaattgacagaagtgagcagaactgagtttatgactccatccgcctttatttttctacatgagctgcaactgttcttgacattccggaatcgagcagtatcagtttggaactttcgaggtgaactggtcacgtcatttgaagatcacctgttgtggcaccccgactgcaacacaaacaacatatacatcacaagcgatcaagatcttattatctcgtactgcaaggctgactcaactgattcaacttcagaagaaaatgctggctctataaacataagcagcatactgtccgggaaatgcctggcaaaaataaacactggaaactccaatgcttgcaaggaaagaaagaaggcgtggaagttccggaacacagtctcggaggcccttgaggacatcacggctctgtactacgacgaggatcgcgacgagatctacactggcaaccggcacggccttgtccatgtgtggtcgagctgaaagctgaaactgcggggcggctttcaaccgtagcacggtgatctggtcttcacctgtgcgcgtattaacagctactagtgcctcacgtggcacgggggtggggggcacgaaagagggaccccccaagccactcaagtgacagttcttatttatctcagcatgccaagagcactgtccatcattctgaaatcagaggccccccagatctgttgtaacggacgtaccttgcaagtaatgaaatccattcgttgatctgaaaaaaaaaaaaaaaaccccccccaac

SEQ ID NO: 17365 - DNA, 1207 bp, Zea mays
  misc_feature (1159)..(1159): n is a, c, g, or t
tacaattaggacgttaaacttgtttacatgtgagaccgacttgtatattattaatgaagctgaagtaatagagttcaaaaaggcatttcataatccacgccattttatcgtcacactgatagtttttttttgagacatcctaaacaacacaaatactccctccacttgtctcttattataaggcacacacatgcatatatcaagattgaaactttcaaactcggtcaataatttaactagcaaatcttaattattataataaaaacttgatatatttagatttttaagtaaatatactaccaattatcataagtttaattataagcacaacaaacaatatgacaaaaaataaatatatattcaaaatataatttaggagattgtaaatcatattttgaaatacatatataaaaaagggaatatgtttttttatatagctattatatataacaaaaaaattaagattgaagtacatatattaaagatagcaatgtcactaaacatatatatcatatatttgtgaatggaaggtgcaaggtcatgcaatttaattattaggagaaacctaactcacaatatcaaacaatgaacattaatttaatctactgtacccttttagcacttaagcatgggtatgtgctatatatcaaatttcttttaaagatgctgcaggttcgattaatttgtcccctaacgatccctatacatatttattgttgctgatgacagcggttttcgttagccataatgagtatctggtttgtggagcaataaatcgaagtaatgcatgcacatggtagataaggacgacttactaagacgaggttttcataatttttcatgcaagtgatatctccagaaaataaattatagaaagtaataaagcatgcatgcatggcattggcatcccattgtttttttttttgtctctagcagtatgaagataatctatgcaaaaacgtaacactaaaaccatgaggtgtgtcgataatatatgttggcaatttcagtagctaggtaattaatggggggaaatagtttcacatagcacttagggattattgatgaacagtattttatcagtactgaatagttccaattaactgtgctatatatatacggagttagtaccaatgagaagtcttggtcttttggcacnagcaagcagcagcaaagagttttagaacaagccagtggactgaatgaa

SEQ ID NO: 17366 - DNA, 2306 bp, Zea mays
cctcgaggccggccggaaaaattccattctggtcccttccttgccttctccgcctccgcatccatccggtctccagttgtctcctcccgcctccttccggtcccctcccggcgcagcctctcccgccccctccagccaagcggaccctaggcggagccaccttccacgcttcccgaagctcgcccgtgaggggaggccaggatggcagcgacgtcggcgccgcccgcgagcgcccacgccaacggcaacggctccctcgtgggggtggcggcgccggtgggagcgcccaccaaccccatggcgacggctctgctcaccgaccagtaccagttctccatggcctacgcgtactggaaggccgggaagcacgccgaccgtgccgtgtttgacctgtactttaggaaaaatccatttggtggggaattcactgtttttgctggccttgaggagtgcatcaaatttattgcgaattttaagttcacagaacatgacatttctttcctgcaatcagtcatgccaatgtgtgagggtgcgttcttcaattatctcagggaagttgactgctctgatgtagaggtgtactccattcctgagggatcagtagtttttccaaaagtgcccttgatgagagttgagggtccagttgctgtggttcaacttctggagactccatttgtgaatcttatcaattatgcctctttggtaactactaatgctgcgcgtcatcgtcatgttgctggaaagtcaaaggttctgttagaatttggtttaagacgggcacagggacctgatggagcaataagtgcctcaaaatattgttttatgggaggttttgacgcaaccagtaatgttttggctgggaatttgtttggcataccacttcgtggaacacattctcatgcttttgttagctcatacatgagccttgatgagataccagacaaggccctcaagagcaaagatggctcaagactttgccaggattttgttagtttagtgcaagagtggcttcaaaagattcaggcagcaaattcattaggtggtgtatttggtgatacaaataaaagtgagctggctgcatttgcatcctacgcattggcttttccaagcaacttccttgctcttgtggacacatatgacgttatgcgaagtggtattccgaatttctgtgcagtggctctagcacttcatgacttagggtacaaggcatctggtattagattagattctggtgatctggcctatttgtccattgaagcacgaaaagtgtttagtgcagtagagaaggaatataatgtacctggttttgcaaagatgctcattactgctagcaacgacctgaatgaagaaacaattgatgccctcaacaaacagggtcatgaggttgatgcctttggaattggaacttaccttgtgacgtgttattcccaggctgctcttggctgtgtctttaagctagttgagataaataataaacctcgtattaagctttctgaggatgtggcaaaagtttccattccatgcaaaaagagatgcttcagactgtatgggaaagaaggctacccactggtagatatcatgattcgcgaaagtgaaccatcgcctaaggcaggagaaagaatcctctgccgccatccattcattgaatcaaagagagcatatgttgtcccccagcatgttgaggagcttctacagtgctattggcctgggacatcagataaacctagagcagagctgccctccttggagaagatcagaagccgctgcatgcagcagcttgaaatgctgcgcccggatcacatccggcggctaaatccaacgccctacaaggtgagcgtgagcaccaagctgtacgatttcatccaccgcctatggctgaacgaggcgccagtaggtgaactgcagtagatgatgatcatataaaagaagttttgggtcatctgcgatacagcagcaattcatcgaagaaaattagagctcttctgcacaacatcaacagttgagcccatggcaggattttgctccccaacttttcatctctagtcaccggtatagaggcaggttaatcaggttgtctagtttatacgtcccttaattggtgggatgctatacacatcatcatcagaaaagaaccgaaatcatatggagccaaaaatgttactaggtcgtccggtgtttgtgctcgacggtgtcacatttgtttttctagccgatcgtgcatatggtcatataaaacactgcactgttgattgtactgtttatatagtgaaatttgaaatgatagatggaataggagatagaatgga

SEQ ID NO: 17367 - DNA, 1042 bp, Zea mays
acagcactacagcagtcacacgaagacagcaagctaaacactcgtactctgtcgtctccttcccgagcccacaaatccttttgccaatggcacatcctgctagccatgcccgcctgacgaccaccaccatcctcttcatgtcgcttctgctggtcttggctactgaaacactgggatacccatgcccatgcccctacacctgcgagaacgagctgaactggcgcctgtatctgaagcaagttgccggtgctggaccagaccacaaccaggaggtaattttcagaccccagcacgctagtccgttcggcgtgactgccgttcaggactggacgttactagacgcgcctgctccaggcgcaaaggtgttagggcacgcgcaaggcgtgcatatcatgtctgatctagccagcgtgggctggttcgtctccctcaacatggtgttccaaggtgacaggtttagcggatctacactccaggtgatgggagtccttccaccggagggggagtgggctgtcgtgggagggacaggagagctggctctggcacgcggcactatcaagcacagaatagttggaggcgcgcccgagaccagcttccggcagctggatatccacgcgttctacgcgaacggctcagccagctgcgtaggttctgctgcagtcatagccgagaaggggtctgctcacgccaagtgatgccatgcgaaacagttgcatgcatcctgtctcaagtgcaaacctacaggaaataagatgaaaaaaaacataaataatcagttggacggatgcaaatgaagtaaatcaagtgatgctgctgcccttcatgtcatgagaagtaggcagaggatgcaccgtttgtgtgtgtgtttccttacaaataaataagacatgggtctctggatatggaagtcatgaaactaccaatacaaaaaaaaaaaaaaaacatggttcgctgtggtcgttgctgtacgcaactactgttgtcgttgtaatgtttgttgtgtaatattttcaggaaaaaaaagcagttaagtttgcttgag

SEQ ID NO: 17368 - DNA, 2044 bp, Zea mays
agaaacgtcctcgcggcccgccgggccgggactgattgtccacccaccactctacgcaagcaatccttcggacttcggtgggggaaatggaggccgccgccgccgccgagacggggctcgcccagaaaccggttgtgctgtacccttcgccggggatgggccacctggtctccatgatcgagcttggcaagatcctcggcgcgcggggactgtccgtaataattgtcgtcgtcgagcctcccttcaacacgggcgctacggcgcctttcctcgccggcgtctccgcggccaacccgtccatctccttccaccgcctgcccaaagtcgagcgcctcccgcccgtcaagaccaagcaccaggaggcgctcaccttcgaggtcacccgcgtctccaacccgcacctccgcgagttcctggccgccgcgtccccagccgtgctcgtcgtcgacttcttctgcagcatcgccctggacgtggcggaggagctccgcgtgcccgcctacttcttcttcacctcgggcgccgaggtcctggccttcttcctgcacctcccggcgatccacgagcggaccgccgcgagcttccaggacatggggaaggagctcgtgcacgtgccgggcatcccgtcgttcccggcgacgcactgcatcctgcccaccatggagcgcgacgacgtggcctacgacggcttcctaaagggctgtaccgacctctgccgctcccagggcatcatggtcaacacgttccgctcgctggagcagcgcgccgtcgagaccgtggccgcgggccactgcacgccccccggcctcccgaccccgcccatctactgcatcgggccactcatcaagtccgaggaggtgctgggcaagggcggcgaggagtgcctggcgtggctggacgcgcagcccagggccagcgtggtgttcctctgcttcggcagcatcggccggttcagcgtggagcagatcagggaggtggcggccggcctggaagccagcgggcagcggttcttgtgggtggtccgagccccgcccagcgacgacccggccaagaagttcgagaggccgccggagccggaccttgacgcgctcctcccggaggggttcctggcccggaccaaggataggggtctcgtggtcaggtcgtgggcgccgcagcgggacgtgctggcgcacgcgtccgtgggcggcttcgtgacgcactgcggctggaactcggtcctggaggcggtgatggcgggcgtgccgatggtggcgtggccgctctacgcggagcagcggctcaaccgggtgtttctggagaaggagatgcagctggccgtggccgtggaagggtacgacagcgacgagggcctcgtggcggccgaggaggttgctgccaaggtgcgatggctcatggagtccgatggcgggaggatgctccggaagcgcacgctggcggccatgcggcaggccaaggacgcgctgcgtgagggcggtgagtcggaggccacactgaccggattggtggacgagtggaaacgcatttgacgcggtatgtggggattgggaacgtgtgacgttacgcgacggatgaagtgccggtcatcatttttttaaataaaatatatattagtaatatattcatgtatttttcaataaaagatacaatttattgcattatactcgtgcgtgcggcgtgccaacaataataagatatctactctttattagattgaaaaaaaaaaaaaaaaattttcaaatcaaataaatgtgagaatcataacaaatataagtgtaataaaggattaatctcgaataaaaaactggtaataataaaatattcaatagtaatcatacttttataagctagccttaaatcatcgttacctatatggctatatgtacagttgtactaccccctcccccataatcaatctactgcttttccattcagcagtgggccagtggcttttgttttctttcgtgattatgctctcccgtcagcttgcgtatccagcggaggatccgtattttgcgctaggatattctactattcatctttt

SEQ ID NO: 17369 - DNA, 3604 bp, Zea mays
cgcgttagaccaattttagctttagcacttgggtggagctaaactgctaatgaatgctaaaatttagcacttcatttttaacattttttagcattactgtttggatcttcgagtggtaaagtttatcttaaaatgtagcgctaaactttagcaccataaattcaaataggctcccagaaacattagaaacattttatggaactactgcctagcacaaaggcaattagaaatacagataggagcgaagctaggttatatttagcgggtgcaaatgcatcctaaaaatgtatattctatagatttagctaaaatgtcaccatatatgtacctctataaaatattcatatacatccacaaagctagatgcatccttcttaaatttgctcttgattcgccactgaatacgtatgtgtaaatgtagagaataatataaaatattctttgcagttattcgatgtgacgcgattagttatcatttataggaacaacaggtgaaactgaacccaatcttctagtctccttttcataagctctagggatgagactcaggaaggcttatgattagccaagcagagttgcacttagaactcaatatatgattgcttgtgaacggtgtagcatgcatgtatagtaaaatgactaaatgggttattgttttcaaataattgcaaataaaggagtatagggaaatggaggggatccatggggattgaatagcaacccctccatttcctctttctattcaatcccccatgaatagaaattggtcatcaaaccagcactagtctcggagcaaactagaaattgtttcttttccgttatattttttgggttccttttggatgaagaaacagctcgattctctagtgaaactggagaacagacggacaacagagatgtttcaagcagaatcgctctgaaacagacttgtatttttgaagaaaagggcctcatgaatccaatccaggtgttaaatcaactgaacccccaaaagcacaagcctcctcaactctatgtggagaatggagatagatcatacatgatcgatgagagaagtgtaaaaggacaaacatggtgtggcatagtaggcagtcttttattatcaacaggttctgaaaatgatggtgcactgtgtgtgtgtagccggggtttaatcagatcactgttcagcgcccctcctgaaggcgtggtgccggcgcaggatcagccctccgcgcgtggcgcacagcaggcgcagcagccaccgcgctgaccgttccccgccgtcgtcctcttctggctaatgccctcctcctcctcctgcacacccttcaccacctccgccggcattgggaaccacttgttctgcgtaagtcggagcatgcagggcatctttctcacggtgaacttgcatatttcagccatcaccctgccaaaaagaaaaaggcacatggcatttaggtattgcatttgcatcgcattggatgagatgctttccacatggtaccggctagcggccacacacgtactctccgaagtagatgaccccggcaaaggcaacgcagacgatgacgatgatgtagatgcaggaggagaagaagcgcgtggtgccggcgatgtaggcgccgatgaggctgatgaggtcgatgaaggtggtgagcatgagcgccaccaccttggtctccgtgtggtagaaccgctcgttcatcagcagcaccatgatcaccagcgacgtcacgaacgccgtggcgttcaagtagtagaagatcatgtaccgcgaccagtgcctgtcccggagcaccgggttgccggcgcggtcgccgtcctgccagaacccgccgggcgggttcaggccggcctggtaggtcaccgacgccgccacggtggccagcaccatcagccacccgcgcatctccttgaaccacttcttgcgctgcgccaccggatcgtcgtcgtccttctcctccaggaggaggaagccctggaaccccatgctcattatgtcctccgcactggcgcggcgccctcggcttccatcacattctcgctggctgtggagcggcgcaacgagcaccgggatgccgcgcttccccgtcgcgctgatctcggtcactgccggggtcgcgtcgcccggagcagagtcggccacggtgatggctcgacttcgctgtgcttcctcgacattgatcggacaagacatttcaatttggttgagcacacatacacatatagtgtgaactactatacatgtcccatgccatatacatatagtgggtttgtgcctttctgtcaacgtacttatgagccagcatcgtctccgttgaaagcatgaagcaagcataacttacatctttattaaagaagacaagaacaatggatgcatacatatacaatcgtatatatctacatgaagaaaggaatcggacaatcccatgcatgcatgcttctcattgtataatttttttggtggtcttttggtggctacctattgtagggtcctgattcgtgaccctaaacactcgttagcaggtaagagcaacatagtacaacaaaacgggaagctagattgctcggatgttttgtcaaacgtgtcccgtccacaggccagacaacaggtatttatagggtaatcaaaggaccagggcctaaaatacatgtgtgctcttggttacctactacatttagtaacatattgtacactaggataattacggaataatgttggtctagacctaattacaaccgaggatcgtactcgccaaagatgctgacatgcgaacccgcttcactggtggtgggctcactgggtcctaggcagccatgcgtagtcctctgactccggggcccagaggccttcgacttgaggcgtttggtgattcccagtcatctggtgtgatgtccagggggggcggccgacctttggtttgttcaagccttcgccccgatttggactggccatcttagagagaggggtctggacatctgaaagagcgaagtccgtgtaaattgattattgagtatgatgaagtggagctatggtctgcatgtcattgctagtgtcaagggtgaaggtagagggaaggggatgaaagttgtgattaatgaagggggcagcggtgctatagcctgagggacgaaaaggagaaaagaagtgttgtctggtggcatagaagacctcgattccaagactgtggtggttactttcgttgaagagtcgagagagacctgcagttctttgaggtctgcctctcttggcgatagcgcatcggtgaccgccttcatcgagaaagttactggtggtaagtttggtagaattttgaaatacagaaaatttgtttccattggaccaaagcagtggatggtgagggacacccctccgttgtgtaggtgtgaagacgtttgaatattttaccttactctcatgacaaccctgatgttgtgcgagcaacgacatgaaagtgtcaaaggggaagaaaccggtggtgttcggcatggtcaacatgctaaaaccaaaaacacgaaaagctaaagcgggcaccaagatggagaaagcgacgtcagttgtgaatccttaagtcgacattttatcttatcagattaggtatttcctaaatctagattagcc

SEQ ID NO: 17370 - DNA, 1833 bp, Zea mays
ccggccgggagaaacgtactgactgtccgggctcacagcactgattgtccacccaccactctacgcaagcaatccttcggacttcggtgggggaaatggaggccgccgccgccgccgagacggggctcgcccagaaaccggttgtgctgtacccttcgccggggatgggccacctggtctccatgatcgagcttggcaagatcctcggcgcgcggggactgtccgtaataattgtcgtcgtcgagcctcccttcaacacgggcgctacggcgcctttcctcgccggcgtctccgcggccaacccgtccatctccttccaccgcctgcccaaagtcgagcgcctcccgcccgtcaagaccaagcaccaggaggcgctcaccttcgaggtcacccgcgtctccaacccgcacctccgcgagttcctggccgccgcgtccccagccgtgctcgtcgtcgacttcttctgcagcatcgccctggacgtggcggaggagctccgcgtgcccgcctacttcttcttcacctcgggcgccgaggtcctggccttcttcctgcacctcccggcgatccacgagcggaccgccgcgagcttccaggacatggggaaggagctcgtgcacgtgccgggcatcccgtcgttcccggcgacgcactgcatcctgcccaccatggagcgcgacgacgtggcctacgacggcttcctaaagggctgtaccgacctctgccgctcccagggcatcatggtcaacacgttccgctcgctggagcagcgcgccgtcgagaccgtggccgcgggccactgcacgccccccggcctcccgaccccgcccatctactgcatcgggccactcatcaagtccgaggaggtgctgggcaagggcggcgaggagtgcctggcttggctggacgcgcagcccagggccagcgtggtgttcctctgcttcggcagcatcggccggttcagcgtggagcagatcggggacctcgcggccggcctggaagccagcgggcagcggttcttgtgggtggtccgagccccgcccagcgacgacccggccaagaagttcgagaggccgccggagccggaccttgacgcgctcctcccggaggggttcctggcccggaccaaggataggggtctcgtggtcaggtcgtgggcgccgcagcgggacgtgctggcgcacgcgtccgtgggcggcttcgtgacgcactgcggctggaactcggtcctggaggcggtgatggcgggcgtgccgatggtggcgtggccgctctacgcggagcagcggctcaaccgggtgttcctggagaaggagatgcagctggccgtggccgtggaagggtacgacagcgacgagggcatcgtggcggccgaggaggttgctgccaaggtgcgatggctcttggagtccgatggcgggaggatgctccggaagcgcacgctggcggccatgcggcaggccaaggacgcgctgcgtgagggcggtgagtcggaggccacactgaccggattggtggacgagtggaaacgcatttgacgcggtacgtggggattgggaacgggtgacgttacgcgacggatgaagtgccggtcatcatttcttttaaaaaaatatatattagtaatatattcatgtatttttcaataaaagatacaatttattgcattatactcgtgcgtgcggcgtgccaacaataataagatatctactctttattagatttaaaagagtttgggtcaattttcaaaatctattaaatgtgagaatcttaaacaattataaaggtattaaaggattattttcctattaaaaacttgtaatactaaaataa

SEQ ID NO: 17371 - DNA, 1953 bp, Zea mays
gtcatgaaaacagggagactgggaaaggatggactgatgcagtagaggatcatggaaacatgaaaaggaaataaataaattaatgaagccaaaaaaaataagtaagaaagagaaagaagggtttaacagagatgaacatgtatgtgccatgtgggtatatgcgtgtttgtagaaaaaaaaatcaataggaagcccgcaggaaaggcctcgcgcatgcttctataaaaagcgtcacagcagaaacgtaccaacgcagatcgatgggtggggaaatggaggccaccgccgccgggacggggctcgcccagagaccggttgtgctgtacccgtcgccagggatgggccacctggtctccatgatcgagctcggcaagctcctcggcgcgcgggggctgcccgtcacaatcgtcgtcgtcgagccgcccttcaacacgggcgccacggcgcctttcctcgccggcgtctccgccgccaacccgtccatctccttccaccgcctgcccaaggtggagcgcctccctcccgtcagtaccaagcaccaggaggcgctcaccttcgaggtcatccgcgtctccaacccgcacctccgcgagttcctggccgccgcgaccccggccgtgctcgtcgtcgacttcttctgcagcatcgcgctggacgtggcggaggagctccgcgtgccggcctacttcttcttcacctcgggcgccgaggtcctggccttcttcctgcacctccccggcgctccacgagcgggccacggcgagcttccaggacatgggggaggagcccgtgcaggtgcccggcatcccgccgttcccggcgacgcccgccatcctgcccgtcatggagcgcgacgacgcggcctacgacggcttcgtcaagggttgcgccgacctctgccgctcccagggcgtcctcgtcaacacgttccgcctgctggagcagcgcgccgtcgagaccgtggccgcgggccactgcacgccccccggcctcccgaccccgcccatctactgcatcgggccgctcatcaaatcggaggaagtgctgggcaagggcggcgaggagtgcctggcgtggctggacgcgcagcccagggccagcgtggtgttcctctgcttcggcagcatcggccggttcagcgccgagcagataagggaggtggcggccggcctggaagccagccggcagcgcttcctgtgggtggtccgggcgccgcccagcgacgatccggccaagaagttcgagaagccgccggagccggacctggacgcgctcctcccggagggtttcttggccaggaccaaggacaggggcctcgtcgtcaagtcgtgggcaccgcagcgggacgtgctagcgcacgcgtccgttggcggcttcgtcacgcactgcggctggaactcggtcctggaggcgatcatggcgggcgtgccgatggtggcgtggccgctctacgcggagcagcggctcaatcgggtgttcctggagaaggagatgcagctggccgtggccgtggcagggtacgacagcgacaagggcctcgtgccggccgaggaggttgctgcgaaggtgcgttggatcatggactccgaaggcgggaggatgctccgggagcgcactctggcggccatgcggcaggccaaggacgcgctgcgcgagggcggtgaatcggaggccacactggccgggctggtggacaactggaaacgtacttgacgtggttgctgtggattatgttggaagggggtgggggttacgcgacactgttcgccatctgtggactttacatcggaacgagaccttctagatgatcaattatgtcctggtaccagaaactgttctagatgattaattattatataaattaaactattattcaaagtggaattgttccgaaagttgaatccgggataaacgaaaagacactaaaacggtctaaaatattgcgagaatcgg

SEQ ID NO: 17372 - DNA, 2410 bp, Zea mays
aatgcggccccggcccgaaatggcggcctccccagcggccgccgctaccttccttcaccatcacctcccctttcccagtcgccccaagacacttctcagaccacgcctccaccgcctcgccgcgtccatcaacccctcgtccaccgacgagacccccgccgcggacccaccggtcatcccctcgatcagcatcaagaacactgagcccgaggaggtcgcccgccgccgcagttgggtggagcacggatgggctccgtgggaggaaatcatgacgccggaggtcgcctttgcgcgccacagcctcaacgagggcgaggaggtgccgcttcagtcgccggagtccctcgaggctttccggatgctcacgccttcctaccggaagaaggtggaggctgagccaggatacctggagcgcctcttcgcgacgcgcgacacgcccgagcctctcgagacgacgtgggccggccggctcccgctgcggctcgtgccgccgcgggactggccgccgcctggctgggaggtggacccggacgagctggagttcataagggaggcgcacagggcggcctctgagaggctggacatggaggcggcggctgcggcaggggtgaccaacgtggagaagctggaggatgcgccacaggatctggcgctagagaggtacaaaatgttcctgaagcagtacaaggaatgggtggaggcaaaccgagataggttggagcaggagtcctaccagtttgatcaggattacttccctggcagacgaaaaagaggtaaggactacagtgaggatatgcgtgaacttccattctactatcccggacagatatgttacgggcaagtaacgactgttcacctctaccagggagcctttgtgaacattggttgtgtccatgaggggtgggtaccgataaaaggaaatgactggtactggatccgacatcacatcaagcctggcatgaaagtctacgtggagattctggccaaacgagacccttaccgcttccgcttcccacttgagatgcgatttgtatatcctaacattgatcacctaatatttaatagattcgacttcccaccaatatttcaccgtaaggaggatactaacctagagcagttgtggcgtgaagccggacggccacccattcctaggaaaaaacctttaaaagatatggaaaaggaacctttggtatcagaccatccttttgttgacacgctttgggaatggcataatgcagagcagatgattttagactacgaggaacaaaatccagataaattcaagaatacaacatatgagtccacagttgatgcaccctcaatcgatgaagaaaaaagagttgaatacaccgaaggatatttcaaagaaacgctgctaaaaaagaaagttgtgaatattagcatcaaagaacttgatctggatgctgcccgtgctgaacgccagctgataaaaaggctgaaaaaggaagccgaggagagaggggaggaatacaaggttaggaagctccgacgaaacaaagaaatggatgagtatgatctgatgcaatggcgccgttcatttgaagagagggaagcgcttatcagagacatctgctgccggaaagcgcttgatcttcctatcgaagagcccgggcgatacgacgtggacgagacagaggtgtacgggaaggatcactatgacccagagaagccaatgtaccggtacgactactggggcgagcccaagaacacggagaagacgaagctggagcgggacgtggagcgccacaaccagcaggtggtcggcgacgcgaagaagtggtgcgagatgtcgtacgacgactacgtccgcaagaagctgcggttggaagcggctgaggcgagggaaaggcggaggaaggcggccgaggcgcaagaggacgagcaggagtacgatgacggcatggacctggacctgaagaagatgaccgatccacgcgccccgcacaaccggttttacatcacgaaatgaaaggttagagatagttgttagttgtgcaaaaggttcgattgccttggttgttgttgttgggccaccgcttccgcctatggtgcaagagttgggggcgcttgatcaggtcgtctgacattctccttgttgacccaaccccattccgattggggcgacctggtcaaacgcgggggcgtgctagctacgctcagtacaagtattcagcatggaatctccagtattttattctagagaacatatcttgtgtatattgaagtttagtgcacatgttacatatattaaatcagtatcactcattttagatttagcatctctagttgtttgatatattttgttaaagacacgctccgacattgtgggtagtggtggacgatgttatttataaattgcaatgatcaaccatataagttagatttaaaa

SEQ ID NO: 17373 - DNA, 1287 bp, Zea mays
ggtcgacccagctttttctggtactggaccgcatccatgggcgtgggatgaaatttacatggagattctggccaaacgagacccttaccgcttccgcttcccacttgagatgcgatttgtatatcctaacattgatcacctaatatttaacagattctttacccaccaattttcaccgtaggggggggtgacctagagcagttgtggcgtgaagccggacggccacccattcctaggaaaaaacctttaaaagattggaaaaggaacctttggtatcagaccatccttttgttgacacgctttgggaatggcataatgcagagcagatgattttagactacgaggaacaaaacccagataaattcaaggatacaacatatgagtccacagttgatgcaccctcaatcgatgaagaaaaaagagttgaatacaccgaaggatatttcaaagaaacgctgctaaaaaagaaagttgtgaatattagcatcaaagaacttgacctggatgctgcccgtgctgaacgccagctgataaaaaggctgaaaaaggaagccgaggagagaggggaggaattcaaggttaggaagctccgacgaaacaaagaaatggatgagtatgatctgatgcaatggccccgttcatttgaagagagggaagcccttatcagagacatctgctgccggaaagcgcttgatcttcctatcgaagagcccgggcgatacgacgtggacgagacagaggtgtacgggaaggatcactatgacccagagaagccaatgtaccggtacgactactggggcgagcccaagaacacggagaagacgaagctggagcgggacgtggagcgccacaaccagcaggtggtcggcgacgcgaagaagtggtgcgagatgtcgtacgacgactacgtccgcaagaagctgcggttggaagcgagggaaaggcggaggaaggcggccgaggcgcaagagggcgaggaggagtacgatgacggcatggacctggacctgaagaagatgaccgatccacgcgccccgcacaaccggttttacatcacgaaatgaaaggttagagatagttgttggttgtgcaagaggttcgattgccttggttgttgttgttgggccgccgcctctggtgctgacattccgattggtcaaacgcgggggcgtgctagccacgctcagtacaagtattcagcatggaatctccagtattttattctatagatcggtagctgctgaagtctgaacagctgcaaatccctgtcctaaaaaaaaagcggcc

SEQ ID NO: 17374 - DNA, 1047 bp, Zea mays
gcacgatgcaaagccaaaaccccaatcgcacaggagagaccgagagagaggttttccatccatggctcccggcgtcgcttccgtgctggtcccgcaggagcccgtcctcctcaaggacatcctcgcctcaccgtccccctgcgggaacaccgctgtctccgcccgccacctcttcggcaacggagtcgcgccgccacgctcctcggacgacggcatcaaggacgccgctgccgaccgccacggtgaccgcgacctctccatccccaagatcttcaccggagacgtgctggacctgctcgacgatgctgcgaggctggacctgatgctggcgctgacgggggacggcggtgcggcgtccatggccggcttctccgcgcgcgggtggtgggtctcgaaggaggatggcgacgcggtgcagctgaaggtgccgatgccggggctggggaaggagcacgtgaagatgcgggtggagaaggacgccctggtgatcaagggggaggccggcaaggacctcgagggcgacgacgacaagggcccggcgcggtacagctaccgcatcggcctctcctcccaggctttcaagatggaccagatcaaggctgacatgaagaacggcgtgctcagggtcaccgtcccgaagatcaaggacgaggagcgcaaggacgtcttcgagatcaagatcgagtagggtgtgtgcatcggatgggtcctcccaggtctcctagttgcagtccatatccataccgtagttgcagtccatatccatatcgtagttgccatgagctagtcgtattagtagtttcaattactggagtgcagtagtcgtttctgttgcagagcagtcgtagtactagtagctttctggtggtgctccgtctctgcctgatctgaggcagcgtttacctttctgttggtcttgcaaagttcagttccctggatggcgacgatcactgacgatcttgtgatgaacttcaaatggtaatggaatctgcagttaataatcgacatctatatgaccttcctgtgatcgtcgcgatctagaaatat

SEQ ID NO: 17375 - DNA, 2034 bp, Zea mays
cagaaccaaaagtcactggtccgccccaactcccatggttcagcgactcactggttccctcggtcgtcccatttcccaaaacccaccggaacacacaactactccgtcccggtagaccgcacgaatcgcaaagcatgactccgggcaaactgaagccgtcgatggcgcaaggtgcgcactctggaaccttctgtcccctcggccatccccccttccccaagaaagccccaagcatataaacccccgactcccgtcgctgtcaaggcacatctcgctcgcagcgccccgctagaatccaaagccaaaaccccaatcgcacaggagagaccgagagagaggttttccatccatggctcccggcgtcgcttccgtgctggtcccgcaggagcccgtcctcctcaaggacatcctcgcctcaccgtccccctgcgggaacaccgctgtctccgcccgccacctcttcggcaacggagtcgcgccgccacgctcctcggacgacggcatcaaggacgccgctgccgaccgccacggtgaccgcgacctctccatccccaagatcttcaccggaggtactaccgaaccgtctcgtttggcccttccttccccttgtttcctcgaacctgactagcgaagcgaaagtgggagagagagagagagagataggaagagcgcgcgaactgatgattatttggggttttgtgtgcagacgtgctggacctgctcgacgatgctgcgaggctggacctgatgctggcgctgacgggggacggcggtgcggcgtccatggccggcttctccgcgcgcgggtggtgggtctcgaaggaggatggcgacgcggtgcagctgaaggtgccgatgccagggctggggaaggagcacgtgaagatgcgggtggagaaggacgccctggtgatcaagggggaggccggcaaggacctcgagggcgacgacgacaagggcccggcgcggtacagctaccgcatcggcctctcctcccaggctttcaagatggaccagatcaaggctgacatgaagaacggcgtgctcagggtcaccgtcccgaagatcaaggacgaggagcgcaaggacgtcttcgagatcaagatcgagtagggtgtgtgcatcggatgggtcctcccaggtctcctagttgcagtccatatcgtagttgcagtccatatccatatcgtagttggcatgagcttgtcgtactagtagtttcaaactttcaattactggagtgcagtagtcgtttctgttgcagagcagtcgtagtactagtagctttctggtggtgctccgtctcgtgcctgatgcgaggcagcgtatacctttctgttggtcttgcaaagttcagttccctggatggcgacgatcactgacgatcttgtgatgaacttcaaatggtaatggaatctgcagttaataatcgacatctatatgaccttcctgtgatcgtatattcttgtgttttactatcctgatgtctttgtgaagttgagtttattgttggctacatccgtactgatgatctttgtgagacgtcttttgatctaaagcaaccccggccctcagtttctttgtacgtttttttatgaatgtgatgatcgagatgtatttctggtgtcggttctgtgttcttgtgcttgttggttgttacatttctgcatgctctatgaagttgtgtttattttggttacatctaatgtcgtttcggttatttcaattacacatagattaatatgtattgtgatgtgtgttgggatgtattttgacttatatggatttaaactgactcaataccaattaatccacatagattattcttgaaacaaacaagcccaaaaaggctgtaattcaattaatcttctattgcactgcatgtctgcatgtgttttaagacggtccacgggcttttcattgtaagagtaagagaacatactagtactggaagaattgtactctcaaaatattagtcgctttaactcttgatttttatttatataattctatattcaaatggatgatgataaa

SEQ ID NO: 17376 - DNA, 1065 bp, Zea mays
gtaccctccgggtttcggaaggcacatctcgctcgcagcgccccgctagaatccaaagccaaaaccccaatcgcacaggagagaccgagagagaggttttccatccatggctcccggcgtcgcttccgtgctggtcccgcaggagcccgtcctcctcaaggacatcctcgcctcaccgtccccctgcgggaacaccgctgtctccgcccgccacctcttcggcaacggagtcgcaccgccacgctcctcggacgacggcatcaaggacgccgctgccgaccgccacggtgaccgcgacctctccatccccaagatcttcaccggagacgtgctggacctgctcgacgatgctgcgaggctggacctgatgctggcgctgacgggggacggcggtgcggcgtccatggccggcttctccgcgcgcgggtggtgggtctcgaaggaggatggcgacgcggtgcagctgaaggtgccgatgccggggctggggaaggagcacgtgaagatgcgggtggagaaggacgccctggtgatcaagggggaggccggcaaggacctcgagggcgacgacgacaagggcccggcgcggtacagctgccgcatcggcctctcctcccaggctttcaagatggaccagatcaaggctgacatgaagaacggcgtgctcagggtcaccgtcccgaagatcaaggacgaggagcgcaaggacgtcttcgagatcaagatcgagtagggggtgtgcatcggatgggtcctcccaggtctcgtagttgcagtagtccatatcgtagttgcagtccatatccatatcgtagttgccatgagctagtcgtgctagtagtttcaattactggagtgcagtagtcgtttctgttgcagagcagtcgtagtactagtagctttctggtggtgctccgtctcgtgcctgatgcgaggcagcgtatacctttctgttggtcttgcaaagttcagttccctggatggcgacgatcactgacgatcttgtgatgaacttcaaatggtaatggaatctgcagttaataatcgacaaaaaaaaaaaaaaaa

SEQ ID NO: 17377 - DNA, 946 bp, Zea mays
attacagtctcgagcacgtttcacgagcaagctcgttgagttcagtcactcgaaaatctatggggctggggctgcaaagtatgttaaggtggtcgatgatgctgtacatgagctgtataaggagtatgtggctcagccactcccactgaccccagcctatgttgaccaaggcgaagggaataatggaccagccaatgcgaacagcagtcaaggggctcctgcttccactggtgatgggcttctagacttcgatatgtacctttctgagatccaaagtagccagccctcgaaatctgagctggagcagtacctggatgaatccctcactccacgtatccaggagtttgatatcctgaactggtggaagctaaacacggtcaagtttccaaccctctctaaaatggcccgtgatatcttggccattccagtgtccatggtaagcagtggcagctctatattctgtgctggaacaggaagtcacatgctcgatgactacagaagctctctgcggcctgagattgtggaagcacttgtttgcgcgaaagactggctccagtattcaccacctgccaccgaggcaccgagttctgcactggtgaaggttcaaggatcgtaggtttgtcgtggtcactgcctgccttgtggaagcaaagcaagaatccatttacccatctgtcgtatctctgagtgtagttaactgtaggtgtattgtaggctgagattgtgaaccgattttgatatattctggtatttatcacgtaaaggtgtaacatgtgttgaactctgctgaactcgtggctgttctgatgtcgtctgaccctttgcagtttgcacgcttccctatgtgcttgtacaagccgtgggatgtatcttgtttttgtattaaatttgttttataccgtggattgatgtctcattaccctaaactaccaactaaaattggggg

SEQ ID NO: 17378 - DNA, 2643 bp, Zea mays
aaaaaaaatatccccaccccgccttcccccaaaagagaaaccagatcacctgctcggggccttggggcgcttcttgggccgagccctaggtagcccggaactccgatctcggccaccaccaccaccctcgcctatcccagaagttcagctgctagtctatcaggatggccgtggaaactgccagtgacgctcaggtggcacaagataacgagatttcccccagcaatgaggcaatccaaggtgatgagttggctcatggcgaagagctgttccaaggtgatgatcttgttcaaggaaatgagttggttgtttctgaggtaacaacacctcctactactggaatcagacgtaggaggaagaagaagtccttggtatgggagcacttcactattgaagccgtcgcgggcggggccacaagggcctgctgcaatctctgcaagcaaacctttgcttacagctctggctcaaagattgctgggactagtcatctcaagaggcacatcaccttgggctcttgtcccaagataaaggaccaagatcagaggctggcactgccttcaactggtgggactgacaactatggcgaggcaacttcggagcggccaaccaagagacgctacagatataccggttatgcaaatgctgtttttgatcaggaccgcagttgctcatacttggcaaggatgatcattcagcatgactacccacttcacattgtccaacagcaggcattttccgtctttatcgaaagtctgcagccacgtttcaagatcgtggatgttgatacgatggaaggagaggtgtatgctgtttatcagaaagaaaaggagaacctgcttcgatcattcaacactatgcctggaaggatcagtctcactataggactgtggacaactagtcagactctcgggtacgtttcacttgcagggcagtttatcgactctgagtggaaagtgcgccgaagaatgcttaacttcatgatggtgtcatctcctcactcagagaatgcacttagtgaggcaattagcctgagcctctctgactggagtatgaaggacaagctattcaccatcacattggataatgaatgctcctcacacgatatctacagtgcaaatttgagggatcatctctccaacaagaacagtctcatgcttaagggacagctctttgttgtgaggtgctatgcccatatccttaatgctgttgcacaagatgtcattgcttcggttcatggtgttgtatacaatatccgtgaaagcataaagttcataaaagcttcttctgcccgtgaagagaagtttgccgagattgctctgcagctggagattcccagtaccaggaccctctgtctggatgttacaacccagtggaacaccacttatctgatgttgctagctgccttggattataagcaggctttcactgcactagaaacatgtgatgatagctacaatgaagctccatcatcagaggactggaggaaagttgaggccgcctgtaattacctgaaactgctctacgactccgcacatagcatcatggcagcagcaaacccaactgcaaacatctttttccacgaagcatggaaacttcagctagagctagcaaatggcacaggacatgaagaccccactttcagaagcatcgccaaggatatgcatgagaggtttgacaagtactggaaagattgcagcctcgtgttggccgttgccgttgtcatggatccacgtttcaagatgaagcttgttgagttcagttacacaaaaatttatggggctgaagcagcaaagcatgttaaggtggttaatgatgctgtacatgagctgtacgaggagtatgtggctcatccactcccactgaccccagcctatgtggagcaaggtgaaggggggaataatggagcagcaaatgcgaatagcagtcaagggcctcctgcttccgctggcgatgggcttctagacttcgatatgtacctttctgagatccagagtagccagccctcgaaacctgagctggaacagtacctggatgagtccctcaccccacgtacccaggagtttgatatcctgaactggtggaagctaaacagagtgaagtttccaaccctctctagaatggcctgtgatatcttggccattccgatgtccatggtaagcagtggcagctccatattcactgctggaacaggaagccgcatgctcgatgactacagaagctctctccgacctgagacggtggaagcacttgtctgtgcaaaagactggctgcagtactctacgaaggctgaaggatcgtaggtttatcgtcgtcgctggtcactgctcctgccttgtggaagcaagaatctgtgtatccatctgttgtacctataagtgtagtttaactgtaggctgagattgtgatctgttctggtgtttgtctcgtaaaggtgtgtagactctgatgtactcgttgttgtcatgtaatagcttatgtatcatgttctagtatcgtctgatgttggagtttacaagccaaaaaaaaaaaaatcgacaggccgtgggatgcatcagctgcttgctgtaatgctgtttgaactccggttttgtatttaatttgttttgtaccgtggattggtgtcaaaaaaaaaaaaaaaaaaaa

SEQ ID NO: 17379 - DNA, 1425 bp, Zea mays
gcacgtctgccactcgctcgctctcttcccaacccgcttcccccaaaaaccagatctaccacctgctcggccttagggcgcttcttgggccgagccctagcagtccggaattccgatctcggccaccacctcctcttctctcctctcctctcctgaaagcaatctcaaaagttcagcgggtagcctatcaagatggccgaggaaactgccaatgacgctcaggtggcacaagataacgagattgctctcagcaatgaggcaatccaaggtgatgagttggtccatgttgaagagctgtcccaaggtgatgatttggttcaaggaaatgagctagttgtttctgaggtgacaactcctactattggaaccagacgcaggagaaagaagtctttggtatgggagcacttcactattgaagccgtcgcaggtggggccactagggcatgctgcaagctctgcaagcaaacctttgcttacagctctggttcaaagattgctgggactagccatctcaagaggcacatcaccttgggctcttgtcctaagataaagaatcaagagcagaggctggcgctgccttcaactggagggactgacaatgatggcgagggaactatagagcggcgaaccaagagacgctacagatacactggttatgcaaatgctgcttttgatcaggaccgcagttgctcgtacttggcaaagttgatcattcagcatgactacccacttcacattgttcaacagccgccatttgccatttttattgaaagtctgcagccacgtttcaagattgtggatgttgaaacgatggaaggagaggtatatgctgtttatcagaaagaaaaggagaacctgcttcaagcattcaacactatgcctggaaggatcagcctcactataggattgtggacaactagtcagactcttgggtacgtttcacttgcagggcagtttattgactctgagtggaaagtgcaccgaagaatgcttaacttcatgatggtgtcatctcctcattcagagaatgcacttagtgaggcaattagcatgagcctttctgactggaatatgaaggacaggctattcaccatcacattggataatgaatgctcctcacatgatatctacagtgcaaatctgagggatcatctctccaacaagaacaatctcatgcttaagggacagctctttgtcgtgaggtgctatgcccatatccttaatgctgttgccctagatgtcattgcttcaattcatgggtgttgtatacagcattcgtgaaagcataaagttcataaaagcttcttctgcccgtgaagagaagtttgctgagattgctctgcagctggggattcccagtaccaagaccctctgtgtgggatgttacaaccccaggggaacaccacctatctgatgctgctggct

SEQ ID NO: 17380 - DNA, 1964 bp, Zea mays
caatccataattaatgaggtccgttagtgtgtacgaaaaattgaacactagcagcaacattcagtttacaaggtcatatgatattttagcacgcaacgtcatgccttaacccaggccgtgtcccgcgcgcggcccccctgcaaatctatcatgcactttgcatgcggcgcacacacaacccctttcatgcctccgtttagtctcacgtcaaccaaagctcaatgatttgatcggctcctagtgacatgtctctgaaatcatctttataccaggtcatcggaatcggacgttcccgttggagcagcagcgcgaagcagcagccatgtccaccacggtctcgccgccgccagactctttcggcgatgccccaacggcacccggcacccccagctccaacttcacgctgctgtacatcatcatcgcggtgctcaccggcgtgatactgtacgtggccatccgccatggccagtcagtcctggccgagtggcaacggctccagggaggcggccagggcgaggccgaggcgtccgggacgaggctcgggcttagcgtggaggacatcgccgcgctgcccacgttcacgtaccaggcgcgggccgcgtcggcgtcgccgcaaggtggcgggatgagccgcagcaagggcaggacgccgggccgggcggtggtggagtgcgtcgtgtgcctgcaggagatggaggacggcgacgtcgtgcgcgcgctgcccgcgtgcaggcacttcttccacggtggctgcatcgacgcctggctgtccgcgcactcgacgtgccccgtgtgccgcgcgcacccgaaacccgagcgcgcgcggctggcggaggcgcccatgtccccgccactgccgcagctgcgacggtgcggcgtgtcgcctgagcggtccacggcatcgagggtcctggtggacatcctggcgcggtcaccgttgagaaacagctgctcctgctcgacaagtggatccaaatccaaggagaccatcgtctcaaaatcaccatcgccaaggcttcactttgggtcaaggattccgtctccgaagccgcagttgtctggccgggtggaagatagatgctcaatgtcacctccatcgggattatcagaaatcgtggttgtcccatccaagtcgccgtcgccgatgaggttcagcacaagcaggcagttgacgacggcgagaagcgttgcaacattggaaaggatagaggtgatcgcgtcagcatcaccgtcaccgttgccaattagagaggacggtggtggttccctgtcgaagtcgcagtagccgtcgcctgtgccatatcgagtaatggtagggtagttggaagaacatgaagagggcttgtgacgtatatttcatttttttttactattttactgtgatgaaaaaggtattatgcttctttaattcttaccaaaaaaaaaaaaaaaatgatatgactggggttgtctctcatctttccgctcaggataaactcgaatttaggtggatttgacgttgtgggtacatgactaaattttaagtccatatcaaatcaagtcagaaatattaaatatagtctgattataaaaactaattatatatatacactaaatgataaataaatttattaaacctaattagtttataactcgcacatagaatgttacaatagttatttgctaatcgtagattaatttagcttaataaatttgactcattgtttagtcttcaattatataattaattttataattagcctatatttaatattcgtaatagtcattcaaccgaatgtaacatggactaaactttaatctctacaacgaaacaccgaggactagccacaattatactaccttaaatctgcaaggaaattaataaatgaagaataagtaaacatacgagcactacatagactgtctaagaaatgaaatagagatggaatggatcggattcgaaataagattttacaaatatccgc

SEQ ID NO: 17381 - DNA, 1003 bp, Zea mays
gaaacacatcatcactttaagatgggccggctcaggtagtgggcatcaaccgattttcctacactagtagacagatttctcagaagccgcggccgtcacgcgtcagacccacgcagcgcaccttctcttctccgccgcgtcgccgccgaacatcagcatcggatcgatggagggctgggacaaggggaccaagagcacggtgggcgagatcccgctgctgtcgacgcgcgcgggtccgcgggacggcgaggcgtggcggcagcggctcaaggaggagtaccgcgcgctcatcgcctacacctcggtgaacaaggccaaggacaacgactggttccgcatcgccgccgccaacccggagggaacccgctgggaggggacctgctggtacgtccacaacctccgccgctatgagttccctctccagttcgacatccccgtcgcctacccccaggtcgcccccgagatcgagctccccaccctcgacggcaagactcacaagatgtaccgcggtgggaagatctgcctcaccgtgcacttcaagccgctgtgggccaagaactgcccgaggttcggcctcgcgcacgcgctatgcctcggcctcgcgccgtggctcgcggcggaagtcccgattctggtcgactcgggcatggtgaagcacaaggatgacgaggcggctccggctgaggcatctgcctctgctgctcctccttcgtagttgccacttgcaacaactgagtgtccggtgagctaagggcgatatcggaaatcaactcggcggtgaaccgtgaaccgccaaataagagagatacctgcaaatctaaacatcatgtgaaacatgttccatacctgctgattgctgtctgcgtactaatttctatccaacttctaaattgtgttcgcagatttttatggtacacttgattaataccataaggtaacataattgcttaataaaaaaaaaaaaaaaactcgagcccggattttctgaaaaaaaaaaaaaaaa

SEQ ID NO: 17382 - DNA, 2341 bp, Zea mays
  misc_feature (2140)..(2140): n is a, c, g, or t
  misc_feature (2194)..(2194): n is a, c, g, or t
  misc_feature (2196)..(2196): n is a, c, g, or t
  misc_feature (2259)..(2259): n is a, c, g, or t
  misc_feature (2282)..(2282): n is a, c, g, or t
  misc_feature (2293)..(2293): n is a, c, g, or t
cattgggtacctcgaggccggccgggatcaccacctggaccatctgctcgctgcccccgacctcgagtgagtcgtccgtcgctttccttgtggctcggtcgccgccgcttccatccaataggccgccccgcctgccttgctctcccagcgcgctcgtgtagtcgtcgccatcttcgcttctcttctccacatttctgcgctatcccggcgtacggctgcgatccatacacgcccaatccaaaccctacctaaaactccgcctcgtgcctccgggctcacactcgtaggcacggagtgccgttccgtggtgggtggaatcaccaaaaatgccctccgtccaccaccacctcctcctcctgacgctcgccgccttggccgtggcggcagccaccgctagcgccggcggggacccgccggcaatcgaggcgcagttcgacgcctggtgcgcggagcacgggaaggcctacgccacgcccgaggagcgcgccgcgcggctggccgtgttcgcggacaacgccgccttcgtcgccgcgcacaacgcccgtgcaggcgccaacgccgctggcggcggcggcggcggcgccgcgcccccgtcctacacgctcgcgctcaacgccttcgcggacctcacgcacgaggagttccgcgccgcgcgcctcggccgcatcgcgccgggggcggcgctccggagccgcgccgcgcccgtgtactggggcctcggcggcggtgccgcggtgcctgatgcgctggactggaggaagagcggggccgtcaccaaggtcaaggaccaaggcagctgcggagcttgttggagtttttccgcaacaggtgctatggaaggaataaacaaaataaagacaggctctctggtcagtctttctgaacaggaactaattgactgtgacagatcttataatagtggctgtggtggtggcctcatggattatgcttataagtttgtgataaaaaatggtggaattgacacagaggaggactacccctatcgtgaagcagatgggacatgtaacaagaacaagctgaaaaagcgagttgtgactattgatggttacactgatgtaccttccaacaaagaagatttgttacttcaggctgttgcccagcaacctgttagtgtaggaatatgtggtagcgctagagcatttcagttatactaccagggtatctttgatggtccatgtccgacatctcttgatcatgctgtgttaatcgttggctatggttctgaaggtggcaaggattactggattgtgaaaaactcttggggtgaaagttggggaatgaagggctatatgcatatgcatcgaaacactggtgattccaagggtgtctgcggtataaacatgatggcatcatttcctaccaaaacaagcccgaatcctcctccttcaccaggcccaggtcctaccaaatgcagtctgctcacatactgtcctgagggatccacctgttgttgctcatggcgtgtcttgggcttttgcctttcctggagctgttgcgaactggacaatgcagtttgctgcaaggataaccggtactgctgccctcatgactatcctgtttgtgatacaggtcgcgggcagtgtctcaaggccagcggcaacttctctgctatagaaggaatcaggaggaaacagtctttctctaaagctccctcgtggactggctggctggagttgatggaccaatgagcgtataatcagacatggatagtagcttcatgcaagttgtgcgatccgtaggtcggtcattggccttgttccagtgccctgccacattcctgtacgcctactgcccgctgcgttgcaccgagatgcccttattttctctttattattgaaccctatggtgtaaagtttcacgattgtacatgtatgtcacacttgtattggcctatgcattagacgtctccattagtttacctatatgatcatctaaaatattgttttgcagtttttatactgtagagtgaagtttgaatataaaaatgaggatggtgctggatatagccttataggcgcgccctgcagattatttgccgcggttgagcttttgagggccaggccgcatatatattaatagaggactttgtgtaatgtttcatggctatagcggccagaangatgcatctagcgcaggtcaatgtggtagtatcatacgctgttttggtacgacnancaactaggaattcgttttcgtgttacacgttaaacatacttatattgttatcataaacaggcnaattaaggcgttaggcatagggngggcctaaacnttttgggttttttacaatgaaaaatttaattttaatgaacttgggaaa

SEQ ID NO: 17383 - DNA, 1035 bp, Zea mays
  misc_feature (909)..(909): n is a, c, g, or t
  misc_feature (916)..(916): n is a, c, g, or t
  misc_feature (920)..(920): n is a, c, g, or t
  misc_feature (963)..(963): n is a, c, g, or t
  misc_feature (968)..(968): n is a, c, g, or t
  misc_feature (987)..(987): n is a, c, g, or t
  misc_feature (1004)..(1004): n is a, c, g, or t
  misc_feature (1025)..(1025): n is a, c, g, or t
aactctttactccgtatgtcggatttgtgatattcttgggatacagatacgaatatagcatcggatattgaacgtcctcgattgcgcgagcagactgcagacctagcaggctagcaaccattctagctccgaattcggagcaggcgagggcgaactgaccgaggcgaggacgatcactgtccatgtccatggaggcggcggttggggcggagttcggacctcatctgcatcccgctctcgggttcagacacagccagcgccgtgtctttttttgctgttggcgcctgcatccgccccggccggcctcgcttggcctctgcggtggcgggggagcccgtccccgcggcgctatccccgtcgcggatggcgaccagcggcggcggctgcgagagctcgaggcggaggcggaggcggaggcggaagctggatcgatcttgggtcctccgaggagcagcccccgcgaggtgagggaggagatggcccggtgcttcgacctcgtccgccgcctcggtaggggcgccgtctacctcggctcctccagggtcccgcccacgcacccgcacttcctccaaaccaccgagctcgccagagagatagctcggctgctcgactgcaccacatggacgggagccggccctgggctcatggatgctgccatccaaggcgcctttgaggcagacaagcctgtcggtggcttgaggattgcaaaggaagcgggtgaatggacaagctcaggcttccatccttacctgccaccggagtcctacctcacatgcaggtcctctctgcgaagaaacatgctggttggatctgcgtgccgaacactcttctgacaaaaccttttgtttcctgcagaaggtttggaaccttgaacaatttttgaatcttggccttaatcccttaaaagancggtttnggtncccgtcccggtttggttcccacttacaatcctttttatcccanttttngaatttcttaataaatccngaattgggccggttttnccggcaaatttccccctttgnaagtttttaa

SEQ ID NO: 17384 - DNA, 1611 bp, Zea mays
ctcagtaactatagtttttttgttccttgggaggatagaaaaaatatatccttggttttcttgaacagataacatttcaggtgtgcttctgaagggagatttcgttgaacaggatgaatgcattggcagcaaccagcaggaacttcaagcaggcagctaagctgctgggcctcgactccaagctggagaagagcttgctcattccattcagggagatcaaggttgaatgcacaatcccaaaagatgatggaactttggcatcctatgttggatttagggttcaacatgataatgctaggggacctatgaagggtggaatcagataccaccatgaggttgatcctgatgaagttaatgccttggcacaattgatgacttggaaaacagcagtagctaacataccatatggaggagccaaaggtggaattggatgtagccctggagacctgagcatctctgagcttgagaggcttacccgagtttttactcagaaaatccatgacttgattggcatccatactgacgttccagctccagatatgggcaccaactcacagacaatggcatggatacttgacgaatactcaaagttccatggttactcacctgctgttgtgacaggaaagcctgtggacctcggaggatcattgggaagagacgccgctactggaaggggagttctgtttgctactgaagctttgcttgcagagcatggcaaaggcattgcaggccagcgtttcgtcatacagggattcggtaacgttggttcctgggcagctcagctgataagtgaagccggtggcaaggtgattgctatcagtgacgtcacaggcgccgtcaaaaacgtcgatggcctcgacatcgcgcagctagtgaagcactcggcggagaacaaggggatcaagggcttcaaggggggagacgccatcgctccagactcgttgctcactgaagagtgcgacgtcctcatcccagcagcgcttgggggagtcataaacaaggataatgctaacgacataaaggcaaagtacatcatcgaggctgccaatcaccccacagatccagaggcagacgagatcctgtcaaagaaaggcgtcctcatcctccccgacatactggccaactctggtggcgtcacagtgagctacttcgagtgggtacaaaacatccaggggttcatgtgggacgaggagaaggtgaacgcggaactgcggacgtacatgacgcgcgccttcggggacgtgaagcagatgtgccggagccacagctgcgacctccgcatgggcgccttcacgctgggcgtcaaccgcgtcgcgcgcgccaccgtcctcaggggatgggaagcatgacctccccctccgtgtcgtccgtgtgcccctccctgttgtatcctcttggtcttggtcttgggcccttgtttttctttggttaattattatcgatcaacggagatccgagaaaaaacgggctcagttaataattccaagaagtgcgtcttcttggagataaatagcggaaggagagttataataagtctgtaactgtaacccatagctgagatgctgtctgcaagcagcaatgccaatgccaatgccatctggttttcgtgcc

SEQ ID NO: 17385 - DNA, 2075 bp, Zea mays
ttgggtacctcgaggccggccggggagatacacgcacgcaccgaacccggcccgacccaaccccaaagcagttggaattggaatcccaggcggatccaattctgccaattgcaagcaccgtcggccctggcgtcatcgcccaattacctctccctctcctccccacgccggccggagaaaccccccacccagcaccagttcccaactcctccccccacacactctatcctcctcgccgcctggggcacagtcacagagtatttcccccccattctccatgcatcgcacgagtgtctcctataaaaccccgcgcaacccccccgctccgacggcacgcacggacgacgcaccgcacactacccggcggtggaactcctcgcccgcgtcgctgctccggtctccgcgctgctagccgccgactgtaataactataacatttcaggtgtgcttctgaagggagatttcgttgaacaggatgaatgcattggcagcaaccagcaggaacttcaagcaggcagctaagctgctgggcctcgactccaagctggagaagagcttgctcattccattcagggagatcaaggttgaatgcacaatcccaaaagatgatggaactttggcatcctatgttggatttagggttcaacatgataatgctaggggacctatgaagggtggaatcagataccaccatgaggttgatcctgatgaagttaatgccttggcacaattgatgacttggaaaacagcagtagctaacataccatatggaggagccaaaggtggtattggatgtagccctggagacctgagcatctctgagcttgagaggcttacccgagtttttactcagaaaatccatgacttgattggcatccatactgacgttccagctccagatatgggcaccaactcacagacaatggcatggatacttgacgaatactcaaagttccatggttactcacctgctgttgtgacaggaaagcctgtggacctcggaggatcattgggaagagacgccgctactggaaggggagttctgtttgctactgaagctttgcttgcagagcatggcaaaggcattgcaggccagcgtttcgtcatacagggattcggtaacgttggttcctgggcagctcagctgataagtgaagccggtggcaaggtgattgctatcagtgacgtcacaggcgccgtcaaaaacgtcgatggcctcgacatcgcgcagctagtgaagcactcggcggagaacaaggggatcaagggcttcaaggggggagacgccatcgctccagactcgttgctcactgaagagtgcgacgtcctcatcccagcagcgcttgggggagtcataaacaaggataatgctaacgacataaaggcaaagtacatcatcgaggctgccaatcaccccacagatccagaggcagacgagatcctgtcaaagaaaggcgtcctcatcctccccgacatactggccaactctggtggcgtcacagtgagctacttcgagtgggtacaaaacatccaggggttcatgtgggacgaagagaaggtaaacgcggagctgcggacgtacatgacgcgcgccttcggggacgtgaagcagatgtgccggagccacagctgcgacctccgcatgggcgccttcacgcttggcgtcaaccgcgtcgcgcgcgccaccgtcctcaggggatgggaagcatgacctccctccgtgtcgtccgtgtgcccctccctgttgtatcctcttggtcttgggcccttgtttttctttggttaattattgtcgagatcaacggagatccgagaaaaacgggctcagttaataattccaagaagtgcgtcttcttggagataaaatagcggaaggagagttataataagtctgtaactgtaacccatagctgagatgctgtctgcaagcagcaatgccaatgccaatgccatctggttttcgtgcacgactttgggtcattttcgaatcctgatcactcaacgacagggtcggtagagatgaagctgtagacagccacgtccctgagcctcccactcaccacgcggtagctccg

SEQ ID NO: 17386 - DNA, 1711 bp, Zea mays
ggggcccccacggcggggccggcctccagagcttgggcagactctcctcagtaactatagtttttttgttccttgggaggatagaaaaaatatatccttggttttcttgaacagataacatttcaggtgtgcttctgaagagagatttcgttgaacaggatgaatgcattggcagcaaccagcaggaacttcaagcaggcagctaagctgctgggcctcgactccaagctggagaagagcttgctcattccattcagggagatcaaggttgaatgcacaatcccaaaagatgatggaactttggcatcctatgttggatttagggttcaacatgataatgctaggggacctatgaagggtggaatcagataccaccatgaggttgatcctgatgaagttaatgccttggcacaattgatgacttggaaaacagcagtagctaacataccatatggaggagccaaaggtggtattggatgtagccctggagacctgagcatctctgagcttgagaggcttacccgagtttttactcagaaaatccatgacttgattggcatccatactgacgttccagctccagatatgggcaccaactcacagacaatggcatggatacttgacgaatactcaaagttccatggttactcacctgctgttgtgacaggaaagcctgtggacctcggaggatcattgggaagagacgccgctactggaaggggagttctgtttgctactgaagctttgcttgcagagcatggcaaaggcattgcaggccagcgtttcgtcatacagggattcggtaacgttggttcctgggcagctcagctgataagtgaagccggtggcaaggtgattgctatcagtgacgtcacaggcgccgtcaaaaacgtcgatggcctcgacatcgcgcagctagtgaagcactcggcggagaacaaggggatcaagggcttcaaggggggagacgccatcgctccagactcgttgctcactgaagagtgcgacgtcctcatcccagcagcgcttgggggagtcataaacaaggataatgctaacgacataaaggcaaagtacatcatcgaggctgccaatcaccccacagatccagaggcagacgagatcctgtcaaagaaaggcgtcctcatcctccccgacatactggccaactctggtggcgtcacagtgagctacttcgagtgggtacaaaacatccaggggttcatgtgggacgaagagaaggtaaacgcggagctgcggacgtacatgacgcgcgccttcggggacgtgaagcagatgtgccggagccacagctgcgacctccgcatgggcgccttcacgcttggcgtcaaccgcgtcgcgcgcgccaccgtcctcaggggatgggaagcatgacctccctccgtgtcgtccgtgtgcccctccctgttgtatcctcttggtcttgggcccttgtttttctttggttaattattgtcgagatcaacggagatccgagaaaaacgggctcagttaataattccaagaagtgcgtcttcttggagataaaatagcggaaggagagttataataagtctgtaactgtaacccatagctgagatgctgtctgcaagcagcaatgccaatgccaatgccatctggttttcgtgctaaaaaaaaaaaaaaaaaagctcctcgataccgccgtcctcccgtaggaggttaatgcgcg

SEQ ID NO: 17387 - DNA, 1441 bp, Zea mays
tgggggtaccctccgggctcggccgggaggtgacactatagaagggccggccgggaggccggcaccccgatccgattacctcctaccgtccgacccggctccctcggtccctccctcggtccctcccggtctcgcagttcctccccgtcgtcttccaccgcaaatcgccgaagcaagcaggcgagctcgggaccagatccactgcgggcagctggagcggaagggccatggggacgccgccgcctttccaggagtccggccactgcgacgtctgccgctgcaccttcaacaccttccgccgccgtcatcactgccgcagctgcggacggacgctctgtcacgagcattcttcgtactacatggctctcccgcagtatgggatatatacagacgtcagagtctgctacggttgcttcaacaaatcctccagccaaggacacgctgataatccggtgtcagctggtagcatttctggagcagctgactctttttcagggctgagtttgggtaaggaggatgattcgtcgcctatgaagaattcaacggttcagagcacggcagcccttattgagtgcaaatgtgggatgcctttgtgtatatgtgaagcaccaaaaccagaaccttctcctacacctgtaaagaatatcaacaccgttcccccaaccacacagtcaaatccaaggccaaagaagcctgctaacactcaacagaaggcttcagctacttccagtagcaactcaagcccattcttaaatattggattaatgaacaacgatagcaatgataagggcattgttgactatgaagttagtggggagggactgagagaagcaattaaaggcggggatgttaagggtgtaaagaaacttcttacacagggagtggattctaactactgcgacaaacaaggatttactttgctgcatttggctgctttgtttaaccaaactgaaattgctcttattctcatggaccatggggcaaatgttgaaagcaaaaatgggcaaggggaaactcctttggactgtgctccggcaatgctgcaatacaaaatgcgccaacgggtggaagaactcgcggcttcggcttcgaagggaccactagggtgaactgtgctcgtgctagtttctgctgagttcctcctattccagtttgtgtcaaatgtggtgtcaagaataaaatagttaagtcagctgaaagcttcttgctggtgggacagtgtttggtccgccagtgtataccatctagaaacgttgaatgccagtcacggctcacgcgtgtgaaataatatatattcagcttcatcctacattcctactcatgtactctgtagccggtgaatacttccaaacatttaccacgtacaatatgtttttcttttactgaaaaaaaaaaaaaaaaccgccaccgcggtggaaaaaaatataaaaccacgcgtccg

SEQ ID NO: 17388 - DNA, 1038 bp, Zea mays
gccggccgggctccggagttcgtatcacacccaacctcccactgtaaaaaagagcagcggaacgtgcgtgcatccatccatccatccatttccaatcccaatcccaatcccaccagtgtccagtgctcggggaaccgacacagctcctcagcagagtagccagcacgacaagcccgatcagcagacagcaggcatggcactcgcggaggccgacgacggcgcggtggtcttcggcgaggagcaggaggcgctggtgctcaagtcgtgggccgtcatgaagaaggacgccgccaacctgggcctccgcttctttctcaaggtcttcgagatcgcgccgtcggcgaagcagatgttctcgttcctgcgcgactccgacgtgccgctggagaagaaccccaagctcaagacgcacgccatgtccgtcttcgtcatgacctgcgaggcggcggcgcagcttcgcaaggccgggaaggtcaccgtgagggagaccacgctcaagaggctgggcgccacgcacttgaggtacggcgtcgcagatggacacttcgaggtgacggggttcgcgctgcttgagacgatcaaggaggcgctccccgctgacatgtggagcctcgagatgaagaaagcctgggccgaggcctacagccagctggtggcggccatcaagcgggagatgaagcccgatgcctagtagtggcgattgcgaccagtgtttaacccatgacgcagcgccgtcacagatgtcccgtgtggtcttgcgctttagcaatttctctctggagggagcgtgtattgttatcttgtgatcgagagcctgtgtgctgcctttgcttcttgtgattatatagctactgaataaagatgtagcgttcttcagcctgaaaaaaaaaaaaaaaaaaaaaacaaggttcgttactaactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 17389 - DNA, 1283 bp, Zea mays
gggtacccccgcgccggcccggccgggatcagttcgtatcacacccaacctcccactgtaaaaaagagcagcggaacgtgcgtgcatccatccaattccaatcccagtcccaatcccaccagtgtccagtgctcggggaaccgacacagctcctcagcagagaagccagcccgatcagcagacagcaggcatggcgctcgcggaggccgacgacggcgcggtggtcttcggcgaggagcaggaggcgctggtgctcaagtcgtgggccgtcatgaagaaggacgccgccaacctgggcctccgcttcttcctcaaggtcttcgagatcgcgccgtcggcgaagcagatgttctcgttcctgcgcgactccgacgtgccgctagagaagaaccccaagctcaagacgcacgccatgtccgtcttcgtcatgacctgcgaggcggcggcgcagctccgcaaggccgggaaggtcaccgtgagggagaccacgctcaagaggctgggcgccacgcacttgaggtacggcgtcgcagatggacacttcgaggtgacggggttcgcgctgcttgagacgatcaaggaggcgctccccgctgacatgtggagcctcgagatgaagaaagcctgggccgaggcctacagccagctggtggcggccatcaagcgggagatgaagcccgatgcctagtagtggcgattgcgaccagtgtttaacccatgacgcagcgccgtcacagatgtcccgtgtggtcttgcgctttagcaatttctctctggagggagcgtgtattgttatcttgtgatcgagagcctgtgtgctgcctttgcttcttgtgattatatagctactgaataaagatgtagcgttcttcagcctgttacatcgaattcaaaaagattctatttcgttactagaaaaaaaaaaaaaaaaaaaaaatgcacacttttcgagcttttatgaaagggaaaacaaaataatgaaaggttatgtagcgatattctcaaaagttggaagtaattatgtaaatatatatcctatagtatttcgatatccttcggtgagcaatgactgagcaataactagtgaccaatatatctgtagctagttgggccgacaatcctaaactaaagagtacgcttgctattcgcacgcataggtggacctcacataggaaggcccacgtacagcccaaccgagagaacaggtatcctaccagcggttgcaaaagggggaaaaatttttctgggcagaggtaaacctgacttttatggtatatagtcag

SEQ ID NO: 17390 - DNA, 972 bp, Zea mays
ctgtgcggcgctcgagccggccggtcctgcgatcacacccaacctcccactgtaaaaaagagcggaacgtgcgtgcatccatccaattccaatcccaatcccaccagtgtccagtgctcggggaaccgacacagctcctcagcagagaagccagcacgacaagcccgatcagcagacagcaggcatggcgctcgcggaggccgacgacggcgcggtggtcttcggcgaggagcaggaggcgctggtgctcaagtcgtgggccgtcatgaagaaggacgccgccaacctgggcctccgcttcttcctcaaggtcttcgagatcgcgccgtcggcgaagcagatgttctcgttcctgcgcgactccgacgtgccgctggagaagaaccccaagctcaagacgcacgccatgtccgtcttcgtcatgacctgcgaggcggcggcgcagcttcgcaaggccgggaaggtcaccgtgagggagaccacgctcaagaggctgggcgccacgcacttgaggtacggcgtcgcagatggacacttcgaggtgacggggttcgcgctgcttgagacgatcaaggaggcgctccccgctgacatgtggagcctcgagatgaagaaagcctgggccgaggcctacagccagctggtggcggccatcaagcgggagatgaagcccgatgcctagtagtggcgattgcgaccagtgtttaacccatgacgcagcgccgtcacagatgtcccgtgtggtcttgcgctttagcaatttctctctggagggagcgtgtattgttatcttgtgatcgagagcctgtgtgctgcctttgcttcttgtgattatatagctactgaataaagatgtagcgttcttcagcctgctacatcgaattcaaaaagattctatttcgttactaaaaaaaaaaaaaaaaaaaaaaaaaaaaaaaaaaagaaaaaaataaaaaaaaaaaaaaaaaaaaa

SEQ ID NO: 17391 - DNA, 609 bp, Zea mays
ttccacctaccagtccaccagcgagacagtctccatcacctacggcaccggcagcatgacaggcatcctcggatacgacactgtccaggttggaggcatctctgacaccaatcagatcttcggcctgatcgagacggaacctggctccttcctgtattatgctcccttctatggcatcctggggctgggctatacccccagcatttcctcctccggggccacacccgtctttgacaacatctggaaccagggcctggtttctcaggacctcttctctgtctacctcagcgccgatgaccagagtggcagcgtggtgatctttggtggcattgactcttcttactacactggaagtctgaactgggtgcctgttaccgtcgagggttactggcagatcaccgtggacagcatcaccatgaacggagaggccatcgcctgcgctgagggctgccaggccattgttgacaccggcacctctctgctgaccggcccaaccagccccattgccaacatccagagcgacatcggagccagcgagaactcagatggcgacatggtggtcagctgctcagccatcagcagcctgcccgacatcgtctttcacatcaa

SEQ ID NO: 17392 - DNA, 749 bp, Zea mays
cctattcggcaccaggaacaatcatccatacaagacgtaaaaccagatccagaagaaacagacagcaaggatgtagtcttaccaggagtaaatcttatatttgatggagccgaattacacccctttgatattgctgcatgccttcaagcacgtcagcctctgtggcttatatctgaggcatcaactgcttcatcaacattactatgaggggttaattatgctccaatttctacaagttggccgatgaaatttcattagttggggttattcaaaagtattgtctgattcttagaagaacacaatagcgggctgatgctttgttcactataactgagttctttcacaggaattaatcagatgctcctggttaactgggatgcgctttttgaagcttgtttactgcatcgtatgtttcttggccaatatcttactctacttttcacttgtgtgaaatttccaagtgcgtgctcctacttcaatattgtgaatctttgaggctcgttcagttgagagctaaggctcgttcagggtgtcaattttacgtttacacatgtagtagtttcaatgtagttttggcataaatagcacagctttcttgtttgcggtgatcccgttcccgtggttgtataaaagtgttttcgttctttcttcaaaaggtgaaattcaagtttacatttatattaccttgaagaagcatgtacatacacttcagtacctgtaatggtagtattgcaatgatgcagatatac

SEQ ID NO: 17393 - DNA, 1837 bp, Zea mays
gagaaagaaaaggcaggcacgttattataataattattctatcaagtgtgtgtgcttttattttatgtgctggagctgcactagtgctttatttcaagcttcgaaaccacatccatttaactgaagcgtcacttgtgccaacaaaacctacaggtcctgtttctgcaatggttgggaacaggctagaaagcagacctatttcggcatcaccatccttcagctcaagtttggtggcatataaaggatctgccaaaacatttaacctggttgagatggagagagctacactaggatttgatgagtccagaattattggtgagggtggttttgggcgtgtctatgaaggtattcttgaggatggagaacgggttgctatcaaggttttaaagcgggacgatcaacaaggtacccgggagtttttggctgaggtcgagatgcttagccgattgcatcataggaacttggttaagctgataggtatatgcacagaggggcatagccgatgtttggtttatgagcttgttccgaatggcagtgtggaatctcacttgcatggatcagataagggagctgctcagtttgattggaacgctaggctcaaaattgcacttggtgcagcacgcgcacttgcatatttgcatgaggattcaagtccacgtgtcatacaccgtgatttcaagtccagtaacatcttattggaacatgacttcaccccaaaggtgtcagactttggcttagcaaggacagctttgggtgagggaaacgagcatatttcaactcgtgtcatgggaacttttgggtatcttgctcctgaatatgcaatgactggccatcttctagtaaagagtgatgtttacagctacggtgttgttcttcttgagcttcttacagggaggaaaccggtagatatgttaagacctcctggacaggaaaacttagtggcatgggctggttctcttctgacaagcagggatggtctggaatcaatcatagatcattcacttgggcgcagcattccatttgacagcatcgcaaaagtagcagccattgcttctatgtgtgttcagcctgaggtggaccagcgcccattcatgggtgaagtagttcaagctctaaagctggtatgcaatgaaggcggcgagttcaatgagtcaacctttagccaagatttgcatatccaagatgtcgaggttatgagtagagcaagtacggatgtagacgttgacccaacgctatctgctgagctgttcacttcatcagcgcgttatgatgctatagatgcccctggttctttccgaagatactcaagttcaggtcctctaagagtagggagaactggactgaacaaagagaggggcctgtcaacaggcagctcaagtgaacacgttgggctacagaggtttaggattgatggagaatagtcagcctgcaagcagctcatgatgatgtgcgcatggaagaaatacacattggattattttcttccaagccagatttcatactcatcgtgaatagtatgtggaaaattgagaaaggcgtaaaaatcagtgtgccactgttcggtgctcccgtcgccttctttggaaagctcaaacaagacttcacacgaatttttgtacagttctagagatgatagatgcttttaggaaagaaggggtgtacacgagtttttcagctgtaattccccacgaaccgtattacgtttcgccgtagcatcagtgcaaatcaattaaagggcgtgcacgcagtcaccattttgagttcaatgaaaaaaaattcatcctgattgaccgcaacctttgtctggcccggcatagtctacaaatgcacggttcat

SEQ ID NO: 17394 - DNA, 863 bp, Zea mays
  misc_feature (803)..(803): n is a, c, g, or t
cattgggtacctcgaggccggccggggcgctgcgccggccgcgctgccacatctccggcccatcgcccgtgctctgcactgtctcgcctccgacctccgcgccctctcaaggtctcaccggagaccgcgctgcggtccgcgggctttgggtagcgcgggatggcctccgtggggtgggctgcacgcgacgcgtacgacgaggaggccgcagtccgccgccctctcgagctcgagggccgtggcgtcgccgcatcgtcctccgaccaccggcccggcgggaatgtcatgcctaggtatcaagtgggctcgacaaagggtgattcaagtagtagacgacactctgaggagtggcggcaacctagcacagatgatgtgcgcatgagcaagccggggtcgagatatttcacggcgtttggggtggatctgtcccctgataatatggcagttgccattgtatattttgtgcaaggggttttaggtcttgcacggcttgctgtgagcttttacttgaaagatgatcttcatctagatccagctgagactgcagtggtatctggtttctcgtccttgccgtggctgatcaagcccctctatggctttatcagtgattccattccactctttggatatcgaagaaggtcatatctttttctgtcagggttacttggagcactttcatggagcttaatggccacagtagtgagcagtaaatacagcgcagcattctctattcttcttggctcactttctgttgccttctcagatgttgtagtggattctatggttgctgagagagcccgtgngagaatctcatagtacatctggatcactccagtcactctgttggggatcttctgcctttg

SEQ ID NO: 17395 - DNA, 1150 bp, Zea mays
aggagacaaacgagttcgttcaatagcatattacacttgcatgctggtaaaatcattgaacattctgtttgacacctattttttgaaggatctaagcaatctcatgcacctgctgttgctcgcaaggttcttctatccataacgaattggcacccacacaattacttggatgatgtacttcatccatcacaagtacaagatcaaaggctcgaacgtttaggtctgtaaccacaaaactgaatacttaatgtcttgcagtgttcacttttattatatattgtgatgggtgtttctgaggtagacacaattgtctatattgtttctttgttaggattaaccgcaaaaaacacacctgcatgaactgctatttgttgtacatgttaatagatggtaggatactaggatcaatatgcaacccatcaatcaaccagacaaccatggagtaaaacatggatgacttttcctcttttttatctgcctggaatggctacacgcttctaatacgttacgcttctagtaagttgtcttccacagatgaacctgtttcaccacctacacaatcagtactgactgcagtggaacctggtgctcttgaccatttttatcaacaatcaaagagaaaaaaaagtcccaatctatgcagagcccagagctgattgtcgaggagtttattgagctctgtctgcatcttaacctttagaatcagtttggtatgagtatgatggtttcttatttttactttattcacaggccaagatgccccatcatttcatactggcaatgaacttccaaatcctcatctccgtcaagtacctgctgctttgccatctcttccagttcaaccatatgcgcctcatcctaaaatttctgctgacaatccaaccgctgcaccttcttttcaaaagataccctggtgtaagtactataccggtatgagtttttaatataatgccccggggctgtcttacccctggtctgagtttttttaacagagacaagcttcctgttagtccaccttctatacatcatgctattccgcccccacccaccgtgacagagttatagttcacattcaaatagtactggactcaactaggtcatgctgtgactgtgattttatcatctgcatttacacattccgaccaagggc

SEQ ID NO: 17396 - DNA, 3170 bp, Zea mays
gttccgaacttcactgctgctgatgcactaaggctcactggtgttgggagaaacgagtttattgatattatgaacaaatgcagatcaaagaaactaatgtggaaactgaataaatcgattgcaaaagaaatgctgcctacacagcctgttgacttcccagttgagccttggtggggggtttgtcttgttaactttacactggaagagttcaagaaactttcagaagaagagacaacaacaatagacaaaatatgtaaagaggaagccaattcatatgttctttttgatccgaaggttatagatggactttataaaagagggctagtgtacttcgatgtgcctgtttacccagatgaccgcttcaaagtttctaggcttgaaaattttgtttccaataaggatcaatcatatgaagacccaattgaagagctgttgtatgctgtatttgttgtttcaagtgctaatgctactgttgctgaactggctgcaactttacaagctgacctttatcaactccaggcagctgcatcatttgcttgccgattgggctgggctgcgaaagtcatggatgcgaactctgttcttaatgaagaacgtttacctgcgtttcctagtagtattcttagtgatgatgaagaaggttcaaatacaagtatccactcagagaagtctggtcaacaattgaatggcatggattctgatggacccaggaaaatttctggaactgctcccgtgggactttgttgctgatgccaatgttacatcatacttgatgatgggctcactatcgccaggggtaaaatctcatgctgtcacactctatgaggctggaaaactgggtgcttcttgcattgcagaactttgtcctgatctggctagcttacgagggaaagaaatttgagggtgtgctagaggagttcgcaagtcatgcattcactttgcgatgcttcttggagtgtttacaggctggcggagtttccgcaaatgaaattactgataatactagtgaagcaaagactccaagaagctctgttcatgatattgacaatgctgctgaccatttgtccaaggtgaacattgagggtgttgctgacaataaccataatgaattttccgagcataaccagtgcgtacgtgagttagataatagggatgggaatatactatcaccagctatggttatcttggaaagtgtagaaagcatggtaaaaaatgatgacaagaatgattcaactgtgcagctaaatgtttcaactgaatctcgagttttgaagaacaaaaggaagtacaaagttgatattcttcgatgtgagagcttagcctcacttgccccggctacattagaacggctattccttcgggactatgacattattgtgtcgatggttcctcttccttcttcatcagttcttccaggcccttcaggcccaattcattttggaccaccatcttattcctccatgacaccttggatgaagctagtactgtatacagcaggacattgtggaccagtatctgctgtgttcatgaaagggctacgttttagattgctgcctgaaccattagctggttgtgagaaggcactgctatggtcttgggatggctctgtggtgggtggattagggggaaagtttgaagggaacttactgaagggcaacttattgttacactgcttgaattcgatgctgaaacaatctgctgtactggtgcaaccacttagtatacatgatcttgatacgtcaggaaaccttgtcactgtggatatccctttacccctaaaaaatgatgaccagtcaattgaatctgtggtagcccaaactaatttgccaaaggaacagatattagatttgacttctgtattgaaagacctatctagtaaatttgagctgagcacacttggctacctccgtctactaagacttcacaggatagatgaaccagataaatttgacccagaaaatgtaagctacaagtgggtgcctctgagcttggagttcggggttcctttattcagtccaaagttgtgcgagaagatttgtgaaagggtggttgcatcccatatgcttcagaaagatgatctcattgagcattctgatgtgatgcaaaatgtaagaaggcagctgagagaactttgcagtgaatatcaagcaaccggtccagtagctaagttatttaacaagcgtggaagctcaagggactcaccacgtgccttaatcaatagtattagtggcagatggaatttgtctaatgacccttcaacacctagtggaggagccccaagtgaacacgagaggctgaaatttgttggaaggcagcgaccccgaacagaagttgtgagctttgatgggagcactgtcaggtcatatgcacttgatcctgagcacaatgaagaacaatcatccatacaagacgtaaaaccagatccagaagaaacagacagcaaggatgtagtcttaccaggagtaaatcttatatttgatggagccgaattacacccctttgatattgctgcatgccttcaagcacgtcagcctctgtggcttatatctgaggcatcaactgcttcatcaacattactatgaggggttaattatgctccaatttctacaagttggccgatgaaatttcattagttggggttattcaaaagtattgtctgattcttagaagaacacaatagcgggctgatgctttgttcactataactgagttctttcacaggaattaatcagatgctcctggttaactgggatgcgcgttttgaagcttgtttactgcatcgtatgtttcttggccaatatcttactctacttttcacttgtgtgaaatttccaagtgcgtgctcctacttcaatattgtgaatctttgaggctcgttcagttgagaggctacaggctcgttcagggtgtcaattttacgtttacacatgtaggtctagtttggatactttgggattagagtgttttggagggattggagagggtgtaaatccctaatagatcaaatactctctcaatacatctcaatccattccaatcccactcattactagagtacctaaactaagccgtagtagtttcaatgtagttttggcataaatagcacagctttcttgtttgcggtgaccccgttcccgtggttagtataaaagtgttttcgttctttcttc

SEQ ID NO: 17397 - DNA, 3972 bp, Zea mays
  misc_feature (3246)..(3246): n is a, c, g, or t
gagactaaaaactaaagactaatctttagtccctctaactaaacaccccctaaattgcatgttcttttgttgggagtgctttcctaatttaccatgaataaattttatattggcaacacgaggtttacatctatatttacaatcgaaacctgttttgagggtgcaaataaccacgaacgagcaagcctgaaggtgtattcagcactcagttatgataaaaaaataatgcaacacaagctttacaactgaaataaatggttaaaaaagagctcacataattcaattgtaaccagatcacagcatgcggtcgctgaagaagcgccacaagtatggcatgcaggatagctcaatcctacaaccaagatttgctgcactatgatacaattctcagtcctcccaactcccatccaaacgcagaatctcctaaaagggctaaaccaggctttaggatacgaaccatttacagttccagcacctactttaagggagtgtttggcttctaagtactaatttttagttccttcattttatttcattttagtctctaaattactgaatactaaattaccaaatacagaaactaaaatcctattttagtttccgtatttgtcaatttagagtctaaaatagaataaaatagagaaactaaaaattagtccataaaaatcaaacaccctctaaatctgttccaccctctaaatctgttccaatccgcagagaggcgccaaaaaaggctcccatggggattcagcattcaacactggtctatctgatggcgatgtttttgttgtgtggccgtgtgcctgttgtatgccaaaaccattcccctcaatcgccaagggttttagaacctttaaaacctcacacagctatatggttatcaatatcgaaactccgaaggtctgacgggctggctcctaatctgtaaatcaagttgcacaaaacaagttatagaccatataggaaactagagtagtattcgtaaacttgaacatgctgcaagattgtcatataggtgagtgctgcaggcatgctgcagtgagacaaggaaactagagcaagattcataaacttactttgtaaaagcaatcagagttacgaacgacaacaatgatcagttactacaaaaagggacgatttaccttttgtttataatgcaatagtgatatttgatgtttccagacctcacatcttcagtatactgtgacaaatagtagacatgtttaaagcatttagtgtaaaacctatgaatggcgagaccaaatgtggagcaggcagggagatgttagggagggggaaataccatcctcaaggtgacaacgattgaagaaaatgctagagaatcgaatggtatatcatcgagagcaaaaagtgcacattccagcgactctgctccaggtgaaaaattgggggtcttcagtcttgctcggaaaataatgtaactctactgcatctcattgtaatacaaagataatcaacttagtagtggacaaaataacctataactttgtgactatgccaaattttcactcacttgaccaatcagtggaatatccaactgagcaaaaggtgagattatctctacatctgcacatgcttcttctaatgtttctctagaggctccttcagcagcagactcccccacctctaaataaccagcaggaagtgtcctgttaatgtaaccttggtcaaattggaggacagcagtacatgattgatatgctcaacaaatgaaaaggaagtttgttcatgtcacaaaaaaccaagaaaagttttgacagaaagaacatggaatttggcactgtaatgattgtcactgcattaaaagataatgtcactggatagggagtttgtggaaacagaagagagctatttctaacataaaaacaatgcaattctggacagtaaaggcaaagagttccggctaacaaatactgcaaatttgcatctgccgtacatagttaaaaatagttgcatgagattatgagaatatcaaaacatagtacagctatgccattaacaattatagtgctagaatcagaacaaaaaatcgtaaggaaaacatcaaagggaacttaccaaagaccataagccggttcaatctttcttctgcaaaggagaaccttattatcgtgctccacaaggcaaccaacaacctatccagatgatatatattataaatggcagaaaatagaagccaacatgtattacacacatataaccaaaaaaattattgctagttgtagtcccttgtttcaccaataggttaaacaaagaagaaatgggtcagttatgttcatcaaaagcacttcatacttgactgaaaaatacaggctctattaatcaagaatttcacagtgtcttaatttaaagtacaaatacaaatgcatttgaatccttttatttttattttatttgttcagcatgtaccatttttgggttttcgtagtgaactcctccacaagaagaacaaacagccctcatcttctcatcaccatcaggtatggccaatttcgttggacttccacaagcagggcaaaatttgatctttgacttttgcacctgcagaaataatggtttgctgagattgatccttaaaaaaaatcacaacaactaaatcattgtatgtctcaagaaataagcatttcagagtcatgacatttatgtggattaatactgatcacttagcagttagcactcagactaatacatatttcatcttcagtctagaaaagctgacacagaactttgccgcggtctggatgccacaactttagacagagcaggtgattgtattgtagcgcagagatcgctgcgattttgctagggagcacaccagccgttttgggctgcatgggaagccaatcccattaggcaattggcacggtcactggattgagtcaacgtcctagccgattcagcaagcacgcgtctaagatattacagatacgagcgtacgatcaaccgcctgaccgcagcgcagcacattagagtggcacaaggaacagcgccgaagggggacggggaactcaccacggcagcaggcggcgctggggcaggggagctggcgccggagccggagccggaatgggccgccatgcggataggccgggagcgcgcgagcgggagcaagtcgcggcggaggatcaggcgagtgcgcggggaggacaggcgagcggcgtggtggaggagcgggtgggatctgaggaaggggaggagcatggcggtggcctggtgggtgaggcntcggctttagtagcggaggcgcgggcggggttggtggctggcacggtagagtggggatcgagccgagcgagggcaagcaatggcgactcgggggcctccgtgggaaggggtgaggcctgaggtcggccgcctaacacgttccgccgcgggattggtcgacgccggcctgtttatgtggtacggttgggagaaagattagttgatatgtcgtgtcaggtttatctatgaacatgtatcatccatctactattattttactaaacaaaaaaatactattgtattctaatttataatttgtttgattttttacaccaatttaatcggtttgtcttattattttttaataataattattattactgtaatattgtttatcatataataatattattaacttgaacatgtaccatatatccactattaatattaatattaatattaattggtttgtcttattaaaatttctgaataagacaagcttgtcaaatttgatataaaaaagtaaaacaaattataaattagaacagaggataatattaattagcagtttggtttttctaaggacttgtttggattagagggtctgtgtcgaattttttcaagaaaaaatatctaatttctaagttttacttacattacctggtgtttgaaatggaggaaggggagtttttcggcaagaaagtggaggatggagaaaataaaacatgtagtttaaactgctggaaa

SEQ ID NO: 17398 - DNA, 1139 bp, Zea mays
gccggccgggtcgggagacagcgggggaaggaagagcggaaaagccattcgccacctcccgccccgcccgcggatccacaacccggacgccccacccgggtcctttcttcctccctcccagtcccactcccaacaccgaccgcccctcctcatcacacctcgcaactattttagtctaaccgagtccaaccagtggcaagcgagcgagaggtggtggacggaaccgtcgcctgctgcgggctgcctacgagatctaggcaagcgagcgagcgagcgcggccatgggtgctcgctgctccaagctctccgtctgctggtggcctccccgcttcaaatcgccgatgctcgagaatggcgccgccgaagatgacggcagcggcgtgccggtgttcgccgagtacagcctcgccgagctccgggtggccaccgacggcttcgccaccgaccgcatcgtgtcggagcacggcgagaaggcgcccaacgtggtctaccgcggcacgctcttcagctccggccgcaccgtcgccatcaagcgcttcggccgctccgcctggccggactcacgacagttcctggaggaggcgagggctgttgggcagctgcgcagtcgccggctggccaatctgatcggttgctgctacgagagcggcgagcgtctcctcgtcgccgagttcatgccgcacgagaccttggcaaagcatcttttccactgggagacaaaatccgttgagttgggcaatgaggacgagggctgcattttatgtggcacaggcgttgggatactgcagtagcaaagggagggcactctatcatgacctgcatgcatacagggtcgtcttcgatgcggtgggtctttacttgttcgcgttagttgcttttctgagttttgatacaaagcattaacctttttgtgttttgattgtgggccaattttataggaaggtaacccaagactatcatgttttggtctgatgaagaacagccgtgatggaaagagctacagtactaatttggccttcacgcctcctgagtatcttaagacaggtaaatgtgccacacgctagcaatagtatccatgaaacatttttgggaatgtgcctcttcatttgttttgaactgttatctgttctgcacctgca

SEQ ID NO: 17399 - DNA, 2061 bp, Zea mays
  misc_feature (17)..(17): n is a, c, g, or t
  misc_feature (34)..(34): n is a, c, g, or t
cccccctcgagagtcgnacccacgccgtccgggnaagagcggtaaagcccatcgccaccttcctcctcggatccacaacccggacgccccacccgggtcctttcttcctccctcccagtcccactcccaacaccgaccgcccctcctcatcacacctcgcaactattttagtctaaccgagtccaaccagtggcaagcgagcgagaggtggtggacggaaccgtcgcctgctgcgggctgcctacgagatctaggcgagcgagcgagcgcggccatgggtgctcgctgctccaagctctccgtctgctggtggcctccccgcttcaaatcgccgatgctcgagaatggcgccgccgaagatgacggcagcggcgtgccggtgttcgccgagtacagcctcgccgagctccgggtggccaccgacggcttcgccaccgaccgcatcgtgtcggagcacggcgagaaggcgcccaacgtggtctaccgcggcacgctcttcagctccggccgcaccgtcgccatcaagcgcttcggccgctccgcctggccggactcacgacagttcctggaggaggcgagggctgttgggcagctgcgcagtcgccggctggccaatctgatcggttgctgctacgagagcggcgagcgtctcctcgtcgccgagttcatgccgcacgagaccttggcaaagcatcttttccactgggagacaaatccgttgagttgggcaatgaggacgagggctgcattttatgtggcacaggcgttggaatactgcagtagcaaagggagggcactctatcatgacctgcatgcatacagggtcgtcttcgatgcggaaggtaacccaagactatcatgttttggtctgatgaagaacagccgtgatggaaagagctacagtactaatttggccttcacgcctcctgagtatcttaagacaggcagagtaagtcctgagagtgtggtttacagttttggcactgtcttgcttgatctcctgagtggaaagcacattccaccaagtcatgcactcgaccttataagagggaagaactttctagtgctgatggattcttgcttggaaggtcatgtatccagctccgatggaactgacttgatgcgattagcatcccgctgcttgcaatatgaagcacgtgaccggccaaatttgaaaacggtggtatccggtctcgaatgtctccagaaagatgtttctactccttcacacactttgctggggatccaacatgataataaaaactcagatcgaatttctttatccgctattgggaaagcttttgccagagcagacctgaatgaggtgcacgaaatattactgcatgatggatatgatgaggatgacactgctaatgctgagctatctctccagtcatggaatgatgatgtatctgagagctttgttgttaagaggcatgcagacaacgcctttaggtctaaggattactcgaccgcaattgagtgttactcaaggttcatcgactcaggtgcaggggtggctccaaccatgctggggcggagatgcttcgcatatgtggtggctggcaacccacaggaaggccttgaggatgcaaagagagccgaggttattgcatcggactggccgatgggacactacctgcaggccttggcacttcacaacctgggaagggaggctgaaagccaagaagcactgaagaatggcactgccttggaagctgcaatgaatagtagagctagaactgtatagccctgaatttgtgataccctgtcctgcttgtacctagatcgcctccctccaatgcttcgtcaccagtaggggctgtttttggtattccctaacttgtatcggtatttcccctagtttcacaagtcgaaaaaactcctaggctggctgttgttacacctccaatatatttatgaatacaggaatgggcaactagcattctgttgatgtgagtttgtaaagtgagagtttctatttatttcaacaaattcatgtacatacacacttttgaaccctgcaacttaagatatttgaggtcaggccaacttcaactc

SEQ ID NO: 17400 - DNA, 2286 bp, Zea mays
tgaacatagaatttataacagagaggaacattccatgtcttagacaaacaaagaattggccatgcttatgtaagtcctaagtaaaaatgtctttctcattcaataattgaatatgaggtattttagctactagggcattaggctatgccaattagtgatttttctatctactaaagctctacgaatagaggtattcacccccctgtttcccgtttcggttttccatgctaaacctgtctcttgtctgattgcttgtgttttttatctactgtttattttataatgaataaaaactgttaactactttttatcttatgttgaataatatatttcagcacaaataagcttggattcacaccagagtttctagggcgtgtgaagcttgtaacctcctttgcatccctgctcggtgttgggctctacaactattttctgaaggaagttcctctaaggaaaatatttctcgtgacaaccattataggttcagctcttgggatgacacaggtgctctttatattattttcttgattgttactgcaattcttttctatcctttaaacatactgcatcgtatatatttaggtgcttcttgtaactgggttaaatcggaagtttgggattagtgacgagtggttttctattggtgattcattaatcatcacagtccttggtcaggtcagtaacattactgcaatgcttaataacagtagagtgcattttacatgattgcataaaaaaatgtattcagttgatcatgtaccctttttcgttacatagtggccgtgtaacatagtacttttatatgtccataatttagactggccactgacaattcaggatcagctgatcttagttgtgaaatgctgtacctgttcttaggaagatgttgacttattttgaggagagaagtctcaacgttccatgtgtacaatgagagcatcgtttgcatattaatatgagttaaataatatctagctttgacacctcctgccttcaattgcttccttgaatgcaagcttatgttgcttaagctttttttgtaggcttcatttatgccagtcttggtgttagctgcaaaactgtgccctccaggaatggaagccactttatttgcaactttgatgtccatttctaatgctggaagtgttactggtggtctggttggtgctggtctaactcggatatttggggtcaccagggacacctttgggaacctacctctattgattgtcgtctgcaatcttagttcgctgctgcccttacctcttttaggtctcctgccagaggaatcaggtgacacagacaatggagaaacaaagaatatctgacttgctgagggtttcatctctgtttgttctgattctcaagtatagcataccacagtgcccagcttcaactcagatatgacccatccagttgaagttcaaaagatcagtggggaaatatggaaatcatactggagataagttcagttagtcaccaccaccatcacccagtatctcctgcgactattaacctgtgatcaaagcggttcattggtgatctatgatggcgcacaggtaatcaccgctttttttagtttatataagctaccttgcatacgaaggcaaggtcggctttatctttctctacattctttgagtttttgttagctaatgctgcgaccccatgaaaactagagtaggggtcaaagactagcagttgaggattcccttacaaagtcgaatgtattgtaaccaaaagagagagagagggggaatatttatgcattacggagacctagagtacggacacgtaaaggaaaatacttgcacacaattcgccttgccgtacagtatcaggttctgcttacatcactaggcccaaatgaagtgcaatcagaggcacataaaggaaaactatagcacaacagaaatgcagcacccatggtccataacaactcactgagtttttgcagtgccaagtactggtgtcaatgataaattgataatagtgtgtataaccatagatctattctttgatgtctgtttgggctttgggggttaacttaaaatatggtttcaatttattggcgagtcgaataagagttaagtaagaaatgatcattggaatcaatggagtgtaaagcatccaggaactaacctgtgtgtttctcttttgagggtgtgctcagtgctcctatagttggtatttatccaggactacaatcagttaaattatatcatgaggacgaatcattgttgaataaaaaatcgtcgattagtttctggatgttttacatatttc

SEQ ID NO: 17401 - DNA, 2577 bp, Zea mays
tggcaataggaggagaaacaggctgcagacagcaggggtgcccaaaagcagggaaggaagagcggaaaagtccaccagtccaccacaccaccttcctcggatccacaacccggacccccgggtcctcgggccgccccccgggtcctttcttcctccttccccagtcccagtcccagtaccagtatcagtaccagtccaagccccactccccaccccggcccgaacctcgcaagtattttagtcttacttcattcgagccctaccactaccagtggcaggcgagcgagaggcggttgaggaggagcggacggaaccgtcgcctgctgcgtctgcctgcgagatctaggcgagcgcggccatgggtgctcgctgctccaagctctccgtctgctggtggcctccccacttcaaatcgccaatgctcgagaatggcgccgccggagatgatggcagcggcgtgccggtgttcgccgagtacagcttcgacgacctccgggtggccaccgacggcttcgcccccgatcgcatcgtgtcggagcacggggagaaggcacccaacgtggtctaccgtggcacgctcttcagctccggccgcaccgtcgccattaagcgcttcggccgctccgcctggccggactcacgccagttcctggaggaggcgagggctgttgggcagctgcgtagtggcaggctggccaatctgatcggttgctgctgcgagagcggcgagcgtctcctcgtcgcagagttcatgccgcacgagaccttggcaaagcatctcttccactgggagacaaatccattgagttgggcaatgaggatgagggctgcgctttatgtggcacaagcgttggactactgcagtagcaaagggagggcactctatcatgacctgcatgcatacagggttgtctttggatgtggatggtaaccccagattatcgtgttttggtctgatgaagaacagccgagatggaaagagctacagtactaatttggccttcacgcctcctgaatatcttaagacaggcagagtaagtcctgagagtgtggtttacagttttggcactgtcttgcttgatctcctgagtggaaagcacattccaccaagtcatgcactcgaccttataagaggaaagaactttctagtgctgatggattcttgcttagaaggtcatgtatccaactcggacggaacagacttgatgcgattagcatcccgttgcctgcaatatgaagcacgtgaccgtccaaatctgaaaactgtggtatctggtctcacaagtctccagaaagatgcttatactccttcgcacactttgcttgggattcaacatgataagaacaactcaggtcaagtttccttatctgctattgggaaagcttttgccagagcagacctgaatgaagtgcatgaaatattgctgcatgatggatataatgaggacgacgaggctaatgctgagctatctctccagtcatggaatggtgatatatctgagagctttgttgttaagaggcgtgcagacaatgcctttaggtctaaggaatacacgactgcaatcgagtgttactcaaggttcctcgactcaggtgcagtggtggctccaaccatgctgggacggagatgcttcgcacatgtggtggccggcaacccacaggaaggcctcgaggatgcaaagagagccgagattattgcatcggactggccgatgggacactacctgcaggccctggcacttcataagctgggtagggaggctgaaagccaagaagcactgaagaatggcactgccttggaagctgcaaggaatagtagagctagaactgtatagccctgaatttgtgataccatgcccttcctgcttgtacctagatcgcctgcatttcgggtgcctacctccaatccaatgctttgccaccagtagggttgtttttggtattccctaacttgtatcgttatttcccgtggttttacaagtcgaagaactcctaggtcagctgttattacacctccaatatatccatgaatacaggaatgggcaactagtctgctatagcattctgttgatgcgagtttgtaaagtgacaggatttcgatttatttcaacaaacccatgtatatacaaacttttgaactctgcaacttaagatatttgaggccaggcaaccttcaactattgttaacatctcggcccctggactatcttatgtactactttctcgccttttcggtcctaaaatagtgcatatcttgcactccaaagggtaatgcatacaaaggtttgttccaggtaagactgcccatctaatacgcagcaacaatctaatcacaatctagtacgcccttcggctgcccatcttgggttgactcccaccagatgtcgcagcgcagcagcaactgcggctgcttttggttgctgggctacaacagatgtactctcttcctccctatcttaaaataacagaggtttgttctaagtcaaagttctaaaactttcaccaataatatctacaaaaataattatttttaaattaaagaaattatatattgggctcgatgttttaatagaaaat

SEQ ID NO: 17402 - DNA, 3248 bp, Zea mays
gtccaagctctaaagctggtgtgcgacgaaggcagcgagttcaacggatccacgagctttagccaagatctgcgtatccaggatgttgaggctatgagtagagcgagtggggatgtagacttcgttgacccaacgctatctgccgagctgttcacctcatcagcgcgttatgatgctatggatgcctctggttctttccgaagatgcacgagtggttctttccgaagatactcgagttcaggtcctctgagagtagggagagctggactggacaaagagagggggctgtcaacaggcagctcaagtgagcacgttgggctacaaaggtttagaattgattcagaatagtcagcctgcatcctgcaagcagcttatcatgattgggagtgcagaactagacttcttcggaagcttaaactagacttcgcacagattttttgtacagttctagagatgtgtagatgcctttaggcctaagtggtggacactttaggattgcgagtgttttcaagggattggagtgggggtaaatccccaatacatcaaatactctctcaatacatctcaatccactccaatcccactcattactagaatacccaaactaagccttagtgtctccacaaaactcaactacttaaatcgtgccaggaactgtgtttccacaaaactcaactacttaaatcaaattacactaccatttcgtgcctgtcacattatcaaggcgcaacccaggatgagatacattaacaaccctgtaatgcaggttgacctataccggacatagccatgtggccatatccctgtaggtacatcaagcagcactttttcctgctagcacacataaacagatggcttgattcctccagaaatgaacactcaatacagtatgcacaagcacactgcacacatgaacaacagatggctcgaatcctcgagaaatgaacagtcaatacagtatgcacaaacagaacacagctagcaataatacccatcctcagcgaatgaaaactaacattattacttactgaggccgtcatgtcagtgctgctacttctcttatctgtgctcccagccagtatataccagcatcttaaagtccataactttggggacctttaaaaaacaaaccacagtaaatgtttagtacagcaagctagtgtagggtgcaggaacgtgtccccttctaccttcaacaaaacgccaggtgaagctatacattcgaagcctttttgtttggacactcaagcacactgcaggatcccctaacctggctgcagttgctttactgatagtcaaacaaaaatatatgctgcttttcatgtttcggttttgttcgtggcatgatttccgtacaggaatttgtaatagaccttcctaacattgatcttatcgtgcagttgaagggcccactgaagccacttctatctatataccgataatgaatcatgtgagatattcagaacggcagccaacaaggtccatcttgaaagaacaaaaatagtaaaacatggtcatatttggcaaggttgtcaatccaaggcatgcccattgtacttcccatccatcttatttgatgatagatagcaggttcctgattgagacttcagagttcgatgcttacaggccacaaaacagcaatgcagaaccaatatttcatgaacctttggaaacttataactgcagagcatgtcatgcggggcagtttcgggatcttcacacaaaccagaatcatgtatttgtttcttcttctaggagtatctcatagatgtcagtgcggatgtttaattccttgtcacgcatcacttcctggagatctgacaactccttcaatgtcagaacagagcccaacttttggaaaccatcaagccataatcttttagaccatggacaggcatgtatagctctgaagaacacacgccgtgctgcagaagagttgcaggctatttctgcctcataggctagataacagcgccacaataggacagacttctgcaacttatcatcagctagagctctctcaaacaggctgtgtattctattgtcagatccagctttaccccattcaaaggacaaagcaaagagcaaggtgattacagaagggtccctttgactacatttgtcgagtgtgagacggagattgttggatacactgtaaagataactcagggttaacgtcgctgaatatgattttggattgtagggatatttgtgcactccgcgtgatatgcttggccagacccttgatagattcaattggttaagatttttttgaagcattttgatgtagtacacccacaaatcctcacactccaaattattgctctctgaaaatgtcattggaaaagtctcctctatcacttcaagacccgagtaacagcctgttgtcatgctttcgaacaaagaagctgagcagatcagagcaactgattctttgtttatagcaccacaggaaaatgcagatcgtgagcttctaatctgctctttaaacccttggcgagccctcaagacctgaagccttgaaatagggccaacaaaaggagaatattttgccgggctccctaagcaggataggatgtaaactgcacgatgcattgagtcagagttgtttcttgaagcggacactgtaatctccatctcggcgtaccaaagataaaggatgggaaccttcttcctaagatcctcagaagttgcttcagttgataacagtgccatgtcaaatatcttccttgcttgttcaatgttcccattcattgcctcagttcgtccatatatcccacaaagcaaaaaatcctgtcggtctttcttcaacatacttttggccaaagcccgtgatgcattagtttgaatggaggaagagttctcttgaggagtaaacatttgggtagtaacaagaacagcttcctccaggacatgattacgagggaaaacaccaagcggaagcagtatcgcatttttgagaaatttcatcaggcccggcccctcgggccggtctcacatgcttcccagtaatgattccaatttatatttataactatatgaactttggttcttgtttacaacgtcacacccagcacctagatcttccaggatgtcatctgtaatattctctaagctcaatattcgatcgagccaacttggactgtttgttgatgtccatcttgagatttttccaccataaaaatcaataaattggcacatcagagaaaagcgggcctcctctgaagatagagaaaacaagaactcag

SEQ ID NO: 17403 - DNA, 1713 bp, Zea mays
cgaagggacactgcgtggggaggggaagggcggagagcgccagccacgcggtggggggaaaacccgtcaagagaaagggctgtgtacctttcgctttgttgcctggctctggtattgggttccccgttctgctgctcagctcagcccagccccagagcccctgacctgccgtcctccctccttccctccccgtgagtcgccgtacggcggtacgggatcgccaccgcggcgtccagggatggcggacgggagcctctacgcctggtggtgctgtgccttgggctgggcgctggcgcttgtcgcagcggacggcttcctcgtggacatcacctatgtggaaagcgccgtggccaaaggagcagtgtgtttggatggtagtgcgccggcgtaccatctcgcccgcggctccggctccggtgagaacagctggctggtccatttcgaggggggaggatggtgcaacaatgtcaccacctgcctgcaacggaagcgcactcggttgggttcgtccaaggagatggcgacgcagattgccttctccggaatcctgagtgacacgccggatgacaacccagatttttacaattggaacaaggtcaaggttcggtactgtgatggttcatctttcactggagatgttgaagaagttgaccctgcaacaaagctacattatagaggtgccaggatatggcaagctgtcatggacgacctgcttgccaaagggatggacaaagctgaaaatgctctaatttcaggctgttctgctggtggtttaacctccatactacactgtgacagatttcatgaccttctgccgccggctgcgagggttaagtgcctttctgatgctgggttcttcattaatgagaaagacgttgcaggagttgggtacattgctgcctttttcaacgacgtcgttacaacacatgggtcagcaaagaatttgccgccttcatgcacttcgacgttacctccaggaacgtgctttttcccccagaacgaggtgaaacagatacagacacctctgttcatcctcaacgcagcatatgattcatggcaggtaaggaacattttggtgccaggagtagctgaccctcatggaaaatggcatagctgtaagcatgacatagaccagtgctctgcatcgcagctacgggattcaggggtgattttctgaaggaagtggcagaactagggaactccgactcgagagggttgttcataaactcatgcttcgtgcactgccagtctgagatacaggagctatggttctcatctgactcccccgtgctcggaaacacaacagtagcaaacgctgttggcgactggttcttcgaccgcagctccttccagaagatagactgcccatacccttgtgactcgacctgtcacaatcggatctacgatgactcatcacaagcatagcaattacagtggcctcacttcgtactgccattcaccatgttattacatttgacgcttccagcattgctaacagtagggcaatgcgttgatagccattgattttttttttctttttacgaataagatcaggtgccggcggctttaactcggttgctaccggaaagtgagcgtgcatcttccgacggtacatggcatggtttatctggatggatgaatcgataatcataaattcttaaaaacacaataaatattctagaatttttatgttgtgaaaaaaaaaaaaaaaaa

SEQ ID NO: 17404 - DNA, 1811 bp, Zea mays
gactcggcgtacaaaccaaaggcacgaagggacactgcgtggggaggggaagggcggagagcgccagccacgcggtgggggaaacccgaaaagagaaagggctgtgtacctttcgctttgttgcctggctctggtattgggttccccgctctgctcctcagctcagccctcttgctcctgacctgccgtcctcctccttccctccccgtgagtcgccgtacggcggtacgggatcgccaccgcggcgtccagggatggcggacgggagcctctacgcctggtggtgttgtgccttgggctgggcgctggcgcttgtcgcagcggacggcttcctcgtggacatcacctatgtggaaagcgccgtggccaaaggagcagtgtgtttggatggtagtgcgccggcgtaccatctcgcccgcggctccggctccggtgagaagagctggctggtccatttcgaggggggaggctggtgcaacaatgtcaccacctgcctgcaacggaagcgcactcggttgggttcgtccaaggagatggcgacggcagattgccttctccggaatcctgagtgacacgccggatgacaacccagatttttacaattggaacaaggtcaaggttcggtactgtgatggttcatctttcactggagatgttgaagaagttgaccctgcaacaaagctacattatagaggtgcgaggatatggcaagctgtcatggacgacctgcttgccaaagggatggacaaagctgaaaatgctctaatttcaggctgttctgctggtggtttaacctccatactacactgtgacagatttcatgaccttctgccgccggctgcgagggttaagtgcctttctgatgctgggttcttcattaatgagaaagacgttgcaggagttgggtacattgctgcctttttcaacgacgtcgttacaacacatgggtcagcaaagaatttgccgccttcatgcacttcgacgttacctccaggaacgtgctttttcccccagaacgaggtgaaacagatacagacacctctgttcatcctcaacgcagcatatgattcatggcaggtaaggaacattttggtgccaggagtagctgaccctcatggaaaatggcatagctgtaagcatgatatagaccagtgctctgcatcgcagctacgggtattgcagggattcaggggtgattttctgaaggaagtggcagaactagggaactccgactcgagagggttgttcataaactcatgcttcgtgcactgccagtctgagatacaggagctatggttctcatctgactcccccgtgctcggaaacacaacagtagcaaacgctgttggcgactggttcttcgaccgcagctccttccagaagatagactgcccatacccttgtgactcgacctgtcacaatcggatctacgatgactcatcacaagcatagcaattacagtggcctcacttcgtactgccattcaccatgttattacatttgacgcttccagcattgctaacagtagggcaatgcgttgatagccattgattttttttttctttttacgaataagatcaggtgccggcggctttaactcggttgctaccggaaagtgagcgtgcatcttccgacggtacatggcatggtttatctggatggatgaatcgataatcataaattcttaaaaacacaataaatattctagaatttttatgttgtgcaaccgtgacttattttctctttgttaaaaaaaaaaagaaaaagaaaaaaaaaagaagaaaaaaaaacccagggggggcccggtaccc

SEQ ID NO: 17405 - DNA, 1467 bp, Zea mays
ccctcccgcccgcgagaccccagaggagcgctacagaacggagattttgccgcctccctactctccaccgttctggtcgctcgccggtagctgctccccgctaactactcttccccgccccgccgccatcggtcctcgcgacgcccctctccactgcctgtcctgctgccccacgccgcggacagatcacctcgcccccctccgcttgcagccgcgccggcacgaaggacggaaggacgggacatccgtggggaactcaaaaaagatcccgatacctggtcgccacaatggatcacggcggcggcggcggtagcggcatctggatccgtgcggcagtggcggtggcggcgggagccgccatcgcggcgcgcgctgtccggcgcaagtctgtcgactccagcgccgtgttcgtcggagtccccgccatggtggctcataccgtcgccgggtacaggttcgcggggctgctactggtgttcttcttcacgtcgtcgcgggtgacgagggtcggcgaggcgaggaagcgtgctctcgatcccgagttcaaggagggcgggcagcgtaactggtgcaacccactcttattggcaggaagcaagttttgtcaaatagcggtattgcaagtatcttggttgttttgatagcatcagttaccggagggacagataggtgtttggattcaaaagagtcgactcttgttactgctcttattggtggtgttatcggacattatgcttgctgcaatggagatacttggtcatctgagctcggcattctcagtaaagctgagccacgaattatctcatctgtccagagagtgcggaagggtaccaatggtggtgtaaccatagatgggcttctggcagcagcagcagctggattctcgattgggcttgcatttgtgctgataggattcttcaccactcagtgtgctcctgatgtattctggaaccagctgctggctatacccttggctacagctgctggcctatgtggaagtttgatcgattcgttcttgggcgcaacagttcagtatagtgggttctgcagtgttcgcaaaaaggtggtgggtgtagatggtccaacggtaacaaggatttcagggatgaacatactggataacaacggggtcaatgtagtctctgtgttcttgacaactgctcttactgcggtggcttgcccatacattttctgaggttagctatggcgagtattggtgcgccatggtaggtccacattagatgacacagagaaacctgattgatgaattagaacagcagattgtgtagcagtggcattaatcattttcgaacacctagcagaagatgaacaattgttctcctttaacaaaaaatgttttcaacagtagatgagatcctgtaaaaatagagaaatttcatgtctctcttaaagatgtctcgaagtcgttgctcaaaaaaaaaaaaaaaaaaaaaaaaaaaagcttgt

SEQ ID NO: 17406 - DNA, 1674 bp, Zea mays
cattgggtacctcgaggccggccgggatcaaacctccgccccagcaccggcccgggattcacccgggtcccccgaggcccgccgccggcacaccgcacacgcacgcacgaacgcgctcccaccccctcccgccgccaccgccgccaaaaccccggcccgactcggcgtcctccgccaacctcctcctgggcagcgccggcgggggatatggcatcggaggacgtggtgggcaagagcaggggcgacacggccgtcaccaccatcgtcaacctggcggaggaggccaagctcgcgcgcgagggggtcaaggcgcccggccaccagatcctcaccatctgcaagtcgctcgtcgccggcggcgtagcaggcggagtgtctcgtactgctgttgctccacttgaacgattgaaaatattgcttcaggttcaaaatccgcacagcatcaagtacaatggtactgttcagggtctcaagtatatctggagaacagagggcctccgtggacttttcaagggcaatggtaccaattgtgcaaggattgttccaaattctgccgtgaagttttttagctacgagcaggcgtcaaagggaattctgtgggcctaccgtcaacagactggtgaagaggatgctcagcttactccgctcttgcgccttggagctggagcatgtgctggtatcatagctatgtctgctacttacccgatggatatggttaggggaaggatcactgttcagacagacaaatctccctaccagtaccgtggtatgtttcatgcactgggtacagtctaccgtgaagaaggctttcgtgctctatacaaagggtggcttccatctgtaatcggagttgttccatatgttggtctcaacttcgctgtatatgagtccctcaaagactggctactccagacaaattcatttggccttgcaaatgacaacgagctgcacgtagttacaaggcttgggtgtggagctgtggcgggaaccattggccagactgttgcatacccgcttgatgtcatcaggagaagaatgcagatggttggttggagccatgctgactctattgttactgggcaaggcaaagaagcactccagtacaatggcatgatcgatgcattcaggaagactgttcgtcatgaaggcgttggtgctctgtacaagggtcttgtgccgaactcagtcaaggtggtgccctcaattgccattgcatttgtgacttacgaggttgtgaaggatgtgctaggagtagagatgaggatatcagactgaggatggtcgttttcaactgctatttttgtaggctttgggaagttgtgttttttttttgtaggcagggcgggtagaagggtatgaccgcggctccattcagcatcaggccctctcagcccatgttggatatatatcatatatcctgccactggcttcagtcaggtcctagaattgttgctgggtcgtgcaaaaagtaataagtcggctgtaaagcttattaagcatctgcctaactcatcaaaagaaatctattccttattgatgatgtaccgagattttcgaacttaaagcggtactacgtgctgctaacagttgattaatgatttttctttgttgctggtgatttttcaaaaaaaaaaaaaaaaaaaaaaaaaaaaaaaaaaaaaaaaaaactcgtgc

SEQ ID NO: 17407 - DNA, 1560 bp, Zea mays
ccggccgggacaccgcacacgcacgcacgaacgcgctcccaccccctcccgccgccaccgtcgccaaaaccccggcccgactcggcgtcctccgccaacctcctcctgggcagcgccggcggggggatatggcatcggaggacgtggtgggcaagagcaggggcgacacggccgtcaccaccatcgtcaacctggcggaggaggccaagctcgcgcgcgagggggtcaaggcgcccggccaccagatcctcaccatctgcaagtcgctcgtcgccggcggcgtagcaggcggagtgtctcgtactgctgttgctccacttgaacgattgaaaatattgcttcaggttcaaaatccgcacagcatcaagtacaatggtactgttcagggtctcaagtatatctggagaacagagggcctccgtggacttttcaagggcaatggtaccaattgtgcaaggattgttccaaattctgccgtgaagttttttagctacgagcaggcgtcaaaaggatgctcagcttactccgctcttgcgccttggagctggagcatgtgctggtatcatagctatgtctgctacttacccgatggatatggttagggggaaggatcactgttcagacagacaaatctccctaccagtaccgtggtatgtttcatgcactgggtacagtctaccgtgaagaaggctttcgtgctctatacaaagggtggcttccatctgtaatcggagttgttccatatgttggtctcaacttcgctgtatatgagtccctcaaagactggctactccagacaaattcatttggccttgcaaatgacaacgagctgcacgtagttacaaggcttgggtgtggagctgtggcgggaaccattggccagactgttgcatacccgcttgatgtcatcaggagaagaatgcagatggttggttggagccatgctgactctattgttactgggcaaggcaaagaagcactccagtacaatggcatgatcgatgcattcaggaagactgttcgtcatgaaggagttggtgctctctacaagggtcttgtgccgaactcagtcaaggtggtgccctcaattgccattgcatttgtgacttacgaggttgtgaaggatgtgctaggagtagagatgaggatatcagactgaggatggccgttttcaactgctatttttgtaggctttgggaagttgtgttttttttgtaggcagggcgggtagaaggatatgaccgcggctccattcagcatcaggccctctctggcttcaggtcctagaattgtttgctgggtcgtgcaaaaagtaataagtcggctgtaaagcttattaagcatctgcctaactcatcaaaagaaatctattccttattgatgatgtaccgagatttttgaacttaaagcggtactacgtgctgctaacagttgattaatgatttttctttgcctctaaaaaaaaaaaaaaaaaacgggcctggccgcccccctccgtgctgctaacagttgattaatgatttttctttgcctctatcaaaaaaaaaaaaatagaaaaat

SEQ ID NO: 17408 - DNA, 1541 bp, Zea mays
cattgggtacctcgaggcggccggcgaaaacccccgccccagcagttgctttttattcacccgcctcccccttgtcgctcctccaacacaccgcacacgcacgcacgaacgcgctcccaccccctcccgccgccaccgccgccaaaaccccggcccgactcggcgtcctccgccaacctcctcctgggcagcgccggcggggggatatggcatcggaggacgtggtgggcaagagcaggggcgacacggccgtcaccaccatcgtcaacctggcggaggaggccaagctcgcgcgcgagggcgtcaaggcgcccggccaccagatcctcaccatctgcaagtcgctcgtcgccggcggcgtagcaggcggagtgtctcgtactgctgttgctccacttgaacgattgaaaatattgcttcaggttcaaaatccgcacagcatcaagtacaatggtactgttcagggtctcaagtatatctggagaacagagggcctccgtggacttttcaagggcaatggtaccaattgtgcaaggattgttccaaattctgccgtgaagttttttagctacgagcaggcgtcaaagggaattctgtgggcctaccgtcaacagactggtgaagaggatgctcagcttactccgctcttgcgccttggagctggagcatgtgctggtatcatagctatgtctgctacttacccgatggatatggttaggggaaggatcactgttcagacagacaaatctccctaccagtaccgtggtatgtttcatgcactgggtacagtctaccgtgaagaaggctttcgtgctctatacaaagggtggcttccatctgtaatcggagttgttccatatgttggtctcaactttgctgtatatgagtccctcaaagactggctactccagacaaattcatttggccttgcaaatgacaacgagctgcacgtagttacaaggcttgggtgtggagctgtggcgggaaccattggccagactgttgcatacccgcttgatgtcatcaggagaagaatgcagatggttggttggagccatgctgactctattgttactgggcaaggcaaagaagcactccagtacaatggcatgatcgatgcattcaggaagactgttcgtcatgaaggagttggtgctctctacaagggtcttgtgccgaactcagtcaaggtggtgccctcaattgccattgcatttgtgacttacgaggttgtgaaggatgtgctaggagtagagatgaggatatcagactgaggatggccgttttcaactgctatttttgtaggctttgggaagttgtgtttttttttgtaggcagggcgggtagaaggatatgaccgcggctccattcagcatcaggccctctctggcttcaggtcctagaattgtttgctgggtcgtgcaaaaagtaataagtcggctgtaaagcttattaagcatctgcctaactcatcaaaagaaatctattccttattgatgatgtaccgagatttttgaacttaaagcggtactacgtgctgc

SEQ ID NO: 17409 - DNA, 750 bp, Zea mays
  misc_feature (474)..(474): n is a, c, g, or t
  misc_feature (486)..(486): n is a, c, g, or t
  misc_feature (535)..(535): n is a, c, g, or t
  misc_feature (551)..(551): n is a, c, g, or t
  misc_feature (554)..(554): n is a, c, g, or t
  misc_feature (556)..(556): n is a, c, g, or t
  misc_feature (559)..(559): n is a, c, g, or t
  misc_feature (578)..(578): n is a, c, g, or t
  misc_feature (586)..(586): n is a, c, g, or t
  misc_feature (590)..(590): n is a, c, g, or t
  misc_feature (617)..(617): n is a, c, g, or t
  misc_feature (619)..(619): n is a, c, g, or t
  misc_feature (624)..(624): n is a, c, g, or t
  misc_feature (626)..(626): n is a, c, g, or t
  misc_feature (628)..(628): n is a, c, g, or t
  misc_feature (633)..(633): n is a, c, g, or t
  misc_feature (644)..(644): n is a, c, g, or t
  misc_feature (650)..(650): n is a, c, g, or t
  misc_feature (652)..(652): n is a, c, g, or t
  misc_feature (665)..(666): n is a, c, g, or t
  misc_feature (677)..(677): n is a, c, g, or t
  misc_feature (686)..(686): n is a, c, g, or t
  misc_feature (690)..(690): n is a, c, g, or t
  misc_feature (716)..(716): n is a, c, g, or t
  misc_feature (718)..(718): n is a, c, g, or t
  misc_feature (726)..(726): n is a, c, g, or t
  misc_feature (746)..(746): n is a, c, g, or t
gagtttaaagagggcgggcaaattttttgcaagaaagttttgtcaaatagcggtattgcaagtatctcggttgtgttgatagcattagtcatcagagggatagataggtgtttagattcaaaagagtcaactcttgttactgctcttattgatggtgttatcggacattatgcttgctacaatggagatacatggtcatctgagctcgacattctttgtaaagctgagccacaaattatcacaacattcaagagtgcggaaggctaccattggtggtgtaaccatagatgggcttcttgcagcagcagctggattcttgattgggcttgcatttgtgctgataggatttttcaccactcaatgtgatcctgatgtattctggaaccagctgctagctatacccttggcacagctgccgccctatgtagaagtttgatcgaattcctttctggagcgcaacagttcagttatagngggttctacagngttcgcaaaaaggtaaagccaacaaatttcaatatttaaaataactcgntggggccagggtttgnaananaanattaagcagctctaaaatnaagatagntgcnatcgatcttgccacaatttttacttgngntgagnananaaaangggggttgggncagggntntcttgggcctacnngaaaaaagacnccaggaaanatgncgattttctgttttctccatcccggngntatcatgnggctggttggaatggcccanggga

SEQ ID NO: 17410 - DNA, 948 bp, Zea mays
gttctacgactctcggcaacggatatctcggctctcgcatcgatgaagaacgtagcaaaatgcgatacctggtgtgaattgcagaatcccgcgaaccatcgagtttttgaacgcaagttgcgcccgaaccctccttcggtcggctcggggccggccgggccgggacgttatcgcgcacatctcctgatcctcgttcctctccgccccgcttgcgccgcgcctccgcccccgtctcctgtgagatcagctccggcggcacgcggatatgactacttcaaggcgtcttgctgacaggaagagtgcaaagttccagaagaacatcacaaagaggggttctgtgcctgagaccacggtgaaaaagagcaatgactaccctgttggacctatagttcttggattcttcatttttgtggtcattggatcatccttgttccagataatcaggacagcgacaagcggtgggctggcctgaattcactgagctaaaaccagaaatttatctgtccgtgagctgggaggcagtatctgtgttgtgtagcaaacttgttcatggatatgtagtgcgaatgtcactactgttctgtttgcagtatcaaaagagtttaaactgatgttgtaaccatgcaaaggctgaaaattttaaagagtatgggagaaaccttaatctaaagaagagtggctctgcaaaacaaaaaaaaaaaaaggcccctaagggccgccaccaaaaaagagtacacatcatctcttcccggccccaccagcaaatccccaattcctccgagttcgagcgaccatgtcggggcgtggcaagggcgggaagggtctgggcaaaggcggcgccaagcgtcaccgcaaggttctccgcgacaacatccagggcatcacgaagccggcgatccggaagctggcgaggaggggcggcgtgaaacgcatctcggggctcatcta

SEQ ID NO: 17411 - DNA, 4787 bp, Zea mays
ctccccttcttttaagtattttaaaggaattatgttttatggtaatcatacttcactttcttttgagaatgttaagtcaaatttgttgtttaaggaaaaatttgatgttgattcttgttctgaacccagaggtgaagatttaattgttcggtgatctggagatcataaatccaacctttattatcgttattgtagaaaaaatactcgcccaaagtgagaaataaagaggagagaaagaaaaaagaattggataagtcttctcctgaagccaattttgttaaaactttaaatagtggagaagctctgtttattgcctatgttaacaagtgctcttcttggattcttgattccgcttgcacttttcatatttgttcgcatatggattgatttcctgattatgttcagtctcatgctggtgaggttattattggagatagatctacatgtgagattattagaatcggctctatttatattcaagttatttaataactatcgtataagtttttaatattgtggtaatgtttttaaaagaaaaaatatgtaaattttacgagaataaaaacgtttaaaacacgattactaactataaaataaatatttgtaaatttacagaataaaactgtccttctaaatttttttttatttcattctatataagatattctcaccgatgaaaacatcactacgagggacggacaagtctaacactcaacagtcccaaagcatgcgcaggcagcccgcaactacctccatcaaacaaaatcaatcttttaaagggcaaattggtcacgccaagtacctttaaaaatcaaggggaaaaaaagagttgttgctagacctggagtcctggacgagtaggggacggtggccgagaagaagagctgaacgaagaccagcaccaaccaagagaaaagtagcaactcacacacagtaggagaggagaggaaagaacccagcgatagatcagagtcggggagaaaaatttgcctcctcccatcggaatctagctaattattttccggtccttctcccccatgtaagtctccctctcccatccccgtcgcctgcacctaccggaagcgaagccttctacagttcaggtccatatccgggtcgccgccgtcggctagctctaggcggacatggtggccgcttgccagagcacggcctccacctacgcgcttctgctgctcttgctgtttgccgctgcggtcgccgtctcttcttcctccgggttgcgccgtgtccaggaccaggacagatcggcgctgctccagatcaagaacgccttccctgccgtagacctgctccagcagtggtccccggactctagcggccgcaaccactgctcctggctgggggtaacatgcgactcaagctcccgggtcgtcgctctggaggtgctctccccttcacggcgtttcggacccagccaggagcttgccggcgagcttcctgcggcggttgggctcctcaccgagttgaaagtggtctcttttccgctccacggcctccggggcaagatccccggtgagatctggcggttggaggatctcgaggtggtcaacctcgctgggaactctctccggggcgcccttcctgcctccttcccgccgcggctgagggtgctctcgctcgcttccaacctgcttcacggtgagatcccgtcttccctttccacctgcaaagacttggagaggttggatctttcaggcaaccggttcactggatcggtgccgagagcacttggcagcctgcctaatctgaagtggcttgacttgtctggaaaccttcttgtcggtggcatcccctctggtctggggaattgcaggctgctccgctcgctgcggttgttctccaattcattacacggttcaattccagcagggattggaaagctgaggaaactacaggtgttggacgtatcaagaaacagattaagtggcctggtgccaccggagctcggaaattgctcagatttgtcagtgctcgtattgtctagccagtccaattcagtaaagtcacatgagttcaatctgtttaaaggaggaattccagagagtgtgacagctttgccaagactccgggtgctatgggtgccaagggcgggcctggaaggaactctcccgagcaactggggaaggtgttctaatttagaaatggttaatctggggggaaattttcctttctggagcaatcccaagggatctaggacagtgcagtaacctcaagtttctcaacctcagctcaaatagattatctggtttactggataaggatctatgtccgcattgtatgactgtattcgatgtcagcggaaatgaactttcaggatcaattccagcatgtgtgaataaagtctgtacttctcagctaatgctggatgaaatgtcatccagttattcttcattcctcatgtccaaaactctacaagaactgccatcagttttttgcaactccggggagtgttctgttgtgtatcataattttgcaaagaacaaccttgaaggtcaccttacatccatgccatttagtgctgacaggtttggaaacaagacgtcgtatgtgtttgtcgttgatcacaataatttcagtggatcgttggattcaattctgttggaacagtgtagcaacttgaaggggttggttgtaagcttccgagacaacaagatatctggtcagataacagcagagtttagcagaaaatgcagtgctatcagagctttggatttagctggcaatcaaatatcaggaatgatgcctgataacgttggtttgttaggagcccttgtcaagatggacatgagcagaaattttttggagggtcaaatacctgccagtttcaaagatttcaagagcttgaagtttctctcattagctgggaacaacattagtggcagaataccatcctgtttgggtcagttgagatcactgagggttttagatctctcatctaattctcttgctggtgagatcccaaataaccttgtgacactaggagacataactgtgcttctactcaacaataataggctctctggaaacattccaaattttgcctcttcaccatcgctgtccatattcaatgtttcattcaatgatttgtctgggccactgccttcaaaaattcactcactgacatgcaacagtattcgtggaaatccatcccttcaaccttgtggactgtcaacgctctccagtcctttagtgaatgctcgagcactaagtgaggcagacaataatccaccagctgataatacagcccctgatgacaatggtaacggtggcggattcagcaaaatagagattgcctccataacttcagcatcagcaattgttgcagttctcttggctctggtcatcctttatatttacacacgaaaatgtgcatcaagaccatcaaggcgttctctaagaagggaagtaactgtttttgttgatattggtgctcccttgacatatgaggctgttttacgtgccagtggaagcttcaatgcaagtaattgcatcggaagtggtggcttcggagcaacgtacaaagctgaggtagcaccaggaaaattggtggcaataaagagacttgctattggaaggttccaaggcattcagcaattccaagcagaggtcaaaacacttgggaggtgtcgccattccaatcttgtaacactcataggataccatctcagcgattcagagatgtttctaatatataattttctgcctggtggcaatttagaaagattcatacaagaaaggagtaagagaccaattgattggagaatgcttcacaaaattgctctagatgttgcgcgtgcacttgcatatcttcatgacaattgtgtcccacgcatcttacacagggatgtcaaaccaagtaacatcttgcttgataatgattacactgcctacctttctgattttggattagcaaggctgcttggaaattcagaaacacatgcaaccactggtgtggcaggtacttttggatatgtagctccagagtatgcgatgacatgccgcgtttctgataaggcggatgtgtatagttatggagttgtacttcttgaactcatttcagacaaaaaggcactggatccttctttctctccttacgggaatggattcaacatagttgcctgggcttgcatgcttttacaaaagggtcgagctcgtgaattctttatagaagggctgtgggatgtggccccacatgacgaccttgttgagattctacacctgggcatcaagtgtacggttgattctctttcttctaggcccacaatgaagcaagttgttcggcgacttaaggaactcagaccaccgtcttgctaggcctagcaagcggacgcgcgggtgcttctgcataatgagaccaaggtatataaactattttcccaccccttttgctctgtccaactctctcatccaaatagtaacaaattccaattatgattaatgtactgatatgatatttaattatttattagtaaaaatgttagaccattctcttgcacgtgattgtgttttagaaatcatgaacctttgtgaatacaagcgtctatggagatgtgtcccatgtgtgttcctccccaggaagtggaacagagctttgtattcgtttggttcagctgacccaatgaaaatttcaaattctatttgaagttctttaagattagcaaatcacccttccaagcagtgttttcttaaatgctaaaaagtaaatcatcggtcatgtaccgtttagttattctttggtctgaacagtacattaaataggctaaata

SEQ ID NO: 17412 - DNA, 1326 bp, Zea mays
tccagtcagtcagtcgtccctcctgcctccgctcgtcgtccttcttcattgggtacctcgaggccggccgggacggcacggccacagctgactgactcctcctgcgttggccgataatcatggctagagctccgctgctcctcgcgctgctgtgcgcgtgcgccgccgccgccggctccgccaatgcggcggcggggaggaagatggtcggcgtgtacgagctcaaggcgggcgatttctccgtcggcgtcaccaactggggcgccaccatcacctccgttgtgctgccggactccaaaggggattttgctgacgtcgtgcttggctacgacaccattggaggatacgtgagtggtaaaagctacttcggagcgcttgtcggacgagtggccaacaggatcgccaacgcgcgcttcgtgctcgacggaaaggcttaccatcttttcaagaacgacggcaacaacacgcttcatggtggccatagggggttcagtcaggttgtatggacggttaaagagttcgtcggtggcggtgactcgccctacatcacgttgtactaccacagcttcgatggagaacaaggtttcccaggcgacctggacgtgtacgtgacgtaccagctggcggccccctacgtgctgcgggtgcacatgaacgcgacggccgtgaacaaggcgaccccggtgaacctggcgcagcacacgtactggaacctgggcgggcagggcagcggcgacgtcctccgcaacacggtgcagctgttcgcgtcccggtacacgcccgtgggcggcggcctcatcccgacgggcgcggtggcgcccgtggccggcacgccctacgacttcctcgcgccggccgcggtgggctcgcgcatccgccaggtctccggcggcaaggccggcgtctacggctacgacaccaactacgccgtggacggggagcccggggcgctgcggaaggtggccgtcgtccgggacggcgcgtccggccgggcgctggagctgtgggccaaccagcctggggtgcagttctacacgggcaacttcctccaggacgtcaaggggaagggcggcaaggtgtaccagcagtacggcgcgctgtgcctcgagacgcaggggttcccggacgccgtcaaccaccccaatttcccctcccagatcgtcaggccggggcaggtgtacaagcacgacatggtgttcaagttctccttctagccgctctctgtataggcaacaacaccctggtccctggctaatcaatctactagtacctgttatgattgtcactggcaaagtggcaactgggccttattgggactggagacac

SEQ ID NO: 17413 - DNA, 3973 bp, Zea mays
acccgaaatttcaggacgaaattcgggtattttaggttcgggttactaggttttttttttttttgcatagttaccaccctcagcgctccagcggtcgctgtgattcgctgtttgaagccaaagagaactagatgttccagattccccgtagatcgtaggctcgtgcgaggtgctcgccaccggcgaggaggccgccatatctctcatcgcttgcccgagcgacgtgacggtgacgctgctgggtgctgctgacaggtgacgcctgtcctgccaggctgccactgctcaccgccagcgatggatgagaagcgcaagtgctgctctctggtcaggtggccttccagctccggtgtggaactgactctcgtgcttcgtccctgcaaccgcaacggatatgatcgtactcgtacgctgcctggttcaactacagcctgcgcacgacgacgccggcgcgcgttttacttgctcctctgtccacgttaaaacagccgtgtgatcccgtgtcttccgccgcggtcaccaactcacgatcacacgactcctttgccctcgccaacaaccgctttgtcagcggtggatctatccctagaggatttccgcacaacgtgccccggacaaggacaatccgcgggcaacgaaaaatcccgaccgatttccttccgatcggaagtgtggaggcgcaccgcgcacacaaacgctggtcaccatatgcgcggacaactggcgaacgtgcgtactacctgtttccaagcgctgccgctgggccatcgtgcgcagcacgaggtcgtcgcatggacgaacggaatactcgccgcccatgtgccagccaagtagccggcggcctgctgctgctcgcactcgcacgcgacggaagctcgctggatgggcgcgcacgcagcgcagattagcttgcgcttgcggacaagaaaaatgaaaaaaaaacgcgagacaagcggtagcggtggctggcctcggcgtgctgagtgacgagacgacaattcacaatcccagcaacatctttgactgactgactgcatacacccccatccattattccagcagcagcagctgtcgccagtcgcccagtaagtcagtcagtcagtcgtccctcctgttctgctcctgcctccgctcgtcgtccttcttaaggcgcaggccgcgactgggcgcgcacggcacggccacagctgactgactcctcctgcgttggctgataatcatggctagagctccgctgctcctcgcgctgctgtgcgcgtgcgccgccgccgccggctccgccaaatgcggcggggaggaggatgtccgccggcgtgtacgagctcaaggcgggcgatttctccgtcggcgtcaccaactggggcgccaccatcacctccgttgtgctgccggactccaaaggtgcgttcgactttcctctcctcctcctcctcctctatctctctcgaaaagaatccatctatgcatggcagtccgtcccccgctgtacgtgtgcgattagtcagtccagtccgccatcaccaacgtatttactgctctgtcgccccgactcccttcgcaggggattttgctgacgtcgtgcttggctacgacaccattggaggatacgtggtaagctccagcatcacactgctcccgttcttactgacacagccgttattggttttatgtttttgcttatctctgcaacagttttacgaactactgttgtctgcataacgtcgtagtgagccttggacatgcattcattcctcatttccatcttccggatttgcgccatcctttttcagttttgcaaatagtgtatatgcaaggagaagatatatatttatttaattacttggccgtccagtatccggcaaaaaagccacgctgctgctaaccagtcaatcattcataaggccatggctatcagaaagaaacacagccacacggacctatgccgtcgctgtcagtttgagctcagttttctacacggggaggtcccagccagagaaaacaacccccacacacacacaaattttttttttttttttgagatgtgttcgccacgtctcaaccttgtaaagcacagcgggatagaatagaaaagaaaaaggaactctgagaaacgattaggccattagctggatgcagtttcatttctttatgctgggcgccggcagtggccatgttacgcgagagatagcaactagcaagtattatatgaactgtgggaagcagacagcctccaccacgtgatctcctgatctctgcccaagactaattaactaactctagagccaacagggtaaaagttcaaatgcaatctctctctctctctctctctctctctctagcttcatccaaaaaagcatctttgccaaccttttacaattcggttcaataattgcattctcagtgtgctatatagacctatagtacattcagtttctgttctccatatggataagcaactaaacctcctagctcgcttcactcttcagagtggtaaaagctacttcggagcgcttgtcggacgagtggccaacaggatcgccaacgcgcgcttcgtgctcgacggaaaggcttaccatcttttcaagaacgatggcaacaacacgcttcatggtgtgtgtatatatatatgcttgattattcagggctgctgggtggactgaatcgtcgatcgtccccactccattgtaatgccccgtgagagcagtggctgatttctctcttgccctttgtttcaggtggccatagggggttcagtcaggttgtatggacggttaaagagttcgtcggtggcggtgactcgccctacatcacgttgtactaccacagcttcgatggagaacaaggtaacactggatcacatacactccctcagtcgtccagaaaaaacacatctttttttctttccagaaccaatcttcagtttaaccaaacactagctactccctccgtcccttcttcgacaaaatttccaaactttgaaaccccggacacggtcaaatctgtaaacatcagtactgctatgtattcaaggtctgacgtatattgccgggagctgaactgaggggaaaaaaaaactgaaaacgccacgcgtgcatctaattaaacgccccttctgtggatgtgcgtgtggtgtggaacaggtttcccaggcgacctggacgtgtacgtgacgtaccagctggcggccccctacgtgctgcgggtgcacatgaacgcgacggccgtgaacaaggcgaccccggtgaacctggcgcagcacacgtactggaacctgggcgggcagggcagcggcgacgtcctccgcaacacggtgcagctgttcgcgtcccggtacacgcccgtgggcggcggcctcatcccgacgggcgcggtggcgcccgtggccggcacgccctacgacttcctcgcgccggccgcggtgggctcgcgcatccgccaggtctccggcggcaaggccggcgtctacggctacgacaccaactacgccgtggacggggagcccggggcgctgcggaaggtggccgtcgtccgggacggcgcgtccggccgggcgctggagctgtgggccaaccagcctggggtgcagttctacacgggcaacttcctccaggacgtcaaggggaagggcggcaaggtgtaccagcagtacggcgcgctgtgcctcgagacgcaggggttcccggacgccgtcaaccaccccgatttcccctcccagatcgtcaggccggggcaggtgtacaagcacgacatggtgttcaagttctccttctagccgctctgtataggcaacaccctggtccctggctggctaatcaatctactagtacctgttatgattgtcactggcaaagtggcaactgggccttattgggactggagacacacgttacatgattccaagtcaatttgttttgcggaccgtaattaatgtttttcgctatagattatgtattaaccaaaaaaaaaaaaaaaa

SEQ ID NO: 17414 - DNA, 1349 bp, Zea mays
ttgggtacctcgaggccggccgggacggcacggccacagctgactgactcctcctgcgttggctgataatcatggctagagctccgctgctcctcgcgctactgtgcgcgtgcgccgccaatgcggcggggaggaagatggtcggcgtgtacgagctcaaggcgggcgatttctccgtcggcgtcaccaactggggcgccaccatcacctccgttgtgctgccggactccaaaggggatttggctgacgtcgtgcttggctacgacaccattggaggatacgtgagtggtaaaagctacttcggagcgcttgtcggacgagtggccaacaggatcgccaacgcgcgcttcgtgctcgacggaaaggcttaccatcttttcaagaacgatggcaacaacacgcttcatggtggccatagggggttcagtcaggttgtatggacggttaaagagttcgtcggtggcggtgactcgccctacatcacgttgtactaccacagcttcgatggagaacaaggtttcccaggcgacctggacgtgtacgtgacgtaccagctggcggccccctacgtgctgcgggtgcacatgaacgcgacggccgtgaacaaggcgaccccggtgaacctggcgcagcacacgtactggaacctgggcgggcagggcagcggcgacgtcctccgcaacacggtgcagctgttcgcgtcccggtacacgcccgtgggcggcggcctcatcccgacgggcgcggtggcgcccgtggccggcacgccctacgacttcctcgcgccggccgcggtgggctcgcgcatccgccaggtctccggcggcaaggccggcgtctacggctacgacaccaactacgccgtggacggggagcccggggcgctgcggaaggtggccgtcgtccgggacggcgcgtccggccgggcgctggagctgtgggccaaccagcctggggtgcagttctacacgggcaacttcctccaggacgtcaaggggaagggcggcaaggtgtaccagcagtacggcgcgctgtgcctcgagacgcaggggttcccggacgccgtcaaccaccccaatttcccctcccagatcgtcaggccggggcaggtgtacaagcacgacatggtgttcaagttctccttctagccgctctctgtataggcaacaacaccctggtccctggctaatcaatctactagtacctgttatgattgtcactggcaaagtggcaactgggccttattgggactggagacacacgttacatgatttcaagtcaatttgttttgcggaccgtaattaatgtttatcgcaaagattatgtattaaccaatccaaaaaaaaaaa

SEQ ID NO: 17415 - DNA, 818 bp, Zea mays
  misc_feature (698)..(698): n is a, c, g, or t
  misc_feature (721)..(721): n is a, c, g, or t
cgtcttcccccgcgcccctagatccttcggacgccgccctccctcagctcattccctgccgccgctcatctgctggccttgtctcactgccgcccaaccattttcctccctcaagctagcacgcagcctcaactcctctcccacctcacgcacgtctctcccagccgttccttcatttctctggctcgtccttctccatgaggtcgcgccctgctgcgccgtcgtgctggtcgccggctgagcccccttcagtgcctgacgccgcatctccctggtgctcacctctgtttccccctgcgttggacgacctcgcactccctccctgctccagatttctccatggtcgcccctttccttgccccgggtggcgagctcgcccctcattcctgctcgcctaatctccacttccctgttgcagccacctcccatggacgccagccctcagccatggatgccgaaccccctctctttagtgcctttctttacagcccctgcgtcgccgtgcgtgtaaggtgtttgtataaatgctcaagaggagtgacgtgtcatggccaacccttttggcgtcgtcggatgtttgatgttttgcgcatcccgtctacgacaccgtcgtccatcggtgaggattcgttcttgctttgtcgtttcatcgatcgacgtctatttgctaatgtgaatttgtgtttatgtgcctatgntgtgttgaggagcgaaacccgtngaatctaggtgaagagagacggagcacgtcgtcgccatgggtgcagctttgcctttttgtcgtcgtggagcctccaccagtggcgtgtagcattcag

SEQ ID NO: 17416 - DNA, 3744 bp, Zea mays
  misc_feature (2096)..(2096): n is a, c, g, or t
  misc_feature (3462)..(3462): n is a, c, g, or t
  misc_feature (3541)..(3541): n is a, c, g, or t
tacttatttattgctcttaatgctcctaaatgggttatcaaagccattgataaaattcaacggaacttcttgtggaaaggaagaaaggaggctagaggaggtaattgccttgtagcttgggataaaatctctcggcctcttgatttagggggccttggaattcctaatctccaaaagatgaactgggccctacaattgcgatggctttggctacaaaaaactgctccttcgaagccttggagtggcctggatcttaaaatatcttcccaggcccgggctttatttcagatagcagtgactaccaccattggtaatggtatttcaactttattttggaaagataagtggattgttgggtattctattgtggatatagctccccttattgctgctgcagttccgatgaagtttaaaaaagtaaggactgtgcagcaggccctcacctctcatttctgggttcaagatatccagaggaatctctccctagctgagattgagcaatatctacaattatgggaggtaattgaatcttttcagcttcaaaattcaaatgatcagcatgtgtggatatttagcaacgatggtctgtacacctccaaatctgcctataaagctttattcattggagcagaatcctttgagccctggaaaagaatttggaagagctgggcagcgcctaagtgtaagacctttgtttggctggccataaataacaaatgttggacagcggacagacttaaaaaaaggggacttcagcatcctgaattctgtgttctatgtgaccaggaagacgaaactgtgcagcatattctatctaattgcgtcttcacaagacagttttggcataatattttaacccccattggtctctcttctgtgggtcctaagagaagagattcagtttttgctgaatggtggagaaaggcttcaaccaagattcctaagagcaaaaaaaaggggtttaatagtatgataatccttggggcttggagtatttggaagcagcgaaacaggtgtgtttttgaaggagctcgaccctgccttaataccttagaggatggatttaaagacgagatgagattgtgggtttctgctggagccaagaacttgcgctctctttttgaccctggatagagaagggaaagtcttacagcctattaaaagacgggggtgttggggtgtcgtatgtgtctgtgtggtgtgtgttttgtaagggtgagtgtgtgtttgtgttgtgtttgttctgtttgtcccgggccacaggccctttttccctctacttcaatttaatgatacgcagccctcctgcgtattcgataaaaaaagtcccaccaggatgtacgagacgagttctttatctatgttctttgtagacgccatctcatctgtgcaagagattttatcttggtaacatatcctagcatagtcatgttaccttttctggttgttgttagggtgatccttgtgtccatagtccttgccctagactgcaacacacaggtcttctcgagctcagactacacctctctaggggtcttgtaggttgaaactactgttgactcgtgacttcttgagtcatgggggtcatgaggaaaccgatgacttgctgcacaagcgccgcccactgggtgtactccagattgggttcccctgatgaattgtcacatttcctggtttaatcttctcttctggtgcaacagccgagccatcgaggcagccctgcagctgcgcacccctgagaataggtagagcttgcgccttctagagcgctaagttgttcttcataagcttcaccgtggattgccctaggtggggcgttggcactatagagcttgaggtagatgtcatggagacttgcgtttgcctttggctagagttctagaggtgggtagagctggctttgactaccatgtaagaaaacacgacaccaggtttaagctattcgctcggatctattgggccaagggggtctgattatatataggacataattgattacaacatgatagagtcattgcacatttctatgacagatcaaacctgattctatcctatctttaatccgagttggttatggtcttcttcttttatagaanaactatattgacctctgatctgagatgaccgtagcctgatatacaagcacattctattctaacatgtttcacatatgatttgcagctcagtttgctagagtcattgccatcacttgctatacatggttttgttcttccactagctctgcaatggatatcgccaatgcttaaaagggactcaaattcgtaagttaaatgcactaatcacaagcgggcccaacttcagtttctttttggttcttatttgcttggcctactgagctttgttgccttgttctgagatatactcctatagacctgtcttcggttccatttctccatttatatgtgaacatgaataaaatccatccttttatttggtattggagaaaaaatagagttaagcattcagataatataaaaaacacatgaactggacaatttctgaaaatttaagaacaaacaagagcaaatgtagattgatgttggagaaaaaaatagacttcagcgttcagatcatatcaaaaacacatggagtggacaatttctgaaaatttaagaacaaataagagccaatgtagattggtgcaggttacatttattttatggaaaaatacaacatctgtatttcaatcataggtagacgttttttttttctaaaaaagtttacaacatggtttttaaagcggtatggcgagacaaggtgttggaccgccgtctggacgcctagacggcgcctaggcgaggtaggcgtgcaaggtgcctaggagatgaatcgccgcctggacgcctaggcgttgcctaggcgacacctttaaaacagtggtttacagtgctctactgtagaactgaaagttttcaggattcaccgattcagacactatctacattaagatacaaaaatttgtacagaactgtcaacatataataaaaatgagaaaattgcgagtatctggctgaatagtatttagcttatggatgttgcattacagcattagtctgatcatcacgtttagaaataagtatcagtttatacgactgtaaatgctttgttttattgtaaataaagcaaggggaaaaatattgtattccttgcttgctatcttattacatgagtttcgtgcagggttttgtatgctatggctgttcgattactctgcaagatatgggctgtaaccgactgggcatttccaaacttacaagtaagaagtaagaacacattttttattggatgttaaaacattgttttttctaattctgagtacgaaaactaaagtgaacagttaaaatatttgtttcaaagctatctcttaactgttatgttgaaaaaattgttcatttgttttcaaacatgatgtattttataagaagtaatcattctatctcnctagagttttctatgtacttcattccacaacataagttgaaagttgacaccttgggttaaggcattagttgaaacccantgtagagagaccaatgaggcaccaaaatcaatatgtaggccacagaccttgcataccttgagtgacatgctagtatgctacaacagtacaactgatctcattcacataattaaaataggaaagcatgttacgagtgtgttacgattgttatgaattagggcactaagctcgaatatatacaccaatacatgatagagacagta

SEQ ID NO: 17417 - DNA, 1107 bp, Zea mays
aggacttcgttcctatctcgtgctcagcgttatcttctccgtggcgctcatctccctgatattttcactgcgccgcggcttccagcgctcagcctccagctcccacgcgcactccacctcgtccatggccgccgatcgagtccctccccatctcctacaaccggccgccctgctcgttctccctagctgcgatgtggagctcgccctggacgatcgtccttgcccctcctctctgatctgcgtgcaggggtttccctcccatggcgcctggtcttcttcccttgactccatgccgagcgccccagtcgagctcgtcctggctccagcttcttccttggacggcggagccctcccattcctgcagcaggccagcgtccctctctccatcatcttctctgcttggttcctggcgagctccccctgctcttctgctcgccctggccctgtgccatttttccattcctgcggcaagcaccagtccctccccacgccaacatccctttcctacggacgctgcccctctctggtttctggtggccggccacctctgctgctcccatggtgatctataaatccttctgttgttttactagtcttgttaataccctgctgatgtgaagttttatgtgtgttgatgtgtgcgatatggagtaaaatccctggagaattaggtggaggagaaggttaagttcaacgctccttaggtgttctatgaagtgcttgaactgaagttcgttgtcgttctgttcaccgcggttcgttaattgatcacgtgatgcggacgacaagagccgagttgatcccaaaatgatgctggtgaacgaacctgaagcttggatgatctggtcaagtaccaggatgagagatgctccccaagcggacatcatctaacaacactgacttagtgttatctcagacaagccccggtgcatttgccacctccttctgttttaaaaacttttatcacttacctgctgcattaggtgataggagttgtgcgaataaacaattgatgcattatcattccttggaatttgattatcctccttgctaaaaaaaaaaaaaaaaaaaaaaaactcgagcccggaaaaaaaaaggggcggccgc

SEQ ID NO: 17418 - DNA, 714 bp, Zea mays
  misc_feature (697)..(697): n is a, c, g, or t
tgtcatggacacccctattagcgtcgtgggatgtttggtattttgcgcagcccatccacgacaccatcgaccctcggtgagatttcattcttgctttgtcgtttcatcgatcgacgtctatttgctaatgtagattgtgtttatgtgcctatgtgtgttgaggagcgaaatccgtggaatctgggtgaagaagaaacagagcacgtccgtcgcttactagctgctgggtgaaaggattgaatcggctgccgtggtcgtttagtgccgatcgagtcaactttagtcatgattcgctaattgatcacgtgatgcggacgacaagagccgagttgatcccaaaatgatgctggtgaacgaacctgaagcttggatggtctggtcaagtaccaggacgagagatgctccctaagcggatgtcatctaacaacactgacttagtgttatcccaggttgtaattttgttctgttgtggatggtgctaagtgccggtgggctcggccttcttctataagtatatcccgtctttagtttctctattgaggattgtcacttaagttaacatgtattttaaaacttataaatattttatacattttaaattgtaattctatttaatcattttcttttgtaatcactccgataattgtataatgtaaacttattgtaacatgtaatcattttgcaataaaaaaaaagnaaaaaaaaaaaaaaaaa

SEQ ID NO: 17419 - DNA, 891 bp, Zea mays
accttatcttctccacgccgcccgtcgttcacgccgctcaccacgagcctggcttcttcacgtcacctcctccccacacattttccctctcacctctcaatccatggacaccctccctgctctgatccctccgatgctcgccgtgggtgccgtttgctgcccctacgccaacgttggctgatgatgctccctgcccgcccaccattcccctgcgtccagccggtacctccgccgagcctctccttccctgcacctccccttctatggtgttcgcccaacctccacttccctgttccagccatctcccatggccgccccaactccttccatggacgccaatagcagcagcccctcgctgccggacatcctccggtagtcccgcaccatccgcacccgtatggtgtttgataaaatgtccaagtgaagtatcgtgtcatggacaaccctattagcgtagtgggatgtttggtattttgtgcagcccatccacgacaccgtcgaccctcggtgaggtttcattcttgctttgccgtttcatcgatcgacgtatatttgctaacataaattgtgtttatgtgcctatgtgtgttgaggagcgaaatccgtggaatctgagtgaagaagaaacaaagcacgtccgtcgcttactagctgctgggtgaaaggattgaatcggctatcgtggttgtttagtgccgatcgagtcaactttagtcatggtgagctcttaggctatcctcgctagttagcgtgtatggtggattgattaggatatgatcgatgattcagtctagtgataggtgtgatgatatattgtatgaaatatgcttggtgaatatatatgcattgatatgattgtgttaatcaatcataaaggatagagttttgtct

SEQ ID NO: 17420 - DNA, 1381 bp, Zea mays
acactcctatggttgggtccctcgaggccggccgggccgggcccctcctgtctccgtcttctcaccaccgctgcctccgcggtttcgcttccccccgtcttcccaagcctttgcttcgctcttcgcttcggattccctctgctcatggccgggagagggaaggcgatcggctcaggggccgccaagaaggccatgtccaggagctccaaggccgggctccagttcccagtgggaaggatcgccaggttcctcaaggccggcaagtacgccgagagggtcggcgccggcgcccccgtctacctcgctgccgtgctcgagtatcttgctgctgaggttctcgagcttgccgggaacgcggctcgggacaacaagaagacccgcatcgtcccgcgccacatccagctcgccgtccgcaacgacgaggagctctcccgcttgctgggcacggtgaccatcgccagcggtggtgtcatgcccaacatccataacctgctgttgcccaagaagtctggcggcggcagtgccaaggctgcggctggtgatgaggactagaccgaccacgcctagcctttcatccggtggtggcacctcttgtggatgctgccgtatcaacttgtgcctgtgtagtacgctctagaaatgccttaggtgttgcgttgtagttcgggatgtgtctccctgtaccactgccaaggattagttctgtatattttgctataaggagtgcatcctttggacgacctgtttatcaatcctggtatcccagtttgcatttcgtgtccaaatcttggttagtccatttgaaaattctgaaaatgccggtgagtggcaggttttctgatttgtttgtgagactggctgtggctgctcgttggaagaatatgatggccactgttagattagaagtctcagcaagtggtgattgctgtggatgcgaatgtcggatcattcagcgaacttaacgctttggcatgaaattttttgttcatgatcgttgtgttcttgaagtttaagtgtcagtggtcagtggatatagtggcaggtatcacgaggtgcaatgaagttttatgctgtcagttctgaatttcacttgcccagagaatttgtaacaatgctgtgccgggagacatttggaaaattgacatcaacttcgcgaagaacactttggttatggctatggcctgaactaaccttgggcatatttccagccctctagtagatggataaagccaacaacaaagcactctgaagttttttcacccagagaaggctctcaagttctatatttcctctcagaacgaggctaatcagaggcttatcacaatccttatcctgacctagtcgaggaccattcagctgcaggtgactctaagggtccggg

SEQ ID NO: 17421 - DNA, 813 bp, Zea mays
gggaccctcgaggccggcccggccgggggttctcctcctgtctccgtcctctcaccaccgctgcctccgcgctttcgctttcccccccgtcttcccaagcctttgcttcgctcttcgctgcggattccctctgctcatggccgggagagggaaggcgatcggctcaggggccgccaagaaggccatgtccaggagctccaaggccgggctccagttcccagtgggaaggatcgccaggttcctcaaggccggcaagtacgccgagagggtcggcgccggcgcccccgtctacctcgctgccgtgctcgagtatcttgctgctgaggttctcgagcttgccgggaacgcggctcgtgacaacaagaagacccgcatcgtcccgcgccacatccagctcgccgtccgcaacgacgaggagctctcccgcttgctgggcacggtgaccatcgccagcggcggtgtcatgcccaacatccataacctgctgctgcccaagaagtctggcggcggcagtgccaaggctgcagctggtgatgaggactagaccgaccacgcctaggctttcatccggtggtggcacctcttgtggatgctgccgtatcaacttgtgcctgtgtagtacgctctagaaatgccttaggtgttgcgttgtagttcgggatgtgtctccctgtaccactgccaaggattagttctgtatatgttgctataaagagtgcatcctttggacgacttgtttatcaatcctggtatcccagtttcgcatttcgtgtccaaatctgggtcagtccaggcccctattctgaaaatgct

SEQ ID NO: 17422 - DNA, 3782 bp, Zea mays
cggtttctgtttttgatccctagttaaaaccacccgaacaacattcttgttctgttttccaccacttcgacttcgagatcagctggagcctggagcagcagctagaattgaacggttttctttcaaattcaacccgaattcgcggaattgttaaaactttgactagtaggcaaccaactagccgcacagttatccacgtcaccgcgaaatcagccaaccaataaagaatacgtccggcattatcctcttggtggccccagcagtatttcaacagcaacagcgcccatgttcccttcaatgcttccaatccttggtctccagctccgcctcgcgtcttcctttccgctgcaggaaagtgcaaacccccactcaacgcgactaaaaaaagccgcaaggcaaagagaaaaagcaacgcgaagcaaaccaccatttcggcctccccacccccatcccttcccctccgaggctccagggacggcgtgatgaggccagcggcgacggctgaggcggcggacgcgcaccagtcgcggctgctctacgagctctgcgcgctcctgctgaccgtcctccgagcatcgccggacgacggggcgggggcgcggccgctgctgccgcggcaggtgacacctgccggggtggcgtccatgctgctgggcgcgtccatggcgctgatgctctgcggctcggtcaccttcatgctcggattcttcctcatgccctgggtcgtcgggctcggcttcctcttcctcttcgtcggcttcgtcaccaacctctccgggatctggagggccatcctcctctggccctccgccgcgtgctctcccaaggaggcatcctccccatgtacgtgatcacgccgatttacatgtttggggacgaaacgaccccacttgcccccttcccttactgtatgatttgagggggtgctcaatatccgaacccagtgaagaattcgacgtgattcctgttgaacacgagagtcggtcgttttcgtttactcggatcggggctagttgcgccaaatttggcatccttcgcttagattttgatgaagcaccggactaagtttttgggggcgcttgaaatttctgtggatgttgaagctggaataggttcttgctgcaagtgaggaataagacagttctggatattttagttaaagagggcatcagacgtggctatttgatttccagacgatgtgaaaagcctccaggaattagttcgagatcgcgtatacctcacttttacattttctattgcttggctaacaaaactagcttaggatttaagtgcccggcaccgcccaacccatggaaacagaggggaaaagtggtccagcaagtgatggccgctgcctgttgctgcaagccattgcgagttcattctgagtgtggtttagacgtctagttctgtaagttagatccggaaagattgtgataactgtagttgattgtgataactgtagttctgtaagttagcttaggtaaagaaatatgcatgtgaagtcaaaaaggtgaaatgggaattctattatctggttgcttagtgcaagtcaaaattctagatcaagggggaaaagaaaaccttcgtatatttattcattcatgctgatgggatcacgggagacagggatggctccttatgaaaaaaaaatgctttcagtgaaggcaatattaggtaggattcatgattttgcagaacaagagctctcctggactcttagctaaagagcagaaaagcagcagacaagtggggctcgtcctgtaccatttccttttcaacatttcactatcaagctgccatatattccaatgtggacagaatattagagatacaagactgacataagcgtacaatttaacctcagtatcatcaccggcctcgactatctctagactagaattattattatatttaagcaagtgataagtctatagtctatttttttcttcttcttttatgtacaaagcagatagactaaccgtgccagtcctacgtgaactggtactaccatctagaaccactccacgtcggtggacttacattatctttatattcccttagtgccagtcctacgtccttgtcattgtacagagaatttatacatgtttcacttgtttgggtgtccagcacagcactgtaaatatgacctttggtgttgtctacttcttgcagggcatatacttcccaagccttcattcatgtcgatgtgaatgaaggcaatcacaaagccgggctcccacggaggtgtatagaaacaggggaattcgagcagactgttttgtctttggcaagcctatattttccttcctggacaaccttttcttttttaccatgtaaaacgccgcagcaaagtttggaaatggttttatactgtggggctaggaggatacttgtctgtacatacggaaaagatgatctggtctaaacatcacgtggagcttgtaattgtttcagaaacgttgttccttggcaaagaaaacgagaggtcccgtatcgctgttccaccagtgagcttgtgtcgtctctccagtattgctgttccactgggtgtctcacctgaatctaccgttatgctccgactttgcttatgtttggactttgagaggagtggatgcaacctccgagaaattatttttgatatttaaagttttgtaatacgagaaattagaccataagtgaatatttataagaaaaaaaacagaataggtaggtcctatgggagagaggagagggtaggttcgggccgctctagcgttggacttttatcctagttaaccctctcaatcagatttaactccggcgatacgtccacagacttaccgccgccgcctccgagctcctggagaggcaatggagaatttttgtatggtatggtctgcagcttcgtctgttccggtttggatggggcggtacgagtcactcatacccgtaggcgtagagaaggcgtgctttcctcaccggtcttgacagaaatcttacgcgtgagctttcaccatctggctttatgcttgtgatgttacgcaacgaaactgcagcgaccgtgtgtcttgtcgcccacatcaactgtctcctgtcctaaacatctctaacaatcccttgcttaaacattgcctaacccctgcccaaacccagcaagcgcaacagaccttgaagaaagttctccctcgaattcttcctgagcaccaaaggggctatctataatgcgaccacgttcgctcgtgctcccatgtcccagacctgctagagcaggagagccaccgaggcccccacgaaagaaaacgattggggtcaaaaagaaaaaagataggtggtatggcgacggaagagttgtgccctgccacacgaaaagctctacgctggtaggcgccggtacgggcatcatcacgccatcacccaccgtcaagcaacaaacaagtcatccaaggtgtcttcgttcttccagatacagtcatacagaaatctggcgcattcgacatggagttctcagaacgtggaaaactgaaagagctcctttgatctgtaggggaaaaaaaactataagcggctggttgaagcaactaactagcataccctctctatcttcccttgaaatagaaacatctctctgtttacactcgtttggaaacatccagaaacaggtgcctccggggcctctataaaaattgtattgcacgaagaagaaaaaaacagtttagggcccgtgttggagccaaaatgagcggcggatggtccggtccgcgcaagcgcagaacagattagggttctcgatttttttttgc

SEQ ID NO: 17423 - DNA, 968 bp, Zea mays
gagaaagacggtaggcccatggccccagcagtatttcaacagcctcggcgcccgccggcccggcaatgcttccaatccgcctcgcgtcttccttcctttccgctgcaggaaagcgcaaacccccactcaactcaactaaaaaaagccgcaaggcaaagagaaaaagcaacgcgaagcaaaccaccatttcggcctccccacccccatcccatctcatcccctccgaggctccagggacggcgtgatgaggccagcggcgccggctgcggcggcggacgcgcaccagtcgcggctgctctacgagctctgcgcgctcctgctgaccgtcctcggagcgtcgccggacgacggggcgggggcgcggccgctgctgccgcggcaggtgacacctgccggggtggcgtccatgctgctgggcgcgtccatggcgctgatgctctgcggctcggtcaccttcatgctcggattcttcctcatgccctgggtcgtcgggctcggcttcctcttcctcttcgtcggcttcgtcaccaacctctccgggatctggagggccatcctcctctggccctccgccgcgtgctcgcccaaggaagcatcctccccatggcatatacttcccaagccttcattcatgtcgatgtgaatgaaggcaatcacaaagccgggctcccacggaggtgtatagaaacaggggaattcgagcagactgttgtctttggcagcctatattttccttcctggacaaccttttctttttaccatgtaaaacgccgcagcaaagtttggaaatggttttatactgtggggctaggaggatacttgtctgtacatacggaaaagatgatctggtctaaacatcacgtggagcttgtaattgtttcagaaacgttgttccttggcaaagaaaacgagaggtcccgtatcgctgctccaacagtgagcttgtgccgtgaaaaaaaaaaaaaaaa

SEQ ID NO: 17424 - DNA, 1149 bp, Zea mays
tcagaatgcttaattgtattgccgaagccactggtaccttcattcctgtgtcctccctgctgcttgatatgcttgaaatgaaagaacttagaggacgtccagatgggggtggccaagcccgggatttggtccggggttaacaggttgacaagaaaacagtgaagacacgtgcctttcaggaagcttgcatttattctgtggtcgatgagctggctaaacatttgacccaatggagctactccattgccttctttgagatgtcctttattccacttgttcggctccgaagtttttgcaaaaccattaaagcggacagatttaggaaagagatgaaggatcttatctatcagatagaggccaatgtcgagttcattaagtcaaaacgagtggggattgcattttcacccaatgacccagctgtagagtcatttctgcagaccgaaaaggaagaacgttgcagccctctctcaaaatttgttgctactttacaccagagagcgcaagacaggatggatgctctggatgagaccagtgtgattgtgggtgccgagtcctcaaccttctcacggaggttatcagaagcgcagaagcaacaggatgagcaggacgatgatgaaggcactatcgctttcagtaagaactggctgtctgaaaataagaaacccaaaaccccaaaggaggataaaaagcgaccccgggaggatgatgatgtcgcgactgaggaggatcgggttgaggatttggtcttgagctcagatgaagaggatggcaacaatgaggaagcagacgatggttttgttccggttgaaggtgatagtgatgaagactttgtagaccctgacagcgaatataagaaacaaaagaaggcgaagctgaagaagaggaacaagcgccagccatttctgcacaaggcgccctcgagaacaaaaagtaattcagggcccaagaagaaggccagacattagttatgcctgatagggcttggcaaatatgctgccgttgtgatgtatgcttctgagttccgaccgataaaaacattgtcccttgagtggaaaaattattatattttttcaagaaaagtttcaagtctttttttgaccccaacaaaaaaaaaaaaaaaaaaactcgagactagttctctcctcgtgc

SEQ ID NO: 17425 - DNA, 1174 bp, Zea mays
cccgctagctgtctagttcatgacctgccgcccatgtctctatttatagcactctacgtgccacacgccgcgatctatcggtgtgcttatgcgtaagttcgtgcatcggcgcacgtatggctcctaacacctccttgctcgtgctcctcttcctcctgcccgccgccgccaccgccgccgcaccggctaccggcaacaccgccttcaacgtgacggagatcctcggccggtacccggagttcaagctcttcaacctcctgctctccaagacccgcgtcgcgcgcgaggtcaacagccggagccccgtgaccgtgctcgtcccgggcaattccgcggtggactggctcctccgccgcagcgccaggctgccgcgcgccgcgctcgtggagctcgtctccgtgcacgtcgcgctggactacatcgacgcggccaagctggcgtcgctgccccggggccagcccaccgtggtcaccacgctgttccagaccacggggagcgcgctcggccgcacggggttcctgaacgtcaccgccgcggggcgtggcggcgcgagcgccgtcttcgtctcggccgcgccggggtcgctggtcagcgccacgttgaagagggccgtgaccgcgaagccgtacaacatatcggtgctccagatcagcaacctcgtcgtgccgccgggcatcatcaccaggccgcggctgccgctgccgccgtcgccgtcgccgcccgcgccaaggatgacgcagatggcggtcgcgccgagccctccgccgacgttaacttcgccgcggcaatctccgtcgacgttgttaccggcctcagtgggcgataccgcggaggctccggacactgctgaagcgccggtgccgtcgcatggccatgtggcgcaagtggcgagttggtggactgctgcggccgtggggatggcaatggcatgcatactgatcgggtacttgtaggtcactgcatttgcaaattgcaactggttcggtcgggtgggaattggatcgtcccttgcattttataagagtagttcattttgcgcgccatatatatagttaactcttatggctcattttcttttgtcgatctttccaaaaaaaatcgtttccttgtattattacgcttcttggaattataaagagtagaagaaatacaaaggccaaaaaaaaaaaaaaaa

SEQ ID NO: 17426 - DNA, 1240 bp, Zea mays
ctactgaatgttagtatgagttggtcaccggccctgtcagttatacattaccattccatatgctgtacccttgctactaattttgcagtacctgatttccgtggagatccaagctgcgtagagaaggttgcgacttctggattgcatgtttttgcgcacaacattgaaactgtggaagagcttcaaaggaatgtcagagactaccgtgcaaatttcaagcaatctatagatgttctggaaatggcgaaagagtatgctcctcccggtacccttacaaagacatcgataatgctgggatgcggggagactccagatcaggttattaggaccatggaaaaagtgagggctgctgatgttgatgtcataacatttggccagtacatgaggccatcaaaacgtcacatgcctgtttctgagtatgttacgcctgaagcttttgagaagtatcgggcccttggtgtcgaaatggtatgcctatctttctcgcatgtatatcaatgttttatcaatcctgatgcctctttgttcgacctatgacgggtaagacagtctctgggtagtatattaaggttttttttaaccccgctctgaaatgattattggacatcattgtttggcagcttagaatgctgcaaaaggaagaaccataaatagcatttccattcctttttgtgattctatcttagtaatccaaacatagttgtgctagcaaaacgaggctttagaaaccttcgttttttcacctatgctgcagcgtcggttcgtttgtaggcttcattacttgtcatcgttcttatcggttcctagaatctctcatcgtcaccgagcttcaagcacagagtcgttttccccgcatctgcttgtatttagctggggggggggggggggggggggggttgctgacagaaccgccttatcttttgttgcaaatggcacaggggtttcgctacgttgcgtctgggccaatggtccggtcttcgtacaaggcaggtgaattctacatcaaggctatgatcgaagcggagcgagccaagggaaccgctgcagactcaagtgcataaccgagatagcaccttccggccccacccaccccttgacttggttgtgctgcaaataagctcttcactgcttttgtagtcagagagacatgtcgattttttacgtcataattgtaaccacacattcacttctattttttttgtcaattgaacagttccggcgccttcgtgccttgtttcat

SEQ ID NO: 17427 - DNA, 3974 bp, Zea mays
  misc_feature (4)..(4): n is a, c, g, or t
ccgngccggggagtgtagtgggaaggcgcgaaccgcctcccccgccttttttttaagctgaatccccatcttcgcccgccgcacctcgcctgaatcgctcattcgctccccaccccaacgctccgtccccgcggcccaccaaccgccgccgccgccgccacagccatgcacggccgccggcacctcgcggcgtcccttacccgggccctgatccaggcgccatcccgctccatctcctccaccccgtctctcctccaaaccctcgacccctcagtgccgtcgcctcccgccgcgggagcagggcggctcgcggagctgcggcggcggctgcaggcggacgcgccgtcgctgggtgacttcacgtactcggtggaggtggggacgcggcagcgcccgctgcccaagcccaagtggatgaaggagaccgtgcctggcggcgccaagtacgcggccatcaaggccaagctgcgggagctgaagctgcacaccgtctgcgaggaggcccggtgccccaacctcggcgagtgctggtccggcggcgagactggcaccgccaccgccacaattatgatccttggggacacctgcacgcgcggatgcaggttctgtaacgtcaagacatctcgaacaccccctccaccggatcctgatgagccttccaatgttgctcaagctattgcctcatggggccttgaatatatagtaatcacgagtgttgaccgggatgatctacctgatcagggcagtggtcactttgctgaaacagtacagaagctaaaggctttgaagccagaaatgcttattgaagcgcttgtacctgatttccgtggagatccaagctgcgtagagaaggttgcgacttctggattgcatgtttttgcgcacaacattgaaactgtggaagagcttcaaaggaatgtcagagactaccgtgcaaatttcaagcaatctatagatgttctggaaatggcgaaagagtatgctcctcccggtacccttacaaagacatcgataatgctgggatgcggggagactccagatcaggttattaggaccatggaaaaagtgagggctgctgatgttgatgtcataacatttggccagtacatgaggccatcaaaacgtcacatgcctgtttctgagtatgttacgcctgaagcttttgagaagtatcgggcccttggtgtcgaaatggggttccgctacgttgcgtctgggccaatggtccggtcttcgtacaaggcaggtgaattctacatcaaggctatgatcgaagcggagcgagccaagggaaccgctgcagactcaagtgcataaccgagatagcacctcccggccccacccaccccttgacttggttgtgctgcaaataagctcctcactgcttttgtagtcagagagacatgtcgattttttacgtcataattgtaaccacacattcacttctattttttttggtcaattgaacagttccggcgccttcgtgccttggttcatcctccctctcaagtccaagaaaaaaaaagaggtatttgttgtagcagtatatttaggcgaccgcttcctttgtatctcgctcgtacagaacatgaatacagggcgtggggtttctgtgccgttggtagatccaatctgccgcagatctgaatcagatatccagatcacacacacacacaagaggcagacggagcttgcaggtagtgcggaaatcctggagcactccgcgcgtggctgggacggagtcaatttgaccatcttttgcgcggtcaaccgactcgacatggcaaaagcaggaacgctgctgccctgccactggctcgtacgtgaacgatctgggattatggctggatgatcgtccgtcagatggccgtggcccccagtggaggaggcagctgggcagtgttgcttgcaataatgctaggaacatgtagtgatgaaatgtggtgttgctgttgctctcctaattgaatctgtcgacatccccatccaaggcgcgagtgtagtgtaggcaccccccaccatctcctccggccactgcaaggagcaggcagtggatccgggtcaaccgagcactagaacgctcgctcgcccccccgaatcacgcgactggccggagttctccgagcgcgaatcaccgataagaacacgtttaacatcgtctccagagtccagagcggggggaaaggcggctgggcctgggagagtccccgtctgcttatccgatggatccgaggtgtaatacaactagttcggaaccgcccgtccccatctgcttatccgatggatccggtgcggacgtgcgcaatcagtctacctcccctgcgtccatggccgcctccccccgcataattaaccacacatctgctaaccccgcataataattaacgatatcggcctcgcaatttgatgcggcgcatccttatctgcccatcggctagctgatcggtccccgtcactgctccaatggccaaatcacccttgacacgcccaagggttcacgcggggatcaaagccaacaccccccactaccactacaaggctggacgaatcgcagcccactcggctggcctggctccatcgatcgatcgggcggtccctcgagaaagcgagggccgtttccacgagcgcagagcactcgtgtgcgcgtgcgtgtctgtccgcctatatatcggagccttgcgcatgcaactctactactactactactactactccacatcagctcaaccctacccagcgctagccctacgaaccgcagctgagtattcaactagctcggacgaccagcagtgctgctgcgtgcgtacgttgctgttatagctagccactgccccctgcaagaagcgcgcaaggcataacataaccaaccattcatggccggatcgagggcgcagccgagcctcgagttgagcgtcagggtcgtcagggtggacggcctagaccaagagcagctggagcgcggcgggaccctcttcctgaggtactacgtgccggcaggggacgggcggcggcggctgcgcgtggacacgcgggaggtcccgtgcggcggggacctgcgctggggcggcgagctcgcgcgcttcgagcgccgtggtggcagcagtggcactggcggcgcggcgccggccggggggatcgcgttcgagctgcgctggaggccgcgcccgtcctcgtccgggctggcggcgttgctgggggccggggcacgggcaaggaggccgtcgtcgcggctgctggcgcgcgccgagctcccgtgggccgacgtgtcgtcgtcgcggccggcggagcggtggctcacgctctcgctctcgcaggtgggccgcgaccgcgagctgggcgggtgcaaggcgccgaagctgctcgtcgaggccgaggctgtccacgccgtcgccggtgctcaagtgacgacgggaaggacgcccggcggcgtgccccccgagtgctgccgtgccggcgagcgctgcggccagtgcgggtggattgggagcgaggaggacatgttcctcgcagcaacgttcagtcactaggccgtctcaattgtcgtttctcacagcaaaattaacaacttcggacactcccatgtcagcgtacctctatcgagttcgagtgtagcggggtagcccccagctccaagttttgagaattgagatatgattgattgaatggtttgcgtcactctccagcttagcctattctcaatttattatgagactgtttggatcagttttttttcttttctgaggggattttgtgagaagctgcatgtaaggagaagctggtgtggagagaagctgacctataaaaatataggtgtttgacaataaagtgctttatcatcctataaatacaaaaatgttacaaattaatttaaactgatagtgcataagttttacaagtaaacataccgtcgctcactcagattctcacggacgcggccttcagatcgcttcggacttggcgtgctactactgcag

SEQ ID NO: 17428 - DNA, 2219 bp, Zea mays
cccctcccccactttcgttttttcttttttttttttttttgatcaatcgaaacacaacagcaagtcagcaacatctattgccaaccgtcaagtcttgtaatatcaaaacacattaaaattgcacgtacataaggctcacacaggacaggaccggaccggagtacttccattatggtagtacagcgtacgtatgcctcccttaaccgctacttaaacaacaagcaatagtgcaatacaaacgaacaaagttcaaacgtaccttcagaacggtatactaacacttgtgcatgcatgcaaatcgaccgaccgcgtcctataccatatcatatccgatccatcatccatcggtgaagtgcagcactgcactggtagtggtagcgaagcgagcgatagatagatagcagccactgcattgcaggtacgtgctaggcgtccatgcgcgccgggtactggtcgacgcagtccagccaggggctgcgcgcggggcggcgcacgcggcggacggcgcgccacaccgcgctgttgcacttgaagcccgacccgaaggcgagctgccagacgcggtcgccgcggcggacgcggcccttggcctccaggtacgccagctcgtaccagatgctgctgcttgaggtgttgccgaagcggtgcagcgcggcgcgggaggcctccaggtcggcgttgcgcaggcccaggttgctctgcaggtgctccagcacgtcgcggctggccgcgtgcatgcagaagtgctcgaacgcgcgcttgaagtccgggatgtagggcgcggcggccgaggcgtcccctggggtggtcggcggcgccggcgtggaggccttggacgggaacaggtggcggaacagcacgcccgcgaagaagagcagctgctcggagaagggcagcaccaggggccccagcgtggtgatgttggtcttgagcgcgtggccgcccacctccagcaggtcgcggctgatggacaggcccttgatccgctgctcgtcctcctcctggtacacggagcggaaggcgcggtcgtccgcgcccttgtgcgtgcgcaccacgtgctccagctggtacttggcgcggtggaagtcgcggcgccggttggacagcagcaccgccgcgcagccggcccggaagaaggcgttcgggatgagcatggagcgccgcttcccggggtaccacgtgaaggagacggcctccgtgctgaccaccacggccaggcccgcgccgctggcctggagcatgtcgcgggccagatcgatggcgatgacgcccgcgctgcagcccatgccccccaggttgtagctcaggatgttgccgcgcatcttgtagtggttgacgatcatggcggacagggagggcgtcgggttgaagaggctgcagttgaccaccagcacgcccacgtccttgggccggacgcggcacttgtcgaacagctcgtccagcgccgcgaacatggccgtggacgcctcggcgcggccctccttcatggtggcgcagctggcgttgggctcgaacacgcagcgcggcatgtacgactcgtcgccgatgccggacttggccagcagacgcgactggaacgccaggctgtcctcgtcgaacttgccggacttgcgcgccaggtcgatgaactccgccttggacaccttgagctcgtcggccggcttgtagcatgcgaagtcgatgaggtacacgggcctgggcctggacatgatgtagacggagatggtgaaggcgaggacggcgaggaaggcgagcacggtggcgaggtcgtaggtggcctccccccacaccttgcgccacagctcgtcgcggctgaggctgcccagctcggcgccgcacaccagcacgatgacggggatggtggccaggtacacgccgtggctgatgaggtagtggtacccgaggcgcacgtacttgaggttcaccgactgcaggaagtccggcaggcggcggcgcacgcgcaccgagaaggccggcgagccggcgtccgggcccgacggctccacgccgcggttcacgatctccgtcgacagcagcgcctgctcctcccgcgccatgatggccgagcgatcgatcgatctatcgaccgaccgaagctagctcgcgcgcgctgctgctgcagctggtatggatccggggcagtggtggtggtagtgagaggtgaggggagtcgcccgcccgccggccgccaccgtcccccccgcctcgaggtacccaat

SEQ ID NO: 17429 - DNA, 903 bp, Zea mays
  misc_feature (51)..(51): n is a, c, g, or t
  misc_feature (90)..(90): n is a, c, g, or t
  misc_feature (896)..(896): n is a, c, g, or t
cagatgtgccgcgcatcttgtagtggtgacgatcatgcggacaggagggcngtcgggtgaagaggctgcagttgaccaccagcacgggcnccacgtccttttgggccgacgcggcacttgtcgaacagctcgtccagcgccgcgaaacatggccgtggacgcctcggcgcggccctccttcatgggtggcgcagctggcgttgggctcgaacacgcagcgcggcatgtacgactcgtcgccgatgccggacttggccagcagacgcgactggaacgccaggctgtcctcgtcgaacttgccggacttgcgcgccaggtcgatgaactccgccttggacaccttgagctcgtcggccggcttgtagcatgcgaagtcgatgaggtacacgggcctgggcctggacatgatgtagacggagatggtgaaggcgaggacggcgaggaaggcgagcacggtggcgaggtcgtaggtggcctccccccacaccttgcgccacagctcgtcgcggctgaggctgcccagctcggcgccgcacaccagcacgatgacggggatggtggccaggtacacgccgtggctgatgaggtagtggtacccgaggcgcacgtacttgaggttcaccgactgcaggaagtccggcaggcggcggcgcacgcgcaccgagaaggccggcgagccggcgtccgggcccgacggctccacgccgcggttcacgatctccgtcgacagcagcgcctgctcctcccgcgccatgatggccgagcgatcgatcgatctatcgaccgaccgaagctagctcgcgcgcgctgctgctgcagctggtatggatccggggcagtggtggtggtagtgagaggtgaggggagtccccgaccggcccggctccaccctttgncccggcc

SEQ ID NO: 17430 - DNA, 1009 bp, Zea mays
gcagcctaacttatattttattcctttgttccaggctccgccacttgttagtacatgcgtatgcgtatcaatttcagaagcatcggccggggcttattttgatcaatcgaaacacaacagcaacattttttgccaaccgtcaagtcttgtaatatcaaaacacattaaaattgcacgtacataaggctcacacaggaccggaccggagtagtacttccattatggtagcacagcggtacgtctccctcccttaaccgctacttaaacaacaagcaatagtgcaatacaaacgaacaaagttcaaacgtaccttcagaacggtatagtaacacttggtgcatgcatgcaaatcgaccgaccgcgtcctataccatatcatacccgatccatcatccatcggtgaagtgcagcactgcactggtagcgaagcgaacgatagatagatagcagccactgcattgcagttgcaggtacgtgctaggcgtccatgcgcgccgggtactggtcgatgcagtccagccaggggctgcgcgcggggcggcgcacgcggcggacggcgcgccacaccgcgctgttgcacttgaagcccgacccgaaggcgagctgccagacgcggtcgccgcggcggacgcggcccttggcctccaggtacgccagctcgtaccagatgctgctgctggaggtgttgccgaagcggtgcagcgcggcgcgggaggcctccaggtcggcgttgcgcaggcccaggttgctctgcaggtgctccagcacgtcgcggctggccgcgtgcatgcagaagtgctcgaacgcgcgcttgaagtccgggatgtagggcgcggcggccgaggcgtcccctggggtggtcggcggcgccggcgtggaggccttggacgggaacaggtggcggaacagcacgcccgcgaagaagagcagctgctcggagaagggcagcaccaggggccccagcgtggtgatgttggtcttgagcgcgggccccgccccgggggtcccc

SEQ ID NO: 17431 - DNA, 911 bp, Zea mays
cagcccatgccccccaggttgtagctcaggatgtgccgcgcatctgtagtgttgacgatcatggcggacagggagggcgtcgggtgaagaggctgcagttgaccaccagcacgcccacgtccttgggccggacgcggcacttgtcgaacagctcgtccagcgccgcgaacatggccgtggacgcctcggcgcggccctccttcatggtggcgcagctggcgttgggctcgaacacgcagcgcggcatgtacgactcgtcgccgatgccggacttggccagcagacgcgactggaacgccaggctgtcctcgtcgaacttgccggacttgcgcgccaggtcgatgaactccgccttggacaccttgagctcgtcggccggcttgtagcacgcgaagtcgatgaggtacacgggcctgggcctggacatgatgtagacggagatggtgaaggcgaggacggcgaggaaggcgagcacggtggcgaggtcgtaggtggcctccccccacaccttgcgccacagctcgtcgcggctgaggctgcccagctcggcgccgcacaccagcacgatgacggggatggtggccaggtacacgccgtggctgatgaggtagtggtacccgaggcgcacgtacttgaggttcaccgactgcaggaagtccggcaggcggcggcgcacgcgcaccgagaaggccggcgagccggcgtccgggcccgacggctccacgccgcggttcacgatctccgtcgacagcagcgcctgctcctcccgcgccatgatggccgagcgatcgatcgatcgatcgatctatcgaccgaccgaagcaagctcgcgctgctgctgctggtatggatccggggcagtggtggtggtagtgagaggtggggggagtcccgagccccaggcgccaatg

SEQ ID NO: 17432 - DNA, 898 bp, Zea mays
  misc_feature (27)..(27): n is a, c, g, or t
  misc_feature (34)..(34): n is a, c, g, or t
  misc_feature (42)..(42): n is a, c, g, or t
  misc_feature (45)..(45): n is a, c, g, or t
  misc_feature (55)..(55): n is a, c, g, or t
ggggggggggggcctcttctccgcgcnttttgtngtggttgncgntcatggcggncacgggagggcggccgggtgaagaggctgcagttgaccaccagcacgcccacgtccttgggccggacgcggcacttgtcgaacagctcgtccagcgccgcgaaacatggccgtggacgcctcggcgcggccctccttcatggtggcgcagctggcgttgggctcgaacacgcagcgcggcatgtacgactcgtcgccgatgccggacttggccagcagacgcgactggaacgcccaggctgtcctcgtcgaacttgccggacttgcgcgccaggtcgatgaactccgccttggacaccttgagctcgtcggccggcttgtagcatgcgaagtcgatgaggtacacgggcctgggcctggacatgatgtagacggagatggtgaaggcgaggacggcgaggaaggcgagcacggtggcgaggtcgtaggtggcctccccccaccaccttgcgccacagctcgtcgcggctgaggctgcccagctcggcgccgcacaccagcacgatgacggggatggtggccaggtacacgccgtggctgatgaggtagtggtacccgaggcgcacgtacttgaggttcaccgactgcaggaagtccggcaggcggcggcgcacgcgcaccgagaaggccggcgagccggcgtccgggcccgacggctccacgccgcggttcacgatctccgtcgacagcagcgcctgctcctcccgcgccatgatggccgagcgatcgatcgatctatcgaccgaccgaagctagctcgcgcgcgctgctgctgcagctggtatggatccggggcagtggtggggtagggggggggggggcgcccggcctcgaggtccccaag

SEQ ID NO: 17433 - DNA, 884 bp, Zea mays
atctgtagtggtgacgatcatggcgaacagggacgggtcgggttgaagaggctgcagttgaccaccagcacggcccacgtccttgggccggacgcggcacttgtcgaacagctcgtccagcgccgcgaaacatggccgtggacgcctcggcgcggccctccttcatgggtggcgcagctggcgttgggctcgaacacgcagcgcggcatgtacgactcgtcgccgatgccggacttggccagcagacgcgactggaacgccagggctgtcctcgtcgaacttgccggacttgcgcgccaggtcgatgaactccgccttggacaccttgagctcgtcggccggcttgtagcatgcgaagtcgatgaggtacacgggcctgggcctggacatgatgtagacggagatggtgaaggcgaggacggcgaggaaggcgagcacggtggcgaggtcgtaggtggcctccccccacaccttgcgccacagctcgtcgcggctgaggctgcccagctcggcgccgcacaccagcacgatgacggggatggtggccaggtacacgccgtggctgatgaggtagtggtacccgaggcgcacgtacttgaggttcaccgactgcaggaagtccggcaggcggcggcgcacgcgcaccgagaaggccggcgagccggcgtccgggcccgacggctccacgccgcggttcacgatctccgtcgagagcagcgcctgctcctcccgcgccatgatggccgagcgatcgatcgatctatcgaccgaccgaagctagctcgcgctgctgctgcagctggtatggatccggggcagtggtggtggtagtgagaggtgagggcagtgcccccgccctgctccgagcgccccgaggtcccaat

SEQ ID NO: 17434 - DNA, 5453 bp, Zea mays
  misc_feature (5308)..(5308): n is a, c, g, or t
tacggatttttttttttttttttttttttttttttttaataaaacaaattcctttgttccagggtccgccacttgttagtacctgcgtatgcgtatcgccctcggggccttcggccggtgcttttggcgatcaatcgaaacacaacagcaacatctattgccaaccgtcgagtcttgtaatatcaaaagacattaaaattgcacgtacataaggctcacacaggaccggaccggaccggagtacttccattatggtagcacagcgtacgactccctcccttaaccgctacttaaacaacaagcaatagtgcaatacaaacgaacaaagttcaaacgtaccttcagaacggtatagtaacacttggtgcatgcatgcaaatcgaccgactgcgtcctataccatatcatatccgatccatcatgcatcggtgaagtgcagcactgcactggtagatagcgaagcgagcgatagatagatagcagccattgcattgcaggtacgtgctaggcgtccatgcgcgccgggtactggtcgatgcagtccagccaggggctgcgcgcggggcggcgcacgcggcggacggcgcgccacaccgcgctgttgcacttgaagcccgacccgaaggcgagctgccagacgcggtcgccgcggcggacgcggcccttggcctccaggtacgccagctcgtaccagatgctgctgcttgaggtgttgccgaagcggtgcagcgcggcgcgggaggcctccaggtcggcgtcgcgcaggcccaggttgctctgcaggtgctccagcacgtcgcggctggccgcgtgcatgcagaagtgctcgaacgcgcgcttgaagtccgggatgtagggcgcggcggccgaggcgtcccctggggtggtcggcggcgccggcgtggaggccttggacgggaacaggtggcggaacagcacgcccgcgaagaagagcagctgctcggagaagggcagcaccaggggccccagcgtggtgatgttggtcttgagcgcgtggccgcccacctccagcaggtcgcggctgatggacaggcccttgatccgctgctcgtcctcctcctggtacacggagcggaaggcgcggtcgtccgcgcccttgtgcgtgcgcaccacgtgctccagctggtacttggcgcggtggaagtcgcggcgccggttggacagcagcaccgccgcgcagccggcccggaagaaggcgttcgggatgagcatggagcgccgcttcccggggtaccacgtgaaggagacggcctccgtgctgaccaccacggccaggcccgcgccgctggcctggagcatgtcgcgggccagatcgatggcgatgacgcccgcgctgcagcccatgccccccaggttgtagctcaggatgttgccgcgcatcttgtagtggttgacgatcatggcggacagggagggcgtcgggttgaagaggctgcagttgaccaccagcacgcccacgtccttgggccggacgcggcacttgtcgaacagctcgtccagcgccgcgaacatggccgtggacgcctcggcgcggccctccttcatggtggcgcagctggcgttgggctcgaacacgcagcgcggcatgtacgactcgtcgccgatgccggacttggccagcagacgcgactggaacgccaggctgtcctcgtcgaacttgccggacttgcgcgccaggtcgatgaactccgccttggacaccttgggcccgtccgccggcacacagcagcatcgcgtcacatcagaatcgcatgattacatatagtactgcatcatcgtctgcagctgctgatccatccatgcattctgttcccaaccaaaacacaatctcttcttccctgtacgtgttccgaggctgcgagaagcagcaagcacaaccacatcatcaggctacaccctttggaacacacggctcattgattgctgggccgatggaccgagcgcccaaccgtttgtgatgggtgtggtgacctgtgacctcaacccaacggaaaccgttttctatcatatcgtaccgtacctgccccggccggcccattcatagctgtgggcccagaggcccaacgctcatctaatgcatgggatgagagcctgcaaacttagcgctgacttctaaaaagtctttcaggcacattacatgctgataatgaccgattatgttgatggatcgggaggttggaaggattttagattcatcagagagtagggtttttcgggcatgtggatgtgctctgtcggtgtagtgtttatatggatgccactgtctgcaacatttatgggccttcaagtggtggcagctggccaatgctgtgaccatattaaaggcccagcacggccctgcaatggtactctaccagtgcaggtacgggtatagagcgtgtagattgtacgtccaccgatgtgacaggccacatcacatggctgctagctgtgtataaatgagttcatatacccatgttttaattcacccttccactgctacccctttcttattacccatctttgtatgtccctgcaactttgcctagtattttatttgtcattctaaatatttcaataccttctatatcattaggatgcagtttttcacccttcaaacaggagtgttagtgatatagaaaggattgcgacatacaatcttattttacttttctataccagttttgatggcatggaagaacatacatctatcccaggaaggtagatcagatgtgacatgccttccttgtacatgcatgtacttgcgtgtgagcgccatgactatcaaatgtgtggcaaagtaagcagtagcagtaggaggctaggagcttataatttatacttccttcgtttctttttaattgtcgctggatagttcaattttgcactatccagcgacaactaaaatgaaacggagagaatatataaacaatcaaagaaagtaagtcaggctaaggaagaaattaaataggcctgaagcatgtttagttattactacatctagctagcagcatatgactatataaatatattgcacgcaaatcatatgtagctaagctagtgatggacaggagtagtacgcatgctgtatctatgcatgcacgcacgcaccttgagctcgtcggccggcttgtagcatgcgaagtcgatgaggtacacgggcctgggcctggacatgatgtagacggagatggtgaaggcgaggacggcgaggaaggcgagcacggtggcgaggtcgtaggtggcctccccccacaccttgcgccacagctcgtcgcggctgaggctgcccagctcggcgccgcacaccagcacgatgacggggatggtggccaggtacacgccgtggctgatgaggtagtggtacccgaggcgcacgtacttgaggttcaccgactgcaggaagtccggcaggcggcggcgcacgcgcaccgagaaggccggcgagccggcgtccgggcccgacggctccacgccgcggttcacgatctccgtcgacagcagcgcctgctcctcccgcgccatgatggccgagcgatcgatcgatctatcgaccgaccgaagctagctcgcgcgcgctgctgctgcagctggtatggatccggggcagtggtggtggtagtgagaggtgaggggagtggaaagggtccagctagtattattgatatatagcagtactgctagcaggagaagaggagcgtgcagctgggtaggggaggagatggcgggtgggtgggcggcagttaatgccattagagagcagggcagatgggcagggacggactgatctgatcatctgatggagggggggaagcgggaggcgggagctcccgcccggctgctgctattgttgccacagtcccaaactcccaatcccacccaggcacccacgcagacaggaaatgacagccgcagctgctgctggctggaccgctcgtcttcatgcctttgccttcctccatgcatgtagagtatctttattttatgtgggactgacatgttgtccccgatgaacggcaataggttttttttgcatgttcgccgactgtctgatcaaggtacgtactgatatgcatgtggccatgtgggtttaggatttaatccgaaacgaattgttttttatctataaattgcagttacatattccaacaattgattttaatacgaaccgagtgattgccaggcacacgcatccaaccccaggcggacgactggcattgctgcctgggccgagcaacgttttgcggccatcaactaaaacaagtcttagactatatacaacagcttacacatatatacttatattcaaacaccactctacgaactatacagtctacagtacaaaataatgtaatacagtgcttatatggataaactttggttgagctgctggagtcggccttaactgcatggtcttccactctttgttgtgtgtgaacgtgcagggccgatatcaaggggctggtggctccagaccccatacatccataaaactctatttgataaagaggtagaggttagaagataaggaacggggaaaaataatacagagaaataagcacccattctattagagaaaaatgacaagaaaggagaagggagaaaaatgagccttcctaccggcttgtgttgcctccatcactaatgactaatgtttttttttgaaatataggattggtaaaatataggaatagaaaaaatgtaggactgtcctaaaataaatgcatctaagattacttaactctatttattatttttcattttctctatttttaaagtcacaacaagaatccaaaaaaaaacctgctggcaacggtaactaagctgacgagagttatttaatcttcgtcgtctgacatcctatctgaattcctattgtcagtgtaatgattgtctcaaaacaacttttatactataaattctaaccttgttttttttaaaaaaaaatctagaggtgcattaattacttgttggagaacatacttgttgtcattttattgtctcttgttttttcaaatactatacagtatgaagacagtctcgcccaactttgcatgttgtatccctctatccccagatcgtatactatgcttggagataatcagaagccccaaaccacaagtgcacatccgcgtggacataggatgtatttagttaaacgtacaggaagggatcgaagtagtgaccatattttctatgatgtttagatgagaatcgcgcggggagcaagataaataccgaagcaattttttttagcgacgtgattaaaaaatcgagtgtctccaccttagaccttaaatcaaacacngcgaggggggtaaatgccggtggagacgagacggtgcttgcaacagcgcatcatgctgcctctagcgcctgcacctaacctctcgagggtgaaatgaattggccctgtctgtctgctagtctcagccacagctgctgcccacctc

SEQ ID NO: 17435 - DNA, 1254 bp, Zea mays
tagagtatccaaactaggcctaacttgtttgaggcccactgggtctccgaccaaccatatataatgtttttttttttttttcgcagtgagctgaaccaaccaatgtttcatgtacacttgcttcattacatccatccaatgagtgtttgcagaattgcagttacaggtcaagttacccaatcaatactaagaacgatgaatcgagctatccaatcaatctcattccaacacaacataaaatctaactctaataacaggccatccccgatttatcagcatctgcagtcagcaaagcacacggcatccaattagttcaacttgtgggcccagctgtgctctttcaggtaggcctgcactgcttccttgatggccagattcggaaccagctgatgctccttcagaggttctcgcgtcaccgggtcgaaattgccaaccttgtggagatgttcaacaagtacagccctctcatatgttacaccactcggtgtgatcactgggtctcggaagatctcgaatgttatctgacagcaaaggtaatcgggcacatctgttggtgtatcggcgactgtcgcttggctgaagacctctgatagtagtttaatttgctctgaatactcgttgtctgacctgttggagtcttcctcaagtgtaccagttagaaagtgatgctcctgcagagcagtttcacaagcttccttcaaactttccatcctccatagtcgttcagtggaatgcttctcccaatctaagtattttgcctttgcaaggacctgccaaatgtcctcagccatttcatacgttgaatccacagactttaagagagttagagccttttcgaattccttgatagcaagagcagattcttccttctcgagtagcgcacaccccagcagatagtgccccttgactaaagtgtaatcaagcgcaagagccctcctgctgtcctcttcgaccttggcccactccttgcgcttgaaatggcacagggcccgattgatccagtagacggcgacgtcggggcagagcgcaattgcctcggtgtagcagtcgatggcggcgccgaggcgcgccttcttgaagcagatgttgccctcgatccggcggagctccgcctggcgagcgacgccgtccccgcccgccgccatggcttgccctccggacagagatggcagcagggaagagacgctaaacgcaagtacgcctggagacaagcaagggtgtgcggtgtcggccggcctcgatgatcccaatcgc

SEQ ID NO: 17436 - DNA, 498 bp, Zea mays
agtgtagttttgggcaagaaatggcatcccctttctgccacaagcaaaaagaagttgccggtgcccctgtttcgcttagctgaacattttttgcttataaagaatttaaatagaaagcaagcggagaacaaggggagagacgccgccttgccatgtgtaagcaacggccaacggcaatgctttgtttgcttgcaaagcctcgtgtgaaagggaggaatccggagaacgatggtacggccgttgcttgtggcgttcaatcaggataaaggtacctagtattccagaggtgatttctcttcattgacagagagcaaatctggttcgtgatccctagtaccagagagggacacggttttcctatcgatgtgttagagtcaagtactcaagcttttgtggttccaatggagtctaagcgtgtgagtgatcaggatgctttgatcgacctggagagtggcaatggcactacagtaagcaactacaccaattgtggggatgcta

SEQ ID NO: 17437 - DNA, 1887 bp, Zea mays
agtttctccggccggggctgtcaaatcgccgccgcactgccgagtgccgacggccggtcggccgccagggcgcgccgctcgagctaccagacgatttcggcggataaatttggacgcgcgggcgggagaaggggagaaaacgcggagccacaccccgtgtcgaaaccccagggcgccaagcttcccgcgggccaccgccgctgccgatgccggtgccgaagccgatggagaggaagcaagccgcctacagcaacctcgatgagaggtacgcgatccagggggagaagtaccaggggcagcagtacagccatatctacttcacgcgcctccaccacatgcggaatctcctccacgccctcgtcccctcctggaagccgcaactccctgtcactacagtgttaggacttgaagaaggaaaggattgcataattgttggaactttatataagcacatgaagttgaagccttcaattcttgatgaatatgccaaagagaggtctgcaattccccttgtcaaaccacataatttcatgcatcctgatgatcatctcattctggaagatgaaagcggaagagttacacttgcaggagccatacctccagcagcattcgtgactggggttgtagtggctctccatgggaaggaaacaagtgctggcaattttcttgtggaagatgttcttgaggctggtcttccaccccaaactgcattgtctagcgcagaagaagacaagtatgtagtattcatatcagggctaagtgtaggaagtgacacattcaatcctctacagttccaacttcttattgaccatgtcacaggacatctgggtgacgagaatgagcaatccatagcatcaaatatagtacgcattgtggttgttgggaattcagtgcatatttcaccaaggtttgtcaatggtcagacggtaccatcaaaagatcaatcaaggatagcagaacctattaaggaactggatataatgcttacccagctcgtggcttcgttgcctgtagatatgatgccggggtgtcatgatccggcaaatttttctttgcctcagcagcctctgcacagatgccttttctctggggcatccacctacaacactttttcgtcttgttcaaatccccatcaattcgagcttgacagtgtccagtttcttggaacatctggtcagaacatagatgacctgtacaagtactctgatgctaaagacaagctggaattcatggaaagaacactgagatggcgccatcttgctcctactgctccaaatagcctaggctgttatccatacacagacaaggatcctttccttgttgaaagttgcccgcacgtctactttgttgggaatcaagataaatatgaaactcgactgttggaagggcaagaaaaacagaaagtgaggctaatctccatcccaaggttctcggagagtggagtcgctgtaatgctcaatctgaggaacttggaatgcagcacattgagtttctcaacaagctttgatgcctgaatatgctctgatgtttgtaagtgcagaagacttcaatgtagcatgttgagcggcatgagcacgagggaactacgtgaaccctttgtggggtgtgggggtgggggcatggaaggatgtatttgtaccagaacagttctttattagatgtatgatgatgaccttaggttttgccaaatagatcttttagaatgcagatgctgtaacttgtaaccacaaccgaaactgaggctggaccgagtgtagcgtgtaacaaccgaattggtgctcatgcctcgttttgcaatcacaatcagcaagcacgtttgtcaaaaaaaaaaaaaaaaaaagaaaaaaaaaaaaaaaaaacctcgagggggggcccggtacccaatcg

SEQ ID NO: 17438 - DNA, 3008 bp, Zea mays
ccggccgggaaccttgtcgagcgatccgagcttctcgggtcctcctccaaatccaccggcatctgcaagccctagccccaaccccgaccgcccatgtccgccatcgcggcctcctcggccgccgccgcgtcgaactccgatgaggaagaaaactatgaggagtacatcccagtcgccaagcgccgggccatggaggccgagcgcctccgccagctccgcctctccaagtcggcgccggcctctgccgtctcatcactcccgatgccacctcccccgcctcttttgccagcgcagacctccgttcccgacgccgccgcgaagcccagccttctcgtcaaggccacgcagcttaagcgcgcggccccggaggtgaccgccacggagcagcgcatccagcaggagaaggaagtgattgaaaatctctcagacaacaaatcgctcaggtcagtccgcgagatcgccaagggcatcatctacacggaaccgatccagaccgggtggaagccgcccctccgcctccgccgcatgccgctcgccaaagccaacgagttccggcgcaagtggcacatcatcgtcgacggtgacgatataccgccgcctgcgcgtgatttccgggatctccgcctcccggagcccatgctccggaagctgcgcgagaggggtatcgtccagcccacgccgattcaggtgcaggggctgcccgttgtgctctctgggcgtgacatgataggcatcgctttcacggggtcggggaagactctggtgttcgtgctgccgcttatcatggtggcgctgcaggaggaatcattgatgccgatcgtgcctggcgagggcccgtttgggatgatcatatgcccgtcgcgggaactggccaagcagacatatgatgtgattgagcagtttctcattccacttaaggaggctggttatccggagataaggcatttgctttgcattgggggtgtggatatgaggacacagctcgatgtgttgaagaagggcgtgcacattgtggtggcaacgcctggtcggctcaaggatttgcttgccaagaagaagatgaaccttgacaactgcaggtctgcaggtacttaaccttagatgaagcggataggctggttgacctaggatttgaagatgacatcaaggaggttttcgaccatttcaaggatcaaaggcaaactcttctcttttctgctactatgcctcagaagattcaaaattttgcgaagaacgcccttgtgaaaccagttactgtcaatgtgggaagagctggagcagcaaatctagacgtcattcaagaagtcgagtatgtaaaggaagatgctagaattatatacctccttgaatgcctccaaaagactccacctcctgttctcattttctgtgaaaacaaggctgatgtcgactacatccatgagtaccttcttctaaagggagtggaggctgttgctatccatggaggaaaagatcaagaggagagacagaacgcaattgactccttcaagactggtaggaaggatgttctagtggctactgatgttgcatcgaagggtcttgattttcctgacattcagcatgtcattaactatgacatgcccgccgaaatagagaactatgtccaccgaatcggtcgaactggtcgatgtgggaagactggcatagcaactaccttcatcaacaagaaccaaactgagaccacgcttctcgatctcaagcatctgctgaaggaggcaaagcagaggattccaccggtgttggcggagctcaacgatccattggatgatgaggaaataattgccaaggagagtggtgtcaaaggttgtgcgtattgtggtgggcttggccatcgtgtcagtgactgtccgaagttggagcatcaaaagtccatggcaattgctggctcgagaaaagactactttggcggcgggggttaccgaggagaaatatgattgctctaggttgatgcttgcgtgtggttatcagaagctaagatgctgcaatttcaggtcatacatgtcacatgtatcagccaccagaacatccttcctcccccatcgttgaagggagacggtctgcgttaacgaacttgtgatatgctgctgggtatgacactgcttgctactgacctaccatatatcttgtttgaaggacgcaagttgattatcctgccctgttgtaaaatgtaaccagaacaattgctggcgtatttcttaagcaccagttttagcccctttctgtaagcagtcgacatttcagttcaactcatgtatgtatattttgatcttgtatacagtactatatttccatcttacgtctgcttcggcatataagagcaactccagtagttggctaaaaaaaaaaaaaaaaaaaaaaactcaagagcgtgcataaaatctcctctccaacagcttctgaaatcaacttggtaaatttactaagttgctatcccagctaatttggtctctacatgtagcaactagtttcccactcccgaaaagtcaaatcacgacattttttactttcggcgccttgatctagagcgtggcacctagaaagcactgaggttttgtagaaactttattgtgtctgacttgttagctcaaattgatagtacttccaatggttagaaagtgattttcatctcctattattttcatactgtatcgtgaggctgaacactagtgttgtatggttggataaagaccaaggatcttccaattgaatgttaaatgcatctgcattgtgcattttaaacaaagatgttttaatccaaatggtcgttctactcattgtctattccgtgtgttttgaattattttatatatgtttagatgtgtctagtgaaagtaacacttgtacctctacacttctaatcctctgtacgtatgaacaaaagcaaatgatcaatggctataactatatatatacacacacggacggtgtgattcaattgaacgcatgcgcaggcttgtccgccggtgcgactggtgctcatcttaattggc

SEQ ID NO: 17439 - DNA, 2334 bp, Zea mays
cgcgattcgatcttctcggatcctactgcagatccacgcggcacccccgagcccggcccccaaccccgtccgcccatgtccgccatcgcggcctcctcggccgccgccgccgcggcgtcgaactccgatgaggaagaaaactatgaggacgacatcccaggcgccaagcgccgggccatggaggccgagcgcctccggcagctccgcctctccaaggcggcgccggcctctgccgtctcatcactcccgatgccacctcccccgcctcttttgccagcgcagacctccgttcccgacgccgccgcgaagcccagccttctcgtctaggccacgcagcttaagcgcgcggccccggaggcgaccgccacggagcagcgcatccagcaggagaaggaagtgattgaaaatctctcagacaacaaatcgctcaggtcagtccgcgagatcgccaagggcatcatctacacggaaccgatccagaccgggtggaagccgcccctccgcctccgccgcatgccgctcgccaaagccaacgagttccggcgcaagtggcacatcatcgtcgacggtgacgataaaccgccgcctgcgcgtgatttccgggatctccgcctcccggagcccatgctccggaagctgcgcgagtcggctaccgtgcccccccccccgattcaggtgcaggggctgcccgttgtgctctctgggcgtgacatgataggcatcgctttcacggggtcggggaagactctggtgttcgtgctgccgcttatcatggtggcgctgcaggaggaatcattgatgccgatcgtgcctggcgagggcccgtttgggatgatcatatgcccgtcgcgggaactggccaagcagacatatgatgtgattgagcagtttctcattccacttaaggaggctggttatccggagataaggcatttgctttgcattgggggtgtggatatgaggacacagctcgatgtgttgaagaagggcgtgcacattgtggtggcaacgcctggtcggctcaaggatttgcttgccaagaagaagatgaaccttgacaactgcaggtacttaaccttagatgaagcggataggctggttgacctaggatttgaagatgacatcaaggaggttttcgaccatttcaaggatcaaaggcaaactcttctcttttctgctactatgcctcagaagattcaaaattttgcgaagaacgcccttgtgaaaccagttactgtcaatgtgggaagagctggagcagcaaatctagacgtcattcaagaagtcgaatatgtaaaggaagatgctagaattatatacctccttgaatgcctccaaaagactccacctcctgttctcattttctgtgaaaacaaggctgatgtcgactacatccatgagtaccttcttctaaagggagtggaggctgttgctatccatggaggaaaagatcaagaggagagacagaacgcaattgactccttcaagactggtaggaaggatgttctggtggctactgatgttgcatcgaagggtcttgattttcctgacattcagcatgtcattaactatgacatgcccgccgaaatagagaactatgtccaccgaatcggtcgaactggtcgatgtgggaagactggcatagcaactaccttcatcaacaagaaccaaactgagaccacgcttctcgatctcaagcatctgctgaaggaggcaaagcagaggattccaccggtgttggcggagctcaacgatccattggatgatgaggaaataattgccaaggagagtggtgtcaaaggttgtgcgtattgtggtgggcttggccatcgtgtcagtgactgtccgaagttggagcaccaaaagtccatggcaattgctggctcgagaaaagactactttggcggcgggggttaccgaggagaaatatgattgctctaggttgatgcttgcgtgtggttatcaggagctaagatgctgcaatttcaggtcatacatgtcacatgtatcagctagccaaggctcctcccccatcgttgaagggagacggtttgcgttaacgaacttgtgatatgctgctgggtatgaactgcttgctactgacctaccatgtatcttgtttgaaggacgcaagttgattatcctgccctgttgtaaaatgtaaccagaacaattgctggcgtatttcttaagcaccagttttagcccctttctgtaagcagtcgacatttcagttcaactcatgtatgtatattttgatcttgtatacagtactatatttccatcttaagaaagctttggcataagcggaaaaaaaaaaaaaaaaacaaaacc

SEQ ID NO: 17440 - DNA, 1308 bp, Zea mays
ccggccgcacacgccctcatctcctccccaacccgttgtccactgccaccaggcaaaccagccgcgccgccgccggcgatgaccaccgcgcggctcgtctcaacatcccccgcccgcctatcctccacgtcggcttccccgattcacagaacctcgctgtgtgttgtcggtcgtgcccctgctttctccgccaggccgctcggattctcgcttcgtctcaagccgtcgcctgccatggccgccgccggcgtcggcggcaacggcccccctaccgcgcatggagactcaataggatcttttaggattggagaggttaagagggtgaccaaagagacaaatgtgcacgtgaagatcaaccttgatggcactggtgtcgccgagtgtagcacagggataccgttcttggatcacatgctcgatcagttggcatcacatggactctttgatgtctacgttaaagcaacaggcgacacccatattgatgatcatcactcaaatgaggacattgctttggcaattggaacggcactacttgaagcacttggtgatcgaaagggaattaaccgatttggtcattttacagcaccgcttgatgaggcagcggttgaggttatactggatctgtctggtcgccctcatttaagctgtggcttagatattcctactcaaagagttggcacatatgatacacagctggttgagcacttcttccaatctgtggtgaacacatctgggatgactcttcacatccgtcagcttgctgggaaaaactcacaccatatcatcgaggcatctttcaaagcgtttgctcgggcccttcgacaggcaacagagtatgacctgcgccgtcaaggcactgtccccagctccaaaggtgtcttgtcgagatcatagcatcgcagtttggacgaacgcatatcttccactgcagcgcacatcaatgagaggaaaacctgcagagtagacagcttggtttttgctgctcacgttgggagcctgcgttagcctctgaacattgctaatgggataatcaagaaccatctagcaactagcaagcaccacttattatctgccttgtgacagtggcatagcgcgtctgctcgctactgcaactctattatctgctcgctggagttacaggatatctgaagattgaaggtctagacatgctgtgactttgtaagctacaccggtcaggaataatgctgcgtctggatcatccgcagaaacataggggtatgtaaattgtttggacattgaagggaatgcattgatctttgcgcgttcaaaaaaaaaaaaaaaaaaaaa

SEQ ID NO: 17441 - DNA, 1232 bp, Zea mays
  misc_feature (1093)..(1093): n is a, c, g, or t
cgcggcctccctcttgcccatggcatacatcgcgttcgtgttgcctactcagatcagaggcgggcctcgagcgaaccagctgagattgcaagaagtagagcagcggccgccgccaagggccatggtgaagccgggaaagagaacgagcagggggcgccagaaaattgagatccgccgcatcgacaacaaggagagccgccaagtcacccagtgcaagcgcaagggcgggctcctaaagaaggcctcggagctccatctcctctgtggtgcccaagtcgccatcatcgtcttcaagagaagggaccccgaaagaaaggaggtgcccgttccgccccgcggccaacgcgacgacggcggccttgccttcgcgatgggcaccccctccgtcgaccacgtcctccaccgctgtggcctgctccacgccgacgagggcctcaccgcgatccaggatgtgggcgccatcgccgcagagcgtgccgttatggaggcgagagcggggcagaccgagcagaccagggcgctcgtggaggcggagaaggcgcggaatgacgccatcgggcagaaggtgttgcaggccgtggaggtgaccgggaggcggttctggtgggaagtggacgtcggggtgctcggcgaggccgagcttccggtctttacttcgcagctccagcgcctcagggacagcgtgcggctccaagccaacaaatcgcggacctctgctaccccggccggggtggcggcgccgtggcttccgctgggataggtcagccgcatcgatttgctaatgcaattcaattttacggttcctgctgcagtgtttacttaatttggtcgtacgtgtagttaattcctctatgtaatagttgcattgatgctatatgcggcatctacggcatccgacggcatgaatatggggaaaaaatgtatgggcatgcccaaggacctccatctagggttaatgcatcatgatgtttagagtctgcaagaagaaaagaaggctagtaggtgaaaacaggccttgccagatgtgtgaaccggctagttcggtctctgtaacacactaacacctatgttttaggatcccgctaagccgggnttttagtctaaaatcggttagatttcaatgtagttccggtttgtgttttgatgtggggaatttttagattaaaaaaaaaaaaaaaattgtaatggaataagaatatatatatatatatatatatatatatatatattga

SEQ ID NO: 17442 - DNA, 1374 bp, Zea mays
tctcgcgtccgctttgggattggaattggattactcccctcccggacaaaacggggcgagagcgcatggagagcagagaggaggagaggaagggcagcggtggcgccgccgccggcggcggctcgacccctggggcgaatctaagggacctggtgtcgagggaatactacggccacaagaagaaggtgcactctgtagcatggaactgcctaggcacaaagcttgcttcaggatcgatcgatcataccgcacgtgtctggagcattgatccacatgtccattctaaggttaaagatattgaactgaaaggccacacagatagtgtagatcagctttgctgggatccaaatcatcctgatacagttgctactgcagctgctgacaaatctattcgtctttgggatgctcgaagtggaaaatgtcaagttgttgaacttagtggagaaaacatcaacatcacatataaacatgatggcactcagatagctgttggaaacaaggaggatgagctgacgatattggatgttaggacacttaaagttgctaagaaacacaagtctacttacgagatgaatgagattgcttggaataaagctggagatctattcttcattactactgggttagggcacgttgaggtggttaaggatcttgagtttttaaagccctgcaagctgaatgctcatacagcagggtgttattgcattgcaatggatccacttgataggtatttcgctgttggaagtgcagattcacttgtcagtctttggaatgtcaaagagttgttatgcattagaaccttcacaaaacttgagtggcctgtaagaacagttagcttcagtcatactggagaattcattgcatatgccagtgaagatcctttcattgacattgccaatgttgagactggacgatcaattcatcagattccatgtaaagcagctatgaatagcgttgaatggaatcctaagtacaacctcctggcctatgcgggagacgacaagaacaagtatatgactgatgaaggtgttttccgggtatttggcttcgaaacacataattgatgctgacttagactaccctcatatagaatggtttgcattgtagattcactttcgaattttgtttacactgatacattttgtagatgttcagtgtaacttggatgctaatcaatcttctgccggcttgaactgaacgtcattgttgtagtgtatcacaggatacccatgtgactaacgtatttccgggatccaattctattttttattatacttactttttattatagtatggagatgtattcattttctttgaattgattttgatccgcaatactatcgaagtaaaaaaaaaaaaaaaaaaaaatccgta

SEQ ID NO: 17443 - DNA, 2190 bp, Zea mays
cctcgaggccggccgggctgccgtgtacgaccacactgcgctcaccatgtgtacaatgtattctcccttgccggaccgtagccctgccccactagttcttccctcgcgttcactccccagcgtgggaaaatcccggaattttcctgtttgtccactggttttcttgcgccaaaaccaggtttctccccgttgccgtggcagaactctgttcttgcccagtctagaagatctgcaccgttccaaccaccaactccggccgccaagcatatatccagcgcggcgaagaattcccaacgcgaaagccaaaacctcttcacttcacttcacgtcgacacgtgcggggagaatatgcgcgcgacaatcccagccctgtcgctcctggtgacgccgcggctcccctcgctcgccgtgccgctggctggaggccgcctccgcgtgggcggtcgtcctcggacccgcctccgcgtggcggcgccgacgtccgtcccaggggaagcggcggagcaggcggagccgagcacgtcggcgcccgagtccggcgagaagttctcgtggagggatcactggtacccggtctccctcgtcgaggacctcgaccccagccgccccaccccgttccagctcctcaaccgcgacctcgtcatctggaaggaacccaagtccggcgagtgggtcgcgctcgacgaccgctgcccccaccgccttgccccgctctcggagggcaggatcgatgagacggggtgcttgcagtgctcgtatcacggatggtcattcgatggctccggcgcctgcaccaagatcccccaggccatgcccgagggtcctgaggcccgtgcggtgcggtcaccgaaggcgtgcgcgatcaagttccccaccctcgtctcccaggggctgctcttcgtgtggcccgatgagaatgggtgggagaaagcggccgccaccaagcctccaatgttgccgaaagaatttgaggacccggccttctccacggtgacaatccagagggacttgttctatggttatgatacgttgatggagaacgtctctgatccgtcccatatagaatttgctcaccacaaggttactggacgaagagatagagccaggcctttgacattcaggatggaatcaagtggtgcctggggttactcaggagcaaattctggtaatcctcgcattactgcaacttttgaggccccttgttatgcattgaacaaaatagagatagacacaaagttacccatttttggcgaccagaaatgggtcatatggatttgctctttcaacattccaatggccccagggaagactcgttctattgtctgtagcgctcgaaactttttccagttcacaatgccaggaaaagcatggtggcagcttgttcctcgatggtatgaacattggacttcaaatttggtctatgatggcgatatgatcgttcttcaaggccaggagaagattttcctagctgcaaccaaggagtcttctacggatattaatcagcagtacacaaagatcacattcacgcccacacaagctgatcgatttgttttagcattccgcacatggctaaggaaatttggcaatagccagccggagtggtttggaaatcctacacaagaagcattgccttccaccgtcctttcaaagcgcgagatgctagacagatacgagcagcacacgttgaaatgctcgtcctgcaaaggagcatataatgcattccagaatctgcagaaggtattcatgggagcgacagtagtttgctgtgctgccgctggtattcctccagatgttcagctcaggttattgatcggtgcggctgctttggtcagtgccgctgtagcatacgcattccatgagctccagaagaattttgtattcgtggattacgtgcatgctgacattgattgaaagattcgtgaggatctgttgtgtcgacatcactggctcgcgagtcgtgtctgtagtctagggctctaggcgtctagctagggaaagtaactttttgccgggtataggtcatattgctcacatatgtattttgtatagtgtatgcactcaactgtagccgattcagtgcgaaaatatagtttttatgttactatctattggattaaaattgtctccagatccttttagcatgtaaaatgccatttttcaaatggaagttctcaattgcgcccctagact

SEQ ID NO: 17444 - DNA, 1298 bp, Zea mays
gttggctacctcgaggcccggccgggaaccgtaatccattaccacgcctcctcacaggcacacctcacactcacacgagcagcagcggacgataagagatgtgctgaagctgaacggtggccatgtccaccggacgcacagaggaggccgccgggagcgcggagacggcgtgcgtgacgggcgccggcgggtacatcgcctcgtggctcgtcaagctcctcctctcccgtggctacaccgtccacggcaccgtccgcgacctcagtgacaataaaaccgctcatctgaagcggttagagaatgcttccgaaaacctcaagcttttcaaggctgatgtccttgactacgacgctatggcgggtgcagtcgcagggtgccagggagtctttcatgtcgccactcctgtgccttcagggaagatcaccgatccagagcgagagatgctgggtcctgctgttaccggcaccataaacgcactcaaggctgcgtctgctgcaaatgctcgtcgagtggtcgtcgtttcatccatggttgccgttgagatcaacccgaaagactggcccagagacaagatcaaagatgagaactgctggtcagataaagagttctgcaggaacgaagagaactggtattctgtcgccaagatctcgtcagaagaggccgcacttgaatacgcgaagcagaccgggctggatgttgtgacggtcaatccagctgtggtctttggccctcttctgcagccgacgctcaacacgagctgccagttcctcgtctacttcctgaaaggaggacctgatcgaatgagggacaagctttggcacatcgtcgacgtcagggacactgccgatgctctcctgcttgtgtacgagacaccacaagcctccggcaggcacatctgcgctcctcatttcatcagcgcgcgtgacctgctggagctgctgaagacgatgtaccctgatgattaccctttcattagcaaggagagcatctacgacatggagcacccagctccaatgacgtccgacaagctcaagaaactgggatggaaggtcaggccgctgaaggaaacaattgcggaaaccgttgagttctgccagcatgctgggtttctcgaggacgtggagggattccgttttcctcccctgtacaacataatctagtttacaataacgtcagtagtgtaagagcaactccaacggaatccgtaaaatttacacaaaaactttgatttggaggctctctaaaataaatagctcgctggaaagcaagctctgatagatccgtcatttaaaaaaaaa

SEQ ID NO: 17445 - DNA, 1679 bp, Zea mays
ttgggacccgcgaggccgccccccggccgcggggaccgcacttccactggagggccacacttctcttttgaggaccagtccaccgtccactcccagagtccaaaaccctacgatccgcgccaccatgccgcgcctcgccgccgccgccgccgccgtctcacgccgcgccggcgaggccctgcgccgcggcgcgtttgggggactgcggcctctctcctccctgcaaccgttaaacgccgcctccagcgacgaggtgctcgttgaaggaaagacaagtgcgcgcgctgccgtgctcaaccgccctggctacctcaacgccctcaccaccaccatgggagctaggctcaataaattttatcaatcatgggaggacaacccagacattggctttgtcatgatgaagggcagcggccgagcattctgtgctggtggggatgttgttagattacatgaacttatcactgaaggcaagctggaggaatgtaaggattttttcaagactttgtacatgttcatttattttctgggcacatacttgaaaccacatgttgccattcttgatggcattactatgggtggtggtggaggtgtttccatccctggaacattccgtgttgcaactgataggacagtctttgcaactccagaagttcatattggattccatcctgatgctgcagcctccttttatttgtcgcatctaactggccatgttggggaatatgtggccttgactggtgaaaagcttaatggaacagatatgattgctcttggcctcgctacacactatttcatgagtggccatctggatctgatcgatgaacgacttgcaaagttagtaactgatgatccatcagttattgattcgtcccttgcacaatatggagacatggtttatccggacaaaaatagcattgttcataggctggaggtgattgataaatgcttcagccatgacacagttgaagagattgttgatgccttggaaagtgaagcagccagctcaaatgaagaatggtgtatcttggcgctgaaacgattgaaagaggcctctccgttagctttgaaggtctcactgcgatcgatacgcgagggtagatatcagacacttgatgagtgccttgtccgtgagtaccgcatgtccatgaatggaatctcaaagcaattttctcatgaattctgcgagggagtcagagcacgactagtcgacaaggacttcactcctaagtgggatcctcctgcccttgagtatgttacgaatgacatggttgacgcatacttcgcacctcttggcgattcggagcctgagttgaagctgcctatagaatcgcgagaggcatttgtatgatcacaaatcattccaagaaccggatcattgcaaggaccggactgggacctgataaacgtgttataatctgtgtagccattatttttggcagcacaaccagcccgattggaccaactattcacgtgccgtatactcattcagactgtcttcgctagcttacctatacatatattcaaactatactttagaaacagtgcaatgtactatgcaaaacggtgcaacagtgttttggttgaccatatgggtgtaacgtacagtagttcactataagggtcaccaaaaacaccgtttttatactgtatattgtactgtctgtagagtatagtttgaa

SEQ ID NO: 17446 - DNA, 2099 bp, Zea mays
  misc_feature (956)..(956): n is a, c, g, or t
  misc_feature (1035)..(1035): n is a, c, g, or t
  misc_feature (1042)..(1042): n is a, c, g, or t
cgatcggcacgacgttcaaagtgccgctcaccttcttgataagcttgtcaaggatatcgtaactgagagtgatcagttcagcatagaagaattcataccgctcttgagagagcgcatgaatgtgttgaacccttatgtaagacaatttttggttgggtggataacagtgttagatagtgttcctgatattgacatgcttggttttcttcctgattttcttgacggtttgttcaatatgctgagtgattccagtcatgagataaggcagcaagctgatgcagcactttctgagtttcttcaggagataaagaactcaccaaatgtagattatggtcgtatggctgaaatactcgttcggagggcaggctctactgatgaattcactcggttgacatctatcacatggatcaacgagtttgtgaagcttggtggggaacaacttgttccctactatgcagatatattgggcgctgtcttaccatgcatatctgacgaggaggagaaaatccgagtggttgcacgcgaaacaaatgaggaactccgtgctataaaagctgatccagctgagggatttgatatcggagcaattctttcaatcgcaaaaagagaattgaacagtgaacatgaggccactcgaatcgaagcattgcattggttcttcactttgctggatcgatattgtgctgagttcttggcttacctgaacgatatttttgatccactcctaaatgcactttctgatccttcggacgcggttgtcctattagtattggaggttcatgcacgcatagctgaagaatctcaccacttccatcatcttgtatcctacctgatccgcaccttccacaacaaccattttgtactggagaaacgtggtgctttgatagtccgtcggctctgtgttcttctaggggctgaaaaagtatatcgagagttctccactattcttgagagtnaagttgatcttgatttcgcatccgtcatggttcaggttttgaatttgattttgctcacatcaactgaacttggtgagcnccgctcntcctctgtaccgggcccccccgctcgagtcagctacgtaggcccccccctattttatgcttcatggcgccactctccgatggctacgataagtttatgtttacttgctcaggcatacaatcacgcaagctgtgttattcagtcactgggagaagaagacataaatgtgaattttttggttcaattagataaattgatccgtctcttagagactccagtatttgcttacttgcgtttacagcttctcgagcctggaaaacacacttggcttctgaaaactctttacggtctcctgatgcttttgcctcagcaaagtgcggccttcaagatcttgaggactcgactgaagactgtgccattcagtgaaaatcttaagcgcacatcttcagcgaatccatactctcagattctgcaagtgacggaagatggcaatagaaaccaagatatgcagaactacagtgcaatcaatttcccattccttctccagcaatttgagaacatgcagctgcagcatcgtaaccatttgaaggatcaactgcaatcccgtaaatctgcttcgactttaacattatctcaggagatacaaagatacgaagaagcgcattcctcttcgctgtcagagattaacaggcccccttcaagaacatccaaaggcattttatgatgcatttgttcttgcgatgtatgatatatttgccggaagcatcaccacatatatgttggggctttggttagtctcctcgttttttttcaaaggaggttgcatagggtacatagtgtaatcttttctatttcgttcctagatttgtcaagagatggcaattatttgttggagaaagctcgttgccacattctagtcattcttttcttagtggtttcactgctcatctggtttctgtaatttttcaattgaaggccaaatgagcaaagtagtaattggagatagaaatatgttactactgtcctatctatcgatctccaataaattagcgttgcaatgtaaaaaaaaaaaaaaaaaagatgacatatttattatattatttatatgccttatctgc

SEQ ID NO: 17447 - DNA, 1409 bp, Zea mays
ccgggttacttacagtatcagttcagacaagaccacaaggaggggaaattgttgcggttgaactgtaatctggtgcgaattataaggaaaataagccgagttgtgtaaaaaaaaaaaaaaaaaaaaaaaaaaaaaaaaaaaaaaaaatgcaccttccacaacaaccattttctactggagaagcgtggtgctttgatagtccgtcgcctctgcgttcttctgggtgctgaaaaagtatatcgtgagttctccactattcttgagagtgaagttgaccttgattttgcatccgtcatggttcaggctttgaatttgattttgctcacatcaactgaacttggtgagctccgctctcttcttaagaagtcgttagtggattcctgtggcaaggacttgtttcagtcattatatgcttcgtggcgccactctccgatggctacaataagtttgtgtttacttgctcaggcatacagtcatgcgagctgtgttattcagtcgctgggagaagaagacataaatgtgaaatttttggttcagttagataaattgatccgtctcttagagactccagtatttgcttacttgcgtttgcagcttcttgagcctggaaagcacacctggcttctgaaaactctttatggtctcctgatgctgttgcctcagcaaagtgcggccttcaagatcttgaggactcgactgaaaactgtgccattcagtgaaaatattaagcgcacatcttcagcaaatccatactcccagattctgcaagtgacagaagatggcaatagaaaccaagatacacagaactatagtgcaatcaatttcccgtcccttctccagcaatttgagcacatgcagctgcagcaccgtaaccatttgaaggatcaactgcaatcccgcaaatctgcttcagctctaacgttatctcaggagatacaaagatacgaagcagcacattcctcttcgctatcagagattaacaggcccccttcaagaacatccaaaggcattttatgatgcatttgattattgcgatgtatgatatgtttcccagaagcatcatcacaaatatgttggggctttggttagtctccttgatttttccaaaggaggttgcatagggtacatagagtgtaatattttttgtttcgttcctagattttgtcaagagatggcaattatttattggagaaagctcgtttctgccctctagtcattcttttcttagccgtttcactgctcatctggtttctgtaatttttcaattgaaggccaaatgagcaaagtagtaattggagatatgttactactgttctgcttatccatctctaataaattagcgttgcaatgtaaaaaaaaaaaaaaaaaaactcgagactagttccccccgcgtgcgccccgggtaccca

SEQ ID NO: 17448 - DNA, 1946 bp, Zea mays
cccggtcgacccagcgttttttggttttgcccagctgctagcaacccagcaggtgagaggagatggcgggaggtggcacgggcatcaggaaatcatgggggctcttaaggacaccacaacagtcagcatagcaaaagtaaacagcgattacaaggagctggacattgctattgtgaagccacaaaccatgtcgagatccaacaaagagaaatacgtgagagatatcttttaccatctttcacccggaaggcctcgggcagatgtcgcctactgcatccgcgcccttggtagacgtctttcaaagacacgcaattgggcggttgctatgaagacattaattgtcatacaccgtgctcttcgggaagttgatcctgcttcccgtgaagagcttattagttatggaagatctagctcccatatgctctatctgtcatactttaaggacgattctagcgcagaagcttgggattactctgcttgggtgcgcaattatgctttatatttggaggagaaacttgaatcattccgtgtactgaactatgatgttgaaaaggtatccgttgcaaattcgggatcttgatacaaatggattgctcgatcagttgccagctttacagcagcttcttttccgactacttggttgccagccacaaggggcgtcatcttataacgtcataattcagcatgcactttcaatgggtgctctagagagtgttaggatccaaacagccatcaatgacgggatactcaatcttgttgacaagttctttgagatgcagagagatgacgcaataagggcactgggcatgtatagaagagcaatcgagcaggcagaccggctttcagcctcgtctgacgcgtccgaaagtatacttattggggcggggtgagagattcctaaaaatcgaacagccgcctgcatccttcttggcggctatggaggaatatgtgagcaatgctccccttgcttcaacagttcaaagaaatcaggctgtactggccatagaggacagcaaaaaatcagaagttgaagaatcacaaccaacgctgcctcctccccactctccagctcaagaacctgggccggagccagttcaacaagtcccacctgcagctgaaccaacagatttactgggaatcaatgaaccaacccctgccacatctgaaatagatcaaaagaatgcgggggccttggccatggttccacaggataatgcgccaaaagcacctgcttctactaccagttctggaagtgtggagactagctgggagctggccttggtcactgcacccagttcaaatgggactgctgtcactccaagcaaattggccggtgggctggacctgcttacactcgacagcttgtacaacgaggcgcaccgaagagcgcagcagaacgcaagctacagcccttgggagaccaatccagcgtcaggcccagtgatgcagcagccgatgtacgacccgttctacgcctccaatcaccccgtggccgcagcccgcaacgtccagatggctgccatggagcagcagcaacaacaacaacatgtcttcatgctccagcagcagcaacagcagcagatgatggtgatgatgatggcacagcagcagcagcaagcttcttccaatccgtttgccgacccgtatacggccgccgccgcccacacgtatggtgcaggggtgcagctccatgcgggcaacgcgtactctggagctgggatgatgtaagcgttgcacagaacctgctgtctggttctgaccggcatcttccgttctttcttgttttttctcattattttcttgcattttttttacattgtaagaactgtgttagggctagaactagaaatctgatatagcatcaatatgagcacattcttgatgttcatgaccaataaaaaaaaaaaaaaaaaaaaaaaaaaaaaaaacccaaaaaaaaaaaaaaa

SEQ ID NO: 17449 - DNA, 1815 bp, Zea mays
tgcagttctttgagatgcagagagatgacgcaataagggcactgggcatgtatagaagagcaatcgagcaggtaaatcatgatttattttcttctgttggttaactcattaacctttttattagaacatcagaaacgacacatttacttctgtacaggcagaacaactttcagaattttatgaagtgtgtaaaagtatacatattgggcggggtgagagattcctaaaaatcgaacaggtttggctggcattcctatgatagttggtgtgtacttgtctgttgttttctgtttgagtagtttactgataacctatttggtaacaccaatacatacagccgcctgcatccttcttggcgactatggaggaatatgtgagcaatgctccccttgcttcaacagttcaaagaaatcaggtatgtgagcattataagttttgtgatatttttgtttcagtatgatatttccctgggatcttagttttctgttacttccataaaagtttcttgtaattactctattgaagtaattttaaggcggcatttctatgcctctttatgtccatctctatgtgtttaggctgtactggccatagaggacagcaaaaaatcagaagttgaagaatcacaaccaacgctgcctcctccccactctccagctcaagaatctgggcctgagccagttcaacaagtcccacctgcagctgatccaacagatttactggtaatttccaatgatactgcgctaacaaggtgtcgatccttatgtgttgacagtcatgtgccctaacacttctgtcttttgttggcagggaatcaatgaaccaacccctgccacatctgaaatagatcaaaagaatgcgggggccttggccatggttccacagggtatgtacttacacatcctacaaatggaatcgaactctttgcttgccattcaaagttttggagaaacgtcctgaattgtattcactgactctttttttttatatttgtgtggcagataatgcgccaaaagcacctgcttctactaccagttctggaagtgtggagactagctgggagctggccttggtcactgcacccagttcaaatgggactgctgtcactccaagcaaattggtatacaagctgagataattcacatatattttacacttcatttggcgtctctgcgatcatactaaactcaacttgctacaggccggtgggctggacttgcttacactcgacagcttgtacaacgaggcgcaccgaagagcgcagcagaacgcaagctacaacccttgggagaccaatccagcgtcaggcccagtgatgcagcagcaaatgtacgacccgttctacgcctccaatcaccccgtggccgcagcccgcaacgtccagatggctgccatggagcagcagcagcaacaacaacatgccttcgtgctccagcagcagcagcagcagcagatgattgtgatgatgatggcacagcagcagcagcagcaagcttcttccaatccgttgtatacggccgccgccgcccacacgtatggtgcaggggtgcagctccacgcgggcaacgcgtactctggagctgggatgatgtaagcgttgcacagaacctgctgtctggttctgaccggcatcttccgttctttcttgttttttctcattattttcttgcatttttttttacattgtaagaactgtgttagggctagaactagaaatctgatatagcatcaatatgagcacattcttgatgttcatgaccaataatggttgttgagatcataaaaaaaaaatgaagcccaaaacatgtttaaata

SEQ ID NO: 17450 - DNA, 3315 bp, Zea mays
cctcgaggccggccgggattcacgaccttatcccaccagcagattcgaaattcacggacaggcccatggacccggcgaaagccagcggtggttcagcccctgacgtgcgggtcccactctccagccgcaccgcctagagagccttgggtacctcgaggccggccgggaaacgaggcgtgataaagtggggctcctcggtcccggcgttggccgcatcgacactcgccgcgcaccaccaccaccgctgcggctcacggctacgcagcccgctctcccgacccccccgtgccctcctctttttgctactagcacatagagtttcgcccgaatcgatcgccgactgactccgctagggttcggcccgatcgccgcttcgtcctcccggctcccgcggggaccccgccgagatgtctgactggagctcgccggctgcgccgacgttcttcccttttggcccgcaggccgaggggtgggacgtcaccttcaaggtcaaatatggtgatacacttaaaaggttttatggttgtgccaatgggagtcattttgacatgaatttatctgctctacgggcgaggattgatactgcctttaagtttggtcctgacgttgactttgttctgacttacaccgatgaggatggtgatattgtcatgctagatgatgatgatgacttgcgtgatgcagctctccgtcagagattaaaccctctcaggattactgttcaactgaagaaaaatcaaccaactgaaaaaaaagatacttctgcaccagtgaaatccgctgctcaggatccactatcccagttaatgtcagctattgaaggtttgaagcctgttcaggaagatagtctggcccatataaaatcagctattggtgaagcaatcaagtctatcccagagccaatacctgatgcccttgcaaaactttctcatgaaatacttgatgcagcaccaccaccattagctgagctgatgaaaccttttgcacaattgatggcaccaaacaataatggcaatgggccatctgatgtgcatgctgaggggtcatctagctcttccagtgcacaggtgccagctgaagctaaaaatgagcccaaagttaggccaagtttgggtcttaagaccgtgttgaaagaggctgctggacctgttcctaatgctggagcttctcaggttcaacagccattaatgtatccatctgttgaggagatgctgttcccctgtaattcagtcgacaaatctgtttgcaaagggaagattgatgctcaaagtaagggaaaatctgttacgtcctcaggcatccaacctgctcctcattctcttcgtactcatgccccacctccaccacatccgtgcatttcagaatggtcccgagcacaaagaagccaacaccgtcaattgaaatttgaagacaatgcaaaagccactaatgattctagatggcgcattccgatgtataaaatgccctatgcaccaccacctccagcagtgccacccccaggctatgtaccttctccacattttccttatccaggccgcctcttatcttctgggcatccatacggagatctcgctggtaacatggaaaactcagcaccacatagtctgcatagatggattcagtgtgatggctgtggagcgcaaccaattgttggtccacgttataaatctaatgtgaaggaagactatgatttatgtgattcctgtttccagcgcatgggaaatgaaatggagtacaccaaaatagacaagcctattttaccccacaggtttctaagagatccccatgtgtaccggaaggtgcaccatccacgggttctaatgaagtcaagacgggagaaacttgaaagtcgcttcattttggatgtgactgttcttgatggaacactgatgacaccttctaccccgttcactaagatttggcgcatgcataacaatgggtctgttgtgtggccacggggcacacagcttgtctgggttggtggagatcagtttgcattgcagacatctgttccattagagattcctgtggatggttttcctgtggacaaagagattgatgttcctgttgattttgtggcacctacaaggccagggaggtacatatcttactggaggttggcttccccttctggtcagaaatttggtcagcgagtttgggttcatatccaggtggaagacccttcttttgttaatgacaataacaggaatgctgctattaacctgaatctgcctccagagagctatagttcaaacacaaccaacttaattgatgtgaacattgagcctgctgactcagcccttagtgcacatgctaagcgcacaaaggagttccatttctgttcaactgattttcctgaacccagtaagtctgtgccttttacgttggccactacctctttgtctgcagcagctcctacaaaccaaactggtgatgttcccatgtccagtacacctgctgctgcttgtttgccctctgttaatgtgcctatgcatgaagtcgttactactcatacaccgtcacctattacgcctgtcttgcctacaactatacacttttcagccccagtatctgctcctgcaattgcccctgagcttgcatcaggggctgttggtgtgcctccacctgttagtgctgtggtacctgagctgtcagaactggatgttcacaatgaggagaagttgctgagggagctggaggaaatgggttttaggcaggtcgatctcaacaaggaaatcctcaggcagaacaattacaatctggagcagtctgtcgatgacctatgtggcgtcaatgaatgggatcctctccttgcagagctggaagagatgggatttgatgacacagagatgaacaaggagctgcttgcgaagaatgagggaagcatcaagcgagctgtgatggagctcattgccagggagaagaaggacaagtgaagatcgtgtgctatctaagtatatattcgtaaataatgagacggctgtgccactgcggtgcagccctggtgcgtctcagagcttgcttatggtgaactcttcgtgttaggtttcttccttatatctgtcgtgtctgcggtgtcgatgaactatctagtatgtggagcgtgtgcgtctcagcagttaccctgccatgccacgtggactggctgtcgtgcctactgtctgttaccatgtatatatataaaaaatgatgcgtggaccaatgtttgatgctggcgctcttgccctcgtgataatgtattagcggttggcttgttgcttgctaaaaaaaaaaaaaaaaaacgccccgattgcagaaaaaaaaaaaaaaaaaaaa

SEQ ID NO: 17451 - DNA, 580 bp, Zea mays
  misc_feature (577)..(577): n is a, c, g, or t
atcaagcgtcaggcccagtgatgcagcagcaaatgtacgacccgttctacgcctccaatcaccccgtggccgcagcccgcaacgtccagatggctgccatggagcagcagcagcaacaacaacatgccttcgtgctccagcagcagcagcagcagcagatgatggtgatgataatggcacagcagcagcagcagcagcaagcttcttccaatccgtttgccgacccgtatacggccgccgccgccgcccacacgtatggtgcaggggtgcagctcaacgcgggcaacgcgtactctggagctgggatgatgtaagcgttgcacagaacctgctgtctggttctgaccggcatcttccgttctttcttgttttttctcactattttcttgcattttttttacattgtaagaactgtgttagggctagaactagaaatctgatatagcatcaatatgagcacattcttgatgttcatgaccaataatggtcgatgcgatgatggctttgaactgaagcactaaaatagcatcgatccttgcaaatttaatttagtacttgtttgataaaaaaaaaaaanaaa

SEQ ID NO: 17452 - DNA, 927 bp, Zea mays
  misc_feature (925)..(925): n is a, c, g, or t
gcacgagaccattacctagaacatcctaatcaaaaacaacgagggtcgagaagggccgcctcgagagtcgctgaagccatggcgaccacggcgaccactgcaatcctccgcctcactccagccccttctccccgcaccgcgcgccctcctcgctctgctaccttcctccagcccgcgctctccgtttccctctcccactccctccccgactgccgcaaccaccgccttgccgccgcttccaaggacactgctagcagcaaggggcaggaacaagaccaagagcccgcaccgtcggcgccacaggaaggaggaccggagaaggtaacggaggtgggggcagcatcgcccggggagaagagcccggaggcggtggcggcggagctgaaggaggtgctgagggcgcggaaggaggcggaggccgccgagggccgcggcgggtggtgggcaggcgtggcgcaggagatgaccgagatcgagtggccggcgcctgggaaggtgttgggcaccaccggcgtggtgcttggggtcatcgcgggctccactgtcgcgctgctgtccgtcaacgccctcctcgccgagctctccgacaccgtcttcgccggacgcggacttcaggacttcttctccggctgatgaagcggcgtgcttcgtgtactctgtaactattgttttttttttcttgcacttggggctagggtcatagatcaaatgttcgaggttggaattatgtccaattttcagttgccaagaaaaagatgatgagtcacttgcgaatttggtaatgctactaatatgtgagtgacattttgttggtaaaaaaaaaatggtcactcgggaacctaacttgagttccttctgtttagtggtgagataataataggcttccagattcccctaaaaaaaaaaaaaaaaaaaaaaattatanaa

SEQ ID NO: 17453 - DNA, 4562 bp, Zea mays
acacaaagttttctactgtacttgtgtagaaggcagctggatgactgtgattcatgttttggtgtttagttgtttggaaatatgctggtgtagtctagataaaataaagatagttgaaaattgctggctaatatatttctagaattgtatgaaatatgactttcttgaaacaaaatactccacccattcaaattttaagatcttttgcatttctagtacattgtttatactttttagaatgtatctacatgtagggtatatcttagtgcaaatcaaaagctgcgtatctagaaaagcaaaaacaccctataatttggaatggagggagtatcaatttattccctcttatcacaatatatgtttgtcctatgtcaaatcttttagctttgaccctaaatagttaaaaattggaaaaaagtaatctaacataaaatttatggtactagatttatcatgaaaagtaaaaaaggggtcaaaaccagtgccggaggctcccacatctgtggtatctaaagaagggataaactgaggcaggccttcatccgcaaatgtggagaggctgctgcgaactgccgaacctgtgaaaagttactatttgaaatatatatctttagagccaaggtttcatttcacctagacctagtagactatgttgatgtcctaaactgtttatatttgtgattggagggagtcttcttttgcacctcatagattttgtatctcttcgactcttcccttaccgaaccgtgttctctgattttgttcagatattcattgaactgctggaaagtgttctgcagggacatgaaactcctatagggtaaatatcagagttgtatttcgtctcatgaaaaatacataatgaagaagcattgagttgttgatatcaaacacacgtttttctttgaaccttccacaaaatatgacacaatgcctgtaatcatgtttgtgtatctttagtaaatctatttgttctcctacatctttaggcctgaagagcttctagaaagaaccagagatccacaagtttctgattatggtttgtatacattcagatgttcgaactctagttctgcactatcttggtattgttatctaacactgtcgtcttcagttgtcatgttctttaggtttgtcacttctggtgaaattcaaaggaggtctgacttctttgaaccgttcatatctggcttgacaaattcaaccgtggttcaggtcagttccatattctgctgtcacatgttgtatatgtactacatatattatattcatggtcatttacgtgcatcaagcagcattaatctgtgatcctatttgttgctccctggtgaatagtgtctggtgattggcaatcacagtatgttcgttcattgttggcttaaattattctggggcatgtgtagccattatttatagaggcggttccccttaactaaagttcagatatagatgattagatatcatgatgtagcaactctttgagcaattttttccctaatggtgtagtttatcataaatctgtattctgtgatgaatgataaggaaagatttatgctgctgcccatgtgggtaaataagctacttcttggtcttaaataattgttgaagtcacactgttatttccagcgctgttatttccatgttatatatcatgatgtagcaactctttgagcaaaacttttttccctgatggtgtggtttatcataagtctgtgctctgatgcccatgtgggtaaataagctacttcttggtcttaaattactgttgaagtcacgctgttatttcccgcactgaatctgtaccctatttcagtaaacattttggtaaatatttagatactagaatcgggcttgacaaattcaaccgtggttcagttctgcaaggcttctgtggaacctatgggtgaggaaagtgaccatgtgcacataattgccctatcagatgcactaggcgtaccaatccgtgttatgtacctagaccgaagctcgtgtgacactggcaacctgagcgtgaatcaccacgatttcatcccgtcggccaatgattcggagggtgatgcggccacgacacctgctcctgccacagagaaaccgtacatcactttgctctaccgtcctggccactacgatattctctacccaaagtgaattttgcgcatggttagtttcacgacttcggttgagaaagcacactgcccagaaaactcgtcatgtttcgcctgtgtgctgccaaaggtggcaaacttgcttttgagtgcttaatgccaatgccctcgttcaatctagatgttctctacctgctgtaagtcttactctggtacaaggatttaacattgtgttgactgcagagaagttcccgtggatatttgctactcatcagttattcgttcatgttttttttttcttttaccttgatctgtcgttgcaaaccaagttcataaagtttaaacctcgttgaggaatgcaaaaaaaaaaaaaaaacatgaatacctgtcaaaacagttccctacattcgttcgtcgcggcaattttgtctgttttgtcaacagatgcacagttgtggttgtggtgaagctattacgaacggaaggccgagcagctagcagcattcgccaaatatttgttgagaagttgggggttatgctgtgcaggaaggaagtatcgcttggggtggtgttcctgaggctgggcatgaagtgacacaaagttacaggtagaggcctagctatgtcaaaaactaaagagacggagcaaatgtagggggtgacctgcttctcggggccacacggcaaccaatgagcttttgatgaaggcatgtcctctgcgattgggagagaaagaaagggggtcgacaaaggctggggagctggcccctctgcgttgcaaaggcactagcttctctgtgcgaacatgcctactcagcgtacaaaagcaaaacctttttcttctttcgttttgttcggagctcaaataggccatgtgcacttgatggtggtcttcttgtgagcgcacctgtacctggattctccaattctgctttggcaaatgacgttaacgtcgcggtgtacactgcctcattttccggcagggaattagctacactgagtggcggtctcataatcactgtcgcattagtgggtgcaatgtagccactcgtaatctagtagaactatggagatgaggcttggctcggaggatgcaaatggtatacatattatttgtccgtattcgaattcgactcgtttaaaaggctagagatccgatctatgttcaggtcccaatactatatatctgatctttatttatatctgtattcttaaaattagatatttaaaatatcaatatttatgtaaatcctatcggatataacttaccaggaagaggggtacttgactaatagggttaaaatggcttgatgaaccattccgttcacacgcaccggtcccattcacttgcaactcgtagaggctgtaagtaaagtaaacagtgccccactaaattcaaagtgacggtagggttgaaagatgagtgtgcctaccccgagccgagagtgcccgccctttctgtcaagtaggctactttttacggaacgcttatactccgaagagaaaatatacaaacacatattggtacccgattcgattagacctaccggctccacatctctccatcgtcaggagcgctgcacagtcgtgtgtgcccgtctccgcccgtcctgggcgggcccagcgcacagtcaactccttaacgcagcggcgaattggcagatcaccaacccctccatttgtcaggatgccagtatgccactcaccctgaccctgacccgcaccggtgacagaacggcattgtctttaaacagaatgtcatttctgctgacggattcttttaaaaaaaaatgcgcatttcatattttttttcaaaaagaaattcctgcatttcccgctcctcattacaggaaacagttttgctgaataatgtctgcgtcccggccccaccactaaccctgaactgaatgctaattaaaacgggattagtactcaacagtcaacatcaacttaactaagtgcctgtttgtttcagcttatagattatataatctggaatataatatagattatataatccatattataatttatatgtacctatttgatagtctagattatacaatgtagattatttacaaagataacaatacccttatttgtttatttgatatttagtatagttaggacattctatcactagaaacaataaggggcggtgcgatgaactgccatgggggtaaaaagattaacaacaagccagagtcataatggagaatttgatcgtgtattaggtgagaaaagaaggatgacatatattataatttttatttacataacgataagtagtaggtcttttgccaaaaataatctcaaataagttattctcgaggagagtatgagattaccataatctggctttagattatataatttggatccataatctaagtgtttgtttatatgctggattatttgcgttagattatataatctagagagattataatccgaaac

SEQ ID NO: 17454 - DNA, 1542 bp, Zea mays
gcaaaacgacacggacgtatttccgcttccacctgcgccgagatctcggaagaggattcagaagaagcaggcttccgctgctgcttcccccactcgaatccaagcaaccacgcccccacgcccagtccaaccccaacccgcgaagctggcgcgcgaggcggccgacgcgagcgcccgcaagcgcaaggcgggggacggcggcgaggtccccgacgccaccgcctcggcagaggtggccgcagcgccgacccccggagaggacgcggccatgggcgacgttccacaggcgccgcacgctgcgggaggtggagaagagtgggcggggccggaccctaaccctagcccgagcctcggcggctgctcggaccccgtgtcggtggagctctccatgggcggggactactaccgcgcctgctgcggcgagcccgatcccgacatccccgaggggcccaagctgccgtgcgttggggacaaggaacctctctcctctttagcagctgagtttcagtctggcagccccattttacaagagaaaattaagttgcttggcgagcaatatggtgctttaagacgtacacgtggagatggaaactgcttttatcgaagctttatgttttcctacctggaacacatcctagagacacaagacaaagctgaggctgatcgcatcatggtaaaaattgaggaatgcaagaaaacactcctctctcttggatatattgagttcacttttgaggacttcttttcgatattcattgaactgctggaaagtgttctgcagggacatgaaactcctatagggcctgaagagcttctagaaagaaccagagatccacaagtttctgattatgttgtcatgttctttaggtttgtcacttctggtgaaattcaaaggaggtctgacttctttgaaccgttcatatctggcttgacaaattcaaccgtggttcagttctgcaaggcttctgtggaacctatgggtgaggaaagtgaccatgtgcacataattgccctatcagatgcactaggcgtaccaatccgtgttatgtacctagaccgaagctcgtgtgacactggcaacctgagcgtgaatcaccacgatttcatcccgtcggccaatgattcggagggtgatgcggccacgacacctgctcctgccacagagaaaccgtacatcactttgctctaccgtcctggccactacgatattctctacccaaagtgaattttgcgcatggttagtttcacgacttcggttgagaaagcacactgcccagaaaactcgtcatgtttcgcctgtgtgctgccaaaggtggcaaacttgcttttgagtgcttaatgccaatgccctcgttcaatctagatgttctctacctgctgtaagtcttactctggtacaaggatttaacattgtgttgactgcagagaagttcccgtggatatttgctactcatcagttattcgttcatgttttttttttcttttaccttgatctgtcgttgcaaaccaagttcataaagtttaaacctcgttgaggaatgc

SEQ ID NO: 17455 - DNA, 990 bp, Zea mays
gggatgaatttgtgcgtgatggttcatgcatctcatcttcatcgatctcacctgctgctgtctagctccttgagtccttgtccagtccagctagctgcttgctttactccaaagtccaaaggcaaatgtagtccttcccttagcctgcgtccacaagccaagcaacagattaataacaaggcaacgcgcgtactcaacaaccaaagtaagctactagctcgatcgtatcgtacgtactgtaccggttgttctttatatataatgcgcatgccggccgcggcggcgggatccatctctcactcaaccgcgcgcgaagcacacgagatagagctgctagaggctagagcagtagagctagaagaggaggacaacaaccatggatgcggcggcggcggcggcggcgaggggagatacgaagaagaagaagatgcttgccaccctggtgggctgcaactacgccggcacgccgtacgagctgcagggctgcatcaacgacgtccacgccatgcgcgccgtcctcctcgcccgcttcggcttcgcgcctgccgacgtcaccgtgctcaccgacgaccagcacgggcgcggcggcggcggcggcgtgctcccgaccggagcagccgtcaggcgcgcgctggatgacatggtggcgcgcgcggcgcccggggacgtgctcttcttccacttcagcggccacggcacgctcgtcccgcccgtcggcggcggcggcggcgggccgcgccgtcgccgcgacgacgaggccatcgtgccgtgcgatttcaacctcatcacagacgtggacttccgggagctggtggaccgcgtgccgccgggcgccaccttcaccatgccggccgccggacggcaccaaggccaagagcaactgagcaaggagaggtggttgctgcgccatcaccatgcatgactcacacgctcgaaactcgcttgcttgatccgctgccatttattattattcattaataaaaccactac

SEQ ID NO: 17456 - DNA, 2608 bp, Zea mays
atctggtcaagacgacccggtcgtatttaggctcctcaggagcgactgggagcaacttgtcgatgagctgcaagttaggctttcaaagaatgtggaggagtgtgtggactttgcgccagagggaggtaaggtggtggtgagtgctactccaaaaggccactccgatggaagtcatggtgttgagcttcctgttgctctgcaggcattggagattattgatgccctagactatgggatggcaaaaattgcagattcgatgatgaagcatattctggttccagcaatcagtaacatacatgtgtcagtgcttgtggaatgtggtccagaacacactgtatcagtcttgagtgtagtccattccgaggaaaacaaagacaatagagatggttcaaatctgtactcaagaatagttgatgtcatcaagtttgtgtgcaaattcatctgcatggaaaatagcaagtgggttcaattttttgcgaagttaacctggccaagaatttctgatctagttatcacacactttctctccaaggctgtaccaaatgaggcatccaagctaattgagttccaagatgtcgtgcaaagtacaactgaattcgagaacaaacttaggagcatgatgtttcttttgcctgatagaaaggatggcaagctgacccaatttgttgatgatgttgaagttcattttgctgtacggaagagaagtgaaatcttggtgaaagcaaggaacattcttgtacaatatgattatgatagtcctctggaatctggtgaccaaggtgattctgttgttgatctactttttcagccagagaagtgttttacatctaaatcagcacttctagtaatgaaattggttcatggagccctcaaggatgcatctttgtcatcagcaagagtagctaaggagttctgctttgctgctagggatgttttgctcctttatagggctattgtgccggttcagctagagaagcaatttgatagcttaagtcaagtggctgctattgttcacaatgacttttaccatttgtcccaagaaattctgggccttgcatttcagtaccgtgcagattttcctagtgatctacagaaacaggttgtttttgtggatttagccccaatcttctcccagatggcggatgctatattgagaagacaaatacaactcactgttgatactataagtgaggctatagatggtgctgaaggttttcagaacacacaccaacctcagcattatgaatccgcaaaatttagtattgagcaggtcgtgtttattttggaaaagatacgcatcatgtgggagtcgatactgccaagatcaatttacaggaaaagtatgtgcaatgtccttgggtctgtcttctctagaattacgagggatatgcttctgatagatgacatggcagcagaagagacattgcagctgcaaggccttatacatttggctctggaaaacctctcttcactatttctttccctggttgagaacaacgatgggagcacaaagttcttagaccatgacgcttggattcaattggatggaattctaccatctttgaaaaagttccgcaagctagcagagttgcttgatatgtcattgaagtccatcacatcatgttgggaaagtggagacctagttagatgtggtttcacatcatctgaggtgcaaaatttcatcaaagcaatattcgctgactcgcctcttaggaaggagtgcctaggatggatcgttaggactccagcttagaatacagaaacagcatatttctgtctgtgggtcaatgatttttttttcatattcttttgtccaccataccatatagtgaagtattaattggtatgagctcagtttgcactggagacagacttgcaatctgactccccagttcaatactcaccccactgcctagaccttgactgatcagataaggctagcaattgtgcatgttaatgtgttattattgtctttttggtattgtgacattcccaaatgaccttaaccaagtgcaaggaggtgaaaaaggagggtggtgtgtgttaagaaacctttctttggccaggaaggctcatgtggcccatatgcctgaaactttagtttttgtttataaatagagaggagatccccatatcatgtaaccttggacaacaacaccatacactaataaagaatcagtccctctctacacttttgtctccttgtgttctactattattcagttaaaaaactcctggactatattctgtagcaaaaggtttttaacacgttatcagcacgaggctctattcaagaagatcaaacaaaggtattgagaagaatctttgaactatgttcacatgatattttgaatccctgtttttcctttttcatattacaagtatgatcatttcttagctgattatatcgccgactcgaagtcgatggaaatgaacacgtgagtgttgctgacatgaagtcgccaatctgcacatgttgaacgtgcacgtgtgaaacgaaaacattttaaaaaaggaaagaaaaagaaaaaaagggacagaaagaacaataagagaaagccacacttctaacgcactctctcctcctagctgctggagcagcacgcca

SEQ ID NO: 17457 - DNA, 592 bp, Zea mays
  misc_feature (1)..(1): n is a, c, g, or t
nctccccgccccccccccccccccccattccaaccaaaacttgaacgaaggagaaaaggcagagaaaaaaagaagagaagctaagagcttgggagttcagctccaagccgttcgacgagagagacgaccgaacccggccggaaggggaggagcgggaggaccgcctgcgccgtcggtgagctgcaagttaggctttcaaagaatgtggaggagtgtgtggactttgcgccagagggaggtaaggtggtggtgagtgctactccaaaaggccactccgatggatgtcatggtgttgagcttcctgttgctctgcaggcattggagattattgatgccctagactatgggatggcaaaaattgcagattcgatgatgaagcatattctggttccagcaatcagtaacatacatgtgtcagtgcttgtggaatgtggtccagaacacactgtatcagtcttgagtgtagtccattccgaggaaaacaaagacaatagagatggttcaaatctgtactcaagaatagttgatgtcatcaagtttgtgtgcaaattcatctgcatggaaaatagcaagtgggttcaattttttgcga

SEQ ID NO: 17458 - DNA, 984 bp, Zea mays
gcacgagaccattacctagaacatcctaatcgaaaagaagggaatcttttgcaaagtgatccgtgctctgctctctcgttccggaccagcggaaccgtggggaatcttttgccgagtagtagtactgcgcgtacgcctgcagtgacgggtcggctgccgcaccgaccacggaagacgacgacgaccctccgccgccactaaaggtggctccttgcagctgcaagacgacgtggtgaggctcctccagctgctcgtgctttgcgggcggtgggctcgggggcagcgcctcctcctcatcctcctcttccacctcggcggcgggtaggagcctcttgccatgcctcctccgtggatccaccttagtcagctgccagtcgatctgccatggatggaagggggcgacgtcatggaagggggagtcatgggggaggcacggtttgcgggcgcggctgccatggatgggaagaatcacggatttaatcttgtctgcgggatttgggaagcaacttcccttgcgcgccatggatgcgtgatttgcgggcacggctgccatggatgcggctgccaagcagggaaaaaatcacgggtttaaatcttgcgcgggcgcggcggctgccatcggcagcggagcgaggacggcggcgggggctgcgggcgcggggaggggacgcgcggcgggggtatgcgtccgcggatctcgccggcctgcacgggatggaggaggaagcggacggatcggcgatggcagaaccgtgcgccaaaattgtggacgcctacactattgaagggaatcttttgcaaagtgatgcgtgctctgctctctcgttccggaccagcggaaccgtggggtagtgtttgtgctgcggtgcaaggagcacggatcctggttttttcggatggcttgtgtaagtgctcctgccaatgttgcaggtttgcaatagcagttgcaggtttgcaatagcagttttttaatccaaaaaaaaa

SEQ ID NO: 17459 - DNA, 660 bp, Zea mays
ttttttttttttttttaacagaacatcatcaccatgtttgctaaaattacagagagggtttgaacatcagaacatgctaaatcgcctgttcaccatcatccatttgcgattgagacaatacgaggtaaataaatgctactaccaacgatacagcaaactctgatcggatgagaacatgacgagtctgtgatcgcttaccgaaaataacatcactaattggtgccacgctggtgctagcgatggatccaatccaacgaataactccattccccaaaacaaagactaccatggcatcaccacgacgaaaaaccctgatcctaccggcctaccgggtacaagttactacaactatggaccagaagaaatcgccaagcaagagaaatcatgcgagcacatcatagaacgaacgggatatcgataagatcacaagaggagaggggtcggcgcgcaagcgacattgccgggccgcgcttctggttgaagtagttcttgaggcagatccagtgcttctgcgcgggtaccccttgatctggttgaagtaagtccttggcggtctccgatccaggaacgtcgcctcctcccccaccgtattgtgcgggatggaaggcacttcggaaaactagtggtgtgattgtgtgaatggagaaacggaagcttttg

SEQ ID NO: 17460 - DNA, 1525 bp, Zea mays
actcctaagggcgagtgggtctctcgcgcccggccgcgacaaccctttcccttctctgcttgcttgctgctgcagtgctgcctccccctcgcccagcagcagggagcagccatgccaggggaccacggctccaagggcgacatctccttcgccggacgcttcacggccagcgccatcgcagcatgcttcgcagagatatgtaccatcccgctcgacacggccaaggtcaggctccagctgcagaagaacgtcgtcgccgccgccgcctccggggacgccgcgccagcgcttcccaagtaccgcggcctgctcggaactgccgccaccatcgctagggaggaaggggccgcagcgctctggaagggcatcgtcccgggcctccaccgacagtgcatctacggggggctccgcattggcctctacgagcctgtcaaatccttctacgtcggcaaagaccacgttggggatgtccctttgtccaagaagatagccgccggcttcacaactggtgccatcgctatcagcatcgccaaccctactgaccttgtcaaggtcaggctccaggccgagggcaagcttgcgcctggtgtgccacgccgctacactggcgcaatggatgcttattccaagattgctagacaggaaggggttgccgctctgtggactggccttggaccaaatgtagcgcggaatgctatcatcaatgctgctgagttggccagttatgatcaagtcaagcagtcaattttgaaactccctgggttcaaagatgatgtggtcacccacctttttgctggtcttggtgctggcttctttgctgtttgtgttggttccccagttgatgtggttaagtcgagaatgatgggtgactcagcctacaaaagcactctcgattgttttgtgaagacgctaaagaatgatggccctttggcattttacaaaggcttcctgccaaactttgcaagactgggatcttggaatgtgattatgttcttgacattggagcaggttcaaaagctgtttgtgaggaaagcgacaagctgaagatagagtttttgcagtcaggtggcgtacaattgacgcacagggtttttcttctatagacaaaaggggagaaatgacacctcccccctcgagaattggggaacaaggacagatctgacacctcaattgcgagaaataaaaataacagccgacagttgcatgatccctgaacgaataaattcagaactagaaaacagatgtcagtaaacaacatgtggtgaatgttggaacttgaactgctctagttcagtgggcatctgttgttgcatgcttgggatggatttaatgtttcgttttttttcttccttgtactgaagtgctctgatcggtaacgatcactgtgtgtgaagtgcttgattgttatgtggtatcatgagaatgaataaacataataatggagctgtttttttattttttactgttttttttttttttgataaacaggtcgtccaaaggatgcactctttatagcaacatatac

SEQ ID NO: 17461 - DNA, 986 bp, Zea mays
  misc_feature (759)..(759): n is a, c, g, or t
ccctccacgactagttggcgttgagctgtgttgatgcacgcctgagtcatctccgttatcctgccacaaagaacgcactgctgttatgacgcccgccgaaataatcaattatcacttgccctcctctcccataagtacaatcgctgtagtttgtacgagtaaatcaagaacatggagcacgtagatgtaatagttagctgctaaaattatacgtagattttaaatatctatagctaatatatagctaacaattaataagcaatatctaaataaaaattatagccgaaaagaaaattgacaatcatagaggagaaaaaaatagttgacatccttgtgtcgttgatctccgtccggcgccggcgccggcgtccgatctctcctttcctttttgccttttctcctgcccaccaccccgccacaaccctttcccttctctgcttgcttgctgctgcagtgctgcctccccctcgcccagcagcagggagcagccatgccaggggaccacggctccaagggcgacatctccttcgccggacgcttcacggccagcgccatcgcagcatgcttcgcagagatatgtaccatcccgctcgacacggccaaggtcaggctccagctgcagaagaacgtcgtcgccgccgcgcctccggggacgccgcgccagcgctccccaagtaccgcggcctgctcggaaccgccgccaccatcgctagggaggaaggggccgcagcgctctggaagggcatcgtcccgggcctnccaccgacagtgcatctacgggggggctacgcattggcctctacgagcctgtcaaatccttctacgtcggcaaagaccatgggtggggatgtacctttgcccaagaagatagccggcggctgacaactggagccatcgctatcagcatcggcaaccctactgaccttgtcaaggtcaggctccaggccgagggcaagctcgcgcctggtgtgccacgccgctacact

SEQ ID NO: 17462 - DNA, 1413 bp, Zea mays
tcgaggccggccgggcccgccacaaccctttcccttctctgcttgcttgctgctgcagtgctgcctccccctcgccctacccctcgcccagcagcaggcagcagtcatgccaggggaccacggctccaagggcgacatctccttcgccggacgcttcacggccagcgccatcgcagcatgcttcgcagagatatgtaccatcccgctcgacacggccaaggtcaggctccagctgcagaagaacgtcgtcgccgccgccgcctccggggacgccgcgccagcgcttcccaagtaccgcggcctgctcggaactgccgccaccatcgctagggaggaaggggccgcagcgctctggaagggcatcgtcccgggcctccaccgacagtgcatctacggggggctccgcattggcctctacgagcctgtcaaatccttctacgtcggcaaagaccacgttggggatgtccctttgtccaagaagatagccgccggcttcacaactggtgccatcgctatcagcatcgccaaccctactgaccttgtcaaggtcaggctccaggccgagggcaagcttgcgcctggtgtgccacgccgctacactggcgcaatggatgcttattccaagattgctagacaggaaggggttgccgctctgtggactggccttggaccaaatgtagcgcggaatgctatcatcaatgctgctgagttggccagttatgatcaagtcaagcagtcaattttgaaactccctgggttcaaagatgatgtggtcacccacctttttgctggtcttggtgctggcttctttgctgtttgtgttggttccccagttgatgtggttaagtcgagaatgatgggtgactcagcctacaaaagcactctcgattgttttgtgaagacgctaaagaacgatggccctttggcattttacaaaggcttcctgccaaactttgcaagactgggatcttggaatgtgattatgttcttgacattggagcaggttcaaaagctgtttgtgaggaaagcgacaagctgaagatagagtttttgcagtcaggtggcgtacaattgacgcacagggtttttcttaggggagaaatgacacctcccccctcgagaattggggaacaaggacagatctgacacctcaattgcgagaaataaaaataacagccgacagttgcatgatccctgaacgaataaattcagaactagaaaacagatgtcagtaaacaacatgtggtgaatgttggaacttgaactgctctagttcagtgggcatctgttgttgcatgcttgggatggatttaatgtttcgtttttttttcaaaaaaaaagaaaaaaaactcgcccgctaacgatcactgtgtgtgaagtgcttgattgttatgtggtatcatgagaatgaat

SEQ ID NO: 17463 - DNA, 1593 bp, Zea mays
cctcgaggccggccggggggcctagttgggtccgatgggaagcgatgggagacaccgcccgccccccatccaatccaacaccaacacacgctgccatgccatgaaatatccccgcagttaaacagctcagttcagctgatacctcgccggcagatccccctcctgctcatccgccttcctttctcgaagcgcccaatttattaccttcccctaatcccgcagccttgccagaagccaaattggtgctcctcttatctcgccgcgccgccaccgctccatttccgctcccccagcccccccaaaagaacctcgtaaccctactcgcgggattccgcaggccgccgcttgcttagggttcatcactcctgttcacacccgatggccgtggacgaggcgagcagcagtggcggtggggaggaggggtgcgggtcgtggacccgcgagcaggagaaggcgttcgagaacgcggtggcgacgatgggcggggaggaggacggggacgcgaggtgggagaagctagcggaggccgtcgaggggaagacgccggaggaggtcaggcggcactacgagctgctggtggaggacgtcgacggcatcgagtcgggccgcgtcccgcttccggcgtacgcggctgacggcgctgccgaggaagggggcggtggcgggaagaagggaagtggcggaggagggacccatggggacaagcggtcggcgaagtccgccgagcaggagcgtaggaagggcatcgcctggacagaggacgagcacagattgttcctccttggacttgaaaagtatggcaaaggtgactggcggagcatctcgcggaactttgtgatctcaaggacgccgactcaagtagctagtcatgcacagaagtactttatccgtctgaactcaatgaacagagaaaggcggcgatcaagtatacatgacatcaccagtgtgaacaatggagatccatctactgcacagggtccaatcacaggccaaacaaatggtcaggctgcaaatcctggaaaaccatctaagcaatccccgcagccagcgaatacacctccaggcgtcgatgcttatggcacaacaattggacagccagttggtggcccccttgtctcagctgttggaactcccgttacactacctgtttccgctccacctcatctggcctatggcatgcgtgccccggttccaggagccgtagtacctggtgctccagtaaacattgctccgatgccctatccaatgccacccccaccatctcatgggtgacagggtgagggacacatttcaaatgctgtgtagcgtctaaacaaacccataatctccccctatgccagcattttgcgggtgtgctgctatgtctcaataaagcaatgccaataaacccttgtacattacaaactgttgtcacatgttgcattgaggacattgcagattgtgtactttgtgttgcatgcaaactttttcatgtacatctccaaaatccaagtgtttctcgttatggcagcttgtacttcagtcagtacctgtgatatgtaaatgtgtaccagctggaacaagagtaagatactgtcgcctgtttctcatgtc

SEQ ID NO: 17464 - DNA, 2723 bp, Zea mays
cttgggaacaaattcgtagcttaggcggcagaggtttgaagcagaactaataacaagctgaagagatggtgagaacggaggtgtcacaaaattctcccctctgttcaatttatgcaacacgggttatggagaaatgcgaaaaaaaagcaaaaaaacaaagcaaaggtggccgtctagctgagtcgcttgctcaaaagatcccgggcaaagctatacgtgcagatatgcatggcaggagatgagttgccatgaggccatgactgcatgagagagagagagaggaggagggagggagggagagagatggaggttgcttaccttgtgctggctgctgtggacgcctggccaaagctagctctctctgtgcctgccacctttgttgctggtgcacgaggagaagagataagaaggtagagaggggatggtgttgtacttgtttgtgcctcagcactctgctcggctcgcttttgttgagacgacgccaccacaccaccaccagcagcagcagatgatgattggcacaggcaggctggcgccgtgacgctctcgattgctcttagcgactaagcctctgtatgtaagcaccacgctttatttggcggacacccgctccgcctggtctccctccctcatgcatatcgccctccatcatctaccatgcatgcacaagctgttcagtgcatctgctgctgttgatagtgctagcacccttacccgggaactaagcaaaatgcggtgcagtggagctagctttggctggtaaactaatccattctccctggtcccgccgcgggctcctgcctgcctgcctgctctactgacgacgtctgccactagcttatttatggctttatctagctagcaaaggtgtctatgttataacaaaagaaaaacattccagagcaaagatcattagtagtactagtagtaaaggtgctgggattctgtcgagtgagtaggcgagaaacgagtcacgtagtttccatgggacaagagagcggatcagtgcgtggtggggttgttgctgcacactcatgctagtggatcgcagcattggggttgccactactccgtttaagtttttttttttttttgccgttcgtgcatgaaacaggtgccgacgtgatacgtccttgggtttaatgtgctggtgtgccttcgctctcaactcaactgcactcggaaaaggaaatgctgggcctacgtcaccgacgccttccataccccagtcccagaaaacgctctcaacaagcaacactccccttccctgagttcccacacgcacacgcacggtatcttcctttctgccatggtagactacttgcatcgttttcgaccaggctgcctttcgcaacacatccttacgcctaccaaaaggcctgtgggctgttgcatctggaaccaacaccagcttttacctgataacccctgcagatccagattccactgtccagacgcgccgcggcggatgcaaaaataacaaaatatatcccgcgcaactttatcatcatcaaccaacggggacggctgcacaatgatgacgcagctcagctgtccctgcttggaccagcaacgcgcccccccgccagccccctctcttttctgctgtgcaaagcaacgcctcaaccacctgtctcatcgagggttaccagtgttcaccttagctataacctcaatcaaccatacacaacaaaaacaatgagggcttgttcgttttgctctcaatccatgtggattgggtgggattggatgggtttcaatcccaaacaagtcaaaatctttcacaattttttccaatcccatccaatccacatgtgataagaataaccgaacaagccctgaatcggcaggtttttccatcccaagcaaatacaatgaagttctgcagcagtataatgatagtgtgtgtacataccagctgaccaggaacacctgcagctcaagataatgaatgtatagcgctggccacaagtgaagtaatttccagtacacggatagatcaccacactctcctttagttgaggtgtaggcacgatataggtgtatcaatgtggacgagcctcgaccgacacaaggttaagcagatctcttgtaggggtccttgccatggctgccaccattgtggcgatggaattctcctgtgttgccccctttgctgttccgcccagttccaaaggccttctgctcagcttccctcgctttgttgttcttctcacggtacccagccgtagcccaagtatcctctgccttcttcgctcgagatggcggtgctccgtgtggtccaagatatatgttctctgtatctttgctgggctttggaggtggttgaggatcggtagcccgtgaagcttcccagtcaccgatatcagattcttcaacactaaaacttgggatcacaaagtcatcattatcccagtcatcggcatcgtcggcgtcggacgcggcggggccggtcagccggtgcggatccatcaggcgcaaacggacatcgaactcctgacgcggatgggcgcgagagcccgggtccgctacttcaagggctccggcggcgtcggtgggggtgagggggctgaggttaggcggccgccggccacggaatcaggatgaggaaggcgggtgcgctgtgtctggaggagcagatgcggcgaggcaaggtcggaagaacaaaacaaagcaagagatgatgagaaggaactggagcttctgcgcgccgcgcggtaccc

SEQ ID NO: 17465 - DNA, 2086 bp, Zea mays
attacacaaatgtgcgccgccatgttctccaatctcttcgccaagtttgactacggacgatcgtctccaccgaagacgccacacgatgacggccgccgtagccacatgtctgatctttccctagaaagacagcctcgacggtcgtccgtctccgtccgcatggaggcgcccgtggatgatgacgacgtcactgcggcgcccgtagccgaggtgatgagcacggaccatggcggccacgaggagtcgtctccaccgaagacgccacacgatgacggctgccgtagccacatgtctgatctttccctagaaagacagcctcgacagtcgtccgtctcggtccgcatggaggcgcccgtggatgacgacgacgtcactgcggcgcccgtagccgaggtgatgagcatggaccatggcggccacgaggagtcgccgacggtcccgtgcctcgcgttcgcgtccgagcacgggtacagcatcttctccctagcctacatgcgcatgctcgacggcgccgatgtgcggccaatgcctccggtgcccggccgccgtctcatgacatctccgtacggcgggacggtgctggccacggacgtgtgctacaggcacccgtgctacctcgtcaaccccttcaccggctcgcgcgcgtcgctgccggacctgcccatccccttctcggagaaggagccgatcgagtgccgcagcgacgagccacgcccgcgctgcgcgcgcgtcactgacgatgggctcgcgtgggactggtccccgcgcggcatcttggtggcccgtggcgacacggccttcttctgtgagcacggcggcgagcggtggacgccggtgcaccagtcgcagctcggctcgcccatgaccatcaactaccgcggcgggctcttcttcgtcctcgagctgcacacgctgaaaacaacggtcatcgacgcaggcacgctgcaagcccgcgcgaagatcccggcgccgccggtcttgggcgacgtcgacgacgcctacctagcgccatcgcaagacgacgtgatcctcctggtgcaccacgctggagacagcaatggcgtgatctttaccaatgcgtaccgcgcgcggctcaggggcaaccggaggacaccgaggtggaagccagtgctcgacatcggcgaccgcgcggtgttcatcgacggcgcgcacgggttcacagtcaccgccgacccagagggagcgaaagcgaaccgcgtgtacgtgattcttgccaatcggctaacacacccatgtggacgtctggccgtcgtgtttgacgtcggcttctccgaccttaggaggccagagcgcatggggcggctaaagctaaacaccggcgaggttgagccaatgtggggccagccgcactggatcatgcctagggatagatcggatcgtcgtcaaggatatatcaactagtacagtttattgtaggtagttacattagtttacatactctggctgtcaagcactatttctacgtaaagttttttttggcattagggaaatatattacggatctataagatattttgagttttaaaagctactgataaatctacatgtacgttgcaatgcgaaataaactgtgtctatgtttaaataaaaaaaaaaaaaaaaactaaataaaaaaaaaaaaaaaaaagaaaaaaaaaaaaaaaacatggaccatcctttgaggcggtaaacgatgaatatacttgctacgttttctatagcgaggctcgagtatagaatatagagacatatacatcttgttgctaaagtgggatgttaatgtggattttgaaagcaacaaccatgattcgaatccacatatatgcataattttagtttttttaccatttaaatatagcggagcagttaaagatgaacataaatagagtggagcaggtagaggtgaatagaagtagaggctacaatgactgtgtgttacgatgatgcacaaatcattcgataaaatgttaatgcacaactgttccatgaaaacggataaatatcgcaagatttctttgtcaacaatcaatacattgtctaattttgcctcagctattcaaactctatctcactatttaatctaata

SEQ ID NO: 17466 - DNA, 537 bp, Zea mays
  misc_feature (480)..(480): n is a, c, g, or t
  misc_feature (502)..(502): n is a, c, g, or t
  misc_feature (505)..(505): n is a, c, g, or t
  misc_feature (509)..(509): n is a, c, g, or t
ataataccatagaagattagagggagcaggagatctcagccgccgagcgcagcgtctgagcagcggccacccattcgttgttcacccagggagtctcaggtcttccgtcggctggcatcggccaccgttccatcgcatcgccgaccgccgccccacatcccaccgcggcaccgccccacagattggatttttgtcggtgattttggtgccgcactgcagattaagagagaaatttcgtcttgggcagttcggctgacagaccaacctacggcctggattggagacttatccgcgacccctcctccccacttcagcttcagcgcaagccatcttcccgccacaggctcaaaagcaatcaagcgactcctcccacagtcccacttccactcccacccacccacacgcacggccgcaggcagcagcaccatgtggtcggcagcaacggcggcggcggcgcgcgcggtgtccgtgtccccagtnccggcgccctctctcctcagcngcnggcncggcgggtcgcggggcggccgggggtcg

SEQ ID NO: 17467 - DNA, 1336 bp, Zea mays
ccacgcgtccggcgtctgagcagcggccacccattcgttgttcacccagggagtctcaggtcttccgtcggctggcatcggccaccgttccatcgcatcgccgaccgccgccccacatcccaccgcggcaccgccccacagacaaagagatattcaaatcccttgatgatgagactattactagaagattccagcgtcttaaaactagaagaatgcacttgcctcgagtcataactaccccgcttccgccccgcgtccgggatttttgtcggtgattttggtgccgcgctgcagattaagagagaaatttcgtcttgggcagttcggctgacagaccaacctacggcctggattggagacttatccgcgacccctcctccccacttcagcttcagcgcaagccatcttcccgccacaggctcaaaagcaatcaagcgactcctcccacagtcccacttccactcccacccacccacacgcacggccgcaggcagcagcaccatgtggtcggcagcaacggcggcggcggcgcgcgcggtgtccgtgtccccagtcccggcgccttcgctcctcagcggccggcgcggcgggtcgcggggcggccgggggtcggtgtcggtgcgcagcacggtgtgggacttcgtgggcggcgacctggtgcggccggacctgggcaagtggctggacgacgtggagaagcacaaggcgctggccatctacccgccgcacgagggcggctacgagggccgctacctgaaccgcctccgctaccagggctactacttcctcgacctctccgcgcgggggctcggcgacccggagaccacgctcaccaaggtccaccccgtctgcccgcctagcctcggcaggcagccggtggcgcggtggtacttcccgccggaggtggactacaggctcagcctgctgcacccggacgccaaaggcctcgtcgtctggatcatcgaagccaaggttctgtccaaggctgagctgcagttcctggccatgctcccggacatccgccccaaagtcagggtgatcgcagaatgcggcaactggagaagctttgtttggaagccactgaagcagatcgcaggcctcgagccggacccggacgcggaggaatgatcaagcaagcaggtctagctagttgtctaccagactggctactgctactgctacactctccaattgcttctgggacatctctccctgccattcctgcagcttcgcactgaatgagagaggcaattaataaagatatacatacatttttttggccaaaaaaaaaaaaaaaaaaagaccctagggcggccctagggccgcgggcgctcta

SEQ ID NO: 17468 - DNA, 2748 bp, Zea mays
gggcaaggatacgatggagcatcgaatatgtgaggtgaatttaatggcttacaaagaaagatacttgatattaatccacatgcctattatgttcattgttttgcacatcaactccaacttgtggtggtttctattgctagtagtgcttgttgccaatcggttcatgacttctggtagaggtgtgaatcaagaaactaaccttgctagacctggtgacacaagatggggttcacattatttaacattgcttcgattagagacaatgtgggactcagtattgcatgttcttaccattgtgcatgaagatggtcgtgtaccaacacaggcagcggggttgattgaaaaaatggagagcttcaaatttgttttcattttaaaattgatgttgaaaatgcttgcaatcacaaatgagctctctcaaaccttgcaaaggaagaatgccaacattgttcatgctatggagttgcttgatgttgtgaaaacccgaatggctacaatgaggacagatagtggttgggagtcattctttcaaagcgtgaaagaattctgtgctcaaaagggtattcctgtggtagatatggatgaagaagtgcctattagaggtcgttcaaggcgagatggcttcacaatcacaaaccttcactactaccgcaccgagatattctttgttgttcttgataaaatcaacactgagttatgccatcgctttaatgaagtttctagcgagttgcttgtttgcttttcttgcctcgatccaaagaacttattttgcagttttgatatagagaaacttgttcgacttggtactctatatgataaggatttttcagttattgaatgtgcaatgttaagagagcaacttgagacatacattgtccacgtgcgaaggcatgctgcttttggtacttgtgaagatattgcatctctatctatgaagatggttgaaactaaaaagcatcttgtgttccctttggttttcaagctaattgagttggccttgttattacccgtctcaacagcaagtgttgagagaatattttcggcaatgaacatcattaagagagaattgcgtaacaaaattgaagatgattggatgaatgatttgatggtttgctatacggagaaagagatattcaaatcccttgatgatgagattattactagaagattccagcgtcttaaaactagaagaatgcaattgcctcgagtcacaactacaagattgacaacttagtggtatattcactgcactattttcgtcaatgtacttttcttgtattgatgttcatctaatctacatcttttctaactgtagattggatttttggtggtgattttggtgccgcactgcagattaagagagaaatttcggtatgcatgttattatgaaacatttctaatattattacttagcctctatattgtcatcataaaactagttttatcttgtgaattatgatctattctagtgatttagcttttacaatgtcgccccacctataattttatcctgcgtccgccactggttcacacacacagttctcaattataagaagttcaataaataagcacaacaactagttcactagtcggagtccgctataatgatgcaagattcattcatttcttcttcattgtcttcaaggcatgaccctgcgagcctcctagcgtctagcgggccctctaaacatatgattggttatccacactatctcatccggaaccatcacgtgcatttactttacgcgaatatgtgtctggttgtccgtgtgccggaaatgcagttggtatgaacggatgcaaaaccgtctttttaaaaaggcatttacccgcatccgcccatatgaccaaaactagcgtaaccggccgcaatcttggacgagcctggcttggcatgtccaagcatccaaacaaccgataaatcgcatggtcgctggcagctagtggcgggacaacacaactgtgtacgacaacatgcggggacaatgcgagagtagccaaaagtccaatatagggtagggagcagggatagtcaccgggaggatcggtaggggtccgaccgtcgggaagttcgcaaggggcaaggaacatggacgaagggagctcacacggtcgggagcaacatatccacagaagggtgggggtggcggactaggtggcagttgtgtcagggatggggatttggcgaaatgggtggtggctgcggctaggagagagatgctggtgagaatatgtccaacagtttacccatatggttacctaaaacaatgttttgaactattctacactattcgtagagtagattttgaatatagagatgacgacgagggtaagctgatggagatagtctgacaaactattttttaaatatatatttcctaatacggacccacatgtcatgttcgtggagcgagtttagcggatatgcgggtgtggatacatttttttgcccgctaaaaatatcctatgggtttattgttgtatcctcatccttactcccagatataaaaatatacttgtattcgcacttgtcgggtttattattcgtagtcacgtggatattttatgtcgttgccatctctagttgtgcatatggaggtagaaatggggcgagcgggactgaagaggacgatgtattgaagaggacgatgtatgaagagaataatggttttatctactcttttaaagcatgagtttcgtgcggcatgcgtcacccgtgaaacacatagagtaaaattgttttttctc

SEQ ID NO: 17469 - DNA, 997 bp, Zea mays
  misc_feature (142)..(142): n is a, c, g, or t
gccggccggttcggcccacttccactcccacccacccacacgcacggacgcaggcagcagcaccatgtggtcggcagcaacggcggcggcggcgcgcgcggtgtccgtgtccccagtcccggcgccttcgctcctcagcggncggcgcggcgggccgcgcggcggccgcgattcggtgtcggtgctcagcacggtgtgggacttcgtgagcggtgacctgatgcgatcggacctgggtaagtggctggacgacgtggagaagcacaaggagctgaccatctacccgccgcacgagggcggctacgagggccgctacctgaaccgcctccgctaccagggctactacttcctcgacctctccgcgcgggggctcggcgacccggagaccacgctcaccaaggtccaccccgtctgcccgcctagcctcggcaggcagccggtggcgcggtggtacttcccgccggaggtggactacaggctcagcctgttgcacccggacgccaaaggcctcgtcgtctggatcatcgaagccaaggttctgtccaaggctgagctgcagttcctggccatgctcccggacatccgccccaaagtcagggtgatcgcagaatgcggcaactggagaagctttgtttggaagccactgaagcagatcgcaggcctcgagccggacccggacgcggaggaatgatcaagcaagcaggtctagctagttgtctaccagactggctactgctactgctacactctccaattgcttctgggacatctctccctgccattcctgcagctttgcactgaatgagagaggcaattaataaagatatacatacatttttttggcacgagtgtcagaagagaaagaatgcgaaccatgtacagatttccatacatgtgaatagttcacggccgcgacgcgtttagcaaaaaaaaaaaaaaaacgcacagccgaacacgagagcgcaggtacacgagatcactgtcctcgtctccaccg

SEQ ID NO: 17470 - DNA, 2436 bp, Zea mays
cctcgaggccggccgggcccgtctctgggcctgctcgcctcattgccccccgtgctgcctgcgcttttgccagcgcgcgccccaccaccaccggaaaagaaattccccaattctactccacccggcgcgctctccccacgcgcatccggatccgtccgctctgatcgagtgagttgatctggactctgtgcctgcctgtgagggcgaggagggcatggacgagttcgagctggaggacaacctcgagttcatcctccagagcatccaggagctgatggaggacccgggggacaacaacgccttcggagacgccaaccagaacgagctcttcgccagcatcgttaactacgaccaggagaacatgctgcccgacgtgtctgcagcggacgttgctgcagggaaggacattcaggggatcccgtgggagaagatgctcttcgggagggataagtaccgggagatgaagatgaagaactacagaaattaccagaatctaagttacgcacgggaggatgctttgcaggagtgcaaacaagtgaagaaggatagtccttactatgatttccactacaacacaaggcgtgctcggccatcaattgtacattttcagctacggaacctagtgtgggcaaccacgaaacatgatgtttatacaatgcatgatcaatcagtgacacactggtcctcactggagcagacaagcactgagctaatcaatgccgatgattgcatcgtcccaaaacagaggggccatggttcacagtcagtggcaatggttcaggtcacaacaatggccgtggatagtaatttattggtagttggtggctttcaaggggagattatatgcaagcgtttggatgatgagggggttgtttacagcacaagggttacagatgatgaaaatgcaatcactaactctttagagatgtatcaggatccgagcggatctagaaggttggtggctgctaacaatgactgctccatcaggatttttgacaccgagtactttgacctcctcaagcactatgtcttcccttggtccgtgaatagtgtttctgtgagcccgaatgggaaactctttgctgtcctgggagatcatgaggatggttgtgtggtggatcccaagtgtggcaaggcaattggctctctcaggggtcacttggattactcatttgcatctgcatggcatcctgatggcaatatcgtggcaactgggagtcaagacactacatgcaggctatgggacatcaggaacctatcccaatcagtagctgtgcttggtggaaggatgggctcaattcggtgtgtgaagttctcttcagacgggcgcttccttgcaacagcagagcccgtagattttgtccacatgtacgatgcttatgcggactacagcagatctcacgagattgacttgtttggcgagattggaggtttagcattcagccctgacaccgaggccttctatgtgggccttgcggaccagacgtacggaggcatgatcgagttcagcaagaggcaccaacatcattacttgaactccttgtggtgataaccacttgagcggaaatttggtcgcacagctgttggaccccattgttgcattgtgtgctccagaggagtgcatggtcctacagaggaggatctcatgagtgcatgcagaagtgtataaaattctggggggtttctttccctgttgctagtaatctgggttttgtcgctcgactcgtggaactgaaggcggtagcatatgtatagcctttctgtttctcgacacctaacaatgtacatagtttgtgtcaggatattatctccccattcaaaaaaaaaaaaaaaaaaagtagtaggttggagttttatggcttccgaatcgggagccctgcatgagtcccagcattgctgtctgcggcaactactggtcggcaccttgtacgtcgctgtatccgccgttgtatcagcacattgttggtccttacgctgcagttgcagcatcagcaccagcagtggttggtggttgattgtccagtgaccaatgtgtaggagaggaaatgtgacaggcgtcctacaggttacgcaggtcgttttcttggcgaaagttggggctaaaagctgaagtagctactagctaaaaatcgatacgcagttcgttttctcgcgaaattcggactaatttagactaatttttagtctcaaatagtactatctagtcaattattgctatttcagtttttagctccgactagtactgcttactggtattgggtttctccttcctaaaagcatcagtaccacttcctctttctaaaagtatccgggttcgccaccattacttcctctgcacaatcaagtctattctccttctccctgtaagtagcaacacaacttattttcacctcttctacacgttgtctccaccgcaagctccttcagttcttctcc

SEQ ID NO: 17471 - DNA, 1115 bp, Zea mays
acacagcgagccaatcgccgtaatcatgaaggtcctcatcgttctcgccgcgtgcgttgccgccgccctggctggcatcccctccgagtctgagatccaggctcattgggagagcttcaaggctacccacggcaagacctacgccaatgccgtcgaggaggcctacagggccaaggtgttcaaggaaaacgccatcaggatcgccaagcacaatgaccgtttcgccagcggcgaggtcaccttcaaggtcggctacaaccagtacgctgacatgcacacccacgaggtcaccgagaagatgaacggtttccgcatggagatgaagaaaccctccgctaacgtgcacgagggcaacgactcctggccctggagcaagaaggtcgactggagatccaagggctacgtcacccccatcaaggaccagggacagtgcggttcctgctggtctttctctgccactggttccctcgagggtcagctcttcaagataccggcaagctggtctccctctctgagcagaacctggtcgactgctcctgggactacggcaaccagggttgcgacggtggtctgatggactctgctttcgaatacattcaggccaacggcggtgtcgacactgaggagagctacccctacactgctgaggacggcgtctcctgcctgtacaaagctgaaaacaacggtggcgtcaacaccggctacaccgacgtcaagtcacaggacgagaaggccctccaggatgccgtttccaaggttggccccgtgtcggttgccatcgacgccagcaactggagcttccagatgtactccagcggtatctactacgagtccgcctgctcctccacttccctggaccacggtgtgctcgccgtcggttacggcagcgactggcccaacaaggagttctggatcgtcaagaactcatggggcaccagctggggtgagaagggttacatcaagatggcccgcaacaagaagaacaactgtggtatcgccaccatggccagctaccccactgtctaagtgcgggttaacactccactaattgtacttcaagtacaacagacctgaataaataccaccaactaccgggccaaaaaaaaaaaaaaaaa

SEQ ID NO: 17472 - DNA, 1386 bp, Zea mays
ggcttctgcatactacctgtggaactccaaactatgtagcacctgaggtgcttgctgataaaggttatgatggtatggctgcagatgtatggtccgggcgcttgggctcctcggggccggccgcggggtacttaccctttgatgatgccaatctgatgagactgtacaaactgatctgccaagcatatttttcttgcccaccatggttttcttctggagcgaagaagtttattaagcgcattctcgatcctaatcctgatacgaggataacaattgcagaaattttggaagatgaatggttcaaaaaagactataaaccaccacgttttgaacaaggtgaaggtgttagccttgacgacattgatgctgcattcaatgattcagaggaccgtcttgtggcagagaaaagagagaaaccagaatccatgaacgcatttgctcttatttcgaggtcgcagggtttcaaccttggaaatttgtttgagaaggagatgatgggaatggtaaagagggaaacatctttcacgtctcaatgcacagcacaggagatcatgacaaaaatagaggatgcatgtgggccactcggtttcaacgtgcggaaacaaaattacaagatgaaattgaaaggtgacaaatctggaagaaaaggtcacttatctgttgcaactgaggtttttgaggttgccccatcacttcacatggttgagcttcgtaaaaccggaggagacacattggagttccacagcttctacaagaacttctcatcggagctgaaagatatcgtgtggaaagctgaatctgacgcaaataataaacagacgaataagtgatacccagagaatctgtgtagccctcatgaggccacattcagatagatcacctcttcgggtgataccacctgcttggtactgtatgcttttttttttactggtaccacattagcagccaaaatctcttgtaaacgggaactccttctgaatgagcgcaattgtacaaaacacatatgaagaggccctccgtgagatgctccgaacactgcaatgggatgtcaaatagttctgaatggtgagtgctgtttttgcatctataggggcatatatatgtttccattccatgtgcatgtaccgttgttgtatgcgcatgggggtacgtgtgcagcaggagagagagaacatctgaacgtgtcctgagaggaaaaaaaaagtctatgtccgtttctaaaatgctttggttgtcaccagggttgagtgcctttgttttatgaaaatggacaatggagaatgatgtatgaagcttaactctagtatttgggagtaaaagtatgtttggttggatgtataatgaggaatggaagggggtcgtcacactttctatagtgtttggatg

SEQ ID NO: 17473 - DNA, 1469 bp, Zea mays
ttcttgaatttgttgatggaggcgagttattcgataagatcgtcaattctggaaggctaggagaggatgaagctaggatatactttcatcaacttataaatgcggttgattattgtcatagccgaggagtgtaccatagagatctgaagccagagaatctacttctggactcacatggatcccctacggtggcccccccccccctaagtgcatttgcaccacaaacaaaagaggatgggcttctgcatactgcctgtggaactccaaactatgtagcgcctgaggtgctcgctgataaaggctatgatggtatggctgcagatgtatggtcctgtggcataatcttgtttgttcttatggccggatacttacccttcgatgatgccaatctgatgagactgtacaaactgatctgccatgcaactttttcttgcccaccatggttttcttctggagcaaggaagtttattaagcgcattctcgatcctaaccctgataccaggataaaaattgcagaaattttggaagatgaatggttcaaaaaaggctataaaccaccacattttgaacaaggcgaagatgttaaccttgacgacgttgatgctgcattcaatgattcagaggaccgtcttgtagcagagaaaagagaaaagccagaatcaatgaatgcatttgctcttatttcgaggtcacagggcttcaaccttggaaatttgtttgagaaggagatgatgggaatggtaaagagggaaacatctttcacgtctcaatgtacagcacaggagatcatgtcaaaaatagaggatgcatgtgggccacttggtttcaacgtgcggaaacaaaattacaagatgaaattgaaaggtgacaaatccggaagaaaaggccacttatctgttgcaactgaggtttttgaggttgctccttcacttcacatggttgagcttcgtaaaaccggaggagacacattggaattccacaatttctacaagaatttctcatcagagctgaaagatatcgtgtggaaagctgaatctgatgcaagtatgaaacagacgaagtgacacccagggaatctgtgtaacttatgatgtcacattgtgagatagaccaccacctcgggtgataccgcttgtttggtactgtatgttttttttactggtaccacattggcaatcaatctcgtgtacagagctccttctgaatgagcgcagctgtacacgagacatgaagaggccctccctgagatgctccaaacgttgcaatggaactaaaaatttgtataaatgggtccttggcgtcctaccaatcgggcctgctgcaggggcaaccactagcggaggagcggcaggtccccttctctattgtatagagcaccgactttctgtagtttctactgttgtcacttttacaaaaacaaattttttttctaatcgaccacggtcaagcttcccgccaaaaaaaaaaaa

SEQ ID NO: 17474 - DNA, 1900 bp, Zea mays
actgaagtattgtaaatactatagttgttttaaggcattctaaacttagctctggacctcagttttcaaaactgcggtattataaactacggtattgtcataactaaagtatagtatagtatttcaaaaactgtggttttcaaaaactttgttcccaaacagggccttacatgcgtaaccaatccgaatccatccctatagcctatgtcggtaggcggcccccctgaccgacgatgccacctcgtgttgcgatcagaggggttgttactgaccgtgtaggccgccacgctagcggtcggtacggccccgctttggcaccagtctatccccccctatgaattgtgctaatataatcaactctttcttgtgtgtgagcatcagaggaaaatagttctgtcctccatgtgctcatcgtgttatcttgagctgcagtgtttgatccgtcgatttgcttaggttaattagccactgcatagggtgtgtgattgtgttcgtgaggccagcaacatataggcctgcatctgcatggtctttgatttcacgtgatgtgtcttcgacagaacacaattgtagccgaatccaaacgtgtacgtccggcagcaacggggttgctgggccttcatgctcgtcgctcaccatcaccactcaccaaacggtgctagctagtatgccactgtccgcagtggacgacgagggctccctgtccctacccagacacacccactgcgtctctcctcgtgagctgcctaatcgggccacgtgacacagggtcacaatcgctgccagtaacaattgcaggtcactcaatccagcaaccaaacacaaaggaatatatatgtgatctggacagaacatgcaagagaataatagagatcagtaatattagcaagtgggttcacgggtatgctcacgtccaaaatccaacgacattttttaataagcggaatgtaatcgatccagacgggccagctcgagcaccacatggcgtggctccacctcgcgtccgccaccaccgctataaataccactggccatgcacacacgcactcccagcgctagcatagcagcagctcgaactagctttagctactacgtgtgcaagtgcaagcagcccactcgttcgaccatggctgcgagagcggcgctcctccagctggctgtcagcctggttatccttgccgccgtggcgagcgcgagcgcgaccaactgcccaccgccaccgctgccgccggccccaaagccgccgacgcccggcggccaccacggccacgggtcgtgccccaggaacgcgctgaagctgggcgtgtgcgccaacgtgctgggcctggtgaaggccaaggtcggctcgccgccgtacgagccgtgctgctcgctgctggacgggctcgtcgacctggaggccgccgtctgcctctgcaccgccgtcaaggccaacatcctcggcatcaaccttaacctccccatcgacctcagcctcatcctcaacaactgcggcaagaactgccccaacgacttccactgcgcgtagatcatcagtcagtcagttattgatcgtcgtccatcgccggccggccgtggttcatcgtcatcattccgttttgcttaattgttgatcgatcgtcttcttcctgtcagtcccagcagcttatttattttaaatttgtctctttatacatatatatgagtggtgtggttacacttctacatagcccaggcagcggctacgacgcgtgcgtgtatatgtctggcctggggtgatcagttaattactgatcggtgttgcgcagtagtgcagtacgtatattcttcatttgtagtcatgacgatctgtttgcatggttcgttcaataaatgaagttgacaagttgtactttctttctcaaaaaaaaaaaaaaaaaaa

SEQ ID NO: 17475 - DNA, 1792 bp, Zea mays
cgttcctccggccataaatgataaatctcgcattcctgtacggctctaccaactaatttcgacaggattgatcagtttgtatgtcaatcaaatgtgtctttgttattttttccaaataaaaaaggtgactgtaagtgctatccaaccacattagtatagaaaatcatcaagaccaaaaaccctacttaaaacaggtttatcttctacaaaatggtaaaacatattttctacaaaatggcatatattgtgcttcttttctgcttgtccccatttgtttgtgaaagtaatgtctgcgtaatattgctcaaccaaacccttctttttaagatgagaaacctactacttatgattatttatacatcttcattagggcttttctactgggcttcctgagagattgcaattgtcccttgtgcgaactataccagggctggagaactgtctaatgctaagacctgcatatgcagttgaatatgattacttacccgcatatcaatgctcaagatcacttatgacaaagaagattgagggtttattcttctctggccagataaatggaacaacaggatacgaagaagctgcagctcagggtataatttctggaatcaatgcagctaggcattctgatgggaaatcattaattattcttgagagggaaagcagttatataggaactcttattgatgatcttgttacaaaagatcttagagagccctatcgcatgctaacaagccgttcagaacaccggctattgcttcgatcagataatgctgatagtcgtttgacccctttgggacgagagattggtttaatagatgatagacgttgggagctttatcagtcaaagcaagcccgcattaagcaagagaaagaacggttgagatctacaaaagttccaggaggtgaatttgctgctgaagttactgcagtatccaaccaacctgtaaaggattcatctacacttgaagccatattaaagaagccacatgtacaatataaactccttgacgagcatggatgcggaaatgaaaatttatctcgaattgagaaggaatgtgtagagattgatatcaagtatgaaggtttcatcgcacgacaacaaagtcaattacatcagatcgtaaaccaagaacacaggaaacttcctgaagatttggattaccactcaatgacaaatctatcacttgaagctcgtgagaaactttccaaggtgcgtccacaaacaataggtcaagctagcagaatcggcggtgtgagcccagcagacatgacagttctcctcatttggatggagagcaaccgacgcatggctacccacaggagacagcgagagcagctgggatcagttgcagtcgagtcggatggttcttcagaggaggccgtccaagccagcacggcataaacgtggggagcttctggcagctgaacaaggaacaacaaaattcggtgaggcatccagggagcctgcgcgtctgtggtacaacgatgcagggaggcgccaagtgcatgcatgtcttttcttgacgacatgaggaaatagtcggccccctggttccttcatgttgtgcctcattgtctaccagtatgtgtgcatgttgtttaggaatgctggtggaatacaggttgatatttgcagtagtagaattgagagagcagactgtaaagaacgacaacaaataggggtttaaaacatacattcgcactcacttagctaaaaaaatacactttttgtgtgttttatactttatacttaagcaaaatatagattttttcggaaaaaaaaaaaaaaaaa

SEQ ID NO: 17476 - DNA, 1840 bp, Zea mays
ctcccttttagcttttagctcgccccttgcgttcgcggaaaaagctcatcttttcaggtggaaggagcgattcgtctgtgcctgcgcctgcgcctgcgcctcgccgggctcgtgccgctgtaccctccttctccaggagacctgtacggtgaaggggcgctcccgcgccaaacgggaagcaaagctcgctcgcgcccttttttcggatcatataacgccggcgcctagctcaaacaccacagctcgctgcctagatctacgcggcagcggcgtcggcagaggagagggacccggagctgcgccatggggcctaccgccggctccggcgaggacaaggctatgttagagctccggaaaaaacatcgtgtggacctggagagactaacaattacatcacgaccgttcaagacattgtcattctttgtgttagccatcgctcagaatttggaaagaacatgttcatctgttctgaaaaaaggttaccagttaaaaaccgcaatgcttttggttgttgctacttgggttctgctcatgttcactgatggcctgaatgaaaagcatctgcaggagctactttggtatgtcaggtttggattgtggtggattatactaggggtcgcttcatccattggattaggttctggtttgcacactttcataatgtatttggctccccatgttgccctgttcactatcaaagcggttcagtgtggtagggttgatttgaaaagtgctccttatgacactattctccttgaaaggagaccatcctggttagagaaagactgtctgcaatttggacccccaatttatcatgaaacaattccattcagcaaaatactgcaagaagtttatcttgaagctattctttggggcattggaactgcacttggagagcttcctccatattttctctcaagaacagctagcatgtcaggccgcataattgatgagttagaagatttggatgcttccatttcagaaggctttctatcttcagctttacgtcaggccaaacgatggctcatgtctcattcacagtatttaagcttcactctaatattgctacttgcttcggtgccaaaccctctatttgatcttgccggtatcttgtgtggacaatttaacatccctttctggaagttttttctagcaactttgattggaaaggctattgttaaagtttgtatccagactacattggtgattactctctgcaataaccaacttcttgatttggtggagaaaaggcttatatgggcatttagcaatgttcctggagtggcatctgtccttccatcttttgtttccaaactgaagatggccaaaaataagtttttatcagcccatgttgctgcatcagcttctacttctgttaagggaaagaagtggaatctgtcattctctttggtctggaataccctggtgtggctcatggttgcaaacttcattatccagatagttacttctacagcacagggttatctcaggacacaacaggagcgagagatcagtaaaaagttggaaaccgagctttctgcctcttaacgttcttctggcgcaccaaaatgattcgccctgggaaagtccaatcatacattgtacataaccatgcatcaaccatcagctcaaggctaaaggctctcctgcagtattgtggtgcactgactattgatctatttctttcgaaagagagagagaggaaagctattagctagtgctagaaatataatgctgccccagctacaattgtaagtttgtggccttgtacatagcatcaaatattattaggggacaaaaatatctaatgatataagttaatacctgattttgtctccgc

SEQ ID NO: 17477 - DNA, 1167 bp, Zea mays
agcacgggtcacctcgccgggatcccacctcgccagtgccgcctcgccgctctcccacatcgtgtcctccgccccttcgcacggacgcacacgcacctcacctctcacaattccacacctcacctctccgcttcgcttcttgtcgctgcggcgcgcggccatggtctccctccgcttccctaccgctgccatcccccgcctcccgccatcccaggcccccaacggcgtcgccatcgctgccacggtcgccgctgcagccgcggccgcagctgcagtagcggccagcttgaccctcacgggcaagtccactggccggccagtcccgcaccctgcccctctctgggcctccctctccctggccgacgcggcggcccccagctccgtcgaaccccggaccggcgcgacattccccaccgaggccgccgttgggcgccgcctactcggcataggcctccggaagaccagcgtcctcgggctcaagtccatcgacgtctacgcattcggcgtgtatgcggatgacaacgatttgaaacagcagctgaaggagaagtactcgaagttctcggtctcggaactgaagggaaacggtgagctgatcaacgatgcgctagagcgtgacataccgatgacggtcaggctgcagattgtttatgggaggctgagtattcgctcggttcgcagcgcatttgagaagagtgtgggaagtaggcttcagaagttcggtggacaagacaccaaagagttgcttcagagttttgttgcggttttcaaggatgaatacaaattaccaaaggggtctgtgattgagctttcgagggaatctaaccatgtccttaaaatttgcattgaaggcgaggaagtggggagcattcagagcaagctcttgtgcaagtctctcttagatctctacatcggagatgactcctttgacgaaaatgcgaaagacggcatccatgaaaatatagctagcattcttaaaagttaaatgggatgcttaaggaaggttacatggaactgggagatttttcagggaagatatttttaattccagcaatacctcgactgtgcctagtaagtagcgcacaagttttttttcagtagcgcgtgaggaactgaggaaaaggatagatccttccaagtacagccttttccaagtcgtgtgtgaaa

SEQ ID NO: 17478 - DNA, 831 bp, Zea mays
ggggcccctcgggccggcgcgtcccgcacactgcccctctctgggcctccctctccctggccgacgcggcggcccccagctccgtcgaaccccggaccggcgcgacattccccaccgaggccgccgttgggcgccgcctactcggcataggcctccggaagaccagcgtcctcgggctcaagtccatcgacgtctacgcattcggcgtgtatgcggatgataacgatttgaaacagcagctgaaggagaagtactcgaagttctcggtctcggaactgaagggaaacggtgagctgatcaacgatgcgctagagcgtgacataccgatgacggtcaggctgcagattgtttatgggaggctgagtattcgctcggttcgcagcgcatttgagaagagtgtgggaagtaggcttcagaagttcggtggacaagacaccaaagagttgcttcagagttttgttgcggttttcaaggatgaatacaaattaccaaaggggtctgtgattgagctttcgagggaatctaaccatgtccttaaaatttgcattgaaggcgaggaagtggggagcattcagagcaagctcttgtgcaagtctctcttagatctctatatcggagatgactcctttgacgaaaatgcgaaagacgacatccatgaaaatatagctagcattctcaaaagttaaatgggatgcttaaggaaggttacatggaactgggagatttttcagggaagatgttttaattccagcaatacctcgactgtgcctagtaagtagcgcacagtagcgcgtgaggaaaagatagacccttccaagacagctttttccg

SEQ ID NO: 17479 - DNA, 2961 bp, Zea mays
  misc_feature (47)..(47): n is a, c, g, or t
ctgcacctcctcaccagttacctttgtcccatgtatccgcgtttgcnttgcgtctgtgcctgacggggttaatcgtgaaaccccgggcaaagcgcataaaaaacggaaagccgttctcatcttgccctcccttttagcttttagctcgccccttgcgttcgcggaaaaagctcatcttttcaggtggaaggagcgattcgtctgtgcctgcgcctgcgcctgcgcctcgccgggctcgtgccgctgtaccctccttctccaggagacctgtacggtgaaggggcgctcccgcgccaaacgggaagcaaagctcgctcgcgcccttttttcggatcatataacgccggcgcctagctcaaacaccacagctcgctgccttcatagtccccccccccccccccccagaggagagggacccggagctgcgccatggggcctaccgccggctccggcgaggacaaggctatgttagagctccggaaaaaacatcgtgtggacctggagagactaacaattacatcacgaccgttcaagacattgtcattctttgtgttagccatcgctcagaatttggaaagaacatgttcatctgttctgaaaaaaggttaccagttaaaaaccgcaatgcttttggttgttgctacttgggttctgctcatgttcactgatggcctgaatgaaaaggtaccatcttgttttaaattaattagaacatatgtgttttgcaggattaagaacagtctgagttacataaatgctacatattagataatgacttgcaagaaagctttgcccttttttattctttttagcacgaatatttggaagtggatgataaactgcagtctgtttttactcttactctttaggccgctgtatttggggaagccctaaaactatctgccatttggcaaatttgcttgtatattgttcaagaaaatttcatatacatcgctacagcttggtcacattattaataatttgcttccaatatctcccgttgcatgcccaatatgcaccttggataaacatggtatgttgtcattgatgcagcatctgcaggagctactttggtatgtcaggtttggattgtggtggattatactaggggtcgcttcatccattggattaggttctggtttgcacactttcataatgtatttggctccccatgttgccctgttcactatcaaagcggttcagtgtggtagggttgatttgaaaagtgctccttatgacactattctccttgaaaggagaccatcctggttagagaaagactgtctgcaatttggacccccaatttatcatgaaacaattccattcagcaaaatactgcaagaagtttatcttgaagctattctttggggcattggaactgcacttggagagcttcctccatattttctctcaagaacagctagcatgtcaggccgcataattgatgagttagaagatttggatgcttccatttcagaaggctttctatcttcagctttacgtcaggccaaacgatggctcatgtctcattcacagtatttaagcttcactctaatattgctacttgcttcggtgccaaaccctctatttgatcttgccggtatcttgtgtggacaatttaacatccctttctggaagttttttctagcaactttgattggaaaggctattgttaaagtttgtatccagactacattggtgattactctctgcaataaccaacttcttgatttggtggagaaaaggcttatatgggcatttagcaatgttcctggagtggcatctgtccttccatcttttgtttccaaactgaagatggccaaaaataagtttttatcagcccatgttgctgcatcagcttctacttctgttaaggtatggattccactctactttagttacaaaaaatagaaatttaatgtatgcttcacttgcccactctttaaagtgatatgacaacagcccttagactatctccagcaacttacccatccctatactcatattcaaactcccctctgcgaacagtgcaaaactgtgtttttgggtaaactatggattgactgctgcagacggcctttgaggttgataatgttttgatatttttaccattggtcatgtaagtacatggcatggaagaacacaccatggaaaggtgtgcagtaagtggttataaaattaagttcttgatcttggggataattctggtgtttacatcgactcaaagaaaaataaaatgctccagtgatttactctgaccattttactatcttgttgtcatcttcgttgcattgtttaaaaatgctcatattgtttaatccatgtttagggaaagaagtggaatctgtcattctctttggtctggaataccctggtgtggctcatggttgcaaacttcattatccagatagttacttctacagcacagggttatctcaggacacaacaggagcgagagatcagtaaaaagttggaaaccgagctttctgcctcttaacgttcttctggcgcaccaaaatgattcgccctgggtatcgatctggtttcttcaatcttttacatacttatatcgagtttagagaggaatattaacatgaataatgtggtaactgactgggaaattcaaaccgtgttcaccaactatttgctgctactgttcttcaggaaagtccaatcatacattgtacataaccatgcatcaaccatcagctcaaggctaaaggctctcctgcagtattgtggtgcactgactattgatctatttctttcgaaagagagagagaggaaagctattagctagtgctagaaatataatgctgccccagctacaattgtaagtttgtggccttgtacatagcatcaaatattattaggggacaaaaatatctaatgatataagttaataaaaaaaaaaaaaaaaaaaaaaaaaaaaaactcgagggggggcccggtacccaatcg

SEQ ID NO: 17480 - DNA, 5015 bp, Zea mays
  misc_feature (2806)..(2806): n is a, c, g, or t
ggctgtgcgagccacaccgcccgcacaccccaccggccggccacacaggcaccgacagcgactcgaagatgacggccgggcagcttctgcgcaccgagccatcagcccagccccagcgggtgcgccacagcaccccgccggcggcactccaagcggacatcgtgccgtcgtacccgccgcccgagtcggacggtgacgagtcgtgggtctggtcccagatcaaggcggaggcgcggcgcgacgcggacgcggagccggcgctggcctccttcctctacgcgacggtgctgtcgcacgcgtccctggaccggtccctggccttccacctggccaacaagctgtgctcctccacgctgctgtcgacgctcctctacgacctcttcgtggcgtcgctcgcggagcacccgtccgtccgcgcggcggcggtggccgacctgatcgccgcgcggtcgcgggacccggcctgcgcgggcttcgcgcactgcctcctcaactacaaggggttcctggccgtgcaggcgcaccgcgtggcgcacgtgctgtgggcgcagggccggcgcgcgctggcgctggcgctccagtcccgcgtcgccgaggtcttcgccgtggacatccacccggccgccaccgtcggcaggggcatcctgctcgaccacgccacgggcgtcgtcgtcggggagacggccgtcgtgggcgacaacgtctccatactccaccacgtgacgctgggcggcaccggcaaggcggtgggcgaccggcaccccaagatcggggacggcgtgctcatcggcgccggcgcgaccgtcctcggaaacgtcaggatcggcgccggcgccaaggtcggcgccgggtccgtcgtgctcatcgacgtgccgcccaggagcaccgccgtggggaaccccgccaggctgatcggcgggaagaagggcgaggaggtgatgccgggggagtccatggaccacacctccttcatacagcagtggtcggactacatcatttgagcccgcaagctagaaaaaaaaagagctcgtcttgctactgttgttatactgctgttgcgttttctgtgtatgtgcgtggatgtgttagctgtatgctcttgttccagtgaggtgaaccgtggacatgctggtgtggtgtccagaaagatatgctcaaagttcgctctgtaattttcgaagcagatgaactgtgttactactttttactctagtaaaaactgtttctttggctcatttcccacccacccaaagtacgaccagtatgtatggaaaaagataatttgtgtttccagatctaactgtgactttacctgtgaacctgctatcaatcgttgcatggcctttttgtatctgtgttggattattctgaatcggtgaattacttacaccactagtttcagtatgagcaaatggacaaggatggcgacagtctgtaaaaacacagccatatctctcgtcagtcggctaccgttgaaaagatgttgttgtcttctcactggccaccgcattggctcttcttcttcttttttccttggacgaaataaccaaatcttctgcacgcctcaatgcagccttaatccgcgtggacgatacaaaattgtatactaattcatgtagcccatggtagcctggtaggttttagatgtcctcgtggaggatcgcaattcgcaacggtgtcaagcggagccaacttgttgcaacctggcggccttatagctaggcggagaagaaggcgaacacggctttgacatcgtcacatcgattcaggaactctaggcggctttgaccttgaatggcaggatcttatctcgtcaccgttcggctgttagcttgggtgtaccaattaccaagtggaagcctagaacgttcatcttctgttgtaaaatagacaattttttttaacttttaggtaccatatttcatcatttatattattcagttttgttcaaataataaaaataaataaattacaattaaagtatctctaatgataaaataattcctaataaaatgaataatatttatattatatatattttcttatacataagacaaacagtcaaacaagatgtctacaaataaaaatgtcaagtagtaaagaaaaaacgtggcacttggacaaaacagaaagagtatggaagttttattgctaggctgcagctggctgacaaagtacgtaaatcgcagcccttggactcaacagctggtaagctttcgtaggtaccgtgcttgcatttccgccgcagccgcttatgggtcagctgaagcgattgctgctctcgtcactgctttgcttgcatctgtaccctttctgcttagtataccatccaactgaagcacaaaacggattgatattgatgcttgattcgttctgacacacggctaaattcgagcggtgctgcatgaaaaaaaaattataacatacagctggagcatgtactcgtaagtaaacattaaaatggttgtaatttggtctagttgagcccatttgtcactagcccaattcatagagcacatggggtttagtcccacgttgcttatctagctagatgacaactaacatatatgtgaaggtgtacatgaatatttacatgcgataaacaaaaagttataaaagctgttatgtacataccactgccttttatttatttagttataaatataaaataccataccttcacgcggttgcacgtagagaagtttcagaaagcggctattaaaacttagcatagttgacgcggaccctccctttgttttaaggaagaggtttcagggacggctaacaaaacttagccgatcgaatncaatgacttatttagttgacccagaccctctatttttatttttagagacgtcccattgacgagaggaacataagatcaactccaagagactatctatattgtttctaattaatatgaatacattttaaaaaaataccattcaaatgcttatttaaaaggttgtccaaatatagtcatcttctattatggatttctcgctagtcaaagatagaaaatgtgaatgactctctagagtgcaaacaagatatagaaaagttgttactgattggaaagatatataaagtgttttttatgcaaatgactttctaaataatatagaataatatagagactggaatttagaaatactgttggagatgatctaacacaagtggcttgacttctctttatttgcaccgccgcttctttgatgtgtcgtccctacgtttgtcatgcaacagaacaagcaatagcagtgtctccgaactgacctgcaagggtgcctatgaattaggtttctgggtagcgcattcatatgtacactccttcacgtcttcaaaaaaaatgtaagtaaatatatattatctgtttatcatgatgttgatctcatggatagatcggttgttggtttatcttttgtgcgttaattttatggtttaatcaacaattgtttagtactagttttggttgtgttatatgctagtagatcaattttattttatgttttgcactatacgatcaaattaatcttagaccctactaattttataacataaataacactatataagatcaaaataattctagcatatgcaccatctatgatgtagagtagacacggccagccctgagggggtgcagcgggtgcggtcgcactgggcccccaaaaacagagggcccctctggccactggacgttagcactttttttccgctaagcatatctaccctagacataaatacgcaagagtgatgcactatcgatcagtttcgtttaaattgttaaactaatgtctcaattacttatctaatattcactttgttccaaaataatatttgttttaactctttatttttatgtctatattcaactagatgatgaggaatcaactagagaagcaaaataaattctattttgatacagagagagtattatttactatacacatgatggttgcatcgacagagagaagatttttaaacttgaaatatttttttgaactatttaaggacaacaatgacttaagagaggttaaatggtttggcgattatatgtatctaaaagaagttgttggatgagattgatcttaatggtataagcgatgatttgtatcataaaatgttagaagatatttttaatgacattggataacaagtatgtgtttttgctatattttatatttgtcttcttcttataaacttgaaatagtgcattataatttatatacattgaatattatatatattatgtgtagatggggcctctatttcggatttcgcaccgggcccctaaaaagtcaggaacgaccctgagagtagatttagaaaatcatctaaaactggtttcatatttttttctgagctaaaagtaattttctattattttctaaaatgagacccaatatcttggtttcaaataccgtttttttaaaagatgggtaatttttttaatataacgtttctggtaaaatctatttgatgcactaaactttactagtctgacctatcttattcatggacgatgtgctacatgttagaccaaactatcataaaaaccatctaaaaacaatcgatttcaatagccgaaagtgtcaaaatatacggtcttctaattttaagaggtaaatcagatcaaatcaataacgctagaattgatttttgagttggttaaacctagtttcgttctacattgttgtaataattagtttgactcttttttatcataagagatgaagccggatatttattcctttacctaaaaaaccattaagtttctgcaatgtaactttaatcaataatacaacgtgagcatgggtaataaacacaaattcagaactcttcgtttgtttataagcaaattgaaggcacgtgtttttgttgctgattgttgggaccgaatgacacgcggtcaggtgggcccaagcaataggaagttggaatgctcatatgctcagcaatacaacaggctgggacaacggtgttgttaagcgtgtcccgtcaattacagtgca

SEQ ID NO: 17481 - DNA, 540 bp, Zea mays
aatacttgtgacaatttctcatacatcacagacaatgaataccaagaagaatgttgttctttgctgccttctttttgtgctcgttctgcatgcagatcacgctctagccaagtgtggctatacaactcctataatgccattctgcaaagcgtggatgtgcaaggcggagtgttggacagaggccaagttaattggaggcaaagtcacgcaacagaagtgtatgagaggcgggatcaagggctggtgttactgcgaattctgcatttaattttgcaaaggagaaggatcgccatgtctttgcttgtcttgcctttgtcaataactcagtgtaataatgctagttatgtctctaggcagactagtctagatcgagttgtttgttgttggtagctaggcattgctagcatctgctattgttttcagatattgtattgtttgttgaacaattatgtcaatgtccatatgttagagattagtttctttgctcgttgacaaatattattatttatatcctcaattgttacaaaaaaaaaaaaaaaa

SEQ ID NO: 17482 - DNA, 533 bp, Zea mays
ttgggtacctcggggcatggggtacctcgaggccgggccggggtcttctcccctgcgtcaaagacgacgcaagcccttgcctctccctactcctccaaaccctcgccgactcagatccagcttcctcgcaccgccgtcgccatgccgttcactccaggcccctactctggcgtcagcaccctcgcccttgtggcgagggcgtcggcctttggcgtcggtgtcgtctacgggagcatcaagctctcaatcctaaaggtaacaaaacctaaaaaggaggaagtgcatgatcatcactaaggatgacagggctgctacatgttataaaattggcagtgcaccccttctccatacgtgcaatttcgtttatgatttgtggacctgtctgtaacatacctgctgttttttttgtgttgtaataaattcttatacaatgacatgaaatcaggaagtggaaaaagcaatattaataattgcaagtcgttcgacaaaaaaaaaaaaaaaaaagcggccaaaaaaaaacaaaaaaagcggcc

SEQ ID NO: 17483 - DNA, 1001 bp, Zea mays
  misc_feature (3)..(3): n is a, c, g, or t
  misc_feature (23)..(23): n is a, c, g, or t
  misc_feature (39)..(39): n is a, c, g, or t
ccnggccggggatgcacctgtcncacacattggccttgncttgctcataattagttcatcagcaaacaacaaacaatggcaccgaggctagcgtgcctcctagctctggccatggcagccatcgtcgtcgcgccgtgcacggcccagaactcgccgcaggactacgtggacccgcacaacgcggcgcgcgccgacgtcggcgtcgggccggtgtcctgggacgacaccgtggccgcgtacgcgcagagctacgcggcgcagcgccagggcgactgccagcgcccccccccccgcgccccctccggcgtcttctcccctgcgtcaaagacgacgcaagcccttgcctctccctactccaaaccctcgccgactcagatccagcttcctcgcaccgccgtcgccatgccgttcactccaggcccctactctggcgtcagcaccctcgcccttgtggcgagggcgtcggcctttggtgtcggtgtcgtctacgggagcatcaagctctcaatcctcaaggtcacaaaacctaaaaaggaggaagtgcatgatcatcactaaggatgacagggctgctacatgttaattcccatatatgcaaggatgttataaaattggcagtgcaccccttatccatacgtgcaatttcgtttatgatttgtggacctgtctgtaacatacctgctgtttttttttgtgttgtaataaattcttatacaatgactgaatgacatgaaatcaggaagtggaaaaagcaatagtaataattgcaagtcgttcgacaaaaaaaaaaaaaaaaaagcggcctcgggcctccaaaaatagaacacatttagagaagaaaaattgacgaactagacgaaataaatggacataaatggatacatgagagaaaaagggggccccccaaacccccatttttgtccccttaagggaggataaattgccccttgggccttaaaaaacccccaaagtttttgggaaaaaatccttaagcgaagggg

SEQ ID NO: 17484 - DNA, 773 bp, Zea mays
  misc_feature (756)..(756): n is a, c, g, or t
gcgttctcgtcaatggcccatataaagcccagccctcccccgcccccccccgccccgccccctgcaacaaagacgacgcaagccctcgcctgtcctcactcctaaccctcgcccgactcagatctatctgccccgcgccgccgtcgccatgccgttcactccgggtccctactctggcgtcagcaccctcgcccttgtagcgagggcatcggtcttcggcttcggtgtcgtctacgggagcatcaagctctcaatcctcaaggcaacaaagcctaaaaaggaagaagcgcatgctcatcactaaggacgacagggctgctacatgttaatttctatggaaggatgatataaaaatgtggttgcactctttctccatacgtgcaatttgatttatgatttgtggacatcttgctgtaacacacctgctgagttatcttagttttgtgtcataataaaattcttagccaatgacttgaaatcaggaaggggaaaatcaaaagaacccacttttgttttgtcaggatgcgaaattaggacatggcttcttgaacttcggtcaagaggatctgccttgttgatcctgttttgttgcgacgttgtgcaatggattggatggctcaaaaaaaaaaaaaaaaagcggccagggccccgcttttttttttttttttttgtgcgcaattgcttgtctggcagcaaaactaacaagtgttttactccaccccagatgtatggccgtatgggaaaggcttattcagntcagcatcgatctttca

SEQ ID NO: 17485 - DNA, 527 bp, Zea mays
cctcgaggccggccgggccggggtcttctcccgtcttctcccctgcgaccaagacgacgcaagtccctactcctccaaaccctcgccgactcagatccagcttcctcgcaccgccgtcgccatgccgttcactccaggcccctactctggcgtcagcaccctcgcccttgtggcgagggcgtcggcctttggcgtcggtgtcgtctacgggagcatcaagctctcaatcctcaaggtaacaaaacctaaaaaggaggaagtgcatgatcatcactaaggatgacagggctgctacatgttaattcccatatatgcaaggatgttatcaaattggcagtgcaccccttctccatacgtgcaatttcgtttatgatttgtggacctgtctgtaacatacctgcttttttttgtgttgtaataaattcttatacaatgacatgaaatcaggaagtggaaaagcaatagtaataattgcaagtcgttcgacaaaaaaaaaaaaaaaaaaggcccctagggcccaagatcca

SEQ ID NO: 17486 - DNA, 1287 bp, Zea mays
gcgttctcgtcaatggcccatataaagccctgccctcccccggccgcctcgggcctgcaacaaagacgacgcaagccctcgcctgtcctcactcctaaccctcgcccgactcagatctatctgccccgcgccgccgtcgccatgccgttcactccgggtccctactctggcgtcagcaccctcgcccttgtagcgagggcatcggtcttcggcttcggtgtcgtctacgggagcatcaagctctcaatcctcaaggcaacaaagcctaaaaaggaagaagcgcatgctcatcactaaggacgacagggctgctacatgttaatttctatggaaggatgatataaaaatgtggttgcactctttctccatacgtgcaatttgatttatgatttgtggacatcttgctgtaacacacctgctgagttatcttagttttgtgtcataataaaattcttagccaatgacttgaaatcaggaaggggaaaatcaaaagaacccacttttgttttgtcaggatgcgaaattaggacatggcttcttgaacttcggtcaagaggatctgccttgttgatcctgtttgttgcgacgttgtgcaatggattggatggctcatgatggatgtcacttagggctgttttggtggaaggggatgattgatcccttccaccagcccagcccttagttactgttttcgtgaataactatgttgttctgatggtcggttggaataagattgggcctcgcttgttcggtgtggatcgaaaggaattgaagggaattaaatcatttactagtcaattaaataaagagaattaaccgccttaatctactcctaactaggtgcaaatgaaggcatttagaatgtccaacagatcctgtaaaaaaaatctagaggagtttcttgtcctctacaaatagaggacattgcttgatcctatattattttaatattttaacaatagacctagtaaaattaaaatgtgtccaacatatttgagagtatggctaataggtatgtacaaaaactaaaagtaaaatgactctaatatagatacggtgttttttagagcaagggatatagagaagaaaaatgagaaatagagtgagattttttagaggaaacagtaaaaaacaggaattatggatagatataggagacattgttggagagagagtctaagtcagtcactattaaagcccctaacatggattgaaaagacatgggtcccatttggatcattttatataaaaattgactaataatgtgattgcccaaaaaaaaataag

SEQ ID NO: 17487 - DNA, 578 bp, Zea mays
gccggccggtcccgggaagtcttctcccctccgctcccctgcgaccaagacgacgcaagtccctactcctccaaaccctcgccgactcagatccagcttcctcgcaccgccgtcgccatgccgttcactccaggcccctactctggcgtcagcaccctcgcccttgtggcgagggcgtcggcctttggcgtcggtgtcgtctacgggagcatcaagctctcaatcctcaaggtaacaaaacctaaaaaggaggaagtgcatgatcattactaaggacgacaaggctgctacattttaattcccacatatggaaggatgttataaattggcagtgcaccccttctccatacgtacaatacaatttcgtttatgatttgtggacctgtctgtaacatacctgctatttttttttgtgttgtaataaattcttatacaatgacatgaaatcaggaagtggaaaagcaagtcgttcgacaaaaaaaaaaaaaaaaaaggcccctaaaaggcaaaaaaaggcccctaaaaaaaaaaaaaaaaaaaaaaaaaaaaaaaggaaaaaaaaaaaaaaaaaggcggcc

SEQ ID NO: 17488 - DNA, 745 bp, Zea mays
gccggccggtccgaaacaacaaagacgacgcaagccctcgcccggccgcgctcgccccgcctaaccctcgcccgactcagatctatctgccccgcgccgccgtcgccatgccgttcactccgggtccctactctggcgtcagcaccctcgcccttgtagcgagggcatcggtcttcggcttcggtgtcgtctacgggagcatcaagctctcaatcctcaaggcaacaaagcctaaaaaggaagaagcgcatgctcatcactaaggacgacagggctgctacatgttaatttctatggaaggatgatataaaaatgtggttgcactctttctccatacgtgcaatttgatttatgatttgtggacatcttgctgtaacacacctgctgagttatcttagttttgtgtcataataaaattcttagccaatgacttgaaatcaggaaggggaaaatcaaaagaacccacttttgttttgtcaaaaaaaaaaaaaaaaaaaaaaaaaaaaaaaaaaaaaaaaaaaaaaaaaaaaaaaaaaaaaaaaaaaaaaacctcgcccgcccccctagcccttgggccgccgcctcctccgccaccaagggttcgagctcctcgcgtcctgcgagcgcgcgccgcaacgccaccatgaagttcaacatcgcgaacccttccaccgggggccaaaagaagttgaaaatcgatgacgaccaaaagctgcgggccttttttgaccgaaggaaatcccag

SEQ ID NO: 17489 - DNA, 531 bp, Zea mays
aaaaaaataaaaaataagcagccatccacacactactgacacacacacacaaagccattagccatgtcgttcaacaaaaacctagcagtggtcgttggcttcaccttggctctgctcatcgcgtcgaacggtgaagaaacttcctcgtatggcggatcagcgctgtgcgattcaacgacgggggtcgcctgcgcatccgacgcggtctgcgtgaccatctgcaagcgaagggctggacagaactacgtctacggccactgctacaaggagcctagcggcggccgttcgtgcttgtgcaccgtacggtgtgatccacggtcggcggcggcgccgctggaggagccgaccacggcggcggcgccggcgccggcgccggcttggcgcgggatcggaatgctaggctgattcttttttattcgctaattacgtggatctgcggatctgcacataaaccaggacgcctttgaaataatcggcatgcatgctgctggtttgctggatctttaatctgttgcatttcttccggttcga

SEQ ID NO: 17490 - DNA, 1129 bp, Zea mays
gacgatcgtactttgtgaggctggtatcttgcacagactcggagcaagataggcctagctggttacaagccaagaacaagtagagcggtagagggaaatatctggagagggaaacaatggcgggcgaggagggtgagggtcttaaggtcctcggcctgcaggtgagcccgctcgtgctccgcgtgtgcttggcgctgaacatgaaaggagtgcgttacgagtacgtcgaggaggacgtatccaacaagagtgagctcctgctcaagtccaacccggtgcacaagaaggtgcccgtgctcatccacaacggtaagcccatctgcgagtcacccgtcatcatgcagtacggcgacgggctccctcgaggccggccgatcctcccaaccgacccctacgagcgcgccactgctcgcttctgggctgcctacgccgacgacaagctgttcccagcgtggtacggcatggtgaaggcccaggcggaggaggagagggcggagaaggcgaaggagacgctcgccgccatcgagcacatggaagtggccttcgccaagtgctccggcggcaacgccttcttcggtggcgactccatcggctacgtcgacatcgtgctcggctccttcttgttctggttcgaggcggtgcgcagggttttcgacctggagatcattaacgctagcaagactccgctgttggctgcgtgggcggagcggtttgtagggactgtagaagcgaaggaggtgctgccgttgcccacggcggacatggcggtgcagtacatcaataagcttcatgcccccctgccgccgccatgagttcacaatgagtcgtgtaagtgtaaccaagcagggaaaaaggtaaatggtgcggtgctatggtccaaatttcaaccgaataatgttcaaagcttacatcgataggcttgggttgttgtcatcaaataatgtggttcagtcgtctcctctgcaataaatataaatatgattattaaaaaaaaaaaaaaaaaaaaagcccaaaaaacgcgccgcccccgcttgcgcccgcaatggcactcgtctccgcctcctcgtcctccaccaccgccgtcacggggctccccaggaatgggcagcgggcgtcgtcctccttcctc

SEQ ID NO: 17491 - DNA, 990 bp, Zea mays
  misc_feature (9)..(9): n is a, c, g, or t
cttgcacanctcggagcaagaaggggtagctggttacaagccaagaaccaagtagagcggtagaaggggaaatatctggagaggaaacatggcgggcgaggagggtgaggcttaaggtcctcggcctgcaggtgagcccgttcgtgctccgcgtgtgcttggcgctgaacatgaaaggagtgagttacgagttcgccgccgcggccgcatccaacaagagtgagctcctgctcaagtccaacccggtgcacaagaaggtgcccgtgctcatccacaacggtaataagcccatctgcgagtcactcgtcatcatgcagtacgtcgacgagctgttcgccggccggccgatcctcccaaccgacccctacgagcgcgccactgctcgcttctgggctgcctacgccgacgacaagctgttcccagcgtggtacggcatggtgaaggcccaggcggaggaggagagggcggagaaggcgaaggagacgctcgccgccatcgagcacatggaagtggccttcgccaagtgctccggcggcaacgccttcttcggtggcgactccatcggctacgtcgacatcgtgctcggctccttcttgttctggttcgaggcggtgcgcagagttttcgacctggagatcattaacgctagcgagactccgctgttggctgcgtgggcggagcggtttgtagggactgtagaaacgaaggaggtgctgccgttgcccacggcggacatggccggtgcagtacatcaataagcttcatgcccccctgccgccgccatgagttcacaatgagtcgtgtaagtgtaaccaagcaggaaaaaaggtaaatggtgcggtgctatggtccaaattccaaccgaataatgttcaaagctttcattgataggcttgggtttgttgtcatcaaataatgtgggttgagtcgtctcctctgcaataaatataaataaatatgattattttagtgggtactttctttgtccct

SEQ ID NO: 17492 - DNA, 2121 bp, Zea mays
  misc_feature (2038)..(2038): n is a, c, g, or t
  misc_feature (2079)..(2079): n is a, c, g, or t
cttatgctagtagtgataaacacatgtacatacatgttgtcgcatacatcactctagttttctggactaaattaatactgaaaatatctatttctctaacaatgattaccatgaacgtcgtagtctggaaaaaaattgtcatgaacgactaactagcagatgagtgacttgttatacttatataccagagcattagacgatcgtactttgtgaggcgctggtctcttgcacagactcggagcaagataggcctagctggttacaagccaagaacaagtagagcggtagagggaaaatatatctggagagggaaacaatggcgggcgaggagggtcttaaggtcctcggcctgcaggtgagcccgttcgtgctccgcgtgtgcttggcgctgaacatgaaaggagtgagttacgagtacgtcgaggaggacatatccaacaagagtgagctcctgctcaagtccaacccggtgcacaagaaggtgcccgtgctcatccacaacggtaagcccatctgcgagtcactcgtcatcatgcagtacgtcgacgagctgttcgccggccggccgatcctcccaaccgacccctacgagcgcgccactgctcgcttctgggctgcctacgccgacgacaaggtattatgaacttgcacgcacgcgcgtttacgtgcctgatagtctggtaccgatcgaatgggcggcgccttgctcgcagttgtttccagcgtggtacggcatggtgaaggcccaggcggaggaggagagggcggagaaggcgaaggagacgctcgccgccatcgagcacatggaagtggccttcgccaagtgctccggcggcaacgccttcttcggtggcgactccatcggctacgtcgacatcgtgctcggctccttcttgttctggttcgaggcggtgcgcagggttttcgacctggagatcattaacgctagcaagactccgctgttggctgcgtgggcggagcggtttgtagggactgtagaagcgaaggaggtgctgccgttgcccacggcggacatggcggtgcagtacatcaataagcttcatgcccccctgccgccgccatgagttcacaatgagtcgtgtaagtgtaaccaagcagggaaaaaggtaaatggtgcggtgctttggtccaaattccaaccgaataatgttcaaagcttatattgataggcttgggttgttgtcatcaaataatgtggttcagtcgtctcctctgcaataaatataaatatgattattactttctttgccgtaaaatacttatccatattctttttttctagaagctatttttgaatgtttaattaaatgtataaaaatactaatatttacgatatgtaataaccattgttagattaattagtagaaaatatatgtttatcataaatatgtctggagatatagatattgataatgtttttataaataatctcgctaaatttaaaataaaatgacttacaacgagatgtgataagaatagcgttattgcttttttatgagtcaaacaatatcaaatttgatcaaatatactttatgagcgagacctgaaatctttttgattatatggttatcatttaattttagatttaattttaacattagttaaattttatctcttgatgctgtaagcaaaacctagcaacttaggctcaataaataaaatatgatcaactaaatttgcttaccacaatgcagagtctagtcttttgagccttgtataaaaccgtgctatatttgttgagcacaaggtgctcagacttactattaaatataaaatataatcaactaaaattgcttatcacagtgcagagtctagtcttttaagacttgaataaaaccatgctatatttgttgagcacaacgcggtgctcagacttactattcaataaagttatagagggtactagatgtggtctatcttgtaaattttctgtggagcagcaagagttttaggcgtatactcttctaatactactctagtcaacgtcattggggaaaatgagtacccaaatcgtttntctttgtctctatggaatatggatgatagagacacaaaganagagggtatgatgcacgttattttgaatagcaaagtggattt

SEQ ID NO: 17493 - DNA, 1044 bp, Zea mays
agagcattagacgatcgtactttgtgaggcgctggtctcttgcacagactcggagcaagataggcctagctggttacaagccaagaacaagtagagcggtagagggaaaatatatctggagagggaaacaatggcgggcgaggagggtcttaaggtcctcggcctgcaggtgagcccgttcgtgctccgcgtgtgcttggcgctgaacatgaaaggagtgagttacgagtacgtcgaggaggacatatccaacaagagtgagctcctgctcaagtccaacccggtgcacaagaaggtgcccgtgctcatccacaacggtaagcccatctgcgagtcactcgtcatcatgcagtacgtcgacgagctgttcgccggccggccgatcctcccaaccgacccctacgagcgcgccactgctcgcttctgggctgcctacgccgacgacaagttgtttccagcgtggtacggcatggtgaaggcccaggcggaggaggagagggcggagaaggcgaaggagacgctcgccgccatcgagcacatggaagtgaccttcgccaagtgctccggcggcaacgccttcttcggtggcgactccatcggctacgtcgacatcgtgctgacgtgctcggctccttcttgttctggttcgaggcggtgcgcagggttttcgacctggagatcattaacgctagcaagactccgctgttggctgcgtgggcggagcggtttgtagggactgtagaagcgaaggaggtggtgccgttgcccacggcggacatggcggtacagtacatcaataagcttcatgcccccctgccgccgccatgagttcacaatgagtcgtgtaagtgtaaccaagcagggaaaaaggtaaatggtgcggtgctttggtccaaattccaaccgaataatgttcaaagcttatattgataggcttgggttgttgtcatcaaatattgtggttcagtcgtctcctctgcaataaatataaatatgattattactttaaaaaaaaaaaaaaccaaaaaaaaaaaaaaaaaaaaa

SEQ ID NO: 17494 - DNA, 1758 bp, Zea mays
gacaagccatccgacttcgtcgccgcgctccgcgacgcgcttgctggcctctccgcgcggggcgaggccgtgtatctggtgttcgataatttggaggttgttaggagctgggacaagggtggccagcttctggcgctcctcctccgcctctacgatctcctccgattgccgcaggtcgtgctcgtctacgtgagcagtgctacacctgacgcgtactactccctggtgttcgataatttggaggttgttaggagctgggacaagggtggccagcttctggcgctcctcctccgcctctacgatctcctccgattgccgcaggtcgtgctcgtctacgtgagcagtgctacacctgacgcgtactactccatgactggctctgtcgagccgaatcacatttacttccctgattatacagtggacgaggtacgagacatcctgatgcgaggccatctaaatccgaagctgtactcatcgttccttagtgtggcgctgaagccattgttccgggtaacaaggagggtagatgaactggtggctgcactggagccacttttcaggaggtactgcgagccattgggggatttgaaggccgttccggatgagagcatcaaaagaaggttgtttgaacatatacagccacatttggctgttgccatgaacgagactttcattgttcccacgagggtttctgtggatgaatgcaaagaccacagttctcgtgggaaggccagtagtaaaagacagtttggcagtagggatggcttgccgactgaattggagttccacatgtctgtgtctgcgaaatacttactattgtcagctttcctggcttcaaggaacccggctactcttgatgcagctttgttcgattcaactggagggtcagataacaataggcgtgagagaaagagctctcaagcatcgatgaatatgaaggacaccatggccgaagagatgcttatgaaaggccccggcacatttcctcttgagaggctcttggctatatttcagtgtatcacatcagtgtcagaagatgatctcggtgatgttgaatgttctgatagtatgatgaatggaagtggaatgactggtttgatgtcagatgttcttttgcaactgtcaacactttgcaattctaatttcctctccaaaagccggagctgcccgatggaaggctcagctagatatcgatctaacattgatgaagatttagcactcaaggttgccaggagtgttagtttccccctctcgaagtatatttacagaagatagcctttgcatccttagcctaggctgtaacaactgttgtctgttgttgttgggtttagactataatgggatccaatttgtctatttcacaagatggtagagcatcaagggataaagcaaatgctatatgctctatcttctttagtgtgttgacttctgatagtcctgtttctcagtcagacaacgagtacggtgtctgatcctggatctagtggtaacttaacattctgagctttatggagatgtctcagaggtagcattatgtcaatagctcgtgccattcagacagaaaagaaccattagcatctgaatatagccatgctgcttagtttgctagatgttcttttcttcacaattcaaatgtaatgcggtttttgtgtgtgcacagtggtgccacgtttctatctgcaacagatcagtgcccctttgtccaagtccaatgttgttgtaatgatctgtattaagtgattattccattcccccccc

SEQ ID NO: 17495 - DNA, 2480 bp, Zea mays
  misc_feature (1102)..(1102): n is a, c, g, or t
  misc_feature (1121)..(1121): n is a, c, g, or t
cccgaaggtaacattttccagtcactgaccaggcaaacaggcccctggtcatctccggtttcctcgtttcctttcctcttcgtcccagtgacgtcagtacgtcacccatcggcacccgcgccgctgacccccgccaccgtgtcacgatcccgtccccgctcgcacgcctagcgcgatggcgcacccgatgtacggctccggaccgctccgatccaggaacgcggcgagctcggacgaaatccagctgcggatcgacccggtgcacggggacctcgacgaggagatcgacgggctgcactccagggtccgcatgctcaaaggggtggcccaggagataaattctgaagccaagttccagaatgattttcttcatgaactgcaaatgacccttgcaaaagctcaggctggagtgaagaacaacatgcggagattgaacaagagcatcatccagcagggctcaaaccatgttctctatgttgtcctctttgcactgttttgcttctttattgtctacctcttgtcaaagttctctagaagatagttccgtctttggtgggcaaatctaggataccatgacttgtatgtagtctaaagaaagaaaaaaactattgtacttctgcctggccttgtatcctcagtcttttcgtcgaaaatcgaatcaaactagaaatacccttcaaagatttatgctaacgtcatccactgatccatatgattggaactgttgggattgaattttttctaccgagacgctctcccttgcgtcttccgttgagtgtatgcaagtatgcaacgaattgagcgtggatcaaaaggtgcatatagtaggataaaaaagactaatgttattaatatatctttcagaacaatgcatagcttgtatgtgaatccattcctgatttttataggattaaattccatcgttactgctgtggtggttttctgccatcatgtatgttatttctgatattcagagggcatttgcaagcaactaatttcattattgatatatatgagggaagaaacctatccggacaccatttcttacaatttagggctggtttggtgaccatagatcacaaagggacatcatttcttatantttagggctggtttggtgnagctatggacgaagacttgctattcaaaattaaataacaaggagattactctcatgaacaaggagattactctcatgaatccggtgatccttggtcactaaattagtccttatggtgtgactttgcctggtggaacaggatttggttgaacacagagaatatttaaggctgggcacgatagctgtgcacgccgtctcatttttgaataagtggctgtggactattttgcgatgcagcacactactcaaagtgaggagtaccgtatatatgggcttattattgtcaccttgagttaaaattggcagaatatgatgaaattatagttgaaaaggagaacctgtctaatcttttaggagcaccctattgcttcaggcctcatcttttctcaatggacattgcttcagagttcgtatttgctatctgtattgatttggtcttggtcgcatgaagaaattggaattcttacactccgagtgagctatctagtataacaaaactacatagctccaaatttttatttgttttacagcccagaatgctcactgggcttgcttcggtgcaggcagcgtagccactggtttcaacttgcacgcctcatatacatatttgtggctaggaatttgctattatatgggcaagatgacttgttgcattgcattttcagaaaggagtccaaatcgaagtgaaaattccaacaaaaacttcgaacttttgcgagaataaccagttcgactggcaaggccggttcaaccgcactaccccgatgcaactgtaaacttgaagtaaagctcggatctggcaccaaaatcacaatggaagcgttgaataagattaaactggtgaatcttgagatttaagatgaatcacaaacacaaaagcatacaatacacacgattttcactgaggttcggtcacaccacaacggtgccctactcctcgttgaggtgcccacaaagggtcgggtctttctcaaccctgttcctctttaccgaccacacaggtcaaggcgatcccttactcaagtgcttgtaaagagcgggtgatacaaatcattcttggggtcgtccacaactttgaagactcccaaggcaaaatacaatccgtcgaagaacaacacattccaagaacaatgaatccacaattaagaacgatcacaccaactcgagaatgatagatcgaagaattagaatcaaaatcgctttgagatctaagaacttatctcacaccgaagaaaattcccaccaatcgaaagggagaaggacttggggcgggagaattgaatgaatccactttgagtgatgcgagtgtagccatcaatgagtcttgattcgagcgttctaggatttgagagagagagaa

SEQ ID NO: 17496 - DNA, 918 bp, Zea mays
cgggattctctttcgcccactcgggcgcgtccgccaccaggaaattgcctgatgaccaagcaattctgcaaccgctggcaggcatgtcacacacaggcttgtaaaatgtccaggcctcgtctcgtttcctcttcgctcccccgtgacgtcagtacgccacccatcctcaccggctgtcggcaccagcccgccgccgacccccgccgccgtgtcacgactcacgacccattgtggtttcagatcagacccgaatcgcgagcagcgatctgtacgtcgtccccgttcgcacgcctagcgcgatggcgcacccgatgtacggctccgggccactcagatccaggaacgcggcgaactcggacgaaatccagctgcggatcgacccggtgcacggggacctcgacgaggagatcgacgggctgcaatccagggtccgcatgctcaaaggggtggcccaggagataaattctgaagccaagtcccagaatgattttcttcatgaactgcaaatgaccctcgcaaaagctcaggctggagtgaagaacaacatgcggaggttgaacaagagcatcatccagcagggctcaaaccatgttctccatgttgttctctttgcactgttttgcttcttcattgtctacctcttgtcaaagttctctagaagataattatgtcttcggtgggcaaatctagaataccatgatttgtatgtagtctaaagggaaagcaaaatgctattgtacttttatttggccttgtatcctcggtctatttgtcgaaagttgaaacaaatgagaaaaggggaaattagtacctctaagggctagtttggaaactcaaatccccttcgggattgaaggggattggagaggaatttatttttttccacctcaatcttctccaatatcgaaggggatatga

SEQ ID NO: 17497 - DNA, 3664 bp, Zea mays
aggcagaagcaacccgacttgaataaattgatgtactagaagaggagcaattaaatgttgttatttagttggcccgatatcagcagaccttgaggcgttaccatgacaaggatgtacgtcaccgagcattctcagtaggagacctagtgctccgccacatacaatcaggagaaggatggcacaagctatcaccaccatgggacggaccttttataatcgtagaagtaattgagcccgggtcatatcgactcactcagatggatggtactccgatagggaactcttggaacattgagcacctcagtaagatttatccatagtagcaccatggactctagatcgtaagctaccacttgtaattttgcgacttcattatcaataaagcttcaactttctctccagatacaaatatactctcgtatgctacttacagagcaatcggcttaagtcgggattgacttaagtccgtgtcgcatgctcacgcttacaaaacaaagggtgtaaactataccctattaacggaaccatcggctcaagtcgggatcgacttaagtcggtgtcacatgctcacgattataaacgaagggtgcatgatgtacacttctaacggagcaatcggcttaaggtgggatcgacttaagtcggtattacatgctcacgcttacaaacaaagagtgcatactataccctaccaacaaggatatggctcacatcgagaagtggtttagccgatgcctcatacacacacatacacttatacgcaaaaaaggatgcatgcaaaatcccatcaaaagaaacaaagcaaaatacagggacaaacactaagctccttttccccgtaactcgtcacaaaacacaaacaaagcagttccagatctcagattcaatttaaatggcaagtacacttatcaaaaggaggaagcacctccctgcttacccaacccttcgttctattttccaagattacaatgtgtcatggaggagcattttctagaggggcgtcggtcacgggatcaccagggggcgattataacaacagcagtaggtggtgagagtccaagtgctactactcgctcccattattggtgtgtctgtgtctctgtgagatggttcagatcaaaatctttcaacaatagagcttgtttttggcgttttaaaaaatgtcaatataatggtccaccgtccatgcctaacttggtgggaactttcttggaacgcagctctgctggaatttgcgtgtctgccgtgctacggttagtggacagcgtccgagatatctgtgtcgctttctctctagagaaaataactcaaccaaaaaaaaaggcttcagtttcttttctttccagcaggaaatggcttcagttctcttactgaacttgttttaatatgtgttaattaatttggttttgcaaatagaaggtgttataattatttttaatcttccacagtcatccaacccactgattatctgtccttatctcttacaatcctacggctttcatgtttgtgcatttctttcagttgcttcatataccattttaggacatgctattggttttctatataagaatgagcaacataatttctgttgtacactagagacaatttacaatggtgtgatatccacaattccaatcactgaacatattgttttagagaggactgctaaattctctacacaaataaactgcctcaaggaatttcaccttgggcctgacacttctgaagctagaggtggagctgacatgaccacaattctaggagcgctaaagcttggtggatttgtcacgacaaagttatgatctatgtcagtttcgacactgatagagccttccaagacttttacgacctcggacattttgggccttcgtttgcaatcaatctgcaaacaccacattgcgagcttcatcatctgaattgcttcttgctcctgtgcctgactgtcactagtaatgcacatatcaatcaaatctaccaagcgatcactcctcaacttctcctctagcaaggtaataagatgaaagctcttttcagaccgagaagtgtccaggttcttccttccactgatgatctccatcacaaccacgccaaagctatatacatcagccttttcagtgatgtgcgacgtcaaccattctggagctagatatccaggcgtgcctctcattctagtaaccacttggctcttatcccggtcgatgagcttgcagagtccaaaatcagagagcttagcgtcgaagttgtcatctaagaggatgttctgtggtttcacgtccaagtgagcaactctcttcatgcactcctcgtgaagataggcgaggccctttgctacatgagcaataatcttgtgtcgcgtttgccaatgcaggcgaggagcgtcgtcatcgccctgcccctgccggcaaaagatccactggtccagggatccattgggcatgtactcataaaccaagagcctgtgagttttctctgcgcagaaaccgattaccctcaccagattgatatggtgaatgctaccgatggtctggacctccgccagaaattccctctttccctgaccagctctatccaagcgtttcaccgcaattgcttgctcaccaaaacgtcctttgaaaacggagccgaatcctccttcccccagcttctctctgaactgatcagttgcttcctgtagctgctcaaatgtgaaccgtctgggcatccctggtagcctcccaaactctgcttcctcctcttcctgcatctcttggcgtcgatgcaatcgtcgtctatgcaggacgaagaaaaagaccaaggatgcgatcaaagtgaagccacctattgaaccacctagaacataaccaaatattcttggcctcttggattttgatgaggatgtgatgctgcttgttccatttgttgcagtaggtgaagttggaggcggagacaatggtgaagttggaggtggagacaatgacacaagatcgacggggggacagaaaatgatctggtaatctgttcctgacggacacgaatatgtaacgggaccattatcagtggcgtaggtataggcgtcggggcacatccgagcgtagaaaaccgtgttgctgtttaccgtgctggcgtcgcaggaagatccgttgcacgcgctgcggcaaccccctggcaccttgagctcatcggggcactgcgacgtgatgtcggcggcgcagcgtggacccctgctgcaccccgacgaccccttggacgacggcaccggcagaaagtccatgggcaagttaaagccgtcgacgacggtgatgtcgaagtagtcgtccatgttgttggagtcactcagggtgaactctgccatcgtcatcggcggttggccgctggtagtgcatgccagcacgccgccgcagtcacccgtctggcaggatttctttccggggccgtcgaacgaacagcccgtgcgcgcccacacgcggccactttgcgtgttgccaggcacttgaagcacccaggtcttcccaggctccagctgcatgccgccgcccactggtgtggcggccggccacactgtgtaggagcatcggttggtgatgttgatggtggaagaatggctgctgttggtagcgacgccgaggacgaggaagaacagcagcaggaggtgctgcgtccaagtgctactactcctcggacgcgt

SEQ ID NO: 17498 - DNA, 2593 bp, Zea mays
cggacgcgtgggcaccaatgatgcgaagaactgtgatgggaacatatgtcatcgcaaagatcaagaaagaagacggaaatatttatgtcttgttgaatgggatgggtgccacaccagaaggaaatgttccattcctcgatttgtttgatataaatactgggagtaaagagcgtatatgggagagcgacagggaaaagtactatgaaactgttgttgcactgatgtcagacaaaactgacggggaactgctccttgatcagttaaagatacttacgtcgaaagaatcaaaaacagaaaacacacaatattacttgcagacttggccagaaaagaatcaagttaagataacaaatttcccccacccatatcctcagcttgcttcattgtataaggaaatgataagataccagcggaaggatggagttcaacttacagcaaacttatacctgcccccagggtatgattcatcaaaagatggacctttgccatgtctagtttggtcctaccctggtgaatttaaaagcaaagatgctgctggtcaagttcgtggttcccctaatgaatttccagggattggtgctacatctcctcttctttggttagctagagggtttgtgattctgtctggtccgacaatcccaattatcggtgaaggcgatgaagaggccaatgacagatatgtggaacaactagtaacaagtgcagaggctgcagttgaggaagttgtcaaaagaggggtggctcaccctgataaaattgctgtcggtggtcattcatatggtgcattcatgacagctaatctgctggctcacgctcctcatcttttctgctgtggaatcgctcgctctggagcttacaacaggactctaactccatttggttttcagaacgaggatagaacactctgggaggcaacaaacacatatgtcgagatgagccctttcatgtctgcaaacaaaatcaagaaaccaattttacttatccatggagagcaggacaacaattctgggacattgacaatgcagtcagaccgattcttcaatgccttgaaaggtcatggtgcactgtctcgtttggtaatacttccttttgagagccatgggtactctgccagggagagtatcatgcacgtcctctgggagaccgataggtggttgcagaactactgtgtaaatggtactagcaaggttgactcagtgtcagaggctgacagtaaaaacaaaacattgtcagctagtggtggcagtgcagcccgtgaaggtctaaaccctgaggaactctcatcattaccaagatcgcttctgtgatcaacttcagttggtgttcatgaaacattccctggacagcaagcctaaagggaaaaaatagtgtatcgttgcacttctaccttaaccgactaccagggatgccttgattggcctcatatttgtttcgattgctgcaggtgatcatgttactggcatgcagcagccccccccccccccccccccccccacccccaccccacaaatataagaaaggcctagtctctggtggccactgcactcagatatatttgggtcaatttgtattctattggtaatggccaatggaagtcattcttgcgattaatatcatgtacagaaatatagccttttgcagttttgatcccaactcttgcacttggcagcgaactgatacgttggttttctttgacagcaatctaaaataaaataataactaatgagattatcataagcacctgctccaatgtctcgcatcgtcacattttacctgttaccattatttactgcagccgtgctactgacattcgttgcccatttgagaggcgcgggtttgcctggatagctgggtagctgggtagctaccggtagcctgggtgggcttggcctgtttactgcaatacagtgcgggtctgttgggtaggttgtattgggttagctgagtttggctcggtttttgtttggttgcccgctttagcgtaactttttcgtttttatatttaaaatatttgaagtttcatttcatatcgcggttcttaaaagtacaagtctaggtgcctgtcgtcctaggaggagcggccgacacctagatgtaaaatttatttgaactttttttttgcacccgggccttttgggatttgtagcttcagctagggataccaacgagtatatacccatcgagtagtatcattttattttatacatgtactcgtcaataaaaattatacttgtcaggttactcatctgctcttgtgggtataaaaacttactcgttggctaataaaaattatacctatacgggtaattttacctgttggctaacccgtacctgtaaggtctcaaattctaatatttgtatcacttagaatgttaaataaacacacaaatataagttcaacttaaaccatgagattacataatagttaaacaaataatagttgagaaggattttttagctaagatctgctttattattgataataataatatgacgtcggtatattttacatatgggtacatgagtatggatagtatccatctatacctgtatctgtctacccaacaggtagagattcttgaccattaacata

SEQ ID NO: 17499 - DNA, 1998 bp, Zea mays
cattgggtacctcggggatccccacctccgaaggcacaacccccacgacgcaggagcgctggctccgggcgttcgggtactcggagacggcgttgggagaggagaaccgcaccgcggcgcagacatgggcgagttctgcccctccccgcagggggactccgcgctggcggcgccgcccttgacgctctcctccccgtccccagcaacggcggttaggccgagctacgggagctgcgaccgccgctacgtgaagctggtcttcgacaacctccacgggagcatctccgtagacccgttggccctgcagtttgttgataccgaagagtttcagaggttgcgggacttgaaacaacttggtcttacatatctcgtctatcctggagcggttcacacacgcttcgaacactcattaggtgtatattcgttggctggaaaggctataaataatcttaagacatatcagggagaagaacttggaattgatcatgttgacatgcagactgtaaagcttgcaggtctcttgcatgatatcggacatggacccttcagtcatttgtttgagcatgagtttcttcctcgagttgatcctggctcatcctggtctcatgaagatatgtcagtgctccttttggacagtattgttgacaaacatgcaatagatattgaaaatggttatctcaaaatggtcaaggagatgataactgccagcgctaagcctaccagcacaaaaagtgcaaacgagaagcattttctttatgacattgttgctaatggtcgtaatggtatagatgttgacaagtttgactacgttggccgtgactgcagagcatgtggtcttggctgtaatttccagtattggaggttgttggaaggcatgcgagtgatgggtgatgaaatttgctacccagccaaagactacttgagcatccataaattgttttcaacacgtgctgatctgcaccgcacagtctacacccatgcgaaagtaaaggctgttgaactcatgcttgtcgatgcactcattgaggctaatgactacttggggatatcattgcatgcacacgacccagaagatttttggaagttggatgacacaatcatcaaaaccattgagactgctcccaacaatgaactgaaaaaagcaaaagaaatcattcaacgtattcgccgaagagaactttacaagttttgcaaccagtattctgttccaaaggacaaactggagcatttcaaaaatattactgcacaggacatagtttgttcgcagaaatcttctgaggtgctgctgaaggaagaggatgttgcagtaagcaatgttaagatagatcttactcgtggaaaagataaccccctcgaaagcatcaagttctttaaggattttgggtgcgacgagaagttccccatcacagatgatagggttagccacttgctacctgcatacaacgaggatagaattgtgagggtctatgccaagaagcctgagttggttgatgtggtgtcagaagcctttgagaatctccagatgagaatgtatggtgagaaaactcaagtgcatgagacgcccaagagaaagaggattagatccaactaggcagttggattttgtctaatcgcactttagataacatacaaatacaacacaggaaaatagcttcacaaacaagaagctatatagataacaggtttcagatggtagtctgaactggtaaggtgtaggtattttgtgtacaggagaaaatacaaacaacattgcatgaagtctaaaaactcacgttgacgtacgagatgctgcatgtgcgtagattggatagctagtcaaatactttatgatgtggatggattttaattactttatgatgtgtctggatttgtaagtacttgtcattttaatcttaatttatatggatctaagagaaaaaaaaaaaaaaaaaaaaaaaaaaagtcaaaaaaaaaaaaaaaaaaaaaaaaaaaaaagttctctgcgttgttaccactgct

SEQ ID NO: 17500 - DNA, 2027 bp, Zea mays
accagtaccacaccactcctttcctgcctctctctctctctctctctctctctctctctcttctcttctttcctcacctccgacggctgaacaagcgaaactgcgaaaagcagcaacagcaggtaggtatagtgatcctcctcctccatggggaacgccctcaagtgcttcacgggagaagaagaaggccaccacttccacgggcgcagagaccgctacccctactaccagccgcagtcctacagtggtggcgatccacatccaccggccgctgctcatcagcagggtctagcagccccccatggcttcgtaaccttcgtccccgtcacgcaggtttcaatccacatccagtgacatgcatactgtgctgttcctttgtttcccttccccttttctgtgtccctactccctactccctggctactgtgtgtgtgtgtgcatctatttgtgaatgtgagtttgtgactgagccagagcagttgctacaatcttgtgatttgaatgttgggcgcgattgggtaatttctggcaggctgctggtccaaacgccgggcaccagcagaggagcagtggggttcatgacagaagaccggtggcttctaagtatgaatccaagtgagacgctgctctgctctttgttgcttcgtccctcagataattattgcaacgcactagctcatttcgctatctatctatctatctacctttgttcacacacagcaccgaggacatcgacgaatcgtctgccgagggcctgtgcagcgccaagagctacgccaaggcgaacccgctgctgatccaggtgccggtgctgggaaccaccaggaagttctggcggctatccgacaaggccacaaggatcacgcgaaagctcgcgctgatcttgaggagccaccacgccgtcggcaagcacctcgccacgcccctgcaggtgtctaatgtctggatcgggagcaccggtggcagcgtcaagctaagaggcgtcagcttcaccgccaagggcttcggcatcgagcgcgtgagagacgactacaggcagctgtccaggctcctgcacgcgatcatcagaatctccggtgggggtgataccgccatcgccaggctgcctcccgactaccgcgagttcctcgcgctcctggggagggacaccctcgccatggaagacgagttcttgatcgtcaacaacgccgcgctgctgccgatgaaaaaccggtgagaattttgtttccgacgactgccattttgaagaagaagaagaagaaaagcaggctcatttctgttacttgtgtgattctacattttcgcagcacggaggccttcctgatgctgcacgacaggatcgtgaagtacctcggccgcacggaccgacagaagaagaggaggatcctctccgggctcccctaccagagcgactggctggatacggccagggcgaacaagcggatcaaccagtgggtcatgaacgtccagcacgagtacaagggaacgcaccagtccgacatgctgcggctcaacaggaatgtgaggagccacctgcatgagcacaaggacgacgacggcatcgaggaggccctgtactgcgagtggcccgagctgctcatggccatggtgaagctgttgcaccaggaaggcgagctcgaggccactgacattgagaacaagttcggctagtccatcgtcctgccgaagaacagatgtgctaggtagctctgcactgcggtttctgaatctactgttggtgttggcacgctttcagtgagaaagtttatggtgatggcctgatcgcgggtgatatgctacctggtttatgtaatgtaatataggctccgtactttcttgaattctctggacttgaaggcaaaaggttggggtcagctttatataatgttgccttgaaactcaaagttgtactcgatcttttgtgggtgtcttgttttcgttttgatgaatggattgttcatggtggcaaggccaacgcaggcagaaaccagacgttagttggcttctgaaaaagcagtgtaacagct

SEQ ID NO: 17501 - DNA, 1558 bp, Zea mays
cctcgaggccggcccgggcccggccgggaccctgctttcctgcctctctctctctctctctctctctctctctctcttctcttctttcctcacctccgacggctgaacaagcgaaactgcgaaaagcagcaacagcaggtaggtatagtgatcctcctcctccatggggaacgccctcaagtgcttcacgggagaagaagaaggccaccacttccacgggcgcagagaccgctacccctactaccagccgcagtcctacagtggtggcgatccacatccaccggccgctgctcatcagcagggtctagcagccccccatggcttcgtaaccttcgtccccgtcacgcaggctgctggtccaaacgccgggcaccagcagaggagcagtggggttcatgacagaagaccggtggcttctaagtatgaatccaacaccgaggacatcgacgaatcgtctgccgagggcctgtgcagcgccaagagctacgccaaggcgaacccgctgctgatccaggtgccggtgctgggaaccaccaggaagttctggcggctatccgacaaggccacaaggatcacgcgaaagctcgcgctgatcttgaggagccaccacgccgtcggcaagcacctcgccacgcccctgcaggtgtctaatgtctggatcgggagcaccggtggcagcgtcaagctaagaggcgtcagcttcaccgccaagggcttcggcatcgagcgcgtgagagacgactacaggcagctgtccaggctcctgcacgcgatcatcagaatctccggtgggggtgataccgccatcgccaggctgcctcccgactaccgcgagttcctcgcgctcctggggagggacaccctcgccatggaagacgagttcttgatcgtcaacaacgccgcgctgctgccgatgaaaaaccgcacggaggccttcctgatgctgcacgacaggatcgtgaagtacctcggccgcacggaccgacagaagaagaggaggatcctctccgggctcccctaccagagcgactggctggatacggccagggcgaacaagcggatcaaccagtgggtcatgaacgtccagcacgagtacaagggaacgcaccagtccgacatgctgcggctcaacaggaatgtgaggagccacctgcatgagcacaaggacgacgacggcatcgaggaggccctgtactgcgagtggcccgagctgctcatggccatggtgaagctgttgcaccaggaaggcgagctcgaggccactgacattgagaacaagttcggctagtccatcgtcctgccgaagaacagatgtgctaggtagctctgcactgcggtttctgaatctactgttggtgttggcacgctttcagtgagaaagtttatggtgatggcctgatcgcgggtgatatgctacctggtttatgtaatgtaatataggctccgtactttcttgaattctctggacttgaaggcaaaaggttggggtcagctttatataatgttgccttgaaactcaaagtcgtacacaaaaaaaaaagcggccctcgagctccag

SEQ ID NO: 17502 - DNA, 806 bp, Zea mays
cattgggtacctcgaggccggccggacaagtcctgagcgaacctcgccactcgcccactccgctcccaaagaagaagaagacgacgacgacagcaaggtgccgccgtcacgagatccgtccgaggtgaccatgtctacgcctacgaggaagcgtcccaggaaaaccaacggctccacgtcgtcgtcgtcgtccgcgatgcgtcggacgacgagccctgtcggacctcgcgccgccgccggatctctccgggaggcccaagacgcgggcggcgagggggcatgcggtggcagggccagggaccgcgtggggcgccgagataacgatgacgcactcggcggacttcctccccgccatggagacggcagccttcctcaaggcctgcgggatctgcaaccgccgcctcggccccggccgtgacaccttcatctacatgggtgaggtggccttctgcagccaggagtgtaggcagcagcagatgaacctcgacgagctcatggagaagaagtgctccactccggctggcggcggcggtggtggcgtcggcggcggcggcggtggtggctcagatcagcccggcaagagcagcaccgtagcggccgcctagcatcgccagaggggtaataacaacgaagaaaaattttggagccctggtggcgtaggccccaaaaacgcagcagtttccatcagcctatgtatatcctgtatttctggagtcactgtgtgtgtatattggtgggaaggggaaggatgtagggattccaactgggggcatggtttgcaatgcatcataaaaaaaaaaaaaaaa

SEQ ID NO: 17503 - DNA, 1517 bp, Zea mays
tcgagcgaccgtccgggcaggtacatttacaaagggggtgcttaaggtcagagaaatattcagcttcgctcaagatgatttgatcccgcgcctccgatttattttggattgtcactcatgtgtcttcgtatgggttggacaacatgtggacacaaaaatacgagcacaagctttgaacattggagagaaatttctagaccttgacattctaatggagaatgtatcacgagaaacaccactttatgtcatcaatgaaggaagtgaaccccaatatttcactaggttcttcagttgggattcagcaaaatcaataatgcatggtaactcatttgaaaggaggttatctttagtgaaggatggagtaaaaccaagagcagataaaccaaaaagaaggtcaacaacatcaacacacactggaaggtcgagtgtacctgataaatcccaacgttccagaagcatgtcattcagtcctgatcgtataagagtcagaggaaggtcgcctgctttcaatgcattggctgctaactttgagaacccaaacgctcgaaacctatcaactcctccacctgttgttaggaaacaagttccgaagcctgtatcttctgattcttcaaagccacctccaaggacagcttcaatcgctgcgatttctgcttcttttgagcggcctaaagcaactctaataccaaagtcaattaaagcgagccctgatgcaagcaagccccaaattgaagcgaacaagcctacactagagacgaatgccaaggaaatcaaccctacaaaggatagtcaaattgcaactcctacagtagaggaagatgtaaaagagagtcaggcagagtgtcaggcaggacttcctatatacccatatgacagcttgaggacatcttccaccaatatccccacagacattgatgttaccaagcgagagatatatctgtcttcatcggagttcagagaaaagtttgggatgacaaaggaggcatttgggaagctaccaaggtggaagcagaacaggctcaagattgcccttcagctattctgaaaacttggtactgtcaaacagactgcttttctttgctaagtcaaaagcacaatgactgttttcaaaggtaaaacctttttccaggcataggcactcgaaatctctcgcagtcaattcagaagtggtaaagagtaattgtaagtgtagcctagcagggtcaagggaccctcgttgggtctgggaggagcaagtccagtgagtttttagctgctcatgttcctgaattgtgttcttcactgacattttgcatgtagtgccagatcactgcattggtgatccggtcactccaattctttcctatccaaggtcacaggtttgtttgtgagcttgcgaaccctttttttttcccctgtgatgccatatttgttctatttttttgttgaaaaaactagagtcccgagataataagggatatatatgtgatgtaatttagacgacagagcatgctgtacaaaagagtttgtaaaatgtt

SEQ ID NO: 17504 - DNA, 3071 bp, Zea mays
ctctcttcttttctccccctcccgcttccttgttttcccctcgttctatttggattggaagcttctccgcggccaaggtcacgcacacccacccacctggacctggtgcccgccgtgtaggcctctcggccttcgtcgtcctccagccccaggcggagcacgaggcggcggacgtacgggctcgacggaggcgagctgccggccgagcgaccaggaagacgcattcagaagaggacatcgatcgatcgcggagagttccccgggtagctgacgacgatccatgcttgtggcggccggatcagttcgcccgtccaaccgggattgctaggcgcagaagcgcaggacgaggcagcggcagcgtgagcgacgccaccacccaagcggacggcaataatggacgctaaccactcgccgccggcgcagccggagaggcatcatggcagcttcaactacgacatcgagagcacggacggcacgtggcgcggcgcgggggcgtggcaggagcaggacccatcgtcggaggccctgctgcggtacgacgacgacgggccccgggagccgctgctgcgaaggcgcaccatgaacaccacctcccagattgccatcgtcggcgcaaacatctgccccatcgcccacgcgtccgacgaaattgtggaaaatgaccttttcaagcaggattggcgatcaagaaagaagcagcagatattccagtatattgttctgaaatggtcattagttcttcttattggcctgtgtactggacttgttggcttcttcaataaccttgcagttgaaaacattgctgggttcaagttgttgcttacaagtgatctgatgctcaagcataggtacttcacagcatttctggcatatggaggttgcaatctagtcttggcagctgctgctgcagcgatctgcgcttacatagcacctgctgctgctgggtctggtatccctgaagttaaagcataccttaatggagttgatgcttatgctatattagctccaagcacactgtttgtgaagatatttggttcaatacttggagtttcagctggatttgtccttggaaaggaaggtcccatggtacatacaggagcatgcattgccaacttacttggtcaaggggggtcacgcaagtaccatctgacatgtaactggctcagatactttaagaatgatagagataggcgggatttgattacttgtggctctgctgctggagttgcagcagcattccgtgcgcctgttggtggtgtgctctttgctcttgaagaagcagcatcatggtggcgaagtgctctcctgtggagaacattctttacaactgctgttgttgctgttgtactgaggggtttgatccagttctgtcgtagcggaaaatgtggtctttttggtcagggagggttgattatgtttgatcttagctcaaccgtaccgagttacagtacccaggatatcattgcaattattgtccttggaataattggtggggtcttcgggggcctgttcaactttctcttggataggattctccgagcttatagttttatcaacgagagaggtgctccatacaagatccttctcaccgtcacaatatcaatcatcacatcagcatgctcctatgggctaccttggctcgccccatgcactccgtgccctgctgatgctgtggaggaatgccctaccattggccgctctgggaattttaagaactttcagtgcccgccgggctattacaatggtcttgcgtcgttgttcttcaacacaaatgatgacgccatccgcaccctcgcctgctgccgcgccgccgatgagttccacatgtccactctttttgtgttcttcactgcgatttactgccttggccttgtgacatacggtattgctgttccatctggtctcttcatccctgttatacttgctggggctacgtacgggcgcatagtggggacccttcttggtccaatttcagaccttgatcctggactattcgcacttcttggcgcggcatctttcctcggtggaacaatgaggatgactgtgtcagtctgcgtgatacttctggagctcaccaatgacctccttatgctcccgttagtcatgctcgttcttctgatatcaaagaccatagccgacagctttaacaaaggggtttatgatcagattgtggtgatgaaaggcttgccattcctggaagctcatgccgaaccatacatgacgcacttggttgctagcgatgttgtgtctgggccactgatctccttttcaggcgtcgagagagtggggaatatcgttcaggcgttgaggatcacaggccacaacggatttccagtggtcgatgagccacctctatcagaggctccagaacttgttgggcttgtgctcagatcccatctgctggtcctgctgaaaggtaagggctttatgaaagagaagatgaaaaccagcggtagcttcgtgctggaaagatttggtgccttcgattttgccaagccaggctcagggaaaggcctgaagattgaggacctggatttcactgatgaggaaatggacttgtatgtcgatctccatccaattacaaatacatcaccgtacacggtggtagagaccatgtcacttgcgaaggctgccgtccttttccgggcactgggactcaggcacatgctcgttgtgccaaagaccccagggagacctccaattgttggaatcctgacgaggcacgatttcataccggagcatattcatgggctgttcccaaatatacacaagtcacactaatggaacactcaatcagtccatatcttttcttttcttttttgccgtcgccttgtaggttgtagctagctgtacgaaaacgaagctacttttgtccaatatttgctatcggccatctggccttttcttttccattttgtttcttcaggagtactccagaatcatataatcactggataatattgtattttttcaagagctggttccctggcagaacactccataagtgatatttctgtctttttctcaaaaaaaaaaaaaaaaaacgcgcggccaccctcgtgccggcttaa

SEQ ID NO: 17505 - DNA, 1502 bp, Zea mays
  misc_feature (1501)..(1501): n is a, c, g, or t
gcacgagaaggtttaatttgcattggctaagattatcgcataaagttttagagcccaattcaaccacccatctccgccctccggtccttgctcttgttccttgcgatgaacggctgtgaacctcagccttggatgagcttggcgaaaagtatttagtattacaagattcatggtacaagataggtgacattacaaaatcaccaaaataagcgtctaaagtctcacatctgaagaacataaccactactctaaggcctctgtggctgtactgaacatttgaaaattttcacttgctggcaaaccgttgacattgattaaacaccctacccgctgtttgaatgttcctttccagagcagccatgaccccataacaaaagatccaccactcttggcttcatacatgtgtaccaatccaacttcataccagaatatagcaatcatcaccatactgaggcccaacaaaaggctacacgtcatattgcttggcaaaatcatgaatccttggaggaatgcttagtcgcagtataatctaatcacagagtcagcgccagcagtgaacaaccatggttgtttagggtggaacttgcagtccaaaacccctcttccatccgaactagaatggccacgaagaatttccaatggtacaataagtgggttctggttaagatcagaatagaccattccatgacatacataggcagtacaatcctcggaggatgaggcaaaaagagggtactttcggtgaaaggcaacactggtaacatctttagaatggatctttagagtcttgtatggtctggtagatagatcagtatcaaaccagcataattttccatctctgcttccgacaataacattatcaccaccaggatgaatcgagatggaggaaatctcgcgaagacctgactccagcttctttaccaactgcgctttttggagatcataaatctgaacaaatttcttagtagcaacaaagaacatcttctgacttggatggaatgttgcagcaacaggaaggcctggcattttacggaaaggatggtgcgagtgctttttcgtgagctgatgcaacaatacagctctcgtatcaccagttggcacaactgtggtgaagtaatctcccttgtaatgccactccacatttgacacggccttttgatgaactaaggtgatcccatcaagtttttcatgcttcaaccacctcacagctggtttcttgtcatcagtgtcatcttgaagagccatttcatcaaccttgagcagatcttttaccatcgtttgcatttcttcactccccacctcagcattaataagtagtaggtcatgtccaacgacagcagcaagaataggcctgtcaggtgaaggattccaggcaatatgacggacatcacctccaacatcccaaactttaagacagcgaccagtttcaacctcccagacacgaattgtaccatcacaagaaccagatgcaagccactgccctgtaatttcgaccgaaatng

SEQ ID NO: 17506 - DNA, 1270 bp, Zea mays
agctaccaatggtcatggcgaagcagcagcatgacaaggggttgccgaagcaagctcgcaatgagcccgcgccgttccggctcgagcagtgttgccgctgcgacgatgcccaccgtcaggccgacgacgagtccatggatgctgctgggtctgctggcccgctgcacctgactctcggcccgctcggctcggccgccggcccccgctgctcgtgcggtgtcgcgccggcgccggcgccggcgctggcggcgcccgcaacggtggccgtcctccgcgggtcccggtacatgaggccggcgcaggagctgctgggcgagattgtgcgcgtggccgacctggcggctgccgacgacgaagacgaggaccaggcggcggagcggctcgagggcggcggtcaccggacggcgcgtcgggcggccgggaacgacggcgacggcgtccaggccaagctcctctacctgctcagcgagctggagagcaggcgggagcgctacttcggcgagctggagcgcgtggtgtcgtcgttcgagccggcgctgggcggcggcgcggcggcggcctacacgaccctgatggcgcgggccatgggccgccacttcggcaacctgcgccgcgccatactgcgcaggctcaggctccaagccgccgccgcggcgaggaggtctctgcggcgcggcggcgaggaccaggacgacgacgacgacgacgacggcgacagcgacggcgaggtgaccgaggagctggtggacaggttggctcggcggacgaagctggccgcggcggcgcgggcggagcaagcgtggcggccgctgcgtggcctgccggatggctccgtggccgtgctccgggcgtggctcttcgaccatttcctccacccgtaccccaacgacggcgagaagctgaggctggcggtgaccaccggcttgagcaggcgccagatatccaactggttcatcaacgcgcgcgtgcggctgtggaagcctatgatcgaggagatgtacaaggacgagttctccgacggttccgccgtctccagctacgacgacgccagcgcctcctcctcctgactcctgagtcttgaccacctcgccctcgagagcgtttatctagctacttaatcactcgatgtctcggttgattggtcctgttgctttgggattatattaatttatttatatccagcttaatcatgtgcggtgcctctcttgtatttcttagaaaaggacatactccttcaaaatctagcgacttttcaaaaaaaaaaaaaaaa

SEQ ID NO: 17507 - DNA, 612 bp, Zea mays
ctctgagtgcatcgcgaactcacgaattgctggtcatgggtcccttctgtcagatccctcctctttgccacaaacaccatatacgccgccatggatcccagaatcggcttgagccccgttcccatcctatccaccatcacggctatataaatgtgggggccactgcagtcaggatcaaactcggctgcagcgtaggccttgtgtcgacccgggagcttcactacatcactggggtgcacccgtggccgtggaagggggaattggctagcatgcggcctcaattgctcgccagagcggtgcatccgcagtggcactgcacttcgtcgtggccgggccgctcgggtctcattactgttgactatgaggtagacgaaccaaactcgttcgaggatgaaccgtaggacacgttcaagcaagagggtgatgacgaagacattgcagatgatgtcaacgagtattaaagtctaacgatgcgtcagtcaccttcatgtggaagagtctccatgtttaattctgtcgtactttgataatgatacttgctaagatactatgatccaaatgatgtaataaagttactctactctctttacgcctttaaaaaaaaaaaaaaaa

SEQ ID NO: 17508 - DNA, 1555 bp, Zea mays
ccggcccggatagggcccacgccccggcccggccgggaaaagtttcgtccaccatttcgctctcgcaagtcgcaagccaccgatttgtttacaggcgccggagctcccgacgacgactgagccatgtgcggcggcgcgatccttgccgagctccgcgagccggcgccgcgccggctcacggagcgggacatctggcagcagaagaagaagcccaagaggggcggcgccggcgggaggcgctcgttcgcggcggaagacgatgaggacttcgaggccgacttcgaggactttgaagccgactccggtgattcggatttggagctcggggaaggggctgacgacgacgtcatcgagatcaagcccttcgccgccaagagtactttctccagagatggcttaagcaccatgactactgctggttatgatgcccctgcagcaaggttggccaaaaggaagaggaagaatcaatacaggggtatccgccagcgcccttggggtaagtgggctgctgagatcagagatccccagaagggcgttcgtgtttggcttggtactttcaatagtccggaggaagctgcaagagcttatgatgctgaagcgcgcaggattcgtggcaagaaggccaaggttaactttcctgatgcaccagcagttggtcagaagtgccgttctagttcagcttctgctaaagcactcaagtcatgtgttgaacagaagccaattgtcaaaacagatatgaacatccttgccaacacaaatgcacccttctaccaatctgttaactacgcatccaacaatccatttgttccagcaatgaactctactgtttcttttgaggatcctatcatgaatctgcactctgaccagggaagtaactcccttggctgctcagacttgggctgggagaatgatactaagacaccagacatcacatccattgctcccattcccactattgctgaaggcgatgagtctgtatttgtcaactccaattcaaacagctcgatggtgcctcctgtcctggagaacaatgctgttgatctcactgatgggctgacagatttggaatcctatatgaggtttcttatggatggcggtgcaagtgattcaattgatagccttctgaaccttgatggatcacaggatcttggtagcaatatggacctctggaccttcgatgacatgcccatcgctggcgatttcttctgaggaatttgaagcttggccataggactatgtacatagggactagggaataaagactgggagattgggaagcacctgcttggcaccttggggtagcatatgctcgtgtctagctcagatgcagaagtcgcattctgaaactctttggttatcgacctgttccctattttaactatctctgtatgagagccatttatgagactgaaccattttaccattttgttttcccccttctttcgttgttacagtatatggtttaacattatgatttatggatatgtggccaaacatgccttttataaaaaaaaaaaaaaaagttgaaaaaaaaaaaactagttagcggccaaaa

SEQ ID NO: 17509 - DNA, 2767 bp, Zea mays
  misc_feature (13)..(14): n is a, c, g, or t
  misc_feature (1684)..(1684): n is a, c, g, or t
tcgagggccggcnncgggaaaaaaaaaaaaaaaaaaaaaaacattgggtagcccccccgggggcgctccaaagtttcgtccaccatttggctcccgcaagcaccgatttgtttactgctctctccgacgcgcggcggcggagctccctacgacaactgaaccatgtgcggcggcgcgatccttgccaaccttcgcgagccggcgccgcgccggctcacagagcgggacatctggcagcagaagaagaagctcaagaggggcggcggcggcgggaggcgctcgttcgcggcggaggacgatgaggacttcgaggccgactttgaggtcttcgaggccgactccagtgattcagatttggagctcagggaggggactgacgacgacgtcgtcgagatcaagcccttcactgccaagaggactttctccagcgatggcttaagcaccatgactagtgctgtagcaaggtcagccaagaggaagagaaagaatctatacaggggtatccgccagaggccttggggcaagtgggctgctgagatcagagatcctcagaagggtgtccgtgtttggcttggtactttcaatagtcctgaggaagctgcaagagcttatgatgctgaagcgcgcaggattcgtggcaagaaggccaaggttaactttcctgatgcaccagcagttggtcagaagcgccgttctggctcagcttccgctaaagcatccaagtcaagttttggacagaagcctatcgtcaaagtagctatgaacaaccttgccaacacaaatgcatccttcttccaatctgctagctacccctccaatttatttgttcagcatggcaatatgccatttgttccagcaatgaactctactgcttctgttgatgatcttatcatgaatctgcactctgaccagggaagtaactcctttggctgctcagacttgggctgggagaatgataccaagacaccagacatcacttccattgctcccatttccactattgcggaaggcgacgagtctgcatttgtcgacagcaattcaaacagctcatttgtgcttcctgccctggagaacagtgctgttgatctcactgatgggctgacagatttagaatcctatatgaggtttcttctggatggtggtccaagtgattcagttgatagccttctgaaccttgatggatcgcaggatgttggtagcgacatggacctctggagcttcgacgacatgcccatcgtcggcgatttcttttgaggattttgaagcttggtcataggagtatgtacatagggactaggggaatgaagacccgccggcaggcttctctcaagttacatgccatctgcacagttgtgctgggctaatttttttttgttccaaatgtttcaggaataaagaccgggggagattgggaagcacctgcttggcaccttgggggtagcatttgctcgtgtctagctcagagatgcagaagttgcattctgaaactacttggttatcgacctgttccctattttagctatctctttatgagagccatttatgagactgaaccattttgttttgctttcttttcgttgttacaatatatggtttaacattatgatttatggatatgtgccaaatatggtgctcaacagtggtcaaacatgccttttagatgctcttgtttctcgtattgttntgtaccttgtgatatttcattcgttgaaattgagttaaactagttatctgctgaaacttttcttgtacaagcaaaagtattcaagatttaatcttattggcatttggcaagatgctagatttttggtgcctgcatccttgtgcatgctgattttaagataaggttgtgtgaacatacatgaggcaggatctctgtcgtattcgtatgtagccctttcctgttgtgtttctcatgacatgaaaagaggatggcgaatcggttcgttgtgcatttgcttccgttttcaacaaacgctggattcttagatattttgggaggcaaaaaaaaaagagagagctggggtgtgaaaatgcctcccattctgttgagatatatgtatttatttttgaccgggacgaattttagacctgcgtaaacttccgaaatttcagatgttgtttctcactccactattcaaaatggtctccatgagggtcaaatcaaatatgcctgctgctcatttgattccgtcaatgtgatgcggttgcacttataccttaccaagtctagttggccagctgatgttgaagcgcccgatggatcacggcgtctggagacggcattgacccgtttattcggccaggcagcaacgacgaggggaccgaccgtgatgccgcctgcacctgaccgtgccgtgccattgatgtggagcttggccccctgaatgactacgcgttgacaccggcttctgtcgcggaattcgtccagtccgtcaagcgaccaattgaaggttcatgatcttacaagcttgtctccagagaggccaaaaatgggtccgcgagctcttagttttcacgccctctctactccgcagatgatggcgtttgacagacactaggaagcagtaaataaaccatgaaccttgttgagtacgttctcggactggtaggcgtccggtaaaccttgtaaacctccgccgcaggcatgtctcggtcgaccagtcgatgtgtcctggttagagatggcaagggttacaaacccgctgggttttgccgtctcaaacccgtacccatgaaaaatatttatacccataaaaaacccgta

SEQ ID NO: 17510 - DNA, 1732 bp, Zea mays
cgggaaaaaaaaaaaaaaaaaaaaaaaaatggggtaccctcgggttccctccaaagtttcgtccaccatttggcttcccgcaagcaccgatttgtttactgctctctccgacgcgcggcggcggagctccctacgacaactgaaccatgtgcggcggcgcgatccttgccaaccttcgcgagccggcgccgcgccggctcacagagcgggacatctggcagcagaagaagaagctcaagaggggcggcggcggcgggaggcgctcgttcgcggcggaggacgatgaggacttcgaggccgactttgaggtcttcgaggcagactccagtgattcagatttggagctcagggaggggactgacgacgacgtcgtcgagatcaagcccttcactgccaagaggactttctccagcgatggcttaagcaccatgactagtgctgtagcaaggtcagccaagaggaagagaaagaatctatacaggggtatccgccagaggccttggggcaagtgggctgctgagatcagagatcctcagaagggtgtccgtgtttggcttggtactttcaatagtcctgaggaagctgcaagagcttatgatgctgaagcgcgcaggattcgtggcaagaaggccaaggttaactttcctgatgcaccagaagttggtcagaagcgccgttctggctcagcttccgctaaagcatccaagtcaagttttggacagaagcctattgtcaaagtaactatgaacagccttgccaacacaaatgcatccttcttccaatctgttagctacccctccaattcatttgttcagcatggcaatataccatttgttccagcaatgaactctactggttctgttgaggatcctatcatgaatctgcactctgaccagggaagtaactcctttggctgctcagacttgggctgggagaatgataccaagacaccagacatcacttccattgctcccatttccactatcgcggaaggagacgagtctgcatttgttgacagcaattcaaacaactcatttgtgcttcctgccctggagaacagtgctgttgatctcactgatgggctgacagatttagaatcctatatgaggtttgttctggatggtggtccaagtgattcagttgatagccttctgaaccttgatggatcgcaggatgttggtagcaacatggacctctggagcttcgacgacatgcccatcgccggtgatttcttttgaggattttgaagcttggccataggagtatgtacatagggactaggggaataaagaccgggggagattgggaagcacctgcttggcaccttgggggtagcatttgctcgtgtctagctcagagatgcagaagttgcattctgaaactacttggttatcgacctgttccctattttagctatctctttatgagagccatttatgagactgaaccattttgttttgctttcttttcgttgttacaatatatggtttaacattatgatttatggatatgtgccaaatatggtgctcaacagtggtcaaacatgccttttagatgctcttgtttctcgtattgttgtgtaccttgtgatatttcattcgttgaaattgagttaaactagttatctgctgaaacttttcttgtacaagcaaaagtattcaagatttaatcttattggcatttggcaagatgctagacttttggtgccgaaaaaaaaaaaaaaaaagcggcc

SEQ ID NO: 17511 - DNA, 1655 bp, Zea mays
gcaggcttaataaaatcatcttattgttagttttcatatgtgtaatttgttttatataattaaaatatatttaatattcggaattatcatttaaagtgacacaaaccaaacttttacatcattagaaccaaacacactgttaatgactaatatcccagattgagattagatttataacatacttgtgcaaggacgtctctatcagatcgtgtatatggtcgtacaaaatattgttttgcattatagataactattatagatatctttgtttatagagtagaatttcaaatggtggatcatgagatacgagcagatagcataaaactctatatctacgatggaatgtcctagtcctagctatctcctgcctactttgcaccattattactgtagcttttccgtttccaaccccgtggcttcagcttgacgcatctgtccactgaggtgtggacccacctcccttccctgctcgcctgcagactgtgccagtggcggccagacaataaatagggcccacaccccgtccgcgtccgcgctctccaaagtttcgtccaccatttggctcccgcaagcaccgatttgtttactgctctctccgacgcgcggcggcggagctccctacgacaactgaaccatgtgcggcggcgcgatccttgccaaccttcgcgagccggcgccgcgccggctcacagagcgggacatctggcagcagaagaagaagctcaagaggggcggcggcggcgggaggcgctcgttcgcggcggaggacgatgaggacttcgaggccgactttgaggtcttcgaggcagactccagtgattcagatttggagctcagggaggggactgacgacgacgtcgtcgagatcaagcccttcactgccaagaggactttctccagcggtactggctcaagctcgaggcggcttattttctatgctcgtctgtgcttttttcgcgtttgattgatgtagacgattagaatctaagtgttggctgaggaattttaggtgggttagggagtaggtgggcgtctgaggtgctacttggtggttggattggggacggggaaagaaaaggatactgtttagatattggattctggcttgttatgggattctgcaacttattggatgattttatggtgtcccattacggatgaagtctgtggctaccgttttcatccgtgttataattctgaaatgttgggcggcatagtctgttttggttcccgcacctggcagtcgagggaagacaactcggttcatcaagtgttggatctggagagttccaccgtttgtgcactcggatggggtcgtgtatgattagttacattagatgcatattatgccatagttctaaactcgtggtatcacttagatacgtctgtagactatgagttttcgtggggattgttatagagtcgttttgaactattccacgcgatttatggtgttgagcttgagcatatgattatatattcgcatgcatcttctgtttcatatggttccttgtatgactgtatatctttgtgagtttgattgagcaaggattagtcaccatgcatgattaattgtccaaatggttgcattccagagtcaaactgtaggccctggatgcaaagtttaagaagttcagatttctggtccctttgtc

SEQ ID NO: 17512 - DNA, 1512 bp, Zea mays
tgggggtaccctcgggttcgccggggctctccaagtttcgtccccatttcgctcccgcaagcaccgatttgtttactgctctctccgacgcgcggcggcggagctccctacgacgactgaaccatgtgcggcggcgcgatccttgccaaccttcgcgagccggcgccgcgccggctcacagagcgggacatctggcagcagaagaagaagctcaagaggggcggcggcggcgggaggcgctcgttcgcggcggaggacgatgaggatttcgaggccgactttgagggcttcgaggccgactccagtgattcagatttggagctcagggagggtactgacgacgacgtcgtcgagatcaagcccttcgctgccaagagaactttctccagcccacgcgtccgcaccatgactagtgctgtagcaaggtcagccaagaggaagagaaagaatctatacaggggtatccgccagcggccttggggcaagtgggctgctgagatcagagatcctcagaagggtgttcgtgtttggcttggtactttcaatagtcctgaggaagctgcaagagcttatgatgccgaagcgcgcaggattcgtggcaagaaggccaaggttaactttcctgatgcaccagcagttggtcagaagcaccgttctggctcagcttctgctaaagcatccaagtcaagttttggacagaagcctatcgtcaaaggaagtaactcctttggctgctcagacttgggctgggagaatgataccaagacaccagacatcacttccattgctcccatttccactattgcggaaggcgacgagtctgcatttgtcgacagcaattcaaacagctcatttgtgcttcctgccctggagaacagtgctgttgatctcactgatgggctgacagatttagaatcctatatgaggtttcttctggatggtggtccaagtgattcagttgatagccttctgaaccttgatggatcgcaggatgttggtagcgacatggacctctggagcttcgacgacatgcccatcgtcggcgatttcttttgaggattttgaagcttggtcataggagtatgtacatagggactaggggaataaagaccgggggagattgggaagcacctgcttggcaccttgggggtagcatttgctcgtgtctagctcagagatgcagaagttgcattctgaaactacttggttatcgacctgttccctattttagctatctctttatgagagccatttatgagactgaaccattttgttttgctttcttttcgttgttacaatatatggtttaacattatgatttatggatatgtgccaaatatggtgctcaacagtggtcaaacatgccttttagatgctcttgtttctcgtattgttgtgtaccttgtgatatttcattcgttgaaattgagttaaactagttatctgctgaaacttttcttgtacaagcaaaagtattcaagatttaatcttattggcatttggcaagatgct

SEQ ID NO: 17513 - DNA, 2308 bp, Zea mays
acgactgaaaaaattctggaaatcgaaacccaccctcgagcgacgccaagcggccaagacggagaggagaacaattggggagggggaaagtccagggggaagccacggccaccggcgcgatgaaaccatcgccgtcgaagaagaagggcaagaagaagaagaagtcctcgctgccggccgccgcaccggcccctccgccggcggagggcgctgcggatacggaggcatgtcccccgctgcccggaaccataaccctaaccgctgccaccgctgctgcggcggtggtttcggagacggagtccagcagcagcggcgaggcctcgacgtgcctatccgcctgcttcaccgcaagctcgtctgggaccgcgtcctcgcactccttctctgccttgtcctcgtcggcgtccacagcttcgtcgtcggccgccggcgaggagcggcgggacctcacctggctgctcgacgcattcgccagcgccaccttcgaccagatcgactccgcctaccgcgaggccggaggggaccctttcgtggccgccggtatcctgtcctccacgcaggacacgcacccgccgcagcccccgcagccggcgccgcagcccccgccgccaccggatctctcgccgcgcagtggatctggtggaaggaaggctggtcggaggcccaaacgggttgccgtggccgctacgggcatggtcgcggacgtgattggcaaggagtacacgcgacccgcggctaattctgtagtaagcatgccaaatgcttggaagggtcgggacggggagagcgatggcagcgggtctggtggccgcaaggacagtgttgaagaggcagagcagttcctgtgctccatgctcggggataattccgagcttggcatgggtgttgtcagagacgtgctaggccaatatgggtacgatgttgagaaggaacaactcgctgctttgtgttctgaatggatatactgttggtttgtacagttgtgctaatcaagtgctttcaggctttggatgcattgcttgatatatctggtgtgtcttcagttgaaaacatggaaacaaaccatcaaagtgccagaaggaatgacacatgtcatctagatatgttttctggaaatgggctatcagtggagaatctgactgcagggaatagaagaagtctacgccagttgacagatgagatatccaacactgggctccagtctgaattaggacacgagtttttatggggtgaacctcagatcagctatgcggaggctgttaaggaggcaccacgctcatcaacattgccgtcaagatcaactgtaatgaaagctggtccacaacaagtcctggattcactgtttaaaattcctgaaacacgcacgtatgagccaagttctatggactggaaaaaggtagtaaagaaactgcaaacaatcaattataccgctgcatcaaacaatcacgaaaggcctaaggatgggggtggctatcgtgagctccgtggtgttgctgcaaggcattacgataaaatgaaagaatactatcagaaagctgcctttgcatattcgaagggtgacaggtcatatgcttcttaccttgctgaggaggggaaacattatcgagaactgggtcgcatagaagacgagaaggccagcaggaatatatttgaagccagaaataagcatataacgaacacagtaaccatcgacttgcatggccaacatgtccaacatgctatgaaccttctcaaaattcacatgatgatttgtatttgcattccatctgtcttactgagggtaattaccggttgtggttcagaaggtacagggaagggaaaaataaagcgctcggttatagagcttgcggagaaggaacatattgagtggcgcgaagagaactctggaactgtagcccttcgacttggtgggccaagagagtatcggttccttgagcatgaaagcgattctgacctagtggggaactttaacatagattaacttctgatctaatctatgtattcccgtatttatgtgttatagctatggatgctgcctaggttgcgatgtaggctgtagttctgacacagaagctcggtattgtagttgggtaaattatggtgtaatgttgaccccaggctgctaactgtgcaatcacagaagctctgactgtacaaccgtagcccttctgtgaacaatgcaacacaggaaccgtaatcatcgtgagttgaagaatatcatactatggccgattgccacgggaaccaattttggcctgcaccaactggaacttacgatttgtatgaaaatatattcaacacttaggcc

SEQ ID NO: 17514 - DNA, 1623 bp, Zea mays
accacctccccacctcccctcctttcggttgttgtctgacttgtctcctactctcctcgccttccccttgccttagggtttctcccgcgctccgcctcgctccgtccctccctgattcgcgcgatctccgcgcggccatggtctccggcgcggcgcccaacccggacgggggcggcgcccaaaacactcagcgcccgccgccgcttactcaggccggggcccggacggccctcgccacgccgccggcggtctccggcggcgccgcgcactccgcttctacaagtgggggcagcgccggctcaccaccgtccagccgcagcgagcagcacgccccagacggtgctgccaagggtcccgccctcggggccgcgcccgcggcggccgcgtccacgccggccagcgacagcacgttcctccgcttgaataatctcgacatcaacggcgacgacgcgccgtcgtcgcaggctcctacgagcaagaagaaaaggagaggcacacgggcagtgggtcctgataaaggtaaccggggactgcgccagtttagtatgaaagtttgtgagaaagttgaaagtaaagggagaacaacatataatgaggtggcagatgaacttgttgctgagtttacagaccccaacaataatattgaggcaccagatcctgataaccctaatgcgcaacaatacgatgagaaaaatatacgacgaagagtttatgatgctttgaatgttctgatggctatggacattatatctaaagataaaaaggagatccagtggaagggcttgccgcgtactagtataagtgacattgaagaaatgaagacggagcttgtgggactgaaaggtaggattgaaaagaaaagtgcttacctacaggaactacaagaccaagtctgcaaaacctgattcaacgaaatgagcaatcatatggttcaggaaacacgccttctggtggagtggctttgccatttatcctagttcagacccgacctcatgctaccgtggaagttgagatatcagaagatatgcagctggtgcattttgacttcaatagcaccccattcgagctgcacgacgactcatacgtcctaaaagaaatgcgattctgtggaagagaacaacatgacagcactcaagagtcgatatcaaatggaggtgagagctcaagcgtgtcaaatatttattggcaacacgtacagcatgtggaaaggccaaacaatggcacaggtaggttaccgagctcaccgcctattccagggatcttgaaagggcgtgcgaagcacgagcactagcgctagggtgttggttcactttccttttcgtctgagcagttggttttattgcatttctccgttgtgtaaagggccctgtaaattattaggcaagcgggagcgtagcttgatctaatttagctctgcaccagattggtagaacgacgggtgctctaagtagttgtgtaactataactatccttgaatcggtttctttagtatggttgagagaagggttgacatgtaattttgtagagccttgtaaaattaaaattgttgatttctatcagggtgaaatttctgggcacaatctttatttcgtgttccttttcccatcaaaaaaaaaaaaaaaa

SEQ ID NO: 17515 - DNA, 1610 bp, Zea mays
  misc_feature (268)..(268): n is a, c, g, or t
gctccattttgccccctcgctcttcacttcctccgctccgcttgttgtctccttccctagggtttgtccagctccgcgctcagcctcgctcgctagctcccgctctcctcgatcccgcggccccgatcagcgcgatctccgcgcggccatggtctccggcgcggcgcacaacccgggcgggggcgccgccgcccagaccacccagcgctcgccgccgcagctgggggcccggacggccctcgccacgccgccgccggtctccgggcgngccgcgcactccgcgtctactagcggcggcaccgctggttcaccaccgtccagccgcagcgagcagcacgcccccgacggtgctgtcaagggccccgcccccccgcgctgcgcccgcagcggcggcggcggcgtccacgcccgccagcgacagcacgttcctccgcttgaataatctcgacatcaacggcgacgacgcgccgtcgtcgcaggctcccacgagcaagaagaaaaggagaggcacacgggcagtgggtcctgataaaggaaaccggggactgcgccagtttagtatgaaagtttgtgagaaagttgaaagtaaagggagaacaacatataatgaggtggcagatgaacttgttgctgagtttacagaccccaataataatattgaggcaccagaccctgataaccctaatgcgcaacaatatgatgaaaaaaatattcgacgaagagtttatgatgctttaaatgttctgatggctatggacattatatctaaagataaaaaggagatccagtggaagggcttgccgcggactagtataagtgatattgaagaattgaagactgagcttgtgggactgaaaggtagaattgagaagaaaagtgtttacttacaggagctacaagatcaatatgtaggtttgcaaaacctgattcaacgaaatgagcaactatatggttcaggaaacacaccttctggtggagtggctttgccattcatcctagtccagacccgacctcatgcaaccgtggaagttgagatatcagaagatatgcagctggttcattttgacttcaatagcactccatttgagctgcatgatgactcatatgtcctaaaagaaatgcggttctgtggaagagaacaacatgatggaactcaagagtcgatatcaaatggaggtgagagttcaaacgtgtcaaatatttattggcaacaagcacagcatatggagatgccaaacaatggcacagttaggttatcaagctcaccgcctattccagggatattaaaagggcgtgtgaagcacgagcactagcgcttcggttttggttcactggcgttgtcgtctgagagcagtttgttttattacttttctccgttgtgtaaagcgcctgtaaattattaggcaagggggagggtagtagctctgatctgatttagctctgattggtagaacgacgggtgtaattctatatccttgattcggttctttcggtatggttgagaaaagggttgacatgtaatttgtagagcattataaaaactaaaattgttgatgtcttctggggctgcgtgcttcgttctgggcacaagcatatttaaaaaggaaaaa

SEQ ID NO: 17516 - DNA, 4923 bp, Zea mays
  misc_feature (10)..(10): n is a, c, g, or t
  misc_feature (4102)..(4102): n is a, c, g, or t
cctcgaggcncggccggggaaaaaaaaaaaaaccatccccgtcacccttttttcaccccaccccattctccttcttcctccagagtccagacggcgtgcttccgcctgccgccgccggcgagctgcttgcccgcagcatgactccgcatcctggccgcctcgtcctaccaccggcggctccttctccctgaaccccgccgcgcgccaggcaccacgcctccctccgcagtcacacgagcacgcggccgtcctctgccgcaccgcgccgcctccagacgcctcgctcgtcaggtctctccacctccgcctgcgaacgttcggcccagctccggcgagttcctccgcaattccggatctgctggagcgccagcaaggcggtctctccaaccctccggagtccggaccagcaagggttctgatctcccatgccacagtttataacgttgaaggattcaaaaatctacagaactagatgatacttgcataatgcagtcctcaggtatttggaaggcgcatgctggttcatcacagtcagagggttcgggtctggatatggagaggaacggatgcaatcataattattgtccatctcctctccaaccaattgcctcagctggtcagcactctgaaagcagcgctgcatacttttcttggcctacatctactctaatgcacgggtcagctgaaggccgtgctaattactttgggaacctacagaagggtgtactaccaggacatcttggtcgcttgccaaagggccagcaagctaccaccttacttgatttaatgattataagagcattccacagcaagatcctccgccggtttagtcttggtacagcaataggctttagaatcaggaaaggaacattgactgacacacctgccatccttgtgtttgttgctcgaaaggttcacaggaagtggctcagcgctactcaatgtcttccaactgcccttgagggacctgggggtgtgtggtgtgatgttgatgttgttgaattttcttattatggtgcaccagccccaacaccaaaggaacaactttatgatgagcttgttgatggattgcgtggtagcgaccctattgtaggctcaggttcacaggtggctagtcttgagacctatgggactttgggtgccattgtgaagagtcaaactggcaataaacaagttgggttccttacaaacaggcatgttgcggttgatctggattatcccaaccagaagatgttccatccgctacctcctaatcttgggcctggagtttacctaggtgccgttgagagagcaacatcatttataacagatgatgtttggtacgggatctacgcaggaacaaacccagaaacatttgtccgagctgatggtgcatttataccgtttgctgatgactttgacattacaagtgtcagcacatcggttaaaggagttggagtcattggtgatgtaaaggcaattgatttgcaatcctcaattggcagtctcattgggagacaagttgtcaaagttggaagaagttctggtctgacaacaggaactgttgtcgcatacgcacttgagtacaatgatgagaagggaatatgcttcttcactgactttcttgtcgttggggagaaccaacaaacgtttgatcttgaaggggacagcggaagcctcataatcttgacaggacaagacggtgagaagccacagcctatagggattatctggggtggtacagctaatcggggaaggttgaaacttaaaagtggccagggtccggagaactggaccagtggagttgaccttggccgccttcttgatctcttggagctagatctgatcacaacaagtgaagggctacaaggttttttccccagccaaaagtcttgatcaaaactaaatatgttcagtcttctttgtaatatcatcttcgtttcctctgatggtcattgttcttgtgtacacagctgccttggaagaacaaaggattactctagccgccgctgctgctgcggcaactaattcaactgccacagaatcgtcacctgttgctggccctcaagagaatgataaaatcgacaaaatctatgaacctctcggcatcaacatcattcctcgggacagttcttccatatcaacagaccaacccaacgagaatgtggaagagctaaacctgatgtctccgatgcgcaacggtcaagaaggtaacggtgacttgaataacttgatggacttggaactggaaaattcgcctgatggtatttctattgccctgaacctgggagagcgggagccaaaaagactccgctcagattttgattcgaccctcgacatggacttgcagaaatgaggctgttatgctgcagacttgttgcaggaggctctgcactattcagcttttgtgttgatcattggaggtatggccataaaggaaataatatgtttctggacgactggacctgttgtcctgcttggagccggtctgggttaagctgtgaagctcctgcagttttgcgtctagtgtctagtgctctagtatatgtagtgttgcgtaagatgtcggcacctcaatttgacagaggcgccatatttcttgcccatgtaatgttgtcatttgttgtatgctcgtgtatatgtactacatgaagcattgtaaaattgagcaacagcaaccggagctcgagaatcttaggcgcatgcgcaaccatccaccaaccccgtacctgatgaattgacaataaagctggatattttaggtgttggcaaacaatgttcataggcggcctttggggagagatttgggtactaactttggtaaaggcaggccactggtgttgtccttgcctgcctgatcaaacaacatgctggctagagtttggacagagcagtcaatctctagctggtttgagttctcagtagttcctggtgaacgtgcctctcttcacaaatagtacttgtttgggtcaaaaatcactcgagatttgtaaacgatttccaaaacatttagtttagaaatagaaagtagtgtcatgcatagatttgtcttgaaagctagtttcgtaatatcatgcttattatatattatatttcaaaaaataatgggtatagttgaaacccaaagcccataatttttttcacccacgccacaccatacccgtcgtctgtacccacctgagatttgcacatgtttcctcctttctaccttcccgatccgcgacacctccatccccatccgtttccagaaatttgtcaaattgagtcgttctaacatggcgctcttcaaaaaaggtcgttcgagtgtcgggtatttgtcaaaagatgctagtactagtactagtactatcaagcaataccggtcgatttgcctccttaacgttgattttaaaattttcattaaagtgcttgcaaacaggctctccttgctagcaggtagttattgggtataaccagtcaggtcttgtcaaagataggaatattttggaggggtggtctttttgcatgaggatcttcatgagttggccaaaaaaagaaaaaaaaggctgatcatgaaaatagatttcaaaaaagattacaataaagtaagatgggagctctagcacatatgcgccacgagctcatctgtgcgcgaattccgagcgagcggtaggggcaagccctctcgatgtcctgagcgagaaggcgtacgcgaagtgcatcccgtcggtgacaagcacatcaaaattaacgcctcgggccactctaaaatttatcaacattaccatgtgaatttgacactacaccttgtaagttacattctcaataaatgagactctaagtgggcaaggcctcccaccgctcccttgctttatctctattttagtcaccattataatagtaatatttctgctaacaaatttataaaggtggaaataagaaaacaactatatggtagtactagattaccggtcaaagtttgtcctgaatccaagatcagattaacttcagtcatctactatatgggttcttagatcagcagagctgcgaaaactatcacaagtagcgtgctagcacttacactcttacagtagtgttagatatacttcttgacgcaacagtaggaagaggtggctcctccacncttgaagaattcagtgtcggcactggtggcagagatggcggccttggctagttgggactgcgatgtcagcagccggcggcactgcgataaggacagcgcgaccacgagtgattgaggccgctggctaccaggccgattctggtaagtggaaggggttatgggccagattttttggactgaaacaccctaggtataagaggattttgggctacgtcccgggccacggcccaggtggcccgaggcctaaatccgccaccatgagctcatctgtgcgcgtcctccgagcgagcgatggggggcaactcgggcaagccctcctagtaacctaaccaacaacgaaatgcaggacactataaagttgttttagcatactaattagtaggattcctgtccaacaacgaaaaaatccatcttctattctatttgatgggtacccaagaatgaggtacctaaagtaagccaatgatcgaacgaccaaatcccagccgagcaaccgtatgatgtagagcagatgaccaagttttggtcgagcaactctgagaggcggaacagacgacaagtcctggcagagcaaccctgcgagacggagcggacgatcaggtccctgacgagcaactcagtgaggcggaggtcctgactaggctgtgacttggtgcacgctcgtgggccctggcttctgggcccgcctgtcactcgcccaatgatcactcagatacgctcatacccattcggacattgttgactcacgtcagccacgataggacgtgtcgtcaccaaacttcgttcggaccaggggtgagaacatacgaaggggcgccagg

SEQ ID NO: 17517 - DNA, 2695 bp, Zea mays
ccctcgtcaacgcctccgtttcgtcgaagccacatccgcggcgtttcataatcccggtaccctcccgcccgccgcggcccaaacggtgtgcttcttcctccggacgcctcgctcgtccgaccgctttacctccctcctccggcgagctccctccgctgttcctggtgtgtctacgcgccagctcctcctcttgacgattttgggcgcgcccccctccgccgccgggctgtgctgcgcggacgcggttcgtggattcggcagacggatctgcaccgtcctcgccgccgatatgcaggagcactagcaaagcggcttcgccatccctccggagtccggagcagccagttgtgcatcaattctaaaacagagttgataccttttttccatcttcaaggttctgctctctcatgccgcagttttacaacgttgaaggcttaaaaattctacagaactagatgatacttgcataatgcagccctcagatatttggaaggcgcatgctggttcatcacagtcagaggcttcgggtctggatatggagaggaacggatgcaatcataattgctgtccatctcctctccagccaattgcttcagctggtcagcactctgaaagcagcgctgcatacttttcttggcctacatctactctaatgcacggctcagctgaaggccgtgctaattactttgggaatctacagaagggtgtactaccaggacatcttggtcgcttgccaaatggccagcaagccaccaccttacttgatttaatgattataagagcattccacagcaagattctccgccggtttagtcttggtacagcaataggctttagaatcaggaaaggaacattgactgacacacctgccatccttgtgtttgttgctcgaaaggttcacaggaagtggctcagccctactcaatgtcttccaggtgcccttgagggacctgggggtgtgtggtgtgatgttgatgttgttgaattttcttattatggtgcaccagccccaacaccgaaggaacaactttatgatgagcttgttgatggattgcgtggtagcgaccctagtataggctcaggttcacaggtggctagtcttgagacctatgggactttgggtgcccttgtgaagagtcgaactggcaacaagcaagttgggttccttacaaacaggcatgttgcggttgatctggattctcctaaccagaagatgttccatccgttgcctcctaatcttggacctggagtttacctaggtgctgttgagagagcaacatcatttataacagatgatgtttggtacgggatatatgcaggaacaaacccagaaacttttgtccgagctgatggtgcatttataccgtttgctgatgactttgaaattgctagtgtcagcacctccattaaaggagttggagtcattggtaatgtaaaggcaattgacttgcaatccccaattggcagtctcattgggagacaagttgtcaaagttggaagaagttctggtatgacaactgggactgttgtcgcatacgcacttgagtacaatgatgagaagggaatatgcttcttcactgactttcttgtcgttggggagaaccaacaaacatttgatcttgaaggggacagtggaagcctcataatcttaacaggacaagacggtgagaagccgcaacctataggaattatatggggtggtacagctaaccggggaaggttgaaacttaaaagtggccagggtccggagaactggacaagtggagttgatcttggccgccttcttgatctcttggagctagatctgatcacaacaagtgaagggctacaagctgccttggaagaacaaaggattactctagctgccgctgcggctgcagccactaattcaactgccacagaatcgtcacctgttgctggccctcaagaggatgataaaatcgacaaaatctatgagcctctcggcattaacatcattcctcgagacggttctgccatatcaacggaccaacccaacgaggatgtggaagagctaaacctgatgtctccaatgcgcaatggtgaagaaggcaacggtgacttcaataacttgatggacttggaatcggaaaattcacctgatggtatttctattgctctgaacctgggagagcgggagccagaaagactccgctctgtttctgattcgatgctggacatagacttgcagaaatgaggctgcccgctgctatgctgcagacgtattgcaggaggctccgtatcattcagctttttttatcgatcattgcaggtatggccacaaaggaaataatctgtttctaggcgactggaccggttgttctgcttgaaacccggtctgggttaagctgtgaagctcctgcagccgcttgctcctgcagttttgcgtcaagtgtctaccaactctagcatatgtagtgctgcgtaagatgtcggcacctcagatagacagaggcgccatatttcttgctcatgtaatgttatttgttgtatgctcgtttgtatgtactgcatgaagcattgtaaaattgagcaacagcaaccagagctcgagaatcttaggcgcaaccaaccaaccccgtatcgatgaattgacaataaagctgaatattttaggtgtttagaaaataaaaaaaaaaaaatttttggggagattaggatacaaactctctgattc

SEQ ID NO: 17518 - DNA, 1789 bp, Zea mays
ggccgggacttgatttaatgattataagagcattccacagcaagatcctccgccggtttagtcttggtacagcaataggctttagaatcaggaaaggaacattgactgacacacctgccatccttgtgtttgttgctcgaaaggttcacaggaagtggctcagcgctactcaatgtcttccaactgcccttgagggacctgggggtgtgtggtgtgatgttgatgttgttgaattttcttattatggtgcaccagccccaacaccaaaggaacaactttatgatgagcttgttgatggattgcgtggtagcgaccctattgtaggctcaggttcacaggcatgttgcggttgatctggattatcccaaccagaagatggtccatccgctacctcctaatcttgggcctggagtgtacctaggtgccgttgagagagcaacatcatttataacagatgatgtttggtacgggatctacgcaggaacaaacccagaaacttttgtccgagctgatggtgcatttataccgtttgctgatgacttgaattaccagtgtcagcacatcggttaaaggagttggagtcattggtgatgtaaaggcaattgatttgcaatcctcaattggcagtctcattgggagacaagttgtcaaagttggaagaagttctggtctgacaacaggaactgttgtcgcatacgcacttgagtacaatgatgagaagggaatatgcttcttcactgactttcttgtcgttggggagaaccaacaaacatttgatcttgaaggggacagcggaagcctcataatcttgacaggacaagacggtgagaagccacagcctatagggattatttggggtggtacagctaatcggggaaggttgaaacttaaaagtggccagggtccggagaactggaccagtggagttgaccttggccgccttcttgatctcttggagctagatctgatcacaacaagtgaagggctacaagctgccttggaagaacaaaggattactctagccgctgctgctgctgcggcaactaattcaactgccacagaatcgtcacctgttgctggccctcaagagaatgataaaatcgacaaaatctatgaacctctcggcatcaacatcattcctcgggacagttcttccatatcaacagaccaacccaacgagaatgtggaagagctaaacctgatgtctccgatgcgcaacggtcaagaaggcaacggtgacttgaataacttgatggacttggaactggaaaattcgcctgatggtatttctattgccctgaacctgggagagcgggagccaaaaagactccgctcagattttgattcgaccctggacatggacttgcagaaatgaggctgttatgctgcagacttgttgcaggaggctctgcactattcagcttttgtgttgatcattgaaggtatggccataaaggaaataatatgtttctggacgactggacctgttgtcctgcttggagccggtctgggttaagctgtgaagctcctgctgcagttttgcgtctagtgtcaagtgctctagtatatctagtgttgcgtaagatgtcggcacctcaatttgacagaggcgccatacttcttgcccatgtaatgttgtcatttgttgtatgctcgtgtatatgtactacatgaagcattgtaaaattgagcaacagcaaccggagctcgagaatcttaggcgcatgcgcaaccatccaccaaccccgtacctgatgaattgacaataaagctggatattttaggtgtt

SEQ ID NO: 17519 - DNA, 4135 bp, Zea mays
catacaattatgcttgatacagataattgagaagctgtcagcaggagcacttgatgtgcagactaaaatcaaaacattgagctcgatagcagaggagcacaacatcaaatgggagccaaaagcgtttgaggagaaactgcaacaaccaactgaaggtcatctggtaagtaaatgatttagtcttttcacctttctgtccttatttggatattgtggccctaacgattcgttatattatttgttagtatggttctgcaacatattctggaggaaatacttcaactatgggatcatctacttctagcatatcaacaccacagcctacatattcaggtgttagtgcggcacctgtggactcagccactatccatgtgccagcaaataaaactgcatatggcagtgccaattctaatactttttcgaaagaaagcattcataatagttccagtgcatcagtacctcctatctcccaacatgggccgtctgcttactcttcagcacaggttcctggttctaacaatatctcacatggaaatccaggaggtccaccttaccctcaatacagcgcaacagtcccaggtaaagaaggatttcattgtttgaatgtctgccagttttcactgctctattatgttaatattcccattgaaatctttgatttttcctttcagacgcagtatccaggaatgaagatagcaatcagaatagggaaagaaaacctttggtgactggtgccaattggaatgtggaattcaaggatgcaacatctgctgctcaggcagcagcagagtctgcagagatggctagcattgctgctagagctgctgctgaacttgctagtcgtggaaactattctggagataaaggcactggagcctatgattcagccgcatacagtagcaaaaacacagtgaggaagcaacgggcggaacatgtagtgaaggatgagagtttccatgaccagagttcaggtgttaatgatccaagcgagatgccaagtaactcaagaaatttttttggaggaacagaaacatcccatgttgatagtgagaatatatcgacagccccatatcaacagttccatgcctacaatccagacagccatccatatgtttatgaaatgccaactgaaccacctcgtgctcattcacctgacccacgttttgatgatttatatgagagggaaagtgacattggaagatctgaagttgatccgtttgattttcctagagaaaacttccaagatactgcatctgttgggcacaatttcaaggatgtggaaatcaggacacctagctacgatcaagaaagcacagatgactactatggtaattttaattcttcacatgatacattggcccatggcagcagcaccactgcttgggataagcaaaacgacaaagctcaagacaactcttcacctgttgtttttgatcaatatgattctgatgttgaacaagagaatttgttggacacattctcctcaaagcatactgaacaactacctgctcccggagatcatatgagattctcaactgcagattggagtgaacagcataccagtgaatctccatccaagcagagaacgtcagccctattttccagaacagaaacacaactatctgataatttaggaacaaacaaaagtgatattccttcacctcattcttatcataacatgcgtcctgcttttgattcagatggtggtagctctgatgaggaaatagccacaaccacgcatgcagtgcctttaaggtcacattcaggaggatctgcttcgtctgtcctgaacaaaggtggtggacctgatgcttcacccatatttgattattcaggagcacatgcagtgaggaacttgaaccgtgtgcaaagcagagattctgatctttcggaagaagagacagatttagataaatttaaaggttcatccttcgccagagcaaatgagcagcagctgttgccttctgccatacgtacttcagcaacttctgatgataaggaagatgacatcagcctgaactttggtaagttaacgcctggactaagaaacaaacccaggcaacccccaccatacaccaaagtttccagggagagcattctgcctaagcagtccttgcctaaggtttctgctggcactgaagagtcagtcgattctgaagagaatactacattcaaacaggatagaagtagtccccaaagctcattttcagccaggacttcttcaggtaaagactacgacagtggactttatgaaaggaaccgaagtgttggaacacactgggaagcaaaatcaaccatagcaagaaattcctctggtttagatgatgctgagaagttatctgatctacctactaatataagtcttccaacaactaagagttctgaacgctggaattcgagtaaagtgccttatcatgaaaaaccaggtattggaacacgccgagaagtgagatcaacactggctagaaattattttgattcagatgacagtgaagaagaactagagcaacagcagattcctcagtcgaagcaatctggagtgctgatacagtcacgcaggacacgggaggtgacatcagacacaaagagagatggtcgtttccaaaccggagctcagtatggtgatgaaactgagagtgtgacaagtaagacacaagtccatcaaggattcaacagctcaagtactgaacggagtgaaaggagggatccaagtgtgtaccccagggttgcagtacagcgctcttcgtctaaagctgagcagattgaatctccgatggagagagggaagccacaaggagctgaaatgagaagcaccttatttcgaggaaatgaagaggacacagaaacctcatctggaactccaaaagaaagcacccccaaaacaccccctgcacatgttcatcccaagcttccaacagactatgattctttcgccgcacattttaggtctcttcgaacaaaccggccttaggtttacacgacatatagagtttggagtttcagttgaattaagtcatatatacgatactatgatacgttttatggaggttgagttgagatttgtacattatagcaacactgttttctggacactatcgtgctgtgctagtttgggcgtacaattcttttgttctcttgtatcctcatatactcaatagaatcatattgtaaagactttaatttcctgttagtgattattaataagcacggcatgttggcatatgtatagaacatgcggggttctttcattccattgtaacgggatctgctacactcatgctatgagattgtttcatgctttctgcaccttcgtctgtagtctattcatgtgaagggaggtggcacagtctttgcattaagtactactccatcctaaaatataattcgttttaaactaattatatatttcagtaggtaacatataaatatatataaatatagtttgtatatatgtctatattcattatcatttaaataaacgtcgacgaaaaataataggctagaaagaactatgttttagaattgagagtatattttttgataaattttttggcggtactgggtgatttgcgtcctaccgagatattaccgtcatacgctcatgctgctgagggttgagaattttagagatggtaatgagtattcgaaatctaaaaattcgacgggttttatctgatatgtagtcaggtatgagatagtttgtctatccacgatatattagtgatcaagaatctacccgttagatagacgggcaagaacctctacccgagagatacatgtatggatgggtagtacccttacccatatactcgtggataaaatatacccgcatcatattattattattattattattattattattattattattattattattattattattattattattattattattattattgttattattattattattattaaagcacatcttagctaaaaagaaaatccgtcttatatttatttaactattaagttatgtaataacatgatttgcgatattttaagttgaacttatgtgtttatttgatattttaagtgataggaatattagaatttaagactttcctagcgggtatgagttacccgatgcataaaattacccatgcgggtatgggta

SEQ ID NO: 17520 - DNA, 1979 bp, Zea mays
tatatatatatagctaaaactctaaacctagaaagtccaaaaacgatttacaaattggaaactttgcaatctaaatggcacttcaactatgactacaagacgagccggtaaaatttgatgtcaaaaaagtcaaacaacattctttctgagacggagggagtacttattaatattttatgtatatatttggttaaagttaaatatattttacttttggatgatcattggtagagaaaaccatgtgtttcaagagtgcttgtacatttaaatgagcatatatatctatgctgtgttttagaaaagaaagaaaagcgatacctgctgggtggacttggcgaatttccctatctatctcctccccccggcccgtcccccccccgccggttcattccacagtgagttccactcagagtcagagccaccgtttgtaaacacccgtttgcacggctcgctaattcttcttccgtgccagttgtccttccatggctactgaatcgggaaacccaacccatccactatcttatactcctcccatccctcgctcaccacagcatcgccactactcgctccaccatcccctgaccccgtgcacccgcaccattagctcggcctagcttgcttcgatcatcggctcgatcggttctctgactctgatctgatctggagatcgatctcggccggccggccggctatggacggttcgaagagcaatgctcaccaacaaggcgcggcggtgactagcaccaccagctcggcgggcaagcgcaagggaaaggcggcttcatcttgcggcggcggaaagaagccacctatcaaggtggtgttcgtcggcaaccccgtgcgggtgaagaccagcgtggcgggcttccgcgcgctggtgcaggagctcaccggccgccacgccgacccgtacaagcacagcgttggcgacgccgacgccgacgacagcagcagcggtggcagtggcagcccggtggagctgcaggtgggcggcgcgctgtcatcggactccgcctctgctgccggcgtggcccaagtcatctcagtgccggcttacgacgacgacgacgacgacggcttcgcgccacagctgatcgacaacagctactccgtgttctcgccgcccacgttcctctacggcccgcacggcggcgagctgtgattccaacagtacatgtatgtatgtgtagttgtgtatcgcattctagctagctccaacgagcatcatgtgtatcgtatgtgcatgcgctgcaggctcggtagcacgcaagtgtaatacgtaattaggattgatttctgcacgctagctagctagcaacgcaaatctctgttatgctgccaccggccggcaaagtagtggtacactaatataatgccctccggtttgatgggtggtgctaaaaaaaaaagagagccacgtgcccttttgtttggaagggaattgcgttgtacaatgatgaatcgtcaggtattttgagttaacaattccctttcgtgctaattattggttcctcttatagaccaaacaagttaattagagatgaaacactcagagctgatttggtgaccaggagagtagaaggaatccatagggaggaatttccttcttatttaaaattgaatagtaagagaattcctttctcatggatctctatttttttaatctccaaaccatccgtcaggggataggattagttttgaatggctccaggagaatcggattcatcttccgctctttttagctagctaggaactggccttctcagtgttgacccaatgatccatatttgacaaagatatatagatccattttttgactcatatatacacacacatattatacgttcatgggaatgacatattatatagatccattttttactcatacacacacacacatattatacgttcagagctccttcttaacaacatattatcggtcctcttttggactgtctaaaaaattttatctctctaca

SEQ ID NO: 17521 - DNA, 1317 bp, Zea mays
  misc_feature (44)..(44): n is a, c, g, or t
  misc_feature (1282)..(1282): n is a, c, g, or t
gatgtgtgctgccatcctgagtaagaccacaattagtcacagcnacctcacatgcatctatcactggcatgaagaaacatcatgcagcagaacccttcgtgtgacataaaaactgacaaacgacaaaacaatcagaatcgattgtgatctactattctactacgtgcctcaattgataacaacacaaggaaaaaaacttcccagtgaaatcagggtgacaaagaacatcctgttattctgtatggcaaaataggtgaatgtttaaatgatataggccaggagaaacatctcagcaagaatattaaatgaaataacaacaacgttcacattgaatttccagtacccagataatgcatggaacatgtcgcatcaagcacgggatactaaatttccgagtcagcaattgctgacacacattagcgtatgttcaacgtattcctagtctatggggaaagcttattgcagtagctgctgaaacctacattaccacaacggaaaaaatcaattatcagagcacccatagtgactgacaactactaaaccccatgtaatgataaagattgaatttctacgagaaatctaaaactctgttgtggacagatggctccatatgctcatggataaccaacaagaagatcatgctgcgtaccattcttcagacgaacatgataatgacgaggagaatgcttcggatgagcagcgaacgtagagccgggttgacgaagagagctgcaggaatgggataactgaatattctgatgagatcgtcgaggtcgaggacaagattgtttctgaccagggagcagaaagagggaggaacagctttggaattaaagacagagaggaaaagaagatttggttccctaggtctgacagcaccaggggtttccggtcactgccatcatcaccctccatgatcctgggaatgagaaaaggtgtggaacgcatggctgtcgacgatgaccgcaaatatggctatgaggattcagtgtccagaagcagcactaagtttcttagcaggtgcaagcaggcaatcaagaaagcagtaaacaaataggtcactgcaccatacgtctgaatacctctttatttttccttttctttgtgtgagttcaaaatcgattccaattgttgtagtctgtgtagctgaataagcgagtgagcttagcttgcagacttttgtgtggtatttcttatggtcaccctaacgtgatcagattagtgtgtgtacaagtatttttttcatttgatactttgttagaaaagataaactattattgtncctgagccgcagaagtcagcggaccgagtcggaca

SEQ ID NO: 17522 - DNA, 1981 bp, Zea mays
  misc_feature (806)..(806): n is a, c, g, or t
cattgggtacctcgaggccggccgggatccatctatccatcaccaccacctcctccttcccacgactcccgagcgctctgcgtgtggcgcgcgcggcagcatggcgactgcgaacgggagcagcaaggggtcgttcgaggtgcccaaggtggaggtcaggttcaccaagctcttcatcgacggcaagttcgtcgacgccgtctccggcaagacgttcgagacccgggaccctcgcaccggcgaggtgatcgccagcatcgcggagggaggcaaggccgacgtcgacctcgccgtcaaggccgcccgggaggccttcgacaacgggccctggcccaggatgacgggatacgagcgtggtcggatcctccacaggttcgcggacctgatcgacgagcacgtggaggagctggcggcgctggacacggtggacgccggcaagctgttcgccgtgggcaaggcgcgggacatcccgggcgccgcgcacctgctgcgctactacgccggcgccgccgacaaggtgcacggcgcgacgctcaagatggcgcagcggatgcacgggtacacgctcaaggagcccgtgggcgtggtgggccacatcgtgccctggaactaccccaccaccatgttcttcttcaaggtagggcccgcgctcgccgccggctgcgccgtcgtcgtcaagcccgccgagcagacgccgctgtccgcgctcttctacgcgcacctcgccaggggaggccggcgtccccgccggcgtgctcaacgtcgtggccgggattcgggcccacggccggggccgccgtcgcagnccacatggacgtcgacaaggtcagcttcaccgggtccacggaggtcggccgcctcgtcatgagggccgcggccgagagcaacctcaagcccgtgtcgctcgagctgggcggcaagtctcccgtcatcgtcttcgacgacgccgacctcgacatggccgttaacctcgtcaacttcgccacctacaccaacgagggcgagatctgtgtggccggcacgcgcatctacgtgcaggaagggatctacgacgagttcgtgaagaaggccgccgagctcgccagcaagtccgtggtcggagacccgttcaacccgagtgtcagccaaggcccccaggttgacaaggaccagtacgagaaggtcctcaggtacattgacatcgggaagcgcgaaggcgccacgctggtcaccggagggaagccctgcggcgacaagggctactacatcgagcccaccatcttcacggacgtcaaggacgacatgacgatcgcacaggatgaaatctttgggccggtgatggctctcatgaaattcaagaccgtggaggaggtgatccagaaagcgaacaacacccggtacggcctggccgccggcatcgtgaccaagaacatcgacgtcgccaacaccgtgtcgcggtccatccgcgccggcgccatctggatcaactgctacttcgcgttcgacccggacgcgccgttcggcgggtacaagatgagcgggttcggcaaggacatgggcatggacgcgctcgacaagtacctgcagaccaagaccgtcgtcactccgctgtacaacactccatggctctgaccgacctcatcctgtccgatgaacagttcaacatcacaaacaagaagaaacatgtcttgtaagatactcctccaaaggatcggttgcctgtacctgtactcttacacctgcatggattgatgatgcagtgcaatgtagcattcagaacaataaagacatgtttcggactgctggtgtctgatcggttgaagagcatgtttcagtattactatttcttttcaccgacaaccgcgttggtttctgcggcccattttttggtgcctattttcgcgataggaacttatggcaatataatgcttggcatatcatatccaaaaaaaaaaaaaaaaaaaaaaaaaaaaaaaagaaaaaaaaaaaaaaaaaagcggcc

SEQ ID NO: 17523 - DNA, 2091 bp, Zea mays
ctgcagttgcatatcccgatcggccaacagcctcgatcacctgatgagtggctctcggtgccattcccctcccagggccaggagtctcctcgctcaatgagttgcaaagtgcgccaccactaactgcgcactaattaattaacagcacaagtctgtcctagacgccgacgcaggaagcgacagtcatgggctgtcaacttggcgccacgcacgcactgtccatcacttagcttgttgccttgttgtctgcatccgcgtgcagtgctcaaggtggatgagttgattattgcatgatttggttatcgtcattgattgatttgggcaggcaagacgttcgagacccgggaccctcgcaccggcgaggtgatcgccagcatcgcggagggagacaaggccgacgtcgacctcgccgtcaaggccgcccgggaggccttcgacaacgggccctggcccaggatgacgggatacgtaaggccggaccgaccgcgcgcgtgtgtgtggcttttgttaatttggccccaaaacattttatctcggttttattcaaatgctcaacacgcttgtttcccgcaggagcgtggtcagatcctccacaggttcgcggacctgatcgacgagcacgtggaggagctggcggcgctggacacggtggacgccggcaagctgttcgccgtgggcaaggcgcgggacatcccgggcgccgcgcacctgctgcgctactacgccggcgccgccgacaaggtgcacggcgcgacgctcaagatggcgcagcggatgcacgggtacacgctcaaggagcccgtgggcgtggtgggccacatcgtgccctggaactaccccaccaccatgttcttcttcaaggtagggcccgcgctcgccgcaggctgcgccgtcgtcgtcaagcccgccgagcagacgccgctgtccgcgctcttctacgcgcacctcgccagggaggccggcgtccccgccggcgtgctcaacgtcgtgccgggattcgggcccacggccggggccgccgtcgccgcccacatggacgtcgacaaggtcagcttcaccgggtccacggaggtcggccgcctcgtcatgagggccgcggccgagagcaacctccagcccgtgtcgctcgagctgggacggcaagtctcccgtcatcgtcttcgacgacgccgacctcgacatggccgttaacctcgtcaacttcgccacctacaccaacaagggcgagatctgtgtggccggcacgcgcatctacgtgcaggaagggatctacgacgagttcgtgaagaaggccgccgagctcgccagcaagtccgtggtcggagacccgttcaacccgagtgtcagccaaggcccccaggttgacaaggaccagtacgagaaggtcctcaggtacattgacatcgggaagcgcgaaggcgccacgctggtcaccggagggaagccctgcggcgacaagggctactacatcgagcccaccatcttcacggacgtcaaggacgacatgacgatcgcacaggatgaaatctttgggccggtgatggctctcatgaaattcaagaccgtggaggaggtgatccagaaagcgaacaacacccggtacggcctggccgccggcatcgtgaccaagaacatcgacgtcgccaacaccgtgtcgcggtccatccgcgccggcgccatctggatcaactgctacttcgcgttcgacccggacgcgccgttcggcgggtacaagatgagcgggttcggcaaggacatgggcatggacgcgctcgacaagtacctgcagaccaagaccgtggtcactccgctgtacaacactccatggctctgaccgaccgacctcatccctgtccgatgaacagttcaacatcacaaaacaagaagaaacatgtcttgtaagatactccaaaggatcggttgcctgcagtagctgtactcttacacctgcatggattgatgatgtcgtagtgcaatgtaacattcagaacaataaagacatgtttcggactgcattcagctagctagctgtgtgccgactgctggtgtctgatcggttgaagagcatgtttcagtacttccccttctttt

SEQ ID NO: 17524 - DNA, 851 bp, Zea mays
  misc_feature (820)..(820): n is a, c, g, or t
gccggccggggcattgggtacctcgaggccggccgggatccatctatccatcaccaccacctcctcctccttcccacgactcccgagcgctttctccgcctgcgtgtggcggcagcatggcgactgcgaacgggagcagcaaggggccgttcgaggtgcccaaggtggaggtcaggttcaccaagctcttcatcgacggcaagttcgtcgacgccgtctccggcaagacgttcgagacccgggaccctcgcaccggcgaggtgatcgccagcatcgcggagggaggcaaggccgacgtcgacctcgccgtcaaggccgcccgggaggccttcgacaacgggccctggcccaggatgacgggatacgagcgtggtcggatcctccacaggttcgcggacctgatcgacgagcacgtggaggagctggcggcgctggacacggtggacgccggcaagctgttcgccgtgggcaaggcgcgggacatcccgggcgccgcgcacctgctgcgctactacgccggcgccgccgacaaggtgcacggcgcgacgctcaagatggcgcagcggatgcacgggtacacgctcaaggagcccgtgggcgtggtgggccacatcgtgccctggaactaccccaccaccatgttcttcttcaaggtagggcccgcgctcgccgcaggctgcgccgtcgtcgtcaagcccgccgagcagacgccgctgtccgcgctcttctacgcgcacctcgccaggggaggccggcgtccccgccggcgtgctcaacgtcgtgccgggattcgggcccacggccggggccgccgtcgcgncccacatggacgtcgacaaggtcagcttcac

SEQ ID NO: 17525 - DNA, 559 bp, Zea mays
  misc_feature (486)..(486): n is a, c, g, or t
gcagttgcatatcccgatcggccaacagcctcgatcacctgatgagtggctctcggtgccattcccctcccagggccaggagtctcctcgctcaatgagttgcaaagcaagacgttcgagacccgggaccctcgcaccggcgaggtgatcgccagcatcgcggagggaggcaaggccgacgtcgacctcgccgtcaaggccgcccgggaggccttcgacaacgggccctggcccaggatgacgggatacgagcgtggtcggatcctccacaggttcgcggacctgatcgacgagcacgtggaggagctggcggcgctggacacggtggacgccggcaagctgttcgccgtgggcaaggcgcgggacatcccgggcgccgcgcacctgctgcgctactacgccggcgccgccgacaaggtgcacggcgcgacgctcaagatggcgcagcggatgcacgggtacacgctcaaggagcccgtgggcgtnggtgggccacatcgtgccctggaactaccccaccaccatgttcttcttcaaggtagggcccgcgctcgccgca

SEQ ID NO: 17526 - DNA, 1894 bp, Zea mays
attgggtacccgcggcggcggcatccatccatctatccatcatcaccagctagcacctcctttcccacgactcccgagcgctctgcgtgtggcgcgcggcagcatggcgactgcgaacgggagcagcaaggggtcgttcgaggtgcccaaggtggaggtcaggttcaccaagctcttcatcgacggcaagttcgtcgacgccgtctccggcaagacgttcgagacccgggaccctcgcaccggcgaggtgatcgccagcatcgcggagggagacaaggccgacgtcgacctcgccgtcaaggccgcccgggaggccttcgacaacgggccctggcccaggatgacgggatacgagcgtggtcggatcctccacaggttcgcggacctgatcgacgagcacgtggaggagctggcggcgctggacacggtggacgccggcaagctgttcgccgtgggcaaggcgcgggacatcccgggcgccgcgcacctgctgcgctactacgccggcgccgccgacaaggtgcacggcgcgacgctcaagatggcgcagcggatgcacgggtacacgctcaaggagcccgtgggcgtggtgggccacatcgtgccctggaactaccccaccaccatgttcttcttcaaggtagggcccgcgctcgccgccggctgcgccgtcgtcgtcaagcccgccgagcagacgccgctgtccgcgctcttctacgcgcacctcgccagggaggccggcgtccccgccggcgtgctcaacgtcgtgccgggattcgggcccacggccggggccgccgtcgccgcccacatggacgtcgacaaggtcagcttcaccgggtccacggaggtcggccgcctcgtcatgagggccgcggccgagagcaacctcaagcccgtgtcgctcgagctgggcggcaagtctcccgtcatcgtcttcgacgacgccgacctcgacatggccgttaacctcgtcaacttcgccacctacaccaacaagggcgagatctgtgtggccggcacgcgcatctacgtgcaggaagggatctacgacgagttcgtgaagaaggccgccgagctcgccagcaagtccgtggtcggagacccgttcaacccgagtgtcagccaaggcccccaggttgacaaggaccagtacgagaaggtcctcaggtacattgacatcgggaagcgcgaaggcgccacgctggtcaccggagggaagccctgcggcgacaagggctactacatcgagcccaccatcttcacggacgtcaaggacgacatgacgatcgcacaggatgaaatctttgggccggtgatggctctcatgaaattcaagaccgtggaggaggtgatccagaaagcgaacaacacccggtacggcctggccgccggcatcgtgaccaagaacatcgacgtcgccaacaccgtgtcgcggtccatccgcgccggcgccatctggatcaactgctacttcgcgttcgacccggacgcgccgttcggcgggtacaagatgagcgggttcggcaaggacatgggcatggacgcgctcgacaagtacctgcagaccaagaccgtcgtcactccgctgtacaacactccatggctctgaccgaccgacctcatcctgtccgatgaacagttcaacatcacaaacaagaagaaacatgtcttgtaagatactcctccaaaggatcgggtgcctgtagctgtactcttacacctgcatggattgatgtcttgatgatgtagtgcaatgtagcattcagaacaataaagacatgtttcggactgcaaaaaaaaaaaaaaactaaaaacaagctaaaaaacaaaaaaaaagaaccaaaaaaagacaaacaaaacctacaaaaaaaagccataatggcaacaagtg

SEQ ID NO: 17527 - DNA, 1795 bp, Zea mays
gactgtgtttcagatatatatataagaagagggaaacaaaggtttaaagtggcccaaaaaataacacactccttatggaggtcagtaacactcgtacatgaaaggatccataaaaacacacactccctacaacaacctatgcagggcaacaaaaaaggagagccctttggctccagcaatttttgagcttcttctttcctcatctgcttgctccagagtcaaaggctgggagaccctccataaaaaatggctctattgcgatgcttccaaatcaaccaagatcctaaaataacgagggagtaaagacctttcctgaccagacatttacggtctctgaaaccatctcccaccaatgcataaaggaaattgtatgtggccgtggggctaaactatacaacccaaactttcttagtaggttttaccagaaaactcttgagaagacagctcatgagcaagtggttaagggtttcaccttgctggtcacataaaggacatctgctagggtgattcaatcctcttttcgcaaagcgatcagctgtccaacatttattatggtccaccagccaaatgaataaacaacactttggaggacacacgtgtggacacaaggagtacaaagaaaaaaaatgaagagtatgaacttttatttagtggcccatctaaaagcccattaattcagcacaagttccactagcccagacgtttctttaacctagccttttcactgctccagcgaaggcacagccgccaccgtttcttgatctcccatcttcatcttcttcgtagcgccggcgctccatcttccgctccctcccttagtcgcgctcggcacgcgggtgacggcggcagtggcggcactcaggatcgggctctcagcgacggcatcagcggtttcccctcccgcttctctccagtcgcctcgcgccctcgcctccggtcctccgcacaccagccggtgaccctccatatagggtgtgagactaccaaaactcgaaaatgaacaagggaaagatttttaagctagccaagggattcagaggaagggcgaaaaattgcataaggatagcaagagagagggtggagaaggcgctgcaatattcatatagggatcgacgcaacaagaagagagacatgcggtctctttggattgagcgcatcaatgctggtacacgcctccatggggtgaactacggcaatttcatgcatgggttaatgaaggagaacatccaactcaacaggaaggtgctctcggagctgtcaatgcacgagccatacagcttcaaggctcttgtcgatgtgtctcggaatgcatttcctggcaacaggcctgttcctgccaaggaggggctagcgagcattctgtaaacgttttcttcccaataattaaacttgatggtttacatctacatctgaaagtgacctgtctgcttgtaacgtgacgaggaggtccgaaattgtcacgggcattgcacgtgttattcctctatttttttcccacctatctaattgcatgctttgtacctcatgcttataagttttctgaagaacgtgttccattcggtcttcaaagcttttagcagaatcaactgtagattacgtttcgtgcttctgacgggcttggcttgtggcaagaggacagggcaaggctatatcagatcgtgcatgagcatgactgcaacacactgttttgctttgcattctagttcaaaataaaataagaggggtgatgactgatgagtaagctgttcgagaaaagcctaaataaccactcatgtcaaaacccatgaaaaggacc

SEQ ID NO: 17528 - DNA, 690 bp, Zea mays
aaatcccatatccttcatttcttatttaccccttggatgagttccgttggtgggtcagttagtggatctccagttaggaagaggccgcgccatgctgaacaagggttggggggacctctgttgtctttggccgtgaggtgtctcctattaggttgctgtgatcgggcccatgggaccctcttctctaggagtcttgggaggacctccacttttcgcgtggcgctggacacgaccgaggctaaggcaggattgctccgggaccagcttgctgaatccgacgttctggaagtcgagctggagaagttgcatcatcaagcggaataggtcacggaatacgtcggagctcgcaacttttccttggtggaacgtttggacaatatccggtgccatgtccgggatattgtcgactccacgtacaccgagggacatccgtagcgttgcttgttggggagcttcggttcggccgcagtctcctggatgtcattggcccaccttcgtctctcctagatgatagactagaggacatcctggagggctacgatgaggcgcccagtcgtgtcatggacaagttgtctatagataatgttgtccgcaaggcctggtgactctatggtgtatcatgtcttgacgttgtattcccatgagagaatataataataatttttactttcaataaaaaaaaaaaaaaaa

SEQ ID NO: 17529 - DNA, 2785 bp, Zea mays
cttttaaaatcacacccaaaatctctcaaggtttgcttcatctatagcaactgagcacaacaagcaccagcagctatgtattcagcctcggcagtggaaagtacaacacagttttgcttcttaaagctccaagacaccagggaccgcctaaggaattggcaagtccccaaggtgctttttcgatctactttacaactggcatagcctgaatcagagtagccaaataaatcaaaaaaggagcccttaggataccagagacctagattttgggtgtgaactagatatctcaaaattatcttaacggccactaagtgacactcttttgggttagcttgaaaacgggcatacatgcacacactaagcatgatatctggcctagatgcacataaatatagtagagatcctatcattgatctataaagcttttgatctacagttttaccttcttcatttaagtcgagatgaccacttgaagccattggtgtcttggcgtgctttgccttttccatgctaaactttttgagcatgtcttgtgtgtacttggtttggcacagaaaggttccttccttgagttgtttaacttgaaaacccaggaagtacttgagctcacccatcatggacatctcaaacctatttgtcataaccctactaaattcctcacaaaaagtttcatcagtactgccaaatataatgtcgtcgacatatatttgacaaacaaataattgattgtcaactttgcgagtgaataaagtagagtctacttttcctatttcaaaaccattgttaagcaagaaatccttaaggcagtcataccaggctctaggggcttgtttaagcccgtagagtgccttgtgaagtaggtaaacatgatttggcttctttggatcttcaaagcccggtggttgctccacatagaccctctcttgtagtggtccatttagaaacgcgctcttgacgtccatttgatatagcttgaaatcatggttagtagcataggcaattaatattcttattgactctaaccttgctaccggcgcatatgtttcaccaaaatcaagtccttccacttgagtgtagccttgggcaaccaaccgtgctttgttccttgtaaccacgccatgttcatcttgtttgttcctaaagacccattttgtcccaatcacattttgcttgggtctttgaaccaaggaccagacttcattccgggtgaagttgttcaactcctcttgcatggcaattatccaatccggatcacccagcgcttcttcaaccttaagtggctcaagagaggagacaaacgagtaaaattcacaaaaatttgctaaacgagatcgagttgttacccctctcctgatgctacccaggatgttgtccacctgatgatctctttggatggtatgatggactcgaggatggggcactgatggttgtctttgaatttgctcctcctcatcatccacttgatcaagaggcacttcaccatcaacactttcatgttcaccttccaccacggttggcatcctttggggttgatgaccttcttcaagacttggatgacttgaggttgatgggtttgcttgggtggaggatttgtcacccaccacctttgcgcccacatcaaaaacctcattggtcatccacaaagttccttcctcatcatccttttcttgaggtctcacttcacctattgcaagcttctttatggcctcacaaggtggttcttcatttcctgcagtgtcattagaaacatgcccttgcgagccattagactcatcaaatgtcacgtctatcgctatttcaacaagaccggtggtattgttgaaaacacgatatccatgcgcatttgatgcataaccaagcaagaaaccctcgtccactctaggagcaaactttgagctcttgactttcttgttaagaataaagcatttacaaccaaatactctaaaataatcaactttaggtttgttaccagtgagaagctcgtaggcagtcttcttgtagatcttgtgaagataaaggcggttgattgcatgacaggcggtgttgaccgcctctgcccaaaagttgtcaggggtcttgtactcatccaacatggttctagcggcttcaattagagttcggttcttcctttccacaacaccattttgttgtggagtgtagggaaccgagaactcatgtttgattccttcttcgcctaagaattcttcgacacctgtgttcttgaattttgtcccattatcacttctcactttcttgattttaagctcaaactcattttgagctcttctcatgaatttcttcaaggtctcttgggtttcacctttgtcactcaaaaagaaaacccaggtgaagcgagaaaaatcatcaacaataactaagccatacgtcctaccaccaatactgatgtaagccacaggtccgaagaggtccatgtgaagaagctccaatggcctctttgttgtgaccacattctttgattgatgtgggactccatgttgctttcctgcttggcatgcgccacaaaccctatctttctcaaatacaacatttgttagtccaatgatgtgactatccttttgaagtttggccaaattcctcataccgacatgagctagccggcgatgccatagccaacccttgtcggactttgccactaaacaagtctcaggcgtcactttacttgttgtgaaatcaacaagataaagtttgcccttcaagcgacccgtaaaggcaactgaggaatcctcccttctaaggatcttcacatccacatcagaaaataaac

SEQ ID NO: 17530 - DNA, 2478 bp, Zea mays
tttcttgaactccatgacactaaggaccgcccaagtaatggcaagtcccagtagtgctttttcgatctactttgcaaccgacataatctgagtcagagtagccaagcaaatcgaaaagggagcctttaggataccataatcctaggttttgggtgtggactaagtatcttagagttctcttaacggctacaagatgacaatctttaggatttgcttgaaaacgtgcacacatgcaaacactcaacattatatcaggtctagatgcacataagtaaagcagtgatcctatcattgatctatataatttttgatctacaggtttaccttcctcatttaggtcgagatgtccatttgatgacattggagtcttggcgtgctttgccttttccatgccaaacttcttgagcatatcttgagtatatttagtttggcatagaaaggtaccttccttgagttgtttgacttgaaatcccaggaagtatttaagctcgcccatcatagacatctcaaacctgttcgtcattactttgctaaactcttcacaaaatttttcattagtactaccaaatataatgtcatcaacatatatttggcacacaaataattcattgtcaacttttcgagtaaataaagtagagtcagcttttcctattgtaaacccattcttaattaaaaactctttaagacagtcataccaagctctaggggcttgtttaagcccgtagagtgccttgtgaagtagataaacatgatttggcttctttgggtcttcaaagcccggtggttgctccacatatactctctcttgtagtggtccatttagaaaagcgctcttgacatccatttgatatagcttgaaatcatggttagtagcataggcaattaatattctaattgattctaaccttgctaccggcgcatatgtttcaccaaaatcaagtccttccacttgagtatagccttgggcaaccaaccgtgccttgtttcttgtaaccacgccatgttcatcttgcttgttcctaaagacccatttagtcccaatcacattttgtttgggtctttggactaaggaccagacttcattcctagtgaagttgttcaactcctcttgcatggcaattatccaatccggatcacccaatgcttcttcaaccttaagtggctcaagagaggaaacaaacgagtaaaattcacaaaaattagctaaacgagatcgagtcgttacccctctcctgatgctacccaggatgttgtccaccggatgatccctttgaattgtatgatggactctaggatgaggcactgatggatgtctttgtatttgctcctcctcatcagttacttgatcaagaggcacttcaccatcaatactttcttgttcatcttctaccactgttggcatcctttgatgattttcttcgtggcttggatgacttgaggttgatgggtttgcttgggtggagactttgtcactcaccacccttgcacccacatcaactacctcattggtcatccataaggttccttcttcatcatccctttcttgaggtctcacctcacctattgcaagtttctttatggcctcacaaggtagttcttcatttcctgcagtgtcattagaaacatgcccttgcgagccattagactcatcaaatgtcacgtctatcgctatttcaacaagaccggtggaattgttgaaaacacgatatccatgcgcatttgatgcataaccaagcaagaaaccctcgtccactctaggagcaaactttgagctcttgactttcttgttaagaataaaacatttacaaccgaatactctaaaataatcaactttaggtttgttaccagtgagaagctcataagcagtctttttgtagatcttatgaagatagaggcggttgattgcatgacaggcggtgttgaccgcctctgcccagaagttgtcaggtgtcttgtattcatccaacatggttcttgcagcttcaattagagtccggttctttctttccacaacaccattttgttgtggagtgtaaggcaccgagaactcatgtttgattccctcttctcctaagaattcttcgacacctgtgttcttaaattccgtcccattatcacttctcactttcttgattttgagctctcctcatgaatttcttcaatatttcttgagtttcacctttatcactcaaaaagaaaacccaggtgaatcgagaaaaatcatcaacaatgactaaaccatacttactaccaccaatgctaatgtaggccacaggtccgaagaggtccatgtgaagaagctccaatggcctctttgttgtgaccacattctttgattgatgtgggactccatgttgctttcctgcttggcatgcgtcacaaaccctatctttctcaaatacaacatttgttagtccaatgatgtgattattccttttgaagtttggccaaattcctcataccgacatgggctagccg

SEQ ID NO: 17531 - DNA, 2550 bp, Zea mays
acttgctggtgatttatggttggccccggtcttcggcgcgtgcttgcaaacctagaaaatattgaagttataaaattgatcagtcaggtcatcaaggactttgcaagcggcgagataaaacaagcttccactctttttgattgtgacatcacacttgacgactaccttctcaagagctactacaagactgcatctttgattgcagccagcacaaaatcagcttccatattcagtggcgtcagcaccactatttgtgaaaaaatgtatgcatatggcaggaatcttggtctatccttccaggttgtcgatgacatcctggatttcacccagtcagccgaacaacttggcaaaccagcagcaagtgacttggcaaagggaaacctgactgctccagtcatcttcgctttgcaaagtgaaccagagctaagggagatcattgattctgagttcagtgacacggattcgttagctactgcaatagagctcgttcatagaagtggtgggatacggagggcacatgagcttgcaagagagaagggtgacttggcaatccaaaatctgcagtgccttccaagaagtgacttcagaagtgcccttgagaagatggtggaatacaatcttgaggggattgagtagtggattttacttgaatgctccatcagggctccatcaggtacatatctccatttggggtttggggtagtttccatataaatctttatattcagcccctttgggaagatacatttcaccgaaaaatcagatgaatcgcactatttcatacaaatctggggatagcctttgagcaggccactactatcatgttgattctgtaacagcttgtgcagaatcataagaaaccatggtttgaccgcagccccttgcgcctacatgtaaccgagcattctacttggcagttcttgtaaataatagaaccatacagtaacttagcattcttttttgttttgcaatctgcgcatgcttacaagcaacaaagtgtgcgctatatttgtatggatctacgtgccccttgcgcctatattaaggatttatttctcatatctaacagaagtcccactcgctgtgttcggcctcgccttatctctattccacgcagccttatctgatcttgcttccatttctctgttaggtttcgatggaggcagaagtaaagacgatagtacccgatgacgtcctgggcaaggccgaggcaaggtgttccattactccgccatgttttatttcatttgtactactgtcgtctcctatggtttaatttcagcagtacaaacggagctcatcctatctctttggttgaagctttcccaaatatgagatttttaaaggtcgttatgatatcaaattattaataatggatctcccaggcttggtaaattagtggttctaaggtattaacactactatttttggtacatctcgatcctgtctcttgtgcattgtccatctagatatgtgagtttgtctatgtcaatagaatcatttgctgaaatgaggacacactatttatctatcaagacacttcgtaataaaggagatgattaacagtggttataaaaagtgcaatataaaccttatatatgtaaaacccactaaagtttttattttatttctctgaggttatattaattagttggttatttctcatctaagctcaataagcacaaacatggtttcagtatgtgcatggtatatcagtacattcttgcatgtcaatgtgatatagtcatgaaaacaagctaatatattatttgcttaataaaagaaaaccgagtgtgcgtattgaggccctgaacatgctgattttctacacatctttacggtcactcatacagtcgtcgaacttccaagtcctagtgtatttgtttcttcattgcaaagaaacttttctcgtttcttgggactgaaagcttaccacaacaaaggtgatttttgtagcaccattttgttcaactttggtcgcttatgtttacagcagtttcttttaccttcaacaaaggagtatttctgaatgtgataaacaattttcaattgttgcttggtttcgggaatactactaagtgatactggacttccttggtggtctgcgttcatccatccaatatggaggctccaacacatctcttcattatctgtatctggatttatctgtgtaatagcagtatggtgctcctaacttccaagcttcattaaacaaggaaactgaaagtgtcagaactgcaattcatatagactagatttttatgatacattgtaactaatgcattggtaagcattactttgaatgtgtgggtttttccaggggttgagtggtatgttgtggtcagatttggcaacaatgtatctgccatcatgtgctatatcgataaattatgatacaatgtggtcagattctaggattagttactgtttttgcacaacctgtgtgccatctgtttaccgacaactggacaaataggacatatcgcaatcggataaataacttggcactcttggtcaaaattttgattttccaaaatatttagaatcgtg

SEQ ID NO: 17532 - DNA, 1762 bp, Zea mays
cgaacgagactgcagaacatcgacggttggcagagataatcgagatgattcacactgcgagtttaatacatgatgatgtcatagatgatagtgggatgagaagagggaaggaaactattcaccaactatatggtacacgtgtggctgtacttgctggtgattttatgtttgcacaatcttcttggtttcttgcaaacctagaaaatattgaagttataaaattgatcagtcaggtcatcaaggactttgcaagcgggctacccgcgtttccggccgggcgaggcaaaacaagcttccactctttttgattgtgacatcacacttgacgactaccttctcaagagctactacaagactgcatctttgattgcagccagcacaaaatcagcttccatattcagtggcgtcagcaccactatttgtgaaaaaatgtatgcatatggcaggaatcttggtctatccttccaggttgtcgatgacatcctggatttcacccagtcagccgaacaacttggcaaaccagcagcaagtgacttggcaaagggaaacctgactgctccagtcatcttcgctttgcaaagtgaaccagagctaagggagatcattgattctgagttcagtgacacggattcgttagctactgcaatagagctcgttcatagaagtggtgggatacggagggcacatgagcttgcaagagagaagggtgacttggcaatccaaaatctgcagtgccttccaagaagtgacttcagaagtgcccttgagaagatggtggaatacaatcttgagaggattgagtagtggattttacttgaatgctccatcaggtacatatctccatttggggtttggggtagttcccatatagatctttatattcagcccctttgggaagatacatttcaccgaaaaatcagatgaatcgcactatttcatacaaattctggggatagcctttgagcaggccactactatcaagttgattttgtaacagcttgtgcagaatcataagaaaccctaggacttgaccgcagccccttgcgcctacatgtatccgagcattctacttggcagttcttgtaaataatagaaccatacagtaacttagcattcttttttgttttgcaatctgcgcatgcttacaagcaacaaagtgtgcgctatatttgtacggatctacgtgcacctaacatcatgcacttgtacaattgctttgcactattatgtactatttccgatttaacagtaataccgatttaacagtaataataccgttcattttctacataagatttaaccgtttgttctattttaaaagctgataagcatgtgactaccatttattttgttgtgacttttgttgtttttattaatggtggcactttaagaacggcttaaatttttatatatctgcacggaatttttaaacaaatccagtggtcaaactttgtgtcgaaagtcaacggtatcaaatacagtacatcaaaagaccctacatggacacacctatgccacaggcttcttgtgggaaaggttctgagaagaactaggtgcatcaaaggaacagcagaacgctgttctctgtcgtcgtaccttcctggagaaaaatccgtgtagtctgtctatctgattctgatgatcgcgttcgccgattggaatttcagactcgaatgcttggctggaccgctggacgcgcttgcaacgtgcaagcttccagaattgggaaacaccacaatagctgttacattcatgaagtatg

SEQ ID NO: 17533 - DNA, 829 bp, Zea mays
  misc_feature (11)..(11): n is a, c, g, or t
tccgggtgcancacgcgtccggagctggatttcggaatggtggcgaaccagaacggtggagtgctcgactgggtgaagaaactccaccaagaaaagcagctaggcacgatggtggacaaggacctgggcagcagctacgacagggtggagctggaggagatggtccaggtgtccttgctgtgcacgcagtaccacccgtcccaccggcccaggatgtccgaggtgatcaggatgctggagggggacgggctcgcggagagatgggaggcgtcgcagaacgtggacacgccggagtccgtctcgtcggagctcctgctccagaagtacatggacttcgcagcggacgagtgctcgctcggcctggaagccatggagctctccggcccgaggtgaccgaccggctggttgaccggacccggcgggcatcgcacgggtcggcgtaggtgtttttgccgtatcaagccctatattgttgtgttacgttggacacatagggaaggcgatggattgtatggtctatatagctgtggtggcattcatttgtacatacagcagcattgtgtgaggtgagcccatccttgttgcgcgtctacttggtggcaaagagatgaagatgaatgagtatatagagatagagatcaaagttcccagtgcggagcggttggtgcctgtttgtgttttctgctttgctgaaaggcaaggcgtgcgcagcgctgtttgacatgcgccagtttgtgtggcgcgtcatcagttcatcagctttgtaaagcagcggtccgttacgcagtccggagaggatatggtaaatacagacgtagtattaggggtt

SEQ ID NO: 17534 - DNA, 1979 bp, Zea mays
tgtggactaaaatttgactttgttatttctatgttcatccaggtaatgttctttgcagaacggcacataaacccaggggaggaaattacgtacgattaccacttcaaccgggaagatgaaggccagaggatcctttgcttttgtagatcaagatactgcaggcggtacctcaattagtttccggtgggcgtaacatgtctatatataacttatatatctatatgtatatcttatatatttacaaattacaattgcgattcatgcctgctgtatatgtaggaacttgcatctagaactgcctgtttatcttttgtgaagtcaaatgagttatcagctgttcatgtgacactgaagtttcttgtcgggcaaatgctcactgggggagagaaaagctgatgtgcattcaaggaatcaatgggaagtaggctccaatcatacaaatgacgccataaacagcaactcctggtccaatgtaacaattgaacctaagtacaacaataccattataccagtaacaaaagcataaaaagtgtcactatctcgtttatgagaaatcatgcgcctaatctgaatgatggatgatccagtgatctactttggcaagaagggcttgaggtcagacttgtccacctgaagctttgttgagatggcctcgatctgctgattcctgcaaatccaagagccatccatctttgggaaacagaatatataaaaaaaaatgaccaataacagagttctttctttgtgttttccaccaggaccttcacttcagtaattccagatgaaaatcgtaacttaaccaacttatacatgatgagaggagtcactaattcacactaccttatcacgcagcagctcagaagcagtcatcatccgtgctggagtgcagcctcgtcttggccctcttggcatccgggccagatgcagccatggggctcgcctccaattggcactcgctgtacgatgagcgcggaggagtacgctgcggctgctcaccggtggctgccgcctcgccattgttattacaggcgccagctttcttccacttcttgatgccatcgaatccccacgagcttttcttcttacatttcaccgtcgctttctcgtcgccccccccttcctccccccgcaggcgccttgttctcggtgccactgccgccgctgtggaacatcccctgccagatgcctcctcttccctttctcggccttcccggagggcaccgtttccgacggcgagctctcggtcatgaagactggcgcgttggtggcgttgttatggtccacaggggccagcggcggccttgatgcgctgctgttcacgtcctggtccttcttggatctgctcttccatggcgtgacgaaggccttgtgcttcggcttgtcggaggccgccgcagtggcgggaggaggcgggtcacggaggtcgatctccgaccactcctcggccgagacctccgcgtcggggcagtcgacgatgacgccgaacgcggcgagccgctgcacgaggggcgccttggacgcgttgtactccgccgcggagacgcacttggcgtagaggagctcctggaggaagaggagcttgtcccggagcacagcgggctgctcggggtgctgcggcggcgcgacgagcgccgcgagcatggttccgcggaaggcggcaacgtcggaggccggagcgatgccctcgcggtggagcgcggcgaggtggaggatgcggtggaaggactcctgctgccacttgagctgctcggcgtggcgccgcgcggcggcctggtcggcggtgagccgccggcccacgcggaaggagggcaggatggacttgcagagcgacgcgatggtgtcctgcaggcccgagtagtatgtcggagtgtacgtgtaccccatcgccgcagagcttactgccgatgctgcttctttggcgatctctggagaagctgagcaggggactaggggagcgtttagaacggtggtttggtggg

SEQ ID NO: 17535 - DNA, 6517 bp, Zea mays
tgattataataaaaaattagtgtgattgacaaatgcagccaccaccatgattttgcacaagtagctatggaaaaaaaatcatactctgaatattaaaagaggggcatggggggaaataccaatatagaagctgccatattgtgctagaaattagaaccacaatatacaccattatgtagaaaacaaaattgacacatgttgtactaagggaagtcccaacaataaatgtcaagaaaggaaccaaactaggatatgatcttacctagcaattaaatctgtagcagctgatggtgaaacaccttctccaatacctacctagcatcatagaacacaacttacaaagaataaatgcaaacaaataaagatggtaaaatattcttgttcaagttaacacacccaaagtacaagtaaacgagatgtgatgactagacactgtgctcaaatgtggatgctccagaatttatatggaattatggatatcagcatgtcataatgcttctgcatggtaatgtgttatttcactatctctttgcagtacttagttctgaaagttccaacatttctggaaattttccttgttaaatactacatccgtcccaactcccaacccaagatcatattttctcaacctacgtgagaaggtcctcttcttaatatacccaggggctgtcaataccccccaccccgttggtcgagttttttacagactacattctatgaatacacaagcacaataagtagagcaaatttcggaccaacaaccctgagcagacttttcgtaagtagtttaccagaatcctcgatagtacaagccctggcataaaacctgctacaacaggaattatagcagtggccaaagaccatgtcacaacaccgacctcaagcactttcctacaatcagaaaaagaaatagataaatagacactatatgtattgtaggagtaaaagtttgagcagaattaatctgtttttagttttaatggtaatataaagtattttcgtcctggaaaggggtaacacaaataaggatatgttcagcttatgaaccataggatagcagttggcaattcctacttcacaagcagatgccatattagatcagtattttcataagcatagacactgtattcgtacatattcaagatgattttgttaccctaaagtcataaacaaaccttccgccaaacaattttgccagccatcctcctggtagttgactcaatgcataaccccaaaagaatgaggactgaactaagccagcagttgatgagttccaaccatattgatgtgacattggaataattgcgacactcaagttaacctgcaaaattagaatattgcaatgaacagttgttcctctcaggaaaggatgatggaccgatcatccataaaagctttcatagaattaaataaatatgtcacatgaagaagagtgcattaaactgtaaatagcaacttcattacttcaaacaatttcatgctcgtaaggaaatgcctaaaagccctgttggtacatagtgaaggttacatgtttgtactagtgatgcaaatgagttccaaaataagccctaaaaaatgtgacagttagatatggcacgtttccttagagcaagcacaaagactattgcatcagtggacttcagctaaagttctctaaaggaaacccagaggaaaaaaacagtgcaatcgttttgccagttgccacccaaattcccactgaatatccggtaaatgtcattgactacctagttttccatgagcaaaactatagcaggtcaacaactcgaattcatagtcattttaattctagcagctcaaaataccgtagagcaaaatcgtaacagtgcaattagccgcctgccagcctgtcatcccgtgccaagtgcccaggacggaaccgtccacgtgatagagacaaacaggatgggtcaccttgtccatgttgcagatgacgaaggcgagggaggtggcgccgatgagcttgtaccgctcggccaacccatcccacggaggccacctctgctccaaagccccggccacgtccccttccaactcctctcccctcgctccatacccttcctcctcaactatccccggtatcgagcgcttctccacggcgctcgcgaaccctcccgcgccctcgccgtcgccgggtgacaccctcacggcccggggccccctgcggcgccggtgcgggaagagcacgcgtggcgggagcatgcggaggaggggacggttgcggccgctgccgagcaggagcaggtggcgctcggcctgcagcaccgaggccgccatgtcgtggagcgaactgcgagcaaggctgcaaggggcgtagacgcgtgatgtttagaattctggagagcagagcggccacgaaaaagtgtgcgcaattgttgggctgtgaactcactctagagatttttacacagctttctatagatttgcgcggccgagaggacagcacgaagccgagagcgtgtggtgtggttaccgtcgccgtgggccacagcgccacggaaccggggcccacgtgtcagctaccgggacctgcttagtgacgtcgcatgaccgctgcctgcctcgtgttgacgcggattgcatagaagataaatttgtctctagcacatcagcaaactgcaaacaatgattttgtatgcatcgatttagtacagcgttcattgtaattttttagttttatgtaacatattgctgacatttttagtttttttatacaaaatttcatgtttacgttattggtgggactatattatcggagtcggcgtctgttcctatggcgttaagtttacacggacgctgtaggcagagccgggccctaggccaatctcaatgtttggactcttatcgaaactcaactagacacctaaatgatttcaatattagtagatatcaagaatgatcaagtaatctccaaccatacaacttcttacgtcataaacaacaaccctgatcccatgtaacaattgaaccctaagtacaataacaacattataccagtaacaaaaatataaacggactgatacatcccaacgcaaaagagttcaacatcattcagttgtagtttgtgttcaagaacgggttcttctcgctgtagaatgggtttgtgaaactgctggtgaggctttcattgactttcttgcctttcaccgcagagtccggctggtggcgagagaaggccctcgggttgaagttgtcatcaaggtcgatgtcctcaaaggtagcccagccctcactgccagtgatgtccctctgcttctccatctcttcgacgtgctgcttgaacccttccttagccgcggtgatcacgccatccccgtgctgatcacaccatgccctgcaaaaaaaaattgacaccatctcagttatgagaaatcatgtgcctaatttggatggtagatggcccagtgatctactttgggaagtaggacttgaggtcagacttgtccaccggaagctttgttgagatggcctccatctgctgattcctacaaagccaagagccatctctgaacgacggtagatggtcgaaagaaaatacgttgtccgagaacagagtggattacaacttacgagaagttcaagttccgatttgtagatgatagctcagcctgaatccttgagagctctttctttgtgttctccaccagaaccttcagtgattccagatgcatattgtaacttcatcactgctactccttaaagcaaacttatacagggtaagaggaatcagcaatacacagacagtaccttgtcacgcagcagctcggaagcagagtcattgtccgtgtccgagtgcagcctcgtcttggccctcttggcatccggtccagaagcagccatggggctcgcctccagctggcactcgctgtaagatgagcgcggaggaacatgctgcggctgctcaccggtggctgccgcctcgccactgttacaggcaccggctttcgtccacttcttgatgccatcgaacccccacgagctcttcttcttacctctcaccgtctctttctcgacgaccccttcctcccccgcaggctccttgttctcggtgccactgccgccgctgtggaacatccctgccagatgcctcctcttccctttctcggccttcccggagggaaccgtttccgacggcgagctctcggtcatgaagactggcgcgttggtggcgttgttatggtccacaggggccagcggcggccttgatgcgctgctgttcacgtcctggtccttcttggatctgctcttccatggcgtgacgaaggccttgtgcttcggcttgtcggaggccgccgcagtggcgggaggaggcgggtcacggaggtcgatctccgaccactcctcggccgagacctccgcgtcggggcagtcgacgatgacgccgaacgcggcgagccgctgcacgaggggcgccttggacgcgttgtactccgccgcggagacgcacttggcgtagaggagctcctggaggaagaggagcttgtcccggagcacagcgggctgctcgaggtgctgcggcggcgcgacgagcgccgcgagcatggttccgcggaaggcggcaacgtcggaggccggagcgatgccctcgcggtggagcgcggcgaggtggaggatgcggtggaaggactcctgctgccacttgagctgctcggcgtggcgccgcgcggcggcctggtcggcggtgagccgccggcccacgcggaaggagggcaggatggacttgcagagcgacgcgatggtgtcctgcaggcccgagtagtatgtcggagtgtacgtgtaccccatcgccgcagagcttactgccgatgctgcttctttggcgatctctggagaagctgagcaggggactaggggagcgtttagaacggtggtttggtgggagagctccgctccctctggactctggttttgtttgccttttgtcccaacggctgcgggggccggaactagccgttgcggggagggttggatctgcaggtgggccccgcttggcagtgaggtcgtaagcacacaccctcatgcctgtccggctggcactggcagcttccccttgcatatgcgacttttggattgacgttcatgtgctgagagggctgaggctcttctcaaatctgaaccctcgccccgcttactccaaccgttgcaggcccttttgacactggaagtccaaatttacaagagcaaactactctagcacgcacgtagcaactccatggaaatccaaaatgaacatatttggcattgcaaaaaaaaaaaaaccaacgggggagaatttaaaagatacaccgctgacagcaatattatcatgaagaaatgataatttgataatgcagtaggatattcagatcatcaatttccaagagcgctgagctatctaaacagaccatcagccgttagattcgttcatagttcagggagtaaccgtggttacatgggcagggcgtctacaagtcgagagagagttcatagatttgggcgcgccaattaatgattagtatgacttgttgtggatagatacagaatacagaatagtaatagaaaacatgttatcaggtgcatatttgcaccaaatccctcaatccagttatgaaaaattaaaaaatttcccagagaagaggcaacacagaaacttatttcgttgtgggttggcacaagttggctacatcaatttaacagcagtatcccggtccaaaaaaaagttaacagaagtaacctactgaaattactctggtagaccatcggcaaattgctctattcatttgacagtcttgttggaccacatgtattccgtttttctttcagaaatcaaactacagacactagataggttaaaacccaaaagcaagcttcaattttacagaataggagctgcaactgtaggtataaacttaaccaacaaaggtacttgcacttggcttttcatttttcttaggtgtcactgctagctcatcatcatcgacccacccaacaatatggcctttaacttagaactcatttgtattggaatcacccatattacctgctgtgtggcttcttattctactgaaatggtttcatcttcactcttcaaccaccggagcagttccatcttctccttgcttgtttgccacgtagtagtgcaagaatccggcgagctcgtcttccacctccctgtccgtcaagaacttggtcagcgcttccctctccacagcccccagtttcccgtctctctttcttctatctcgcatctttctctcttcttctagatagctgtagtagcaataggtctgtaacaatccagcgcacgtggcggaccgcgagttcgccgtgccaggcggagcagacgaagcctaggaccagatcgccccgggtgacctcggagaagatggaagggacagccaggggaaaggaggaccatccgaagaatgctgaaggaaggaacagccgcccggggaaagacgtgtccaatcagtggtggcgtattctggtgtgagtatatgtcatgtgcggtcaggcttgt

SEQ ID NO: 17536 - DNA, 863 bp, Zea mays
agtgtgatgattccgaagacatagcatatgagataagaccatcagatccagtagacctttgtccaagatttaataggctttttttgtcaccgaaccgttgcactataagagattcaaatcctaagcaccaaacaatcccaagaaggccaaatatgtaaaagacagactcccagccaaagttctgaatgatgggaggggcaaacaggagtcctaagacactgccaaagctcaacccaccaaaaacaacagcaactgctcttgatcgttcttgccaaggaatggacctagcaattaaatctgtagcagctgatggtgaaacaccttctccaatacctaccagaatcctcgatagtacaagccctggcataaaacctgctacaacaggaattatagcagtggccaaagaccatgtcacaacaccgacctcaagcactttccttccgccaaacaattttgccagccatcctcctggtagttgactcaatgcataaccccaaaagaatgaggactgaactaagccagcagttgatgagttccaaccatattgatgtgacattggaataattgcgacactcaagttaaccttgtccatgttgcagatgacgaaggcgagggaggtggcgccgatgagcttgtaccgctcggccaacccatcccacggaggccacctctgctccaaagccccggccacgtccccttccaactcctctcccctcgctccatgcccttcctcctcaactatccccggtatcgagcgcttctccacggcgctcgcgaaccctcccgcgccctcgccgtcgccgggtgacaccctcacccccccggccccgctcccgcgccggccggcctcgaggtacccaatg

SEQ ID NO: 17537 - DNA, 1353 bp, Zea mays
cattgggtaccggggcaccaccgtgcactggataattcgctcgctccgctcgatgcccgcttgtttgcggtgaagcctccggcgaacagccgtagcggaaacgccgcccgagatgtctgctccctccgccccaccccgcacggtgatctgtgtgggcgacgtccacggctacatcacgaagctggagagcctctggtccaacctccaggctgcactccccgccgacgccttcgccaccgcgctggtcatcttcctcggcgactacaacgatcgcggcccgcacacccgcagggtcctcgacttcctcctcgcgctcccgacgcgctaccccgcgcagcgccacgtcttcctctgcggcaaccacgacctcgccttcgcggcgttcgtcggggcgctgccgccgccgcccgacggctccccgttctcggccacctgggacgagtacatccacaacgaggagcacgaggggtggttccgcgggccgggattcgagggcatgcacgtgcaggggaggcggtggggcggggtcatcaaggagaggtggaaccccaagaaggggctcccgtacaagggctccatctacgacgcgcagcccaccttcgaatcctatggcgtcgcccatggttcccctgatcttgcaaaggctgtgccagaggagcacaagaggtttctgcatgatttggtttggatacatgaagaggaaaatgtgccaattgatatggatggaggacaaatcatctgcaatctgattgctgtccatgctggcctagagaggactatagatttgaatgagcaacttagagttttaagaactagagacacaagggtgccaaaggttcaaatgcttagtgggaggcaagatgtttgggacacacccaagggtctggccggcaagcagactattattgtaagtggccaccacgggaagctccacatcgacggcctccgatttataatcgacgaaggtggtggttatgaagacaaacctattgctgcaatagtttttccttcaaagacattgatcagaagtaccgaggaagcgggaaccacatcagagaggtgatctagagttctagacatcatcaggagcagtgaacacggaggcacagttttctctctctcttgaagttactgcttgtagtcatgtactcatgtcaaacgacaataggaagttaggaacaacgtccaaaggcaataagttggtgaaccggacctgcgttttctcattttagtcactaatgactatatgtctatatatattgtacctcgatgctgtcaatttagacgagaccgtacatcctcttttttagggcaataaactttactccctgtcctctaaaaaaaaaaaaaaaa

SEQ ID NO: 17538 - DNA, 1448 bp, Zea mays
  misc_feature (28)..(28): n is a, c, g, or t
aggatccactgctgtagtccttataccnccgacgaaccattgctccactacctgcaggttgctagcagcattggaagcgaatcaaacgcgccactgtctggaagagtgcagctggctactgagagcatcccatcctcccatgtgctgctgatcattccatctgctgctccagcacatcagctacccccttcagtagcttcatcagctccaccattgcccatccacgacactaatgcccacactagccggtcaacaaatcttgtaacgccagatttctttgcgcctccaccatcctcttctactccactggctccaccgggcgcatccgtgattcctactgccccgcctcttcaccctacttcggcatctgttcagcgctctcaatatggcgccccactgctccagccttttccaccgcccactccacctccttcccttacccccgcacacagtgagagacctgttgttacaagggatagagtcaaggatgctctacagagacttgttcagagcgacgagttcatcgatttggtgtatcgggaattgcagaaatcacttgtgtaggctgcttattaatccttctggagtttctggctcgtgacaagtaccctgttattttttttctttgacctttttcatgcttcccttcctgtaatcctgtatagtttcgtgttcatgtattgatgtatagtactataggaatggctggttagcatacttatgtaactcaaaagcccaagtaaaaagagttttgttcaagaatgttgaaaaaaaaaaaaaaaaaaaaaaaaataaaaagagcccacatcgagaggaaaatgtgccaattgatatggatggaggacaaatcatctgcaatctgattgctgtccatgctggcctagagaggaccatagatttgaatgagcaacttagagttttaagaactagagacacaagggtgccaaaggttcaaatgcttagtgggaggcaagatgtttgggacacacccaagggtctggccggcaagcagactattattgtaagtggccaccacgggaagctccacatcgacggcctccgatttataatcgacgaaggtggtggttatgaagacaaacctattgctgcaatagtttttccttcaaagacattgatcagaagtaccgaggaagcgggaaccacatcagagaggtgatctagagttctagacatcatcgcagtgaacacggaggcacagttttttctctctcttgaagttactgcttgtagtcatgtactcatgtactcatgtcaaacgacaataggaacaacgtccaaaggcaataagttggtgaaccggacctgcgttttctcattttagtcactaatgactatatgtctatatatattgtaccttgatgctgtcaatttagacgagactgtacatcctcttttttagggcaataaactttactccctctgtcctc

SEQ ID NO: 17539 - DNA, 3217 bp, Zea mays
ccgactatcaaaagtacctgtcgttccacaacgtgcagccaggagatgttcctgtagttctttcatgagctgtccatgctcccattcgaactgcaagacaagtcaattaaagatttgaagaacgttctcgattatggaagtgagatttcatatgatatgatgtcaaatgggtttgttgaagcattccttgaattcttgagaaacgatactggcagctacagtgtgcaagatcaggaagctggatttcggttttttcttgcttttatttccaatagcagggctaaagttcaatctctgcacgaagaatcatttcacctgatcacatccttccttgactccgagttgaaagtcgaagctttgctgacgctgcttgagttgattaagcactcgagttgtccgaaatctcatgtgatggcctctgttgttactcctccactgttcaaaatactggcatctgaagataccgaaggcctcgaattgtctctgaagatcatctgcgagctttcatccgacgccgatataagatcttcgttagtttcaatgggaataatctcgaagcttgttcccattttaaccgaagggaacttcgtcgagcgctgtttggagatcctgcggaacttaagcgacatggaagaagcggtagcgcggatcacaaggaccgaccggtgccttgcttcggtagcagaatatctggacacaggaagccccacggagcgacagcacgcggtggttatacttttagcggtatgttcgtgcagcgccgaggactgtctgcttgtaatgaaggaaggcgtgatccccgccctagtggacctgtcggtgaacggaaccgaagaagcgaagggctgttcgacgaagctgcttcatcttctccgggacatgaggcgaagcgaccagttcaccaactcgtgctcacaagaagtggctgccacaggcatggtagtagaggatgctcccaagaactcggttcacaagcagcctgcgtcgaagtcgtccaggtttttccagaggaaactgaacatcttctcgaagcctcggtcgctcacgctgttctgaaacccggtttgtgtttgtcggagctggtagtccttttttagtggaaagggaaagcggagtagtccttgactccttccttgtacatgcatgctgcaaaactaaccaccttctgtgtagatggtagcgcttgtgtttgccccggtgagatgcttgatgagatgatagtttttcatcctcatgtgtttcagtagagcttgttagttgctacagaactgtcctgtgtgcccaaaaaaaaaagaaagaaagaaaaaagtcagtagatggcatctcttttctcttttggcggaaagcctgccgttttgtatcccgctgttcctggctaagattacctttgaagcctgaatagaagcttgttttgccaaggtcatgttcacatttccccatcacttgacactagctggcatagaagaatactgcccactgtctgcaacctaattcgatgctgttatgtacagattacagactgggggggttgtgggcgttcggaaagctcacttacatacagtcaggtccctttccagacgagggggacagaagaaacctcccatgatcccatccgattggccgccgcccgttccaattatgcccacatgggggctccatctccgtctccatccgagtgggctgcctcgagtcaggtcattagtcatcactcatcaccccttccccggctgatgatgagtgatgagcgatccatcactcactgcacccgtccgtcggtcttcgtccaggtgcagcgcacgggaggccggccgcccgtttcttcagtgccaaggcactatcatgcatgaagctcacgatcatctggcgacctagctccagaatctgccgcaggagaaggtgttcgaagcagtacatctccatgcccatgctccatacacacatgttcccgaaaaaccgccgtctcgtctcccgccctgtgccgatctgcgtccctccctcggctcgcctatccccatggactgcctgcccgtctgtcgaactggtctcgtcgatctcatctcagctggcgagcttccttcatcgaatcatcatcgtgaatcgtttgaccaaagccagatgtgtgcagaggactagcggcggccggcggtatcggtttcatcagtgcaagcgttgttcgccgaaagcgaagcccacaagggcagcacacgcttcccaccggcgctgttcaccgttggattgaagctttcctttcaggctggatgacagtcacggcacagggctttactgaccgatctgcctctgcctttcctggatgacatgcctgcctgcctacctaccggcctgctacgcgcgtcgagtcgagatcctgcactacactattatatgattcttcctgctctccagcctccagcctccagtcagcacatcaggccgtgttgaggatgcgtcgcgcgcccatatggcagcgggagcgcacgcaggacgccgccggtctctctcattcagcaatcgacgccccccaacccccctaggctgctcctcctttgatcctttcctttccctagcccccactagctagtggcctagcctctcctccgcgcccaggttcggtgcatcgtcgaccaaggggcaagagctgggtccctttcccctgccgagtgcgcggcgaccacgcctgcctgcctgcccgcccgcccgcactgccgcccctctccgaggcagtggcatgcatggcattggcaaggacgctgcacgggcacggcggcggcagcagctgccactggacacgacgcgacggctcctgccggtcaggagatgctttgcttctgatggagcgcgaggtccccgggtgtgcgctagcgctagccagccagccgcgtggcgtgggcgggccgtgaccgggagtggcggcgatacgtactgtcctggcgacggcgacggcgaccgcggctaagcagattcattcaggtatcgcgagggggatgcacggcggggcaggatgagggtggcatacttggtgtggtggtggccagtggccaccatgttaggatttatgggcttggcccaattaagaatttctaataaatcccaggaaaatctcaaaagcccatataagtggatgacaaagggataggtggaaccaatagcaccatattgctagctcttgtggagtagagctaacttaaatatggaagccacactcactcaccaagtcatg

SEQ ID NO: 17540 - DNA, 2465 bp, Zea mays
aattcggcacgaggagaaactcgatgttggatttaccgagactactgaacagttcgagagtacctttggtgtaagatactggaaggctggatgtatgtaccgtggcaacgtgccatctcctgtgacatccactcctcagacattcagtgctgaggttggtactgggtctgacatctgcaaagctcagaaagatcttaatgcccttgatataacagttgtagagttatatttacaaattgtagacatcaagaatttaccatctgctgttcaaaaagaaaatgtgtatgtacggttcaccaagaatcaatcagatatgttcatcagtgacggcggcaggttggatatctcaacagttacagggaagaacaccggagtttgtttacagtgtgaacctaccagagaactcattcttgcagtaatggttgatcaattatcaaagaaaccagaaccgatagggaaggtttctttcccactgcacgatttgacagggcctgattctaagctctccttcgagaagtggtttgaactgaaagctcatggtgggcatgccgcttcacctcctgttagtcttcgtgttgcagcttctgctactgtcccaagcagcgctcagaaggtgttcaccatggtcaggatggagccattctctctcaagtcatgtcttttgccacattccatcaaggatcagaacacgggcagctggactcgtttcgtaaatgattgtggtaccgagcttatccgtctccagataagagagcacaaggcgaagaatagcatggcggtcgttcgagaattggttggagtattgaagtcaacaaaaaagcaaattcagcttgcagaattcaaggaaaacaagtggaccctaaaagactccaacttgccaataagtcatggcactgatggcagtctactcgatctcaaaggtgacaaccatctgatcaagctttatcggggaaggaaactggaatacgagcgcaaatgttgcagcgctcactctgaggacgtatcagctgttactgctgtaaagttctgtgctgaacatccatatggcaaagccgttgccttgctagacactgaagctcagcttatcatggtgaacgaggattggctcctacttccatggatctccatatcagtcctgtttatggacggcgatggcagtatgaaacttggcggcggtgccatggttcagaaaggtacagtgtttggatccgacactagcatggtgctagacacacagaccgtcggagcagggagcgtggcaaccaatctagcacaatgtggcacttgcagcgccgtgttcggtggtgatgataaagaaatggcaaactgcaaggttgagcatgtgagctctggcgcttctcgcacagtcgttgcaagtggtgagaatgggcacactgagactgctggctgtggaggcggctgtggtagcaattgtggacccatgatggctgaagaccccaaggccggcaatgccaagtctggaggctgtggtggtggtggctgcggtggcgcgggaggttgtcggaccatggccaacgaaggccaatccaggtccggaggcgttggcaccttgttgagctccaacgccatgggtggtgagggccagcaggcccattcagctggctgtggctccggctgtggtggtggctgcggcagcggcatgctcatcgaaggctccaaggccaacaacgccatgtccggtggctgtggctctggttgcggtggtggatgcggcagcggcatgctcatcgaagtctccaaggccaacaacgccatgtccggcggctgtggctctggttgcggtggtggttgcggcagcggcatggttaacgaaggctccaaggccaacaacgccatgtccggcggctgtggctccggttgcggcggtggttgcggcgccctgttcaacgctagcactgctgccggagagggcctgcacaataagtcggctggctgcggcggcggcgggtgcggctccgggtgtggcggcggcggcggctgtggtagcggcatggctatcgaaggcttcaaggccaaccacgccaagtctggtggctgcggctctggctgcggtggtggctgcggcaccctgttcagctccagcgctgcggccggccaaggccagtccagatccggcggctgcggctctggctgcggtggaggctgtggcagtggcagcatggtcgctgaaggctccaacggcgggcacgccaagtccggcggctgtggcggcggttgcggtggcggaggtggctgcggcggcggaggctgtggcgggggttgcagcaccgtgttcaacgcatgatctcggtggagtggaggcatttgtgcagacatgcagtcgtcgtcgtctattgctagataccacatgctacagcatactgtgtattgctgtgcataatctactaaataaaatgaatgaataaacaatggatggatcggctgcctccgtggcgtttctgcgg

SEQ ID NO: 17541 - DNA, 1942 bp, Zea mays
agaaacatcagaaaccggtatagattaaagccaagcaaacagacttagagattcatacaataattaatgtatttattttacatatatctagatttattctcattcatttaaatatagatataaaaatcaagagctaaacgactaatattttgaaacggagagagtattatttattattagagcctagatagccgattgtctaacaaatcgaaccatgaattaaaatcttaagtattttgtcatctaatttaatcaaaacaaatattaagttcaatgcagacactagtacaaccgttgacgaaggttgccatgaaaatcaaaatatatccaactgcggctaactcctcgccgtttaatcagatgttagaatcatacctccctctcttcgtcctaaaataaagtttattttaactctttagttaattcatatacaatacttggtatatgtgttctatatatgtgtttatatttatcatcatctagttaaatataaacataaaaattaagagctaaaatgaatactattttgggataaagagagtatgcttttatgggtactctctatattttttaattgatataaataatgtttttattaaaaaataccttcaaaaagcttatttaaatagttattaaaatatagttatcttctatttcgatattctcgctagtcaaatatagaaaaataaatggctctatagagtacaactaagatatagaaaaactattggagattggaaagatatataaagtagtttttatgtaaattgaaagactcttggagatgctctctattgtatctaactctatctacaaataaatagtatgaaaatcaaggctataatatatataagtaaatattaatgaatttaacaacaaaaggtttcaaaattatattttaatttagtttacactcaacaggacactggaatttttctttctaccagccataataactgcacagaccccacaggccagtgggtcactaaccgttcgaaaaacatggcgcgcgcgcaatggccgggcagccatcggtttcgtctccacctcatgtttccacgagagttcctcccatcctctcaagtttaccagcacgccccccatagggcccctggcctcgccccgcccggccgggaccccacaaagcaagaaacaatccttgcacccctcccctgcgtcaccccaccatatccggccagcccaacgaaaatgtcgcgcgccacagctgcggtcctcttctacatcctcgccgtcgctgccctcagcgcggccgaggcaccggcagagtcaccgaaggcaggcagtcctgccaaggcaccggccgagtcaccgaaggcaggcagtcctgcagctcctgccaaggcacccgagtctgctgccacgagaactgcccccgctaaggcacctcaagccgcctccacccccgccgctgccgctgccccatcgtcgtcgtcgtctaggaagtctggtccagctgccgcgccgaccaccgccgcctctacaccgtcttcttccacggacgaggagttgagcccttcgccgtcggcatccaccgccgaggtggcgtcccctgccgctgatgggcctgctgagggaccggcggctgctgatgcctccggtgctgctacccttggaagcggagctgccatcgctggtgtcgccgctgctgtcgctaccatgatcttctactgagttcaccagggaccgtgtcgtcgagggtgggcacgtagttggctgtgcggtaattgctcgtctggtcgggagggaccaataacgcaagtgttgctttgctttgctcacttcgtttgctcttgtaactttatggggtcaaccgttatataactgaaacgatttgattaattgatactaatgctctctaaaaatcatgcaaaaaaaaaaaaaaaaaattggcggccctcgtgcttttttttttttgtaaaaa

SEQ ID NO: 17542 - DNA, 1158 bp, Zea mays
  misc_feature (900)..(900): n is a, c, g, or t
  misc_feature (914)..(914): n is a, c, g, or t
gccggccgggtcgggaaaaaaaatgcattcccattcctttatttatctggacgtgcgtcgtcagcaagatggcaactactccggcgcagtcacgcgaccctgcttcccgtcccgagctcgacgctggcctgttgggtagcattggagtttgttcggcccggggtggctagtcccgtccaaaagaatcgcaactcgcaaggcagcagagagcgaaggaggccaaggccatcgctctcctagcctcggagacttgcctttgcatacacatccccccggagggcggtgtgagggcatggctgcaaccgtgaggagggctgcttcctccgtcctctctcgcttcctcctcacaaagccttcgccttcgcctgcttctgccgccggcaataagtccgctctcctcggagcaggggctgctgctcttcacaggttcagcaccgcaccggcatccgcggccgcggccgcagaggagccgatccagcccgcggtggaggtgaagcacacccagctcctcatcaatggcaacttcgtcgacgctgcttctgggaagacgttcccgacgctggacccgcgcaccggcgaggtcatcgcgcgcgtcgccgagggcgacagcgaggacatcgaccgcgccgtggccgccgcccgcagggccttcgacgagggcccgtggccgaggatgaccgcctacgagcgctgccgcgtgctgctgcgcttcgcggacctgatcgagcgtcacgcgtaggaggtcgcggcgctgcagacgtggcacaacggtaagatgctggagcaggcgtcgatgccccgaggtgtccaggggtcggtgcgtttcctcccgtcactattgccggcctgcacgaagaacactccaggctctggtcgagttctaacagggggccgggtgcnaggatacggggggntggcgggatgaattatcgggttggtcaaaatgcattggtaaccctggggatttggcgaatgttaaaggtaatcccggggaagggcttggtccttgcgtaatggcacgaaggaggcgcgcaatccagggcggacaagactggtggcgcggcggcgccggcgtcgtggcgaaaagatgggaccgcgccttccccgctgctttttccgtacttcgctcggcgccgttcaccccggctatgcgcgcgg

SEQ ID NO: 17543 - DNA, 5057 bp, Zea mays
ggggtggtggttctttcgagcgagcgagcggcggcgacggtttcctcgggcgtgcaagtgacggtgatcccgggggccagcggcggtggcgcaccctaggcccggtggtgatggcgattacgcgaggcgccataggcttcagcaccatcggtggtggctctgagggagcgtggcggcggcggatcttggaggagcgcacacggcggtggatcccataggctcgtgcgatgtcggctcctcagaggcgcgcaccccggagtggcgcacgctggtatcccacctcccgtgacgacgtcggccttccttaggtgtgagtgacgacgacggacttccctaggcggcgagcggtggtggatcaacaaccctatttttttgctattttatatacatatttatgtcaacgtcaatattttttatgatacattgtcagttcatggctctccttccatcttttgtatgtttatgatatttatattcacattttatataaacgtttgttgatttttatgtagtgtacaatacataaatacattcgacatgtagtataattagtattagtatatatcataaactggttctaatgagtctaactgcatggatgttgaagagattatatatttatggacgaaataaagcattgaaaatcatatttttgttttcatgcatgttaatccatttactttcaactcacattattgccatactaaatttgtgcgcatataataggaaacagattttgtacacagtgtaccgcagtgcataaatatcttcgacgtatagcataattagtctcagggtatatcataaaatggttctaacgagcctaaatgcatggatattggagatatcctatatttatggaggaaattaagcatttaactcagatttgtttgttttcatgcatgtcaatctattttctttcaatgtacattcttgtcatcctaaatttatacgcatgcagcaggaaaatgattttttctaaattataaagtatctattatattagaaaaggaaaatatacaatttgatataagtagttgtttattaatgagatgcactcttttctaaattataagatgttttgagttttctaaatatatatatttttttatacagacttagatattttgttaggtacgtaataaaaataatatattaaaaaaccattttgcaattgtttcactgttccctcagttatgtaaaaaataagataaatttgttcgtaaatacgagtttaaatcttagttattagctctacattcacacttagccacaaaacacatatatttttgtattttgtattctatactcaaatataatgtatatattttataaaaaaaagaaaaactcaatagaacttgtccgtcatgtcatacctatgtaatatatgaacgggtggtcaaactagttgcactaatttcattgcgacattgcactcaccgtccacttccacttccgacgatagtaaaaaaatagtcgggcaattggcacgaggccacattatagaaataaaatgctaaacgatctatataaataggtcatccagctagcacggtcaggtgtgcaacggcaacagggggcaattggtccgttggtaaggtgtcgtgatctcccgtccactgccgccggcgtgcctcggagactcaacacgtcgccagactagacgcgccatggccaagaacagctatgtggtttatgtcctagtgctgctcgtcgcgggctacacggcggcgctagcctcggccacgacgacgacgttcatcgtcggtgacgaccagggctggatgaccggcgtggactacgtcgcttgggtgaaaggaaagacattcgcgatcggagacaagctaggtgagtggtctgctctgctctgctctcttaatgcagggttcatcgcatcgccctgcgctgcagctgcacacggactggcacgtcgtggcaaataatcgcagtgtttaactacccgagcgaggagcacacggtgacggaggtgagcaggaccgactacttcgcctgcgccggaggcaacgcgctgagcaacgaccgcagcggatcgaccaacatcacgctcacggggcccggcacgcgctacttcctctgcaacatcccaggccactgcaccatcggcatgaggctcgccgtcacggtcgccgggggcggatcgcctccgggcgccacgccggccggtggcgcggcgggcgccacggctcggccggcgatgggatccttcatcgtcaagacgaccgcgtggctggctgtgatcaagctcacgctgtcctgatgaggtgatgacgccgtgactgattcacacccgtctctcacggttcatggttattgtactccgcaaaattggccagattttgatacgtttaccggagattgtttgtccttgcagaggatccctttactcgtcactgctctttacatctctttggttcgtctgtgatttgcgaatatatttcacggtactttgttgacgctaaatccgtcaaacctaaccctccaacgactaatactctgacatgatacggtagtaatggtttctaaactttacaaaataaaatttgaggatcggatcggcttacgatcgagatctatttatattcaattttgaactaaaattaattaagagtataaataaattatgaagaaaatatttagaccgtgattcattaccaccgttaaacacagccgagcgcgctccactgcgtcatcaatagaaaacccgtgagtagtaaacagggtcgatcaatatggagaagaagaacaatagtatgactattgtaggattattatagggtgaatagtaattttataaatttaagttaacgagctagcaaatttaaatacgaaactaattaagtgttaaaccttgactacaccactctatctaaaatttactagcgcccttgaaaggattaagctagagagcaacaagaggcaaaagctagcgggacctcacctaaacagttgtagtttacaagattaattaatcaaaacaactagagcacaacaagtgcaccagacctcttagagcatctccaacaatgcctcaaactagtgcctcaaattgaaatatagggctctacacaggaaaaaccactccaacagtgcctcaattcaacaaattttgtcaaaaaactatagggcaccctctcaagtgcctcaaatatactacaccgtagtgggctgccctataatctagatttggggctttactgttggagcggggtgttttgttggtgccctaaattctataaaatttacttatttttaaattataaggcatttttataggtcacgttgttggagatgctctaactgcaacaataattttaggtgcaatagaattgataatgtgcaatgcaactcagttgtgccattggtgatgataatctttcttgtgaggtggcttgttgctgtaaactagggatggttgcagtcgccccaggcgatggaggcagcggtactggagttggaccagtggcgacgtgcccatggccataatatatatgctgcaaatagaatgtcatagatgtttgccttggtttggcaaaatttaaattactgaggttgcaatatattgctgctgaaggaaggggccaactcatatttgcagttgttcttttatccaattctttttaaggtatctttttattttatccatattggtatgatgttacatttgtcagcatattcatggctctattgatatactgttgtaagctatcgtaatcccaggatagaactactattaaaggcctcctttttccacttgtgattatgagtcttcttctaccatgaataaattgtgttgtgagctgtgacactaactagccccttccttgaatccctgcaacatgttcttgatcaggacatatatgacagatcgtcgcaaacctcttcttgttcggtattgtcttgctctagccaagaagtccttcagagggcaacatttcctattaaaatttagcagagttcatcttgacctgcatcatgtaacaaaccaagacttagatggactctggagctccatgagttttttgtaaacgttgtcaacaaatgcagacatagcagtgattcttggttagctttctcccataggcctatacctaaaacacaaatcatgatgttaatgaatctaaagaaaaaaatacaattgaattaaaaaaatgaatggaaaaagtgatctgcctaacaagatttatcaacaacatattttaaataacatgaaatatgaaattctaggaataccatttaactttctaaattttgagatcaagaaaaagctagaaaattaatgcaaatgataaactactgatgaaagattcaaataaagctagatagtagaaaatattttgatgtgctgataagttctcctcgacgcgcttgaccccaggtatgttcggtattggccatcctttctctccatagtgcatctcggcaaaaaacaaacgacaactctgtatcatgaccactaaagttgttgcctttcgctcatctatctattgtccttgattgcagtccttcctcccccaagtccatagaggtatggagggttcgactcattattccttcttcaattcactcatgcatgaggtttttctctcaattttgtgttctaatcatgtagcgaaagcctatgcacatcttttttatttccgccgaacactaggtggttgaccatgttagatgctgctgcaaatcttgaatgttgcgtgttgcccactataatcaataaaaggtatcgccatactagatgaccggtcagttttgtacagtctacgcgtatatccagcgttccccagatataggaagtatcttgaattcaatgggcacccgttcagttcagttgtatttcaatagaaaaatagctttcagttgtgttggccttctgataagcgccacttcacttcgaaactgactacttattacgatgagtgctcaagtatgacaatctcgacttccctgtgttgtagtgctgcagacgtttagtattctaagtatcttagtttatttaacctttgcagcaaaaggtagcagtatgtgtaacacccgga

SEQ ID NO: 17544 - DNA, 3701 bp, Zea mays
cgcgaccctgcttcccgtcccgagctcgacgctggcctgagcacgagaccttgacctagaacgtcctaaggtggctagtcccgtactcccgtccaaggcagcagagaccagagagcgaaggaggccaaggccatcgctctcctagcctcggagacttgcctttgcatacacatccccccggagggcggtggccggagctgacccctgatcggacgcgcttagcgcctgagggcatggctgcaaccgtgaggagggctgcttcctccgtcctctctcgcttcctcctcacaaagccttcgccttcgcctgcttctgccgccggcaataattccgctctcctcggatcaggggctgctgctcttcacaggttcagcaccgcaccggcatccgcggccgcggccgcagaggagccgatccagcccgcggtggaggtgaagcacacccagctcctcatcaatggcaacttcgtcgacgctgcttctgggaagacgttcccgacgctggacccgcgcaccggcgaggtcatcgcgcgcgtcgccgagggcgacagcgaggacatcgaccgcgccgtggccgccgcccgcagggccttcgacgagggcccgtggccgaggatgaccgcctacgagcggtgccgcgtgctgctgcgcttcgcggacctgatcgagcggcacgcggaggaggtcgcggcgctggagacgtgggacaacggcaagacgctggcgcaggcggcgggggccgaggtgcccatggtggcgcggtgcgtccggtactacgccggctgggcggacaagatccacggcctggtggcgccggccgacggcgcgcaccacgtgcaggtgctgcacgagccggtcggcgtggccggccagatcatcccctggaacttcccgctgctcatgttcgcctggaaggtcggcccggcgctcgcctgcggcaacaccgtcgtcctcaagaccgccgagcagacgccgctctccgcgctctacgtggccaacctcctccacgaggctgggctccccgagggtgttctgaacgtggtgtccggcttcggcccgacggccggcgcagcgctctgcagccacatgggtgtcgacaagcttgcgttcacgggatcgacgggcacggggcagatcgtgctcgagctggcggcgaggagcaaccttaagccggtgacgctggagctcggtggcaagtcccctttcatcgtcatggacgacgccgacgtcgaccaggccgtcgagctcgcgcaccaggcggtcttcttcaaccagggccaatgctgctgcgccgggtcgcggacgttcgtgcacgagcgcgtgtacgacgagttcgtggagaagtccaaggcccgcgccctgaagcgcgtcgtcggcgaccccttcagggacggggtcgaacaggggcctcagatcgacggcgagcaattcaacaagatcttgcggtacgtccagtccggcgtcgacagcggtgccaccctcgtcgccggcggcgacagggtaggcgacaggggcttctacatacagccgacggtgtttgccgacgccaaggacgaaatgaagatcgctcgggaggagatattcgggccggtgcaaaccattctcaagttcagcggcgtggaggaggtgatccggcgcgcgaacgcgacgccctacgggctggcggcgggggtgttcacgcggagcctggacgcggccaacaccctgtcgcgggcgctgcgggcgggcaccgtgtgggtgaactgctacgacgtgttcgacgccaccatcccgttcggcggctacaagatgagcggcgtcgggcgggagaagggcatctacgccctccgcaactacctccagacaaaggccgtcgtcacacccatcaagaaccccgcatggctgtaaatcacatcctccgtccttgcccgcacggcgctgcgccggttctcggagaacgtgacgaataaaacaaacggtttggttaaaaagacaaggacgacggaaaatgggtcatttttatctcccccaaaaaaaaaaaaaaaatgcctcaaactaatgcctcaaatcgaaatatagggctctacacaggaaaaaccactccaacagtgcctcaattcaacaaattttgtcaaaaaactatagggcaccctctcaagtgcctcaaatatactacaccgtagtgggctgccctataatctagatttagggctttactgttggagcggtgtattttgttggtgccctaaattctataaaatttacttatttttaaattataaggcatttttataggtcacgttgttggagatgctcttaacgcgtcaccgagtttcttttttttctcccacaaacgtccgaactgatcctccgaaaatccgatcctcccctccctggagtttatctaccctactgcccgtttagagaacccaagagccagattaaaatgacagattatcgaaaagtaggcacgcatgcatcatttgtgtgtgtatatacaatgagcaaagctgctttcacgggccgccagtgctatcagaactagattagcttcatgacacctttcttctgttcgcacccttcttccttttttctctctcccaccttttacagtgcaaatcagatcaaggagctttttttccccctttttactacggttgcatgcagcatgcgtgcagggcagttcagcagctgccggttcttcggtgttcacataatggccatctcatgcctgaaccggagaagaaaggaaatgtccttctgatgctagtataccgctacctgtgctgccgatgaatgccgtcgggcctcatgcatgccactgccagcatgatggtcaaagacaaaagaaacccaaattccaaacgtaaaatgaagaagcgtatatacaccacgacgtcaatccatatctcgagactgtgcgatgatcggaacgagcaaagcagtcgcagattagcgcatgccataactgctgtgacagtaatagtctcgtgacacgtaactagctagtactattaccagtaaacatccgtagtttgtcaactactgaaaacgagatccaaactcgctctcgaattgggtcagacactacctcgtcttcggttcatttgggtgcgccggtcatcatgccgtcgttccgatgcggtggcagagccgcggtcgtgcacgaggaggaggaggagccctggcgatcgggtgccacgtcgctgtcggagtgctcggtgcactcgaccttggtcgccaccacccggttgctgcccctcctcatcacgcgctggccccacgccgcgacgcgctcgcacacccgccccaccacgccgcccgccgcggtgcccgtgcccccacccggcgcactcgcgcagctcggccaccacctcgtccatggccggccgccgctccacgctttccgacacgcaccgcgcagccacggcgaggacgcgggccagcgcgcggtccgtgggcggcagtggcgcggcggccacccgggcgtcgagcacctcccgcgcgcgcccggcgccgatcaacggcgcggcccacgacacgatggacgacgggcacgagtccacgtccatcaccttgcgcccgctcaccagctccaggagcaccacgccgaagctgaacacgtcgctcgcggggcccagcttcccgggctccgtggaccaggggtaaaaagaaaaaattgttgccgccatgtctggaggcggtcccggcttcccccatcct

SEQ ID NO: 17545 - DNA, 2381 bp, Zea mays
ctgcagttctctcctcgtgaaccggtggcgtggggctacccgctctgacaccgccagtccctcttccctcatctccctctccccaaagcaaagggcaaagcaaaagcccccgacccccgtctggcgccgggagtcccggaccaaaacccacgccacgccacgccacgccacagccccgccctcgccgccgtttcccgaatcccccaagggcaagcggagccatccaggatggcccattcgccggcgcccagcggcggcggcggcggggggccgctgccgctactggtgtcgctcaactgcctcgacgacctctcgctggagcaggaggggctggcgggcgtggccgcggtggagcacgtgccgctctccgccgtcgcctgcggccgcatcgaggccgcctccgcggtgctgctcccctccctcgccttcctcccgcgcgccgcgcagcgccggctgcggccctggcagctgctgctctgtctcggctccgcggaccgcgcggccgacgcggcggcggccgccgacctgggcctccgcctcgtccacgtcgacgccaaccgcgccgaggaggtcgccgacaccgtcatggcgctcatcctcggcctgctccgccggacccacctcctctcgtgccacgcctcgtcggtcccggccgccggctggctcggctccgtccagcccatgtgccgcggcatgcggcgctgccgcggtctcgtgctcggtatcattggccggtccgcggccgcccgctgcctcgccactcgtagtctcgcgtttcggatgagcgtgctctacttcgatccgcgctacgtggcaagtgggaaaacaaagcggccttctattgttttcccttctgcagcaaggagaatggacactctcaatgatttattagcagcgagtgaccttatttcgctgcattgcggattaacaaatgaaaccatgcatatacttaatgctgactgcctgcagcacataaaacctggagctttcatagtcaatactggtagttgccagcttatagatgactgtgctctcaaacagctcttgattgatggtaccatagctggttgcgcattggatggtgctgaaggtccacagtggatggaagcatgggtgcgggagatgccaaatgttttaattcttccgcggagtgcagactacagcgaagaagtgtggatggaaataagagagaaagcaataactatgttacagtcctttttcttcgatggtgttcttccaagtagtgcaatttctgatgaagatgaggaaataagtgaagctaaaaatgaagatgactatctaggcccacaggcaaaggatagccagtcacagatttttgatactgaaatagatgaaagccacataacgctggagtctgaaaagaaaagagccatatcccaccataaagagcctcaggcgtctggaaagtctgtaaacattggctcccgatctgaagggaggcgtagtcgttctggaaagaaagggaaaaagaggcctgcccatcgcagacctcaacagaaaccagatgacttatctgctgttgagagtgacagtaactattcctcccggagagatgatgacactgcaatgagtagcagggaccaggttgtaagttccagttcacgatttgcctctcctgaggacccaaaatacaagcataaatctctttctgaatccccgatggaaataacatccgagaagaaggtgcctgtactactcagtagaaagtaccctgataaactaaaagatggatttattgtagctttgagagcaagagataattcagggtaccatgttgcaagacagagagtagttggtggtggtggctggattcttgatgttgtctcaaatgctacaaacagggaccccgctgctcagttccttgttactttcaaaaacaaggatactatggggctccgatcctttgttgctggcggtaagctactacagattaataggaagatggagtttgtgtttgcaagccattcttttgatgtttgggagagctggatgctggacggttccttgctggagggtagcaagcttatcaattgcagaaatccttcggctgtattggacatctgcattgagatcctcgcagcaccaagtgaagaagacggagtcactaggtggctagattccccacgctggggactgtaaaaatgatctgagccatcattgttgttcggttcggtttgcttccttcttttttgaaaaaaaaaatagcttccagtttttctattcctctgcttaagttcccaattttgtcctttctgatgtagggaccatgtagagttgtagacatttatatcaatacatcatgtgtaacgtgttttttgcaaaaaaaaaaaaaaaattgcccgagggggggccgggtaccc

SEQ ID NO: 17546 - DNA, 8489 bp, Zea mays
  misc_feature (2017)..(2017): n is a, c, g, or t
ccctggctcatgacgcgctggaacgcgtccctggcctcgttcgccatgagagcgtcccgcctcgcctgcagcagctcgcggttctgctcggccagcctgtcacgcatcgcctgcgactcctccagcagcgaggcgtgcgagagcgccacggccacctggtcggcgaccacctccacgatctccagctcgtgcggcgcccacttcctgccgctgggcggcaccagaaccagcacggcgtagctggccttgatcacctggggcgtcccacccttgaagtcggcgaccctgagcatcggcattcggatcgccgccaccgtgccggtcccctccttgccgccgccgctggcggagccaagtaccgagcccggcggcagcagcttgaccccgtcggcgcccttgacctcgaggacgtccgcgtcgtcagcgcccactacggcctcgccgtcgtcgctgccccgccggagctcgtgtgtgaggcacattccggacttgtcctcggatggcatccagacggcgcagttgtcgagcgcgagcaccctggagagctcgatgagcgtggtgtagagcacggtgtggcggtccagcgagcggcggatctcctgggtgagcatgcggacgtgccagctcgcctcctcctgccgcttcatgagcaccacctcgcggtccagctcgcgggccttgatccacagcaggctctcgcggaccttgacgcgcagcagttgcgggatgagcgtgagcagcgtgatggcggtgaggaaggagacgagcgccgtgaggaacttggcggcagtgaggagcagcacgaccatgaacgggtggggctcgtaggtgaaggccgccagcaggtgggtgaggccgcacagcacgatgaaggcgccgaactggaccagcacccaccggaacgggagcaggtggcggagccccgcgacgaagtagaggatctcaagcgggatggagaagtaggccgccgcgatgagcaggtcgctcaccttctgccacttgaagatgttgtccaggctccagaacccgcttccaccgccagcgccgccgctgccgtcgcagccgcaatgcgcgtaccccatctcgccggcggcgggggcggcggcgaacgccaagaggaggagccaccgcatccgcacggcgggggggggggggggggggggagatgaatggcgtctcgatctggatgagcatccggatctcgggcaaagcatcgtcagttcagctgcgccgctgatggtggtggtgatgacgatgctgaccaaattggcaagttgccgaggagatgcgagaaaaagatcgcaactttcgcagtctagcgttaccatgtggctagcactgacggtttacaatgacgttgacggcattgcagtagtgtccaggtagaaggaaagcaagcagaagcatactagcgccgccttggttggtccgaaatggcggcgacggctcgcggacctctccctcactagcaccatctgtatgtacctgaagcagaggaaagcagagcaggaacaaggatcagatgccatttggacgagagactttcccaagcgggattccactccctacgaaagaaggatggatgaaaaccatttgaatcctctctggttgaacgaaacgaacttgcctggagaagttgccatagtagtttcctaccgaaaactgttgctgggtaccagtaccagcagcactggatgaatcaatcaaatggggggaaaagatcaagggcacttgttcttgcgtccgtggagcggcgatcctcgccgcgctcggggagcaggggagggcagcgttcagatctgcaggcggcggactggcccgcccgattagcaaggataggcaggccaaggaaccccggcaagaggaatcaagtagagacagacgggcggaatggtggatggattggggatggatggagcagaacgaagagtgaaggaggcggcctaggcgacgaggaagaggcacgaagcaagcaaagcaagccgccttgtctgcgactgcgagtggggaacagganggatccgtcgggggtccgccactgaaccaatctggcggtggcggcgggcggccatccctcgcgctcgcgctgcttgcttggagtttgtctactcgtcaggtcagcggactcagctagacaggatgcagctgcactagagaggtgggggatattttttcccccatttttatactgtattagctaagggctcagatgaaaacttcgtgaaattagacattttgcacgtgtggctgatcaagtcacttgttcaacgtgtggcttatctttagagtatctctaacaatgcctcgaattgatatctcaaattacaatataaggttttatataaaaaaactactctaacagtgtcttgttttatagaatttggtcaaaaaattataggacaccctatcaagtgcctcaaatatactataacttagtagacatagtttgattactctagcattgaagtagtttggagggattgaagagtgcataaattataatagataaaaactcacataatacatctcgatccacctcgaagacggactatgaaaaggggcccatgttcaccatatgtagagaccaaatagactatatgagaagctaatagtgtgtttggtttgagggatgagctagtccatcatcttctcactcctcacttttttgtttggtttgtggattggaatgagttgatccatcatcaccttattcctcatagttaattagttagtaccaatatgaggattgaggtcattccaccaaatttgaggaatgagtccatgatgcaccacctcattttggatggaatgatttctcaaaccaaacaccccctgagagcctgaaatggactttgatgtagctacatattgtcttgtggccctaattgtttggtggtgtaagaagtaatcaaattgttactactcctttgtgtagtatcacattctgttaataacactaaggtttacttcttttgattgtcgtattacaaataataaacaatatcaaagcaatggggcctagagtgccctggtcgctgcagggcctttggaaaatatagagccggccctgtccactccaatccctcgttgctggtaaaacataagactgtctcccgcatctataatatcctatcacctattttaaacttaaataatgtaatctagagtataaatcttctattttaaacgatctcgtgaggacagcctaagcgagataaaatatcgattggttccaatgaagttactcttttctatcatttcgtggattttctagtagaagatagtagtttattttctactatttgtctttgccctgtcggagcgaatgtagccataggaagcaaaaaaattaaaaaaaaaagactgagaaatggcaacggtgatgccaatgctctctctcaacctgggaaaaaaaatcagggaagccatttccatttccaagtctttggtggatgctacaactattcgattttgcttgccaccgcaaaaggcaaagcaggtgagacgaacctgtacatgatgcatcgggccacggagaacctgcagttaatgcgctaacacgtgcccccgccatgagccaccagcccaccacgtctagtggctagtgggctctctctctctgcgtgtaggtggataggacaggcccagcgaagaaaaagctcagacaggccgaaatgatgggctggtcaatgggctttccgtttcctttaaaaggattgattgatgaacattgggggccactgatgacaagctcaacatttcgttcgttggcgcgattatagtatagaaatacgaggcataggccggcgggatcctctacagtcacgtccgtggacatagctgcagttgaaaacatgggggagcaaaacatggtgaaactaagatgtaatatatttgaggcaccggacataactgactgcagaggatatgtacacgcgcacgcatacatgaatgtaattaggtgtttggtgcttgttcccttgcccaaacaaacacaggagattcttgccgcctcagggcttgttcggttattcccaatacatatggattgaatgagattagaaaaaaaatgagaagaagtttaacttgtttgggattcaaactcatccaatcccactcaatctacatggattgagagctaatcgaacaagctctcaacaattacatccttaatcattgcgttggttgtgaaccctgcgtttaatcacacgctgaactcgagccctttataactattaagcatataatactccttgtcaagtgttattataccggttgctcttggtgcagccacaatgtcattcctttcatctggatccgtcttgccagatgcgggggagagacacgtgtcgacctcacacagtgctcaaacaagtcgagtcccagccacaaggaaacctagtagatacatctctgtggtcgagattccacgtactacatgtttagatgcacccagtttttttaaaaaactgttttatagaaattgaagtgattccaaacataccggtatataccttagtttataagaattaaattattagtttgttaaaaactaagaagctaatctctcttagctaaaaaataattgcttctaaagaggaccttactagtacgggaataccacatgtacatactccctccatacacacatatcatgccaaagggaccgacaacaatttcctgtagcagagagaggttcgacccaacacgctgcggtgttcacggaacccacatcagcatactctgctactcatgagtatatatatacgcggcacggcaccaccagatcagcacgtccattttcagaatgttcttgaacacgcccagccccacaaaactttcaccgtggatgattctacctggtcaagtagtaaaccagtagatttggtctcgaacacctgtatcatgttcgtttacacatgacatgaatcatctcaagaagggcacaaagggcagatgaactgcatagtagcaataattgtttctgatgtcgcttaataccgtcttgaatttgcccacggtgccagagagaaagccccttgatgtatccatgtcgctcccctgaaccagacatgaaggtaaggggggtagggcagtagattcagatcttatcttacaacataaaacggtgggccccttcagggtatccctgcggctcccattcggtctagcattctgttatgagtctccccctcttcgtggatatcacctgacaactacaggaaagtaaaagagctttcagtacctaataacaaatgtatagttgtctagaagcttatccataatccttctatatctcatctagttgttagcttttaaagaaagacataccttattaatgtagacattctagttgttagcttccaaatgcataccacactaaaaaaaaagttcggccaatgaaatattcagatagcatcaatgcagccatcaatacagcattgcaaggaccatcgtattccctttacgtaaaattaaccagaaaactgtgcttaactactttcaaatatttcaaactaaactggtccaggaaagcacatggttgacaaggatcccatatctaccattatgcattgaagttgacgcagaaaggaactatttttagaggaacacaatgttgtttcaataaatcagaaatggggaacttgcatactctgtgatagaccgacaaacacagttctctggacccatatcacgaaataagacaaaacattgtctgctaaaatgttttggtacgacagaaaaccactacaagttgacaaaaaagggtgtgacaataactaggcaatgacattagtagtacataatagccccaattagcaatacaattgagatccatagttaccatagagagcctgttaattccgtctaagatgaaattcatgtactgcggttatgcaggatcactgtgtcttatatttttctaattatagctatattgctccagcatatccttttcatgatttcattcccttccataattggattatttgtaaagatgcagtcttatgcagaactacagattacagagcttgtgacagagatagagagggacagaaatagagacctaacagaaagaattttgaccatgaggcagtgatagcgggcaaagtatgaatctgttaacacgcagaaatatcagcacaaataaacaaagggatcagtagctttagaatagtagcgcttaagaggacgggagagtccccactccccacgcccgtgtcgttccccacgggcaacacaggcggagccaaggcggcgcgctcgccaatacctccctcccgctccccagtctcgccatcgccggagcgacctgcagagaggctcacgcgggcacgaggaaggcggcggcgaggagctcctcagctctcccctcccacccacacccgcacctcaagggcgggtgccacgcggcattggcgactacttgaagggcggcggcggcatgaaggttgtcgatgcaggcggattcaagggcaggtgttaacgtagaccccgcgcccctgcctctcacgagcgcggtcctctgcgtgagaaacgacttgggggtggggaggaggagaggtgggtgtaagggctgcgcttgccggcagatctaggccccgtcggcctgtatctggccctcccttgctggatcgacaccattgaggtggtggtgcttgtggggaggagcggtggaacctgcttgggcgttgggaggctgcacggatggagagaggcgtccagtggcccggcgaggtgcgccagcagggctacgcggtcggccgagatggcggcggcgacggggccctcctctcgtttgatggcatggcaacgacgacaagtgacctgggcaggcacaagatggtggcgacggcggcggagcgctcgacggcaggtggctttggtgcccgcgggtgccagggccgacagcgacagcgggcttcggctttggtgcacggcagtgtgacgcatgtggcaagttgttgcccggttccgtgtgcccagccggaggggtggcggccgacgcagcattgcggcggcgcgttgatgccctttggaggggtttgtgcagaagcccgggcggcaacaacgttggaggctgcatgctttgacgcggggttctagcctagctatgttatgtgctgggtgacatcaggcttagcgacgatgaaaatcatgggcgccgtttatctgctgagtgcgtcacgtttccagcacagttttacataggcgaaagcccggtccttctaggacaagtgagggtggcgtccgagacgtcactcctttactaaagacatcgctatagaagttcgtctcgaccgcgacgtcaccttcagttgatgtcttcgcttctcaacgtttggtttgcggggtagaggtgggattttgcaacgtgaaatcgaaactgctacgtttagagattggcttggtaactatgacatgaggcgaaaccccttttttatggactagattgtttcggaggttgggcaaatgttggggtggggcaaggataaagcttgttggtgaaaagaatcaaagttgtctcgcgtgtggtgtgttgaggcttggcaacgacagtgcaccgtggtcttcctccttctgtgtcgggttttgggtgtaggtgtcgtcgagttcctttggtcatgagtggcccatcttgcggagtcagagttgcttgttccttgtgttgagctcggtaacgatgactctatatgagctttgtgtggggggctaccgttgtctagattatttgtgcactttgtgtaggtgttggacccgaattttcttaaaactagatcaattctatttttttaattgaaaggcaaattgaaagacagagacgttaaaaaaacagagagaatagtagcgcttagagtcccaagttacaaatttattggtctcttctctcttgagacagataagcaaaacaagcccattcaataatcacgtgaaaccaacttccatgtctgataaacctagattcgtgatcctcaaacaaacaacaaacttagagttggggaaatgaaactgtccaatacagcaatcgatttgtctttggaaggaattcctcaaccataattttgagacaacaactgaattatctacaagccaaggtaagtagacagcagcacatcgtcttaatccttaacaatcacagcgtaccgatcgcactaatcgcgtgtgatccatccacaacgggccctactaacaaatcgcttgcgctcatcaaccctgatatccgaacaccatgtcacaaaattcgaagctcaaagcaacaaaaaggcgcagaatcttaccctctcgggttcatggcgctcgtctcgatccgaatcgtgctgcctcctgcctgcaggaatcaaaccctaaacccatcagagacaaacaaaacattgagggcttgttcaattagctctcaattcatatggattaagtgagattggatgagtttgaatctcaaacaagtcaaactttttcttatttttttccaatctcatccaatccatgtg

SEQ ID NO: 17547 - DNA, 856 bp, Zea mays
  misc_feature (739)..(739): n is a, c, g, or t
  misc_feature (787)..(787): n is a, c, g, or t
  misc_feature (800)..(800): n is a, c, g, or t
  misc_feature (806)..(806): n is a, c, g, or t
  misc_feature (815)..(815): n is a, c, g, or t
  misc_feature (821)..(821): n is a, c, g, or t
gcccggccgggagcccgccggcacggctccagcaacgacacccgagtacccgacccgcctgcccgcctgccggtggtcgcctgtatcacaagctcccaaaaccgccgcgcacgctgccaccaccggtacccaacgaacatggcggcggcgccgtcctccctcgcctcctcgtcgcatatcccccgccgcgccacagctacggccccagcacagtcgcactcgcctccgttgccgcagcagctccgccccgccaggtccttcaaacgcggggcgctcgcgcagcacgtccggtacagctttgctggcagggaggcatcgaggcggcgcacaccaggtgcttgcttcgtggtctcatccagccagccaggccttgctgccatcgatgtgccggcagcgactattcctgatgccacgacgacaagcgtcactgagcggacttcggtttcatctcttttagaggttgtatcggaggacttgctcagccttaacaacaatctgaaatcgcttgttggtgcagaaaatccagttttggtttctgcagctgaacaaatttttggtgctggtggaaaaagattaaggccagcattggttttcctggtgtctagagcaactgctgaattagctggtttgtcggagttaactgcagaacatcgacgcttggcagagataatcgagatgattcacactgcgagtttaatacatgatgatgtcatagatgatagtgggatgagaagagggnaaggaaacttatttcacctactgatatgggttacacgtgtggactgtnacttgcctggtgnattttnaagtttggncacaantctttcttggtttgcttggcaaacctaggaaaaat

SEQ ID NO: 17548 - DNA, 3755 bp, Zea mays
  misc_feature (721)..(721): n is a, c, g, or t
  misc_feature (3733)..(3733): n is a, c, g, or t
agttttcccggtttgtcataggctgcgcatgggcggagtcacactaagcaacatgctctggaccttagacagatggaccaaatgcgcatgcttgttaattcgattccccctcatcagcgccaacaagctgccggcatgctttaacatatgatgcttcgttgctatttctggaatgaatagacctgatgttccgaggcacacatgttttattttcttcttcagaatgaagtcaaatttcactgctctgctagaaatgacctgctggaacgttggtgcagatttggcctgcaacaacgcagaggaggtgatcttatgtaactacaaaagatagtaatggggatatccaaggtgacaggcattgccgcgacagcttttcttgtcacatctgttagtctgtgccagttgggaatgaggattattatgcttccattcctagccaccggtattgttgcttccattgtcacggttgcatcgcatgatgccatcaacctaccgtggatcttggggaagaactcggttggaagatttcctctttggtcgattatactgtttggtcctttcttgacgcttgctcggacatatgcgatggttaagagatacatgaggaaggaggccgtgtatgacaagatcgtggaaggcctatatctcggaggatggccgtttctcttgaaacatttgccccctggaaacccatctgtcatagattgcacttgtgagcttncaagaagttcattcgttccagcaaacgagtatctttgccttgcaacttgggataccagagctccaacaccgcaccagatcgaaaaggctgcacgttgggcttgtgaaaagagatctgaggggaagccagtttatgtccattgcgcatttggttagtaacccacgttttgttataattacttttaggattgcatcttgatgtttgtattgtgtacataattgtgttccctagtactgtatttgtgcactatattgactgttaggtttgttctttgtgatggacacattaggtcatggaagaagtgcccgtgttgtgtgtgcaattctagtagcgctgggtactgctgtgaactggaaagatgctgagaacatcatccgtgaaagaagaaagatataaatgaacgcccctcacccgtaaaaccttggaagagtggtccaaacaacgagttcgtcagaaaaaggataagtagttgtaagtggaacattttccatagtgatggacttgttttgcggtgttaacgcctgtcataaaatgacatactccccccgttctttgggggtagtatttgcttaggccaagtgtaatttctggggcattcttatttatgttttaaccagtagtattagtgtttctccctttaaatggatatgaatttatatgtatccaggttcgggactgttttttgtccccctggttaattgaatgtgagcaggcattagctttaatgtatttcttcatggaactaaatggatgtatatatgataaagattatataatatagtaaccaaatagtcctagataatggataaacatagtcataaaaattactagatagcctcaaccaacctattcaacatactcaatccagtaatcataggtggaattgttgaatggattcttccatcataggaagagctgttacaagaatttagaccagacaaaagaacacattgtactggagtactcgacatgagattctagcttctctctttccccttcccactgcagtcaatgaagcaatttcaccttcctggaattttcttgtacacacattttcagaaagtgttttttgaaaactaaagaatttccagaaacactccttgttttagagcttcttctatttcccagctttcctctgtagctctcagatatctgccacgtgcatctaaacaatctctcttcgcagtcatttttctcttgctcctatgctgagggttagttccacaacatgtgtcagtcagaaggttgaaaattggttttgggatggttgtgctgcaatgcttatctcacaattgccttcatcggtcaccagtatctctcgaggtctagaagcccagagggaacttaaggcacgaaggcggttgtggtactcgccaattgccaagagacatcgagctgcctgccgaactgtcagaatccggtgcatctgatgaagagtctgttgcctcaagttatcggcctgtatcacaaagccttcaaggttggccagcttgccgagggcaagagccatttggctcatgaagctcatgttggcgtcgtcagtcagagacccaccggccatggtgtcagcaagcgactgatgcagctgctccaagccctgcgagagagcttcctctgcctgctgtgatgactgctgaaggctgcatatgccgaccacttgctgctctgtcagtggatctagctggggcagcagtgtcttgagcagatcggagggcctgaatccacccatccagaggaagcaccgctcggcgggggtcgtccacaccccagtgatgaggtggaacacgtcggacttggccgccatggccttgagctggaacagctcgtcgtggtgggtcagggcgtcgtcgacgatggctctgaggtcgccgtctgccaggtgcgcgtgcagggctccgttcagctcggccaggcgccggctgtggtcgtccagccaccgggcgtactccacgtcaaacatggcggcacctgaactggtgcttgcacccggatctcctccaagaaagaggccctgggtacgggctcgctgcatgtcctgttccatctgagaaagcttcagcttgcagctctcaagctgctgaatgtacgccttcttccgcagccggcttttgcgtgcagcctcacgattctgagccagccttctgattacctttggatcaagagccttgccagttcttggagtggaacttgtagccatatttttgtgctgaagctgctgctgtgaagcttgctcgaactggctcgccatgtttgctgctgctgctgctccgagctggtctgaggagtggttgctgtggttcttgctgctgctctccgagtcgtctgtgctgtctgctgtcacattcgagcactccttgacgtgcaaaagggtgaagacgagacctcagaggccgagctgggaagatgtccagtgtaggaggtggcctagccgtagccgtagccgttgcagctgtagcaccagcagcagtgggaaagggcttggtgtctccatgatgaggtgcagagacggttgcagcctgttgagttcttctgagcgaggcgacctgatgcatgaacgcttcttccagctctccgaaataggtgcctcctcctccttggtcaaagaagtttgcaggaggagtggagttggcgatggcgccatggaagccatagccaagaagagaaggatcctgccttgaatggctagaactactagtatcccccatcctgcgatgccgcacacacacgatcagcgctccctcctacttctcgtcgattaattaattagcaacctgcagcggaactactgagggttctctgcggcaacgaagggctgagactgagaccacaagcccagtcagggacgccgaagtagcttggactttggagcctcggagagttggagccttggagggcaggcaggccgcaggcagtcttgactcttgactagttgtttcttttctgagagttgctcttgctcacacgctgaagctctcttcttgtgtgatatgacagtgtagtaggttcagtttnctatgggtgtgagaatcccccc

SEQ ID NO: 17549 - DNA, 1138 bp, Zea mays
tggagccgcacgtctccttccggccttccccgacgatgccgctgccgccgggaggaacggatggatcccattggcttgccaccaccactgcacgctccggccccgattcccgctcgctacggccccagtcgcgctcctcaccggccggcaccaccccgcccgccctcgccttttgcctgcccagatttaggcctggcattctagcaatgcagaagaagtgatcttataatcataaaagataacaatggggatatccaaggtgaccggcattgctgcgacagcttttcttgtcacatctgttggtctgtaccagctcggcatgagaattgttgtgcttcctttcctagccaccagtattgttgcttctgttgtcaccgttgcatcccatgatgccatcaacctaccgtggatcctggggaagaactcagtgggaaggtttcctctttggtcagttatactgtttggtcctttcttgacgcttgctcggacatatgcaatggttaagagatacatgaggaaagagtccgtgtatgacaagattgtggaagacctatatcttggaggatggccctttctcttgaaacatttaccccctggaaacccatctgtcatagactgcacttgtgagcttccaagaagttccttcgttccagcagacgagtatctttgtcttgcaacttgggataccagagctccaacaccataccaaattgaaaaagctgcacgttgggcttgtggaaagagatctgaggggaagccggtttatgtccattgcgcatttggtcatggaagaagtgcttgtgttgtgtgtgcaattctagtagcgctgggcattgctgagaactggaaagatgctgagaacatcatccgtgaaagaagaaagataaaaatgaacgcccttcacaggaaaaccttagatgagtggtccaaacaacgagattctcagaaaaaggataagtagttgactagttgtaagtgtaacattttccttagtgatgaacttgtttgtggtgttaaagcctgtttgaaacatcaatggcatatctacttaagacaagtgtaatgtctgtgaaattattatttaaattattaaaaaaaaaaaaaaaaaaaaaaaaaaaaaataaaaaaaaaaaaaaaa

SEQ ID NO: 17550 - DNA, 2015 bp, Zea mays
aggtcggtcagcagtcagcacgtctccgtccccgacgatgccggggagcaatgccaatggagggcgcagcctgtacggacacggccgaccggccatcttcacccccctctccttgccgccctcggttccggactctgctcccctgccccatacccccaccgctcctcacgcctcgcctgactgccgaggcaaccccggaagctcctcccgcgcgcgaacatgatttggcctgaacaacgcagaggaagtgatcttatgtagctacaaaagatagtaatggggatatccaaggtgacaggcattgccgccacagcttttcttgtcacatctgttagtctgtgccagttgggaatgaggattattatgcttccattcctagccaccggtattgttgcttccattgtcacggttgcatcgcatgatgccatcaacctaccgtggatcttggggaagaactcggtcggaagatttcctctttggtcgattatactgtttggtcctttcttgacgcttgctcggacatatgcgatggttaagagatacatgaggaaggaggccgtgtatgacaagatcgtggaaggcctatatctcggaggatggccgtttctcttgaaacatttgccccctggaaacccatctgtcatagattgcacttgtgagcttccaagaagttcattcgttccagcagacgagtatctttgccttgcaacttgggataccagagctccaacaccgcaccagatcgaaaaggctgcacgttgggcttgtgaaaagaaatctgaggggaagccagtttatgtccattgcgcatttggtcatggaagaagtgcctgtgttgtgtgtgcaattctagtagcgctgggtactgctgagaactggaaagatgctgagaacatcatccgtgaaagaagaaagataaaaatgaacgcccttcaccgtaaaaccttggaagagtggtccaaacaacgagttcgtcagaaaaaggataagtagttgtttgaccagatgcatggagttgccctggatatggtgttattgctgcaccaatttattttaatccaatattccatagctcatgtatagtcgagtggaatgaggaatatcatagggagcccagctcgtgtgtaggatctatctatggagtacctatgacactgtcatagtaacatattgatttgagattctagatttggtgagaaccccataacctgtatcacaaagccttcaaggttggccagcttgccgagggcaagagccatttggctcatgaagctcatgttggcgtcgtcagtcagagatccaccggccatggtgtcagcaagcgactgatgcagctgctccaagccctgcgagagagcttcctctgcctgctgtgatgactgctgaaggctgcatatgccgaccacttgctgctctgtcagtggatctagctggggcagcagtgtctgcaacagaatggaatttcgtatactttattattggaactgcaaattcttcttgtactaaggggaaatctgatttacattggaacagttcttgtgatctcagtaatgaaaaagtaacatcgcctgagttccctgcaaaaaaaaaaaaaaaactaccttgtgcatgcacacattttttttgatatctgatgttctatctcagagtactgaaacgaatccataccttgagcagatcggagggcctgaatccacccatccagaggaagcagcgctcggcgggggtcgtccacaccccagtgatgaggtggaacacgtcggatttggccgccatggccttgagctggaacagctcgtcgtggtgggtgagggcgtcgtcgacgatggctctgaggtcaccgtctgccaggtgcgcgtgtagggctccgttcagctcggccaggcgccggctgtggttgtccagccaccgggcgtactccacgtcaaacatggcggcacctggacacgtacaccactcgtcactcgtcagtcagagagaaatggcataccgtggcagttggtatgccacagggg

SEQ ID NO: 17551 - DNA, 2336 bp, Zea mays
gatcctatatatactctttgcatcgacagagttaactctatagaatgagatcctacattctctttgtattaaaaagaatgcaattctccttttccgagtagttgaacaattacaattttaattaaatttatataaaaatagtactatatccatttgtaatatttgtcgtcgtccgcaagagagagtaacatttatgatgagagataaatattattagataagttatagaatatatatatatatatatatatatttaaaaattagtgatataaatattattattatttattataaatttaattaaatttaagctagtttgaacatacgtcatatattgctttatggaccgactgagtcttatattcacattcgagtcacgtgggagtgtacaaatcttggacacttggcgtgcatgctcattcggtatgatagcttccgctggaccgctagtgggtagtaggggtgcatgtcgaccacgaccagcatctactggggatcccattcccatcccatctactgtgtatctccatccccgtggcgggcccccccagggccggcccggatgtccctgccaccagcagtgcgtgcactaaacacaaactaggcagtagtgcactctacctatagctctctccgatccatgcagagctcggtggtcatgttgtcgagcacggtggcagcggcggccatggcatcgctgcgcaccctcccgctgccggtgctggtgcccctcgtcgcctcggggctcgtcttcctggccaccgtgctccgacgcttgctaaggcggcagcggccggtgtacctcctgaactacagctgccacctcccggacgcggagcggcaggtgaacctggaggtgtgcgagtacttcggcctcaagtgtcgccgctactccgacgacatcgccgacttcatgcggctggtgtacagcaagtccggtctgggccaggagaccttcgcgccgcccttcatctactcgggcaagttcgagaagacgctggcattcgcgatccaggaggccgaggagggtctgttcgccgtcgtggagcagctcctggcaaagtcggacgtgagtcccagcgacatcagcgtcctggtggtggcctgctccatgttctccccgatgccgtcgctggcgtccatgatcatgcaccggttcaatatgcggccggatgtgaagtcgtacagcgtggccgggatgggttgcagcgcggggaccgttggcatcgacacggcggcgcggtcgctgcgctctcggcggacgcccgggtacgcgctggtggtggtgacggagaacacgagcctaaactggtacttcggcaagaacaagcacatgctggtgaccaactgcatcttccgcgtgggcagcgcggcggcgctggtgacggacgtcccgtcccggcgcccggacgccaagtacgagctggtgcgcacgctgcggacgcaccacggcgcggacgacgcggccttcaacgcggcgctgcagatggaggacgaggagggcaacctgggcgtggcgctcaccaaggacctggtccgcgtcgccggtgcggcgctgcggaggcacatcaccacgctgggtccccaggtgctgccggtgtccgagatgctccggtacgcgtggcgcgtggcgcgcgcctacgcggccgggaacagcaaggccgcggcggcggaggtgcccgacttccagcgcgcgttcgagcacttctgcatccactcgggcgggaaggcggtgatcgactcgatcgcgcggctgatggggttcgggccctacgtcgtggagccggcgcgctccacgctgcaccggttcggcaacacgtccagcagtctggtgttctacgagctggcctacttcgaggccaagcgccgcgtccgggccggcgaccgcctctggatgctggcgttcgggacggggttcaaggcgtgcagcaacgtctggcgcgcgctccgcgacgccgcgcccgacgccgacaacccatggaacggatgcgtccaccgctacccagtgccgccgccgccaccgtccaagacgcacaagcatgcttgatatagtactatgtgctcctccgtcgccgcgtctcgtgcctgtgtctgcgtcgattgtttgataagcaacatcaacgaaggcgtatgtatcctagctagggaccgggtcagttgtttgatacgcttggatgcatgatgatcagctgtctcattggctccaagaagacctatggattgtttgatttctgtgtcagtgatatgtcatatgacaacatgagtatccctgtttggaaagtgaaatatataagaaatttaaatattaaaaaaaaaaaaaaaaaaaaaaagaggcc

SEQ ID NO: 17552 - DNA, 2191 bp, Zea mays
taggggccttttttttttttttttttggcattgaagagatagtatgagattttctcttaatatagagaatcaaagttatatcaaacggtattttaacggtctcccctacctctctagacaaccgaaacagccctccctaccgaaacagcttctcatgttgtacatgccctaaaactgattgcacatcggtcgttgaataaaagggcaatcatctcagcgcagagctcgagcccgcagcctgccatcacctaccaaatccggcgggcgtccagcggatctccatctggtcggcgtggatcggatcttcggtggtgtttctcgtcttcacggcgattagtggcggcgagccgaccacgtccccgcagcagcagtcagcggcggcttgacgcggtcggacgggtacctctagttggcatcagcgagtgggcgcggggcgccgcaagtctcaccgtccgctggtgtagaggccccgagtctcggcgctatggagtgtaggccgcgtgtctccgcttagggagggccaggggtcaacaaagggacttgtcaagtgacaacatcgcggccttcgggtgttggaggtgtccggcctgttggtgccgtaccacaggattggttcattatttgtgggagatctatatttgtcttaccattttgttcccgcttctagtccccaaatcttcacgggctttgccagatcgctggccatctccttggcagccgcttccgctgtcgccagccatcaccaacctgcgcctcatagtggagcccaggaaaggcggtgggactgagcgagggaagaggagatgactagcttgtcgatcacggtgatgacgctgaacctgcatgaaggcgaacagccgagcgagagccccaacagctgggagaagcgccgggacatctgcgtcagcgtcatcaccagctactctcccaccatcctttgcacccagcaaggcttaagatggcaactggactacctacaacagtgcttgccgggttatgaacagtttggaatctcaagaaaaggctcacaggacaacactgatgaatactgcacaatattctatgaaaaggagaaggtggagcttactgaaggtggcactttttggttgtcggaatcaccatcggttccaggaagcatttcatggggagcaaaggcaccctgcattgcaacatgggcaacgtttcaactcaaaagactagaaccacctggattcagtttccagatcgtaaatacaaatcttgatgaagttagccctcgtgctcgacgaagaagtgctttacttacatggcaacatatagcatcgctgccacccaatttgcctgttatctattgtggaggcttcaatacacagaaggaatctatgactgggcggtttttgcttggcagatccagagaacatggtgttgttggtgatatgagagatgcttggccaaatgctcgagtgcgaaaaaatgtttcactaatacacacatatcatggatttaaaggggagaaacaaggtgccctggaatttcttaaattgatatttagagctctttgcctctgctgggatcgacagacacaggacttgcatatcgactggatcttgtttagaggacgcccattggttcctgcactttgtgaggtcattaatgacaatatagatggtgtttatccgtcgtcgcacttccctatctttgccgagtttttgcttccacgctcagtccgcctagctgagacaccttcatagctattgtgtcaattttttgttctatttttcccaatcttattttgattacggctgattgtttctttcgaccacttcaccatgatcttgcggtaacccccctttacaaccattgttgggtttctttctgttatcccattccgcaaaacaagacaatgcacatgtgcatccttgtatgtttcctgtcactagtccctattatgtgttcgccttagctttgttatcttcttaaagttcactttttccttatgtcattgatttttagactgtcatatataccgtgtatatatatggtatgaatatgttgtcatgtatagtcggccgatccttgtatatgttataaaaaaaaaaaaaaaagaaaaaaaaaaaaaaaaccgttatatatgaagtgtgtatagagatattgggagatttcatttggttctgtttccataaaccatgagatctctcctctctttatatat

SEQ ID NO: 17553 - DNA, 1864 bp, Zea mays
ccggccgggaaatccaaatttctcgtgaatatctcagcgccgagctcgagcccgcagtctgccatcccctttcggtggcaaccaaatccggcttgcctgcagcggatctccatctggtcggagtggatcgggtctccggtggtgtttctcgcctccgtggcggttagtggcgccggacggaccacgtccccgcagcagcggtcagcggcggctggcctagctgcggtggcttgaggcggctctcggacgggtgcctcgagctggcaccagcgggtgggtgccgcaactctcaccgctagctggtgtagaggcggcgagtcccggcgccatggagggtaggccgcaagtgtccgcttagagaggggtcaacaaagggacttgtcaagctacgacactgcggtcttcggttgccctgctcagcttgttgttgccgtacatgatccttcatgatttgtgagagatctatattccccgaatcttcaccggctctgccagatcactggcgatcttcttgccagccgcctccgctaacctgcgcggcacagtagagctcaggaaaagcggtgggactgagggagaaaagaggagatgactagcctgtcgatcacagtgatgacgctgaacttgcatgaaggcgagcagccgagcgagagtcccaacagctgggagaagcgccgggacatctgcgtcagcgtcatcaccagctactctcctaccatcctttgcacccaacaaggcttaagatggcaactggactacctacaacagtgcttgccaggttatgaacagtttggaatctcaagaaaaggctcacaggacaacactgatgaatactgcacaatattctatgaaaaggaaaaggtggagcttactgaaggtggcactttttggttgtcggaatcaccatctgttccaggaagcatttcatggggagcaaatgcaccctgcattgcaacatgggcaacgtttcaactcaaaagattagaaccacctggattcagttttcagatcgtaaatacaaatcttgatgaagttagccctcgtgctcgacgaagaagtgctttgcttacatggcaacatatagcatcgctggcccccaatttgcctgttatctattgtggaggcttcaatacacagaaggaatctatgactgggcggtttttgcttggcagatccagagaacatggtgttgttggtgatatgagagatgcttggccaaatgctcgagtgcgaaaaaatgtgtcaataatacacacatatcatggatttaaaggggagaaaaaaggtgccctagaatttcttaaattaatatttagagctctttgcctctgctgggatcgacagacacaggacttgcatgttgactggatcctatttagaggacgcccactggttcctgcactttgtgaggtcataaatgacaatatagatggcgtttatccgtcgtcgcacttccctatctttgctgagtttttgcttccacgctcagttcgcctagccgagacaccttcatagccatcgtgtcattttttttatattttttcccaatctcattctgattacggctgattgttcctttcgacgacttcaccatgaaattggggtaccacccttcaccacaattgctggtcacttcattccgcaaaacaagacaatatacacgtgcatcctttttatatatgtttccagtcagtagtcactattatgtgttgcctcagccttgctatctttttaaagttcaccttttccatatggcgttgattttcatgtatatatactgtacctttacatgctatttatcacaactgtgagagttcaagtaaatctgatgtaatgaaatttccaagctgtcttttttcacatt

SEQ ID NO: 17554 - DNA, 2994 bp, Zea mays
gggagttgagaacatggatggtttcgttgctcaatgggcaactttacatgagcgtggactttgaaaagtcacgtgaagcaagaactttccgtatcttggcccctaagcagggttctgctcctagctagctttaggattagttttctcaactactcatgtctcttgactcttgcatacatcctatttatttttccgagaaaaagaagtttcctcaaattttatttcttgtgttgatcgtttcgtagcagtaaaaccactcgcataaagtccttggaaaaatagtaaacgaaacagcgtagcgtggtggatggtaaaagaaaagtaaaactttgcgcccgcctatacaaaaccgggagcgacgggacgaccatgtcggtgagaagagaatattccacagccagtcggtccaagctggacagcaggaggacagacaggcagcccgcagccgccgccgccgcagcccgttccgttctcctcgctctcttttcacttgccaacgccaacgccaactgcttcttgtgcaattgggtgtgcttgctactgctcgctccccccgcggccgccctcgcttgctccgggcgccaccgtggggtcctccccccctgctctcccacacccaccctgtccttgtcgtccgctctgcgcaaccaaaccggagaaaccgcccccctttcactccccctcctcctccagatccatccgcctctcctcgaaaccgtctctctgtgcgtccggagtccggggagagggtggcggcggtggagatggagagcctggcgcagcgcgcggcgctgctgcgggagtcgctgcagaagagccagcaggtcaccgacgccgtcgtctccatactcggctccttcgacagccgcctcaccgcgctcgactccgccatgcgccccatccaggtgaggacgcacgccgttcggaccgcgcacgagaacatcgaccgcacgctgcgctccgcggatgtgatcctcacccagttcgacaggacccgagaggcagagcgtgaaatacagaaggggccgcatgagaaccttcaaggtttcctagatgcagttgatcgcttgagaagtattgagcgtttctttagttcaaatcggagttaccgtagtagcgatggggtgctcaaccacgtaaacgcgctcctttctaaggcccttgtcaggatggagggtgaattccagaatcaattatcccagcgcagcaaaccgatggagcctgatcgtctttttgattgtcttccaagtacacttcgaccatcgtctgaatctcagcccgaaggtgggaaaaacccatccgagaatcagcaaaacccagaggctgttgtatatagtcctcctgctcttattgagccaaagtttgttccactactctctaaattagcacaacagttggttcaagctggatgccaacagcaatgctcagaaatatatagtgaagctcgttcttcagctttagaatcaagtctgaagaacttgggcgttgaaaaacttagcaaagatgaagtgcagaaaatgccgtgggaaattttggagtctaaaatagggaattggattcatttcatgcgaattgctgttaaacttctttttgctggggagcgccaactttgcgaccaagtttttgagtgcagtcaatcgttgagggataagtgctttgctgcaataacaaagaacagtttggctacactactcagttttggagaggctattgctatgagtaaacgatcaccagagaaactctttgttctgttagacatgtacgagataatgtgcgagcttcaaacagagattgataccattttcgttggagaatcaggttcgcaaatgcgcgactctgcactgagtttaacaaaatgcttagcacaaacagcacaaaagactttcagtgattttgaagaagctgttgaaaaggatgcaacaaagaatattcatactgatggaacagttcatcctttaacaagctatgtgatcaactatgttaagtttttgtttgactaccagtcaactctaaagcagcttttccaggagttcaaggaagatgggacaggttctgagctggcagctgtaacaatgaaaatcatgcaagccttacaaaataatttagaagcaaaagcaaaacaatacaaggatcctgcattgatgcacatatttttgatgaataacattcactatattgtcaaatctgtccgcagatcagaagccaaagatttgttgggtgatgactggattcaaaggcaccgaaggattgtacaacaaaatgccaatcagtatagaaggattgcttgggcgaaggtgttgcaatgcctctctggtcaaggtttgacttcatcaggtggtagtggtcatgtaggaagtgatggtggcaatagcagtggagcttcaagaacagctgtgaaggagagattcaggtctttcaatgtgttgttcgaagagatctaccacaagcaatgtggctggtccgttccagacactgagctgcgcgagtcactaagactcgcggtcgctgaaatcctgttgcctgcctaccgatcattcataaaacgttttgggcctctcattgagaatagcaaagcacctgggaaatacgtgaagcacactcccgagcaactcgagctgctgctaggcaatttattcgaggggaaacaagaacgtgcttgatagtttggtaccgcccgcagcaaggatgtgctgctcttcagcttctatgtaaaatacaaaataataaaaataaaaaagatctggaggccctgttagcgttagcattgcttgtgttctccccaatccttgtttagccgcattattatttgtacagaagaatatatgtgtcagctgtgccttgtgttgatctgatagcaggcgtgttcctggtttctctaaaaaaaaaaaaaaaacattcgttcgggtggagcactaagatggcgacccatctgtagtttttgagatagaaaaatacttccccctcgtcgttatttattttcggatggtgtacgcg

SEQ ID NO: 17555 - DNA, 2326 bp, Zea mays
gcacgagaccattacctagaacatcctaatcgaaaaaggggaccaggaaagcgctctttgcatctccgccggtccgtccacggtgtgaatcgcgtggtccgccgaacctcataatagccgctcgaaccgcttcataactcccaccgcaccggtcgccccggcgcgccggcgaggtgacctactgacctcgacgagcgcgcgacgttgaccggggcgtgcatccggccgcatcttgtcctcgttccttacgcagaggagcgccgctccaaaatcgcagaacgccaaggcgggcgtagcgaaggatgtcggaggccgtcgccgcaggcgagtcgcccgtcgagctgctgctccgcgcggcggcgatggtgcccgcagagcgctacgcgctggccgccatcatcgtcgtgtccgtctttctgtaccgcttcctcgagctccatgttatcggcgacatcctccgcggcttccggggcggccgcgtcgagctcaccttccaccccgcctcggagatctaccaccgcgtcgcgtccaagtgccgcttgctccacggcaggtatctggcgacaccatggctggcgagcccgcatttgcagacattgttcctgggcatttacgggacgccgccttcattcacatacaagagacagttgtacactgttcgtgatggtggaaccattgctttggattggctgttcgcatctgatttggaagttgcagatggattcatttcgaaagacgcttcaacaccccttgtagttgtggttcctggattaactagcgattctgctgctgcttatgtaaaacacttggtttactccatggcaagcaaaggatggaatgttgttgtaagcaaccacagaggtcttggtggtgtgtccattacttcagattgcttctacaatggtggttggacagaagatgtccgagaggtcattacacacctgcatcacagatatccgaaaaccacactgttttgcattggtacaagcataggtgccaatattgtggtcaagtatcttggagaagaaggcgagaatactcctatagcgggtgcagtatctatttgttctccatgggatctgttgataggtgacagatttatttcccgcaagcttgtacagcgtatttacgacaaagcacttgcaattggtctgaagggctatgcaaaattacatcaacctgtcttggcccgacttgcaaattgggaaggtattaaaaagtcacgatctatccgagagtttgaccaccatgctacttgtgttgtctcaagatatgagacagtggatacctactatcgccggtgcagtagtgctagttacgtcggaaatgtgtcagttcccttgctttgtatcaatgctttggatgatcctctttgcacaagggaggctattccttgggatgaatgcagggccaataagaacattgttttagcaactactccaaatggtggtcatcttgcattctttcaaggactaactgcgcggagactatggtgggttggagctacttctgagttcctttctgctcttcatgacagctcctacatgcataggcagaaggcaaatgatcatgttttgctctcgtctttggaatcctccattgataagagtccgtatgttaatctcatggaagatggaatggtagctgcggtaacaaaagatggccctagcaatgacgggtcacctttgaaccatgcagctgatgaacaattaagtaacgaggcgggcggtggacaacagaatgtggtatctgcattgaaccataatgaaaactccattggagtgggaaacgacagccctgcagagccagtaaaacagcaaggtgatgacatccacagcaataagcttcatgagataattgctcctgtcaagagatctatgagccaactgactcgataccaagggaggtcagtctggttgcttgcctacattgcttttgtaacatcctggccgctgcttggctccctagctttcatcaccttccggaaaaagtccaggaatccgttgcgagctaaatgaatcatacttatattatgttattacaattacatcatgcaacatcctctgagctacgaaggccatttttccccgggtcgtcacagctcctgtgtacagtatcatcaccgatcatcagcaaacattgggggcgcctggataaactgatactttgtaatttgtattgtatttacaacaaaataatacgcaggataagcatctgtgtaattttactcggtaaatctggctggatttgctgtttggcatctgtcgagcttaacattatttttaatccaaaggatgcgaaacgtgtggtaaaaaaaaaaaaaaaa

SEQ ID NO: 17556 - DNA, 3976 bp, Zea mays
  misc_feature (3556)..(3556): n is a, c, g, or t
agtatacacgccaagtcgccagccagcatttcctcccgaaccatccttccactccctcgccgaccctccccccgcgcccgccatggacacggcgatcggctccgtcccggcagcctccgacgcggcgcgtcacccagcgccgtccgcgtccgccccgcgcgacgcgacgctgggccggcacctggcgcggcgcctggcggaggtgggcgcccgggacgtgttcacggtgccgggggacttcaacctcacgctcctcgacgagctggaggccgagccgggcggcgtccgcctcgtcggctgctgcaacgagctcaacgcggcgtacgcggccgacgggtacgcccgcgcgcgcgccggcggggtcggcgcctgcgccgtcaccttcaccgtcggcggcctcagcgccatcaacggcgtcgccggcgccttcagcgagaacctccccgtcgtgtgcatcgtcggcggacccaacagcaacgactacgggagtaacaggatcctgcaccataccatcggcttgcctgatttcacgcaggagctcaggtgcttccagaacgtcacgtgctatcaggtaggggtaattcctcttctaattcttcttcttttttttttgttcgcgtgtcgggtaataacgcagggcccagttctatagacgtctgctaacgagcacactcctaccactgcgttacgcgtttctcaaagaagaaaaaaaatactgcgttacgtgtccactgttggaggaccctacaagctatgttttttttcttgcatgtgtggttatcaggtgaaaaaatatatgagacgttgcttttcttaactgccgaaattaccatgactctgttggaaatcactagttggttcagtacaggtttcctgcatctttttggtactgcggtcaggtggcagcacaatgttggtcaaacactcaaactgtaataaactgtcgtaaccatttctatataatcctagttggttgaccatgacctatctgttttcaaaaggtaccatttgcagccatgaatggttactgcaagcactaacttttacatggcatggtatttactgatgaaacatcagttctggactctacctacctcttgatcgatgcaccatgcataagagacttgtgaaattgacagttcaaacgcatacaccggagtgccacagcagataacatccatttatactaaccaaaactccaaaaccctttcttctatttcaacctttgctaaggcattacgttctttgttcatgtgtcacaggctgtggtgaacaacttggaagatgcgcatgagcagatcgacactgccatctccacggcaatcaaggagagcaagcctgtttacattagcatcagctgcaacctcccttcgatcccacatcccaccttcagccgccatcccgtccctttcttcctctccccaaggtatatttcagaaactccgagagctctgacttgtgcatatataagggcaaagtgacgatcagtttgtaaaacgattttgcaggctatcgaaccagatgaacctggaggctgcagtggaagccgccgcggctttcttgaacaaagccgtcaagccagtgcttgtaggtgggccaaagatgagggtgtccaaagcatgcgaagccttggcagagctggcagatgcctgcggctatcccgtcgccgtgatgccttctgcgaaggggctagtgccagagcaccactctaggttcattggcacgtactggggtgcggtgagcactccattctgtgctgagatcgtcgagtctgccgatgcctacctatttgctggccccgtattcaacgactacagctcggttgggtactcgctgctcctcaagaaggagaaggccatcattgtccaaccagagcgggtggtggtcgggcacggacccgcgtttggggtgtgttctgatgaaggatttccttcatgcccttgcaacccgtctgaagaagaacactgtcgcgtatgagaactaccgtcgaatttatgtgcctccaggcgaaccactttcatctgaacctggcgagccgttgagagtgaacgtgctcttcaagcatattcaggcaatgctgtccggcgacatggctgtcatcgcagagactggggactcgtggtttaactgccagaagctgaagctaccggaaggatgtgggtaagctcctctttcgaatcatgattttgctgtgaaattttgtagtgatgcaaaattcatctgtcagtttcttctgcactgtttggtcgggggtagcaagtggtatcgctgatttaggccgagtcagataaaaaaaaaatctgatggatgttgctctgattcttttacaccactagaatttcaatgttgtcggcctcttcagtcttcaccataaagagaatatatttcatactatatgatagtgacatcaaactttggttcagtatgttgagatgctttctgtcatcgagttactcctagtaaccaggcatcttttgctttcaccaatcaccaggtacgaattccagatgcagtatggatcaattggctggtcagtgggcgcaactctaggatacgcacaggctgccaaggataaacgtgtcattgcctgcattggagacggcagctttcaggtatgattggtagtgattccaaacgatggaatcttcctacgttttctatatcaattccttgaaaaatatgtggtaagagttttcatttgactcggattcaggtgacggcacaagaagtgtcaacgatgctccggtgggggcagaacagcatcatcttcctgataaacaatggagggtacacaatcgaggtggagattcacgatggcccttataacgttatcaagaactggaactacaccggtctggtggaagcgttccacaatggcgagggcgcgtgctacacagcaaaggttggttggtgactgtatttcgtattgctgtaattctgtggtcaccaaatgccacactgcaactgacacttcgcatcctcttttcgcaggttcgaacagaggaggagctgacggaggcgctggaggcagctctaggacctaagaaggactgcttatgcttcatcgaggtcatcgtgcataaggatgacaccagcaaagcgcttctcgagtggggatctagggtttctgcggcgaatagccgtccacctaatcctcagtgaatacatcaggtctcccgaattgccctgtaaaccgatccgctttctggtgacgcccataacaagaagtctcggcgatgacatgctgccgatttctgaataaattgtccctgtaattcactgatgttgcaagtccttgttgtaaaactagagagccgcttggaggaatcatggacagtctaaactcgggtctgagtatatacaagctgattgagtcctagataaatacaatatggactttaccttgatttcagtctatttcattattggaacatccacttggttataactctttatcctatacaatatcttttaacatgttttcctcaatcttaaccttctctatcactaccagaatccacggctttgccgagtgtctgaagcactcgacaaagcntgaaaaacactcgacaaaggtgtcgggaccataattaggggtaccttcaaggctcctaaatctcagctggtaacccccatcagcacaaagctgcaaaggcctgatgggtgcgattaagtcaaggatcggtccattcgagggacgcgatcacgcctcgaccgagcccagcctcgggcaagggtagccgaccccggaggatctacgtctcgcccgaggaccccctccagcgacggatacaccttcggctcgcccgaggcccagtcttcaccaagaagcaaccttggccaaatcgccacgccaaccgaccaaatcgccggggcatttaatgcaaaggtggcgtgacacctttatcctgacgcacgccctccagtcgacagagccgaagtgaccgcagtcacttcgctgctccactgatcggtc

SEQ ID NO: 17557 - DNA, 2155 bp, Zea mays
atacacgccaagtcgccagccagcatttcctcccgaaccatccttccactccctcgccgaccctccccccgcgcccgccatggacacggcgatcggctccgtcccggcagcctccgacgcggcgcgtcacccagcgccgtccgcgtccgccccgcgcgacgcgacgctgggccggcacctggcgcggcgcctggcggaggtgggcgcccgggacgtgttcacggtgccgggggacttcaacctcacgctcctcgacgagctggaggccgagccgggcggcgtccgcctcgtcggctgctgcaacgagctcaacgcggcgtacgcggccgacgggtacgcccgcgcgcgcgccggcggggtcggcgcctgcgccgtcaccttcaccgtcggcggcctcagcgccatcaacggcgtcgccggcgccttcagcgagaacctccccgtcgtgtgcatcgtcggcggacccaacagcaacgactacgggagtaacaggatcctgcaccataccatcggcttgcctgatttcacgcaggagctcaggtgcttccagaacgtcacgtgctatcaggctgtggtgaacaacttggaagatgcgcacgagcagatcgatactgccatctccacggcaatcaaggagagcaagcctgtttacattagcatcagctgcaacctcccttcgatcccacatcccaccttcagccgccatcctgtccctttcttcctctccccaaggctatcgaaccagatgaacctggaggctgcagtggaagccgccgcggctttcttgaacaaagccgtcaagccagtgcttgtaggtgggccaaagatgagggtgtccaaagcatgcgaagccttggcagagctggcagatgcctgcggctatcccgtcgccgtgatgccttctgcgaaggggctagtgccagagcaccactctaggttcattggcacgtactggggtgcggtgagcactccattctgtgctgagatcgtcgagtctgccgatgcctacctatttgctggccccgtattcaacgactacagctcggttgggtactcgctgctcctcaagaaggagaaggccatcattgtccaaccagagcgggtggtggtcgggcatggacccgcgtttgggtgtgttctgatgaaggatttccttcatgcccttgcaacccgtctgaagaagaacactgccgcgtatgagaactaccgtcgaatttatgtgcctttaggcgaaccacttccatctgaacctggcgagccgttgagagtgaacgtgctattcaagcatattcaggcaatgctgtctggcgacacggctgtcatcgcagagactggggactcgtggtttaactgccagaagctgaagctaccggaaggctgtggatacgaattccagatgcagtatggatcaattggctggtcagtgggcgcaactctaggatacgcacaggctgccaaggataaacgtgtcattgcctgcattggagacggcagctttcaggtgacggcacaagaagtgtcaacgatgctccggtgggggcacaacagcatcatcttcctgataaacaatggagggtacacaatcgaggtggagattcacgatggcccttataacgttatcaagaactggaactacaccggtctggtggaagcgttccacaatggcgagggcgcgtgctacacagcaaaggttcgaacagaggaggagctgacggaggcgctggaggcagctctaggacctaagaaggactgcttatgcttcatcgaggtcatcgtgcataaggatgacaccagcaaagagcttctcgagtggggatctagggtttctgcggcgaatagccgtccacctaatcctcagtgaatacatcaggtctcccgaattgccctgtaaaccgatccgctttctggtgacgcccataacaagaagtctcggcgatgacatgctgccgatttctgaataaattgtccctgtaattcactgatgttgcaagtccttgttgtaaaactagagagccgcttggaggaatcatggacagtctaaactcgggtctgagtatatacaagctgattgagtcctagataaatacaatatggacttaaactagatttcagtctatttcattattggaacatcccggtacccaaaaaagcggcc

SEQ ID NO: 17558 - DNA, 2009 bp, Zea mays
ccggcttgccgacgccgctgccgtccgcgtccgcgtcggcctccgcctcggcgtcggcgtccagcggcggcgactcctcgctggggtcctccacgtccgacgaccagctggatctcggggtttacaggttgtcagaaacaagcagcactcttctgggcagaacagtagcaattgaatcccggaaacaaagtcaggtgccagcagaggggaccattttcaccaataatcaggctgtggagcatacccggttgtctgaaacatcagtttccccaaggaaagaatttcgccctcaaaatttggatcttgcaaatgatcgaactacatactgccgtggtcggagatcaaccgaaatcgtgttcagtacacaagtgcccacttctcctcctagttcaagaggacatcactatcaaaattcgcctgtgccatcaagaacatttgggcaatgccctgcatctcctacttcatggcaggatgattcgcgaagctcaagctcaccccaaccacttcctcttcctccaggttccccatgcttgccttcctcttctctacagtggaagaaggggaagttgctaggtagtgggacgtttgggcaagtatacatgggattcaacagtgaaggtggtcaaatgtgtgcaattaaagaggttaaggtcatttcagatgattctaactcaaaggagtccctcaggcagctaaatcaggaaatcgtgctgctgagtcagctgtcacatccaaacattgttcagtactatggcagtgatttgtgcaatgagacactctcggtctatctcgagtatgtttctgggggctctatccataagctgcttcaagaatatggtccgtttggggaggcagtgcttcggaattacacagcacaaatcctttctggccttgcatacttgcatgggcggaatacagtgcatagggatatcaaaggggcaaacatacttgtagatcctaatggtgacatcaagcttgctgattttggtatggcgaaacatatatcagcatatacatctatcaaatccttcaaagggagcccttactggatggcaccagaggttattatgaatagcaatggttacagcctttcagtagacatttggagccttggctgcaccattcttgagatggcaacagcaaagcctccttggagtcagtatgaaggggtggcagcaatattcaaaattggcaacagcaaagacataccagatatcccaaataatctttcttctgaggcaaaaagcttcctgaaactctgcttgcagcgtgatcctgctgcccgccctacagctgctcagctgatggatcacccttttgtcaaggaccaggctacagtcaggagttccaggtccagtatcacaagggatatgtttcctaattcaactgacggaaaaaacagcagggtgaaaattgaaacttcgtcatacagaagtttatctcctttaagagatcctgatatccttggaagaaacttgccaggaccaacatcccctattccttcgacatcaagtcgcaggatcgcagcattgaacacatccaatgttcggatgaacatgtcgctgcctgtctctccctgctctagcccgctacggcagtacaggcagtccaaccgaagttgcttgcgctcccctccccacccagcctattcagctggagcagccaactacaatcctatcaacaatgcactctacccaacgcgaccaagcagcggtctcacagatccatggctcgaaatctctcaggtgaaaacgcaaacttttgattctccaagaagattgtagagattccaaaaagaagcaatactttgtatacaggcagggaaagaagtgtttcattatttatgttgttagagaaacaaaggaacacctttttttttttgtgtttcgccctttctgtatgtatctttcacccaggatgcagttgcatcgcctttgtacaaattcagagaagagctagtcaaaaagagtagcatttcagatcgcacatctaaaaaaaaaaaaaaagcc

SEQ ID NO: 17559 - DNA, 5549 bp, Zea mays
ctgcagaggtctttgctctcgcgccgcgcgcggcgttgcgtttcgtgctgggggaaggaagggtagatagatggagatccccatgcgtacgacacgacagtacatgcgccaccagcccttccttttgtaggcgccctgccctgccctgccctctctctccatcggccgccagccagccatggcgtcctctcctctcccgtccctccccacaggcacaggcccaccgcccacacacactcggcgccgctgccctctttgcttgcttctttctttctccctcttccctttggaccctttccagttgtccacgctcccatctttttcaccaccccctctccttctctctctcccccccaccctcgcccttctcccaccgcgcgcttgccctccggccgggcgcccgtcccgtccttccctacttgtaccagcccctcttttccaatttcatcctctccctccaattccaccatccctctctctctctctcgctcgccacccgcaccactctcgctcggtgtgtgggagagagaggaggggagggagctaggctggcatggccggccgcttgagctgcgcatgcctacaattcagtaccagtactagcaaagcaagctaggtaggagtaacacctccccaattgctacttctactgagttagccatcccgtcgtcccggcagtcacttctacaagtacgcacgcagctacccagcagggcggctatactaatccctccctgcctctgccttccttccgaggaccgccgcggcgggccggggtgcgcgcacccgccatgcagcagcagcaccagggtggcggcggcggcggcggaggctcacagttcggggccccgccgccggacatgggccccttctcgccgacggcggctgctaccggtcccatgccgctgagcagcaggcctccgtcggcgcagccgcagcagcaaccgaggaccagctacgaagaattggcgcccatggtgcctggggccgccgctgccagtggcttcgacgacgagacgatgggtagtggcggcggcggcggcgggtcgtcgggcgcgtccagcaaccggtggccgcgggaggagacgcaggcgctcatcaggatccggtcggagatggacgcaaccttccgcgacgcgacgctcaaaggccccctatgggaggacgtctccaggtaaaggagcgagagagagagagacaggggaactcgtcgtcgtcctcgtccagacgcatttgcagtctggttcaagaagcctgtctccggcatgattttttttcccctgcggaaagcggctaacggtttcgtggaatttagcagccgcgcccacatgaaatgatggataattatcctgcgtcgctcgctgcgcccaattcccctcgaatttcgttttgttttcccgtttccgtcccagtctaatcaaatgcgtctcgatttcagcgagacggcaggggagagacagagagagagagagagagagctggaaggcagtactcctaggtgcagtagccagtagggtgaaccggtgaaggaatctgggcgcctgcgcgcctggggatcgtaccacggtggtgagtgcgggagtgcaggcagctgctgccgtcgctgcaggctgcaggctgccactgtctcctgctttcatggctccagtttttgggaaaagaaggaaggcagccttcctctcccatcccaatgcggcctccttgctttcatgactcaccagtgcatcatcagcttcacatcccctctgatccctaaaaatacgagatggtttgtgattaactataattccattctgctgcagtacctccacctccttcggcccgcactcttctctcctcgctctcgcctgtccttccaaaattccaattcttcccatcttcttgtctctttcctccagaggccttgatgtgttatgccactacattagatgcttcctccagtaaacgctgccactgcccatcatttaattcttcttcctcgccgatcacttgattctttgcacgtaagtaatggctgaccggaacctttgtgtacgcgtctttgtcactgctgtggctttcaggaagcttgccgacctgggctacaagaggagcgccaagaagtgcaaggagaagtttgagaacgtgcacaagtactacaagcgcacaaaggaaggccgcgccggcaggcaggacggcaagagctaccgcttcttcgaggagctggaggcgttgcacgcagccgcgccgcagccgccaccacagctctggccggcagccagcaccgccccgcagttgcacgccctcgccgcgccagtatccccgacgccccagcagcagttgccggcatccagcgccgccccgccgttgcacgccttccccgcgccagtatccgcgccgccgccgttgagttcaatgccactgctgacagggccgatgcagccagcgcccatatcatcggcggccccagccccggcaccggtggatctgctcggggcccaccagcccctcaacctgcaaggcttcagcttctcttccatgtcggactcggagtccgacgacgagtccgaggacgacgacatgacggcggagacaggcggaaaccaggaccgcctcggcaagcggaagcgcggcgacggcggcggcagcagcagcaacaagatgatgtctttcttcgaggggctcatgcagcaggtcgtcgacaggcaggaggaaatgcagcggcggttcctggagaccatggagaagcgggaggccgagcgcacggctcgggaggaggcgtggcgcaggcaggaggtcgcccgcctcaaccgcgagcaggagcagctcgctcaggagcgcgccgccgcggcctccagggacgccgccatcatcgccttcctccagcgcatcggcgggcagtccgtgcagccccctgctaccgccgttgttgtcccaatgccagcaccggtgtcagtccataccacgccgccgaaacaaccttctcgccagcagcagcaaccgccgccgccgtcgccccaggccggccaggcgacaccgcagtcgaagccaatctcagccgcgccgctccagcagcaaccgccacagcagcaaccgaaggatacgtcgcagcaggacgccggcacgccgcgcagcttgcccccggcgtctggccagtcactcgagctggtgcccttcgccgccacggagcatcacgtcgattccgggctaggaggaggggatggaggtgcggcgtcgtcatcgcggtggcccaagacggaggtgcacgcgctcatccagctgcgcatggacctggacatgcgctaccaggagacaggtcccaagggtcctctctgggaggatatttcgtccgggatgcggcggctgggatacaaccggagctccaagcggtgcaaggagaagtgggagaacatcaacaagtactacaagaaggtgaaggagagcaacaagaagcggcccgaggactccaagacctgcccatacttccaccagctcgaggccatctacaacagaaagcacctcagcagcctcacaaccgcggccacatcgtccaccgccgccgccgccgccgctcctcgtcccgcctacccagatcagctgaacccgagcaggcaagagatagaggggaagaacatcaacgatgacaagaggaacaacggtggatcaggtggaggcacgcaggtgccgaccagcaatggcgagacagcgacgacgacgacgacgacgcccgtcgcgttcgacgccgacaccggcatgaagaagccagaagacatcgtcagggagttgaacgagcacccgcgtcgggagttcacgacggaggacgagacggacagcgacgacatgggcgacgagtacaccgacgacggcgaggaaggcgaagacgacggcaaaatgcagtacaggatacagttccagaggccgaacccgggcggcaccaacaccgcgccagcaccggcagcagcgacgacggctgcgccagcggtgccgacttcggctccgaccagcaccttcctcgccatggttcaataggggcgcgggcggcacccctctcaaaccgtacgtacgtatatgcgtccaaaccaaaaacctgcgcgcatcaccgtcacctcctcctttactttaccagtccaccaagcatgcaccatcagtccatcacactgttctcttgttcatcctgtaatcccccgtgccattccattatttattgatttgtttcgtgtataataagatccccaccgttgcggaggatgcagagtgaggctgcggtggtagagcaaaaaggaagagtccagtccctcagtaataacttatttataggtcatcgtcgatcgcgttaaacgagaactgtacatcgatgtaacagtcagtccatgatgtttttcctccctttttttttagttactcccttcccgggacggcagtatacaagtttgtataagagtatacaagaattacagacagttcaagcaacctggagcttgcggaggtgagaaggtgtttttgccgttgggaatctacattttttttgtcgatcctttttcttttaacagtggatataattaaatcctgttacttgttacagtgtacattaatcgtgttgttattccagtactctgccctttgtggcaaatatacatgagcagttttaccgttgccagttggataaaaaaaagaaccagagaaaagattaagaacaacataagctgctttgtaattgtaggtgcctggattttagagatttagacgacagtaatcgtacacaattaactagtgtaattaattaaaagaacaatgataaaacttgatgttgcttcagtttgagtcgagtacctgggatatagaagaagtaaataacagtagagtgaattggagaacaatggtggaccaatgacatgaacaccgtgcaggtggttgcttgagttagagtcgagtaaaaaaaattaggcagttggcaacttgggtcggtgctcaagcttaattgacacacggtgatcctctgcggagctgtccggtgtactgtgtaggaaaaggaagaagaaaaaaaggtttacggcgagaaaaatgacaggtcgttggatcaaccgcaagtataggggcctaacattgtgtgacaatggatgatagacttgaattgaccgtgcaagagaaggaacaagatcaaattagggttagtacagttaacagcgaggacaaacacaagtcgttggatcaaccgtaccgcgtggcggccttaatatgagatgatggatgatggacttgaattgcccgccagtgagttatatatatatatagacacagacccatcgaaaatggcactagactttactaaaaacgctaagataaaaaggttttgcctcaaaggccggttgctgctagttgtgatttcggcttgcatgcatgactgattgacagcgcaataaggcctagtcttgtcagcatctaactagataaaaccatacgacctgcgcagttggtgtactgtaccgcgtacacacctaccagtagtagttgccatcccctatggcctacctttacaaagttatcatcagccttttcgcttggttttaatg

SEQ ID NO: 17560 - DNA, 5718 bp, Zea mays
tacaatagcaataaatggaaataatccaagttgtaaaatcatttgcatatattctacgcttcgattgttgattgcaaacatattttcattgagccaaaggtaaaagttcatcaatacatgtcattcttgaaatgggtcctattgaaacacatagatttgctctttttgtcgtgaatttgtcttgtgaagattgaataattagatgaagcaatatccaagggctaaatcataatgaacattctttaccataaaagttgtagttatgcaatagagatgttttttgtgggtatgcaagatagatatctatacccatatagagcacattatctatttgtatcacatttgaaacgaaccggagggattaaaaaaaatctagagggcatgttctcgtggaatttggatatcttccattggaagtgcctctgcatactcttgggattgaatggactatttctgtccacaacatttatgaaataaatcgtggactaaaatgagaatatcttataagtcacatatggtgtgtggaggtacatataatttattttacggaaacgtacgcgttagtatctatctctagcatttacgaaaggaatccattagacagaagttaaaaatgtctttgttttacaatttaaatatatatctcgatacgcagacatttactcgtggagaagacatatatctctaatatttttctcgtacattatgtatctatatatttattaatatatgcataaaagctaaaatgtgtatattttttctcctaagatcataaatcgtgtgagagagatgtactcacaattaatcctatagcactagtatttatctagtggagtttacacatgtagcataccccatccccagcctacccgtttgtagaggctcttcgctttctctgtctggcctcagcgctccacactcttttgcccctttccagttgtgcatgaccccatcccatccctttcaccaccgcccctcttcctcctcccctagctgcacagcccctcgcagccagtttccctcataacccgtcgtccagagggggccgtaagtatctaatctttctttttcctagagagagacgggagggagtcggggactgagagagatgggtgtagaagcaagaattctccccaattctgtgcctgaattgctttcttagactcgggacccctgctagtactagtagtacgtatctgtagaccggagacaggagagggactgtgcgctagtcgcggtactggttaagtgatgctgcgattttctattccctcggtcctgtgatgtggtagatcaacggaatttcgtgtttttttgggcagggaattaagcaaaggtggtggggtggtggccatgctgcaccaccacggtggcgccgggtccccttacatggccccgacgacggctgacacgggcatggacccgttctcgccgacgccggcgacgcggcccgctgtgtctgtcaccgccataccacccccaccgacgatgcagttgcggccggcgggagcgggaccgagtgctgatttcgaggaattgccagcgggcggcgccggcgccggtgccgcggccagcctccaggacgacgacatgcagatgcaggccgactacggcgccagcgccgcgggagcgtccggctcgggcggcaaccggtggccgcgcgaggagacgctggcgctcatcaggatccggacggagatggacgccgacttccggaacgcccccctcaaagcgccgctctgggaggacgtcgccaggtgagaaaaggcactagcaaagccgtaataatccttttcctcccccctctgcccgctgctgcggaatgcggctaacgcgtcggttccacggaattccacctcttctccgtccggcgtcgccggtgaaatgatagcgagctatcctgtcatctatctttttacccgctgctttttggcgtaatgctccccggtttctgtgggattggagcgtagtgaagtggtaggtgcagccagcgcaggcgcaggccggacatctctcggcgcccgggcagggcagccgtctgccgcggcgtgattgtgcgtgcaggcgcaggccgcacaggcatgggcagggtctgcagcctgctgcagtgcactctttttctattcctctcttcctttttaaaaacgcacttgatttggataattggatggatgcaccaagttttcgtgggaggaagctagaggaatgaaaagcatctcgctgcgccgggctgccgctgtcatcaccacttcaattaccttatatatttgtttgttcctcggacacgacgatgccatcaacttgacatcatcaccacatgtctgtgctgattgattcctaacactactgatggctgatgcttccaccgtcgtcgctttacatgtctgtctccgatccgcttccaaattccaattccttccgcgtccgtccagtccctttcaaagaaagaggaagaagaatgatgccaagctttgaccactcacttccacgaaagatactcctccgcacacacacacaacgaagtcatcacctcttgatgactcgtgagtcgtgatggttgagacgtgaacgcgagaaagagctaacaggtgcggccgtgttggggcgcattttttttccatgcaggaagcttgccgggctgggctaccaccggagcgccaagaagtgcaaggagaagttcgagaacgtgcacaagtactacaagcgcaccaaggacgcccacgccgggcgccaggacggcaagagctaccgcttcttctcgccccgggaggccctgcacgccgcggcgccgcagccgcagcccccctcgggcatgaccacggtgcaagctggccctcatcatccgatggcattggcatggacggcgggccctacggcgctgggccctgccgctggcgccggcctgccggacctcagcttctcgtcgatgtcagggtcggagtccgagtacgactcggacgacgacgacgacgatgatgccggggaggagggcctcggcaggggcgagtaccacagggagatgatggcgatcttcgaggggatgatgaagcaggtcacggataagcaggacgccatgcagcgcgtgttcctggagacgctcgagcggtgggaggcggaacgcacggcgcgcgaggaagcgtggcggcgccaggaggtcgcccgcatgaaccgcgagcgcgagcggctcgccagggagcgcgccgccgcggcctcccgcgacgccgcgctgatcgcgttcctccagtgcgtcggcggtggtcaggggcagcccgtgcggctccctccacacagcgccggcgccagtgtcgtgcccgcgccgccaaagccggactgcgcccctccgtcgccccggctcgacgcggctgccacctcgcttcagcagctggtgcccgcgcagctcaaggcggtggaggccttggcgtgggcgggaggcgagggcggcgggtccacgtcgtcgcggtggcccaaggaggaagtggaggcgctgatccaggtgcggaacgagaaggacgagcagtaccatgatgcggggggcaaggggccgctttgggaggacatcgccgccgggatgcgcaggatcgggtacaaccgcagcgccaagcggtgcaaggagaagtgggagaacatcaacaagtactacaagaaggtgaaggagagcaacaagaggcgccccgaggactccaagacctgcccttacttccaccagctcgacgccatgtaccgcaagaaacaccgtggcgacagaggcagaataaccgcagctggaccgaacatgcaggacagcccgagccagcgcgagctcgagggaaagagcagcaacgatgttgacattgacaaccggaagagtgatgaacagggaaacgtgcatacttctcccgtcagcggcaaccgtgatacagcaccaacgaccacccggccgccaggtgacggcgccaaaaacaaggtaaggtcatacattcacggtaaaattttacatatttggaaaaactaactaatcacacaagctaaccaaaatttataattgacgctgtgcagacggcggaggacaacttgaaacgaacgaatgtgcagctcaagcaacaacagcatgagtttggaacggacgagacggacagcgacgacgacatggcaagaaaccacacagcctacactgaagaagacgacgacgaagccaaaataaaatacaagatggatttccagaatcctaatatgatagggagcagcagcaatatgtctgcaccaccaccacccgcagcagcagcagcgacgacggctgcggcaccgacgacttcagctgccccaacgagcaacaccttccttgccgttcagtagagggcaatgctgcaggaccggtgccagctgatcagcagttcagcaccacctttttccggcccataatcaccaagtatacctgccctgcctttgaaccatccgaataccatttattgatttgttctgtgataagtaccagatcatgaaaggttaaaaaaaaactagtagtagtaagactgaagaacagaagaggtaccagaggcgcccaaacagaaagttcttttcttttttcttaccataggtcatgttatactgtagcccattgctcacaattgtacattcttgtgtcagtctgaacttccagtaatcttatccgatagaaatcgatcgtgggatttggagcggtgaatcgaccgtttgtttcaggcataaatgacctttcatttcaatcgctcagataacatattgctgattcatggtgtccaggctagaacttgtttgtatacgctctatcagcacctctgagtaggacatattcccggatactgctaaatatcctgatcaaaatgcctcacacactttacgtcgatcatttatttagcttgttgtatgacatctatgatatgctaattcgtgaaatcatagtcctcttgtttaatgtgtgtgttataaatgtatttggggtaccgtatgggtcccatacgagtatgggcaaaactttggactcatgcatgagtatgagtttcttcttagatacaatttatattagtgtgtttgggtatggttgagtggtacccaatgggtacacggccattgccatctctatctgtaatctgtttccctgcatcggatatggtgctaagtcaatcctaattccaatctctttttcaatgtgaaaactttaggtcatgtcctatttagccgatctttcagagttgattctctgttgaatccatcagaagctctaccaaacgaagcattgattctgtgattctctagtagagtaaataagataccgagagctaaataaagaatagctttttcctaattttataaagtaattcactatcatgcttttgagagttttacttcaagtaaaaaaaatacttctctcatgcaatctccgcttttattttgaattagaattaaatgaaacactacgaagaggttgtagtcagtagtttactcattctatctcttaagctcattctcatcttttattctaaaatttactctatagatagtacaatttattgtataaaataatattttgcacgactcattcggcggagacaaccttactctcatgcctttcacttacctgtcaactgtcattggtaccctcgatatcgacaacgcgcatgggagaacttcgccactaggtgtcactcttcagtggtaccaccaccaccagtggcatcccgactcactacggcgagtctgcag

SEQ ID NO: 17561 - DNA, 4453 bp, Zea mays
  misc_feature (2226)..(2226): n is a, c, g, or t
  misc_feature (4120)..(4120): n is a, c, g, or t
tcggtaccccctggtgagcaggcgccagcggcggctcggcgggcaaccggtggccgcggcaggagacgctggagctgctcaagatccggtcggacatggacaccgccttccgggacgccaccctcaaggcccccctctgggagcaggtctccaggtacgtaactagctacctgaattgcggcatgaatcactcgccacgccgtcgtcccggcgcgccgccgtaacggaattctcgtcggtggaatgccgcatgaaatctcgacggccttcgggaccggcccctggcgccgatttggctagcttcttagctagcaggcccagttaattaattattacttacccggctaaagaacacttctttttactttttcttaaccatccttcacgagaacagtgacttttccattttaaaatagctcgatatcgctctctccttcgctacttttccgggaaaaaaaatcagctctagtgttttaccaagctcttcgtctctccaatacagtaggtacgtagcagtagagtagtagacacggacagcaatattcttcagatccaatggcatcaatcccaagctttatctctttggcctctgaatttctcgcaaaaagatgggaatttttattcccagtttcttcctccccttctgttatgcattcttcttgggatgagcgttgtttagcttactaaaatggttgtatttaattggtatttaattgtgtatatgagtttctttatctttttccatgggtgcccaaatcgagtaaaattctactacatgcatgcaactttagtgtgagggctactacagttgttgcttgtacggttgaaatttgtggtggttggtggtggcgatacgccattgataaggcaattaaggttctcgtttttgttgctaaattcctctgcgatgcaggtcgtcggcaggaagctggctgagaaggggtacaaccgcagcgccaagaagtgcaaggagaagttcgagaacgtgcacaagtactacaagcgcaccaaggagagccgcgccggccggaacgacggcaagacgtatcgattcttcacgcagctggaggccctgcacggcaccggggcggctcccgcgtcggtggcggcgtcgcaggtgccccctgcgatctctggcggggtgtccggggcagcggggccgttagccgtgcgcttgcctgccgagccaccgcctgcggtgtcgggcggcgtggggatgccgatgacgaccgtgggctacccgagcttctcgacgtccaacacggaggactacacggacgaggacgactccgacgacgagggcacagaggagctggtgggtggcggcggggacgagcgcgggaagaggaagagggtgtcagagggcggcgcctcggtcgccggcggaggcagcgggaagatgatgaggttcttcgagggcctgatgaagcaggtgatggagcggcaggaggcgatgcaacagaggttcttggaggccatcgagaagcgtgagcaggaccgcatgatccgcgaggaggcgtggcggcggcaggagatgacccgcctcgcgcgcgtagcaggagatcctggcgcaggagcccgccatggccgcctcacgcgacgctgccgtcctctccttcatacagaagatcaccggacagaccatcccgatgccgtccatcgccgcgcccaccataaacgccatgccaccgccgccgcatccgaagccgccgccgcctcagccgcaccccacacccattgcctccgcctcgccagccccgccgccaccgcaaccaccagcctcgcagactccgcccccgctgcaacagcagcagccctcgccgccacagcagaagccgccaatgccgcaacagcaaagcatggacattgtcatggtgccggccgagacgacgccgcacgccgacatcccggtgcacgaggggtccagtggcggcgcggcgtcctcccggtggcccaaggcggaggttcacgcgctgatacagctgcggagcaaccttgacacccggtaccaggaggttgggcccaaggggcccctctgggaggagatctccgccggcatgaggcggatgggttacaaccggaacgcgaagcggtgcaaggaaaagtgggagaacatcaacaagtacttcaagaaggtgaaggagagcaacaacaagcgccccgagcgtctttccaaaacgtgcccctacttccaccagctcgacgcgctctaccgcaacaaggcancgctgagctcctcctccggcgtcggagccccggtgcacgccaacgcattgccggcaccgcaggagacggtcacggtcgtcacggccgcggcgcccatctcacagacgccgccgccgacacagccttctcagtcccaccactacgctgccaagaacggaggcaccgggaacgggaacggcggcggcgcatcagagcacggctccagaggcatgcaaacgcaggcgagcaacggcagcgttggagccagcaggttcgtcggcgaaggcggcggcgcggcctcggcggcgaagaaggtaagccagtcagcctcataggcgcatgcatgtgcgccctcggtgtggccatagctaaactgcaccgtacatgtggtacctgctattcgttttggtgatccaatgctgattgcataacgctgcacatttaaagccagaggacattatgaaggagatgatggagcagaggcaggcgccgcagcagcagcagcccccctcgcggccgcccggcggccgctataacagaatcgacggcgcggacagcgacaacatggacgacgacgaggaggactatgacgacgacgacgacgacgaagatatcgacggcaacaaaatgcagtacgagatccagttccagcgccagcaaccgcaccatcaccagcagcatccgaatgccgtcaggccgaacgccggcgccggcggtggaaacccgcccggcaccgccgccgctcccagcacggctgcggccccgacaacaacagccggatcgtctttcctgggcatggtccagtgatcgatccgtctgcgcgcacccaggcattatcccccggtgactctcatcctcctccacttctccatggcttcttttctttctctcgctcgcatgtgacatttgtgtctacccacctgtcgcctccatgcatgctcgtccatatctctagttctctacacctctaaaccaaaaatcacaagaactatctccctcagctcctccatgctccggcaattctccattcctcatatatgcacctagcaacacctcgatccatgtcgtgtcgtcgtcgctgctgcatgcctacccccctttttttgattcgttgctgtgttaattatagtggtcgcctctttagatgttacagtaaaaaaatattggcggtgatgcggttatttattgatttgttctggtaattaataagaaccctcaagctttggggtgttcacggagaggttgagttgatgcggtgaaaacagcacgtgaaagggtaatgagagatcgatcgcgcggttaaggagacaaggtgacaagaaaggcagatgacgcagtgggtgtttgcactgttactgcggtaaattttgtgcatgcggctactactctacagtgggctagtttgttgcaagggagctgcggaaaaaaatggaaaagaagagcttgctcgtcatgtgccatgaagaacagtcagtttgatgcatgcgggatttttatatttatccttgttttcccctctttttcatttttcaccatttcttttatgttctgcaacaagtaaactgtccattaagtattacctaagttttttctttctttctttctttctcaaactgctgttaccgaaatttacagtgtatacttgagaaatgttatatgttaaaattcttgctgttaattatatatagtattgcaattgctttcaagtgggattttatatgtcaactgcgtgcctttcattaaaatacatgaagtccattgcgtttgatgataaacttgcacacattcagttctgattatactctaatagtagcagttaatctgtcatttattgcactttttggatttaaatctagtaagggatctcatattgaatataataatactaacatggcaagattggaatacctttganagcatctccaacagtcttaaaatatagggctcaactcataaaaaatagttccaacacttctccattttacaaatttttatcagaaaagatataggacacaccataaagtgacccaaatatacttcacctcatattagtgccctattcttgtttctatataattttcaacattttctttcctaataatgcattttacttcctaaaatacatgatacagggcttgattattggagctcaatttgttttttatgccttaaacactttaaattatgtagtattttaatttttgtggcaccttgttggagatactctgagagattgcgttcacatgca

SEQ ID NO: 17562 - DNA, 2159 bp, Zea mays
aagtttggcctccgtttccagatttttattcaattcttcttaatcaacttttaaaatccggcgactcatagtccgtggtttttggccggcatatccggttttggtgtcgtcggtaaattcctcttcattgcgggcctttttcccagaacttgcagtggaagctggttcattgagaaataatggatgcatttagagatgctatattgcagcgagctccaattgaaacctttgcactcaagactgttcaacactttatacaacctcagaaacaaacaaagttggctcaagatgaaaaccaaatgcttgaaaacatgctccggacattgctgcaggagctagtggctgctgctgcgcaatcaggggagcaaattatgcagtatggtcagttgattgacgatgatgatgatgatgatgatgatgatatacatggacagattcctcatcttctagatgttgtgctttatctttgtgagaaagagcatgtagaaggtggcatgatattccagctgctggaggatttgaccgaaatgtctactatgaaaaactgtaaagatgttttcggttatattgaaagcaaacaagatatattgggcaagcaagagctttttgcacgcggaaaacttgtcatgttgaggacttgcaaccaacttctccgccgactctcaaaggccaatgatgttgtattctgtggaaggattcttatgtttttggctcacttttttccgttatctgagcgctcagccgtcaatataaaaggtgtttttaatacatctaatgaaaccaaatatgaaaaagatcctccaaaaggcatttctgtagatttcaacttctacaagacattttggagtttacaggagtatttctgtaatcccgcttctcttacttccgcatctaccaagtggcagaaattttcatccagtttggcggttgttttaaacacctttgatgctcaaccactaagcgaagaagagggagaggctaatagtttggaggaagaggcagcaacttttaatataaagtacctaacaagtagtaaattgatgggtttagagttaaaggattcgagtttccgacgacatattcttctccagtgcctcattatgtttgattatctaagggcaccagggaagaacgacaaagatctgccatctgaaaccatggaagaacttaagtcatgtgaggatcgtgtaaagaaattgcttgagatcactccgcctaaagggaaagaattcctccgtgcagttgagcatatactggagcgcgaaaagaattgggtctggtggaaacgtgatggatgtccaccatttgaaaagcaaccgatagataagaaatcacctaatgcagggcaaaagaaacggagacaaagatggagattgggaaataaagaactctcccaactttggagatgggcagatcaaaatccgaatgctttgactgattctcaacgcgtgcgaacccctgacattgcagactactggaaaccattagcagaagatatggatccatcagctggcatagaagatgagtaccatcataaaaacaacagagtttactgctggaaaggtcttcggtttacagctcggcaagaccttgaaggattttctaggtttactgaaatgggaatcgaaggagttgtcccagttgaactattgccgcctgaggtccggtccaaataccaagctaaaccaaacgaaaaagccaaacgagcgaagaaagaagaaaccaaaggtggatctcatgaaacagagggaaaccagattggtgtttctaatagtgaagctgaagctgaaggaggaaggggtgatgcagagacgatggagagtgatgctattgcagacactcctacgcctgaggaacagcaaagactcggtggttctgatacagaaaacggtcaagaggccggtcaaatcgaagacggagagacagaagaagctggtctgatggacactgatcttgatcatcctcctatgcccgtctcatgaatacgctttcagtttgtcaaccctttcttcaatggggaatcctttggatatgaagttcaaaagtattgatgtttaacaaattatgttaaaaggtattttctaaatatgtttgtatgagtgcaaatctgctagcttattaaaaaaaaaaaaaaaaaaactcgagggggggcccggtac

SEQ ID NO: 17563 - DNA, 1113 bp, Zea mays
  misc_feature (69)..(69): n is a, c, g, or t
  misc_feature (116)..(117): n is a, c, g, or t
  misc_feature (130)..(131): n is a, c, g, or t
  misc_feature (136)..(136): n is a, c, g, or t
  misc_feature (192)..(192): n is a, c, g, or t
  misc_feature (199)..(199): n is a, c, g, or t
  misc_feature (204)..(204): n is a, c, g, or t
  misc_feature (210)..(210): n is a, c, g, or t
  misc_feature (214)..(214): n is a, c, g, or t
  misc_feature (232)..(232): n is a, c, g, or t
  misc_feature (242)..(243): n is a, c, g, or t
caagttccaggactggaccagaaatgcagataacaaggggaggcctttaccactgcagcgtgccccctngggaccccggatgccttcaacaaaatataaaatggaaggcccatacnngcagggtggcccnntcatncctccagcgctttttcagggaattagttacctcgacaagcgaagcccgctcactcngcagctncaagnttcgcnttgncctgccaattttagagcngacacttacnncaagtacaacggcagcacagatccgaccccccgctccatctgcttccaagtcgtcgttgcatcatctggaggggacaacgccaccatggccaagtccttcatcatcgcgctcgaaggcctagccctaacctggtatactaggctgtcgccactataaatcgagtcatggaagggacttcgtgacaagttcttattgaatttccaagggtacagaccaggcacagatgccttggctgagctatcactctgcaagcagcaagagaaggaaactcttcgagaatactataagaagttcatcacgcacaagtcgcagttttaaccatagtgtcaaccacgtagctctcaccgacccagtggtacaaacaaagtggtcccatgtcccactcaccttcgatgccagagatgtcgacttacgcagtgcaccacacgcagatgccatggtgatcaattgcagggtggcaggttgggatctaatcaaagtattggtcgataatggcaaccaagccgacaacattttcctgcacgccttcgatcgcatgggcatcaaccacagcctcctcaagcccgcagacaaccccttatacggttttggaggcaaaggcaccttccccgttggcaaaatagagctaccgttgtcattcggcacggcgcccaatgcgcgaagcgaacaagtcaccttcgatatagtcgacatggtctacccgtataacaccatcatcaaaactgactccaaggttgtcgccggccaaatcgaaaaagactacttagccaaagtgcacgtgctaatgtagtatcatgctgccattcgaagcctcgagggggggcccggtacccaattcgcccttatagcgcgtcgaaattggaacggga

SEQ ID NO: 17564 - DNA, 1453 bp, Zea mays
  misc_feature (288)..(288): n is a, c, g, or t
  misc_feature (291)..(291): n is a, c, g, or t
ttttcgcaattggaaatagggcaggggcgggaacaaatgaggggaggtcggtgctgggattaagcacgcacaaaaataacattaattctatccggggccgattattgttatagaatggggagggagtgcaatattttacggggggagcagcttggacccataattagccagagtttgaaataaaccccccaaataagagaaaaaaaaattgggggtccctccggggggggggccgctttgaaggaaagggtcccccgaaatggagggagaaagagagacacagagagnaanagccccctcttcccccccccccccccattatagggctccacccgcaggccgccgtgtgggcatagcgggtcgggccacgtctgtaataaagcatgatgtaatgacacgctataacccccgtgaggaaatattctggggataaactaggtaactgagggtctaattgtccttggcagggccgggcggtcccttagttacctataaatacccctgtattgtgccattgtcggggacagaaaaaaaacactgttgccccaacgctttgtgtttagaggcatcaaactgttttccattctctcaccatcggaatttgttgtccccggattagcaagttccaacatttggcgcccaccattcgtgctacgacaaagcatccccgcgatggcccccaagagagcgaatttgaaggccaccgcttccgtcgacaacacagcgaaggcagcgctcctagccgagaagaaaggcaaggctcccattgctgacaacatccttcaggaggccttcgaagatgacgctgtcaacagcaagaggcaacgccaggacaaccaccctatgcccgatggtactgtgcgcacctgcaattccgagggggcaccacgagcaccccccaccaggcttcactcatccaaaaggtgaagacaccgtagaagacggtgcgattatggcatctcggccgaagatcagttaaagctgcgagccctgcgcatcaagaacaaccaccttcaaaagcaaaaagaaatactcgaagccaaacgccagcgcatcaccatgcaagccaaagttcgacaaatgatattggacgaggaacaaaagtctcaggaactagaacaagaaatcgcagatatacaaggcgaaggcccttaccacctgcagcgtggccccctcgtgaccccggatgccttccaacaaaatataaaatgcgaaggcccatacccgcagcgtggccccctcatccctccagccgctttccagggaattagttacctcgacaagcgaagcccgctcactccgcagctccaagcttcgccttggcctgccaattttagagccgacacttaccccaagtacaacggcagcacagatccgacccaatacatcatgagctaccaagtcgtcgtttgctatacacaagaaagttggaacgggaggggggaaaggagtt

SEQ ID NO: 17565 - DNA, 1424 bp, Zea mays
  misc_feature (146)..(146): n is a, c, g, or t
  misc_feature (187)..(187): n is a, c, g, or t
  misc_feature (1180)..(1182): n is a, c, g, or t
  misc_feature (1288)..(1288): n is a, c, g, or t
  misc_feature (1297)..(1297): n is a, c, g, or t
  misc_feature (1308)..(1308): n is a, c, g, or t
  misc_feature (1317)..(1318): n is a, c, g, or t
  misc_feature (1405)..(1405): n is a, c, g, or t
gggacggatttgaaggcccccgcgttcgttgaaaacccagggaagacagcggtccaagccgaggagaaaagcaagggcttccattgctgacaacatactttcaggaggccttcgaagatgacgctgtcaccagcaagaggcaacgnccaggacaacccaccctatgcccgatggtactgtgcgcacntgcaattccgaggggggcaccacgagcaccccccaccaggcttcactcatccaaaaggtgaagacaccgtagaagacggtgcgattatggcatctcggccgaagatcagttaaagctgcgagccctgcgcatcaagaacaaccaccttcaaaagcaaaaagaaatactcgaagccaaacgccagcgcatcaccatgcaagccaaagttcgacaaatgatattggacgaggaacaaaagtctcaggaactagaacaagaaatcgcagatatacaaggcgaaggcccttaccacctgcagcgtggccccctcgtgaccccggatgccttccaacaaaatataaaatgcgaaggcccatacccgcagcgtggccccctcatccctccagccgctttccagggaattagttacctcgacaagcgaagcccgctcactccgcagctccaagcttcgccttggcctgccaattttagagccgacacttaccccaagtacaacggcagcacagatccgacccaatacatcatgagctaccaagtcgtcgttgcatcatctggaggggacaacgccaccatggccaagtccttcatcatcgcgctcgaaggcctagccctaacctggtatactaggctgtcgccactataaatcgagtcatggaagggacttcgtgacaagttcttattgaatttccaagggtacagaccaggcacagatgccttggctgagctatcactctgcaagcagcaagagaaggaaactcttcgagaatactataagaagttcatcacgcacaagtcgcagttttaaccatagtgtcaaccacgtagctctcaccgacccagtggtacaaacaaagtggtcccatgtcccactcaccttcgatgccagagatgtcgacttacgcagtgcaccacacgcagatgccatggtgatcaatttgcaggggggcaggttgggttctaaatcaagtattggtcgataatggcaaccaagcnnngacacatttcctgcacgccttcgatcgcatgggcatcaaccacagccctcctcaagcccgcagacaaccccttttatacgtttggaggcaaaggcaccttccccgntggcaaatnagagctaccgntgtcattcnngcacgcgcccaatgcgcgaagcgaacaagtcaccttcgatatagtcgacatggtctacccgtataccacatcatcaaactgactccnaggtgtcgcgggccaatca

SEQ ID NO: 17566 - DNA, 1128 bp, Zea mays
  misc_feature (771)..(771): n is a, c, g, or t
aactcatttcacccctccagttcccactttcttgtgtttatgctattggacgaggaacaaaagtctcaggaactagaacaagaaatcgcagatatacaaggcgaaggcccttaccacctgcagcgtggccccctcgtgaccccggatgccttccaacaaaatataaaatgcgaaggcccatacccgcagcgtggccccctcatccctccagccgctttccagggaattagttacctcgacaagcgaagcccgctcactccgcagctccaagcttcgccttggcctgccaattttagagccgacacttaccccaagtacaacggcagcacagatccgacccaatacatcatgagctaccaagtcgtcgttgcatcatctggaggggacaacgccaccatggccaagtccttcatcatcgcgctcgaaggcctagccctaacctggtatactaggctgtcgccactataaatcgagtcatggaagggacttcgtgacaagttcttattgaatttccaagggtacagaccaggcacagatgccttggctgagctatcactctgcaagcagcaagagaaggaaactcttcgagaatactattagaaggtcatcacgcacaagtcgcagttttaaccatagtgtcaaccacgtagctctcaccgacccagtggtacaaacaaagtggtcccatgtcccactcaccttcgatgccagagatgtcgacttacgcagtgcaccacacgcagatgccatggtgatcaattgcagggtggncaggttgggatctaatcaaagtattggtcgataatggcaaccaagccgacaacattttcctgcacgccttcgatcgcatgggcatcaaccacagcctcctcaagcccgcagacaaccccttatacggttttggaggcaaaggcaccttccccgttggcaaaatagagctaccgttgtcattcggcacggcgcccaatgcgcgaagcgaacaagtcaccttcgatagagtcgacatggtctacccgtataacaccatcatcaaaactgactccaaggttgtcgccggccaaatcgaaaaggaatacttagccaatgtttaaacacaatgaaatgggaacgggaggggggaaaggagtt

SEQ ID NO: 17567 - DNA, 723 bp, Zea mays
  misc_feature (688)..(688): n is a, c, g, or t
aataacccatccaacccaaaagcatacaatacaatgtctactcttgttttattcctccaacttttttccatcctaccattagcacttgggttgaaccacccaaattgtgacctgaccaagactcaagaccaaggctctaccctaagaatcttccacatagacagcccttgctcccccttcaaatcatcatccccactctcatgggaagcgcgtgtgctccagactctggctcaagaccaggcccgtctccagtacctgagcagcctcgtcgccgggagatctgtagtccccattgcctcagggcgtcaaatgttgcaaagcactacatacattgtcaaggctttgatcggtactccggctcagccactgctcctagccatggacacgagcagtgacgtggcttggattccttgctccggttgcgttggctgtccttctaacaccgccttttcccctgccaagtctacctccttcaagaatgttagctgcagcgctcctcagtgtaagcaggtaccaaaccccacgtgtggagcacgcgcgtgctctttcaacctcacctatggaagctcctccattgcggctaacctctctcaagacacgatccgtcttgccgccgatccgatcaaagcctttacatttggatgcgtcaacaaagtcgccggtggaggaaccatcccaccaccctcangcttgttgggcttgggacgagcccactttcactca

SEQ ID NO: 17568 - DNA, 1100 bp, Zea mays
tcactagtcccccccccccccccccgagtaataatcgcctatctcactgactcacccaaagcccgaccaaaagcttttgattcctcaagagtgaaaatggcgtcgtacacagtctcctttatccctttgacgctctctaatcctcggatctttgtttcgagacagaatggatctccctcgtcttcttctcggattcctctaacgtcttctctgttaggtaagaagcttctggcgacacaaccgtcgcatcgctgcttcgtccccaagctccggtgcttgacctcggccagcacggtcttaaacgtccctattgcgcaaccggagaatggttcttcggataagatcccaaaatggtcggcgagagctataaagtcacttgcaatgggagaattggaggctaggaagctcaagtatccaagtaccgggaccgaagccattctcatgggtattttagtcgaaggcactagcacagttgctaagttcctgagggggaatggagtcacacttttcaaggttcgagatgagacgttaagcctgctggggaaatcagacatgtactttttcagcccagagcatcctcctctaactgagccggctcaaaaggccattgcctgggccattgatgagaagaataaatctgatgtggatggggaactaaccacggcctacttgcttctgggggtttggtctcaaaaggattcagcaggccgccagattttggagaagctcgggtttaacgaagataaagccaaagaagttgagaaatcgatgaatgaagatgtagatttgagcttcaagaaacaaggtcaatagtgatgaggtttatatcgattagaaaagcttctgtaactgtatatggagtagcaaaagcaactcttgattaaagactcggccaaagaccccactttcattagtattcactttccatacttgtttgtggttagtgtcatttagcttttccgcattatcacaatatacaactctggcaaatgattcagtgctttggttctcaaaaaaaaaaaaaaaaaaactcgagggggggcccggtacccaatttgtttaaacacaataaagtgggaacgggaggggggaaaggagtc

SEQ ID NO: 17569 - DNA, 809 bp, Zea mays
  misc_feature (688)..(688): n is a, c, g, or t
  misc_feature (773)..(773): n is a, c, g, or t
  misc_feature (793)..(793): n is a, c, g, or t
tcgtgctgagctcactagtcccccccccccccccccccgattattcacttaagtatatagtagcttccataagagtcttagttctaactataaatacacatatctcactctctctgatctccgcttctcttcgccaacaaatgtcgaccgctcctctctccggcttctttctcacttcactttctccttctcaatcttctctccagaaactctctcttcgtacttcttccaccgtcgcttgcctcccacccgcctcttcttcttcctcatcttcctcctcctcgtcttcccgttccgttccaacgcttatccgtaacgagccagtttttgccgctcctgctcctatcattgccccttattggagtgaagagatgggaaccgaagcatacgacgaggctattgaagctctcaagaagcttctcatcgagaaggaagagctaaagacggttgcagcggcaaaggtggagcagatcacagcggctcttcagacaggtacttcatccgacaagaaagctttcgaccccgtcgaaaccattaagcagggcttcatcaaattcaagaaggagaaatacgaaaccaaccctgctttgtacggtgagctcgcaaagggtcaaagtcctaagtacatggtgtttgcttgttcagactcacgtgtgtgccagggccgccggaaatcaccgagatccgncgcgtcagcgccactgccgccgcaactttttgccagttaatttcatcgcttactgggaaaaagttgtcccaggttgcgccagtanagctttcatcacctcatggncatgatcactcgttga

SEQ ID NO: 17570 - DNA, 1285 bp, Zea mays
  misc_feature (2)..(2): n is a, c, g, or t
  misc_feature (1223)..(1224): n is a, c, g, or t
  misc_feature (1227)..(1227): n is a, c, g, or t
  misc_feature (1233)..(1234): n is a, c, g, or t
  misc_feature (1277)..(1277): n is a, c, g, or t
cnaaacaagtggatcccccgggctgaggagaaaagagaactcactagtcccccccccccgggtgtcataagcgtttactgtgagtctctcaaagaaaccaaaggcagagaaaagagataacacacacaaaaaaaaatggcatcaacctcactcctcaaggcttctccggtgttggacaaatccgaatgggtcaagggacaaagcgttctcttccgtcagccttcttccgcttctgtcgtcctccgcaaccgtgccacctccctcaccgtccgtgccgcttcctcctacgccgatgagcttgttaagacagcgaaaactattgcgtctcccggacgtggaatcttggcgatggacgagtcgaacgcgacttgcgggaaacgtttggattcgatagggctagagaacactgaggcaaatcgtcaagctttccggactttgctggtctctgcaccgggactcggacagtacgtctccggcgcaattctatttgaggagactctgtaccagtctaccaccgaaggcaagaaaatggtcgacgtcctcgtcgagcagaacattgtccctggtatcaaagtcgacaagggtttggtgccacttgttggatccaacaatgagtcatggtgccaaggactagatggtctatcagagagagctcactagtcccccccccccccggacactgtccggtggtgcaccggacagtccggtgaattatagcgaagcgcctctgaaaattcccgaaggtgaagagttcagcttggagtcccctggtgcaccggacactgtccggtggtgcaccggacagtctggtgcgccagatcagggtgccttcagttatcccttgctctctttgtttgaacccttttcttggtctttttattggcttagtgtgaacctttggcgcctgtataacttatagactagagcaaaactagttagtccaattatttgtgttgggcaattcaaccaccaaaatcaattaggaaataggtgtaagcctaattccctttcagaggggcgggagtcaagagagtgcatggtcaccactcaccacctacctttcattcaacgggcggtgcttagaccgaccttagtgtgagcattccggagccagacgcttaccgtgacccatggccagccaagcggaaccccgagaagggtggaggtaacgaaaccctctcgactaaatactacttttgaaaaaccgcggggtgacgactaannacnatttgnngcaaacacggaacgggacccctacttatggcggcctgactggntcaaaacg

SEQ ID NO: 17571 - DNA, 1130 bp, Zea mays
  misc_feature (1)..(1): n is a, c, g, or t
nagggcaggggggctggcggggggggtgggacgtggcctcgggtgggagggggtggaggccgcccggccgcggcgaccgtagacactatcctcgacctcagaaattcatacgagggtgttggagggcgggaagaggggcggagggggggggcggagaggggttcgggggcgcgcgggggggagggggctgggacaggctggtcgtcgcggcatagcggggatctcatcttgccgcatcaaggtgtgcagggggatgcatacaacgcccgggcagagggggggtcagcgccgcttatcggattgtgggagcccggggaggggggaccagcgtgtgattcggagggggatgggagaagggggggggaggcgtgagaggggggggagggcgatgtgctagcgcggggagaggtgtttggcgcgtggacggtgccgccgtttcgggggttaggcgttcgttgggagggccgggaatctctggggggcgcccgggagccaaggcccttttagatctcttgtatgcactgggggggggtgaaggtggcccccgggggggcgagggagggggggagcccccctggcccccccccccccccccccgaaagaaattaaaagtgttcttgttgctgtagaacacaaacagaacaaacaaaaaatcaattgaagagtctctcagtcgttaggggaagcaaatagagaaatggctagctttactgcctccgcttccacagtctccgccgctcgtccggctctccttctcaagcctaccgtcgccatctctgctcctgttcttggtttgcctccaatgggtaagaagaagggaggagtgagatgttcaatggagacaaagcaaggaaacgtctcagtcatgggggctagagtttcagctgcagcaacagctgctttgacggcggtgatgagcaatcccgcgatggctttggttgatgagaggatgtcaacagaaggaacaggattaccctttggtctaagcaacaacctcttgggttggattctgtttggagtctttggtttgatctggactttcttcttcgtctacacttcatctctcgagggggggcccggtaccccattgcccccctaaaggggagccgattacaattcccgggccggcg

SEQ ID NO: 17572 - DNA, 808 bp, Zea mays
gccggcctgtgcggcgctcgagccggccgggccgggatcaacaacagccctacaacttactgcttgctctagctagctagctgctcccggcccatatccactacacaagtaggctagcagcagcagcagcaatggcctcggtgacgaggttcccggccgtggccctcgtcctgctgctcgccgccagcgccttcctggccagcgaggtggcggcgtgcggcggctgcccgaaaccaactcctcctccatcgccaccaccgccgtcgcccaccagcacgccgtgccctccgccgccgtccagctccggcggcaagtgccccaagaacgcgctgaaactgggcgtgtgcgccaacgtgctgggcctcgtcaaggtgtccatcggcaaggtgcccaccgactcgtgctgcccactgctggacgggctcgccgacctggaggccgccgtctgcctctgcaccgcgctcaaggccaacgtgctcggcgtcaacctcgacgtccccgtcaagctcaccctgctcctcaactactgcgggaagagcgtccctcagggcttcctgtgcgcctaatatatatactagtggctagttcgtcactagcttcagttgccatgcatatttgtgattcttcttctttccttctagttcaccactgtatgtacgagcctcctccggatgttttctttggtattgccttctcttctactcttctcctaacttgcttgcattatacattgcgtgagcatgataatatataaatcattgggtgcaaaaaaaaaaaaaaaaaaggcccctaggggcgcggccgctct

SEQ ID NO: 17573 - DNA, 791 bp, Zea mays
cattgggacctcgaagccggccggccgggaacacagccctacaacttactgcttgctctagctagctagctgctcctggcccatatccactaggagtacacaagtaggctagcagcaatggcctcggtgacgaggttcccggccgtggccctcgtcctgctgctcgccgccagcgccttcctggccagcgaggtggcggcgtgcggcggctgcccgaaaccaactcctcctccatcgccaccgccgccgtcgcccaccagcacgccgtgccctccgccgccgtccagctccggcggcaagtgccccaagaacgcgctgaaactgggcgtgtgcgccaacgtgctgggcctcgtcaaggtgtccatcggcaaggtgcccaccgactcgtgctgcccactgctggacgggctcgccgacctagaggccgccgtctgcctctgcaccgcgctcaaggccaacgtgctcggcatcaacctcgacgtccccgtcaagctcaccctgctcctcaactactgcggcaagagcgtccctcagggcttcctgtgcgcctaatatatatactagtggctagttcgtcactagcttcacagttgccatatgcatatttgtgattcttcttctttccttctagttcaccactgtatgtacgtgcctcctccgatccggatgttttctttgggattgccttctcttctactcttctcctaacttgcttgcattatacattgcgtgagcacgataatatataaatcattgggtctaaagcaaagcagaaacacgccccttccgcc

SEQ ID NO: 17574 - DNA, 1950 bp, Zea mays
  misc_feature (420)..(420): n is a, c, g, or t
  misc_feature (431)..(431): n is a, c, g, or t
  misc_feature (1923)..(1923): n is a, c, g, or t
aggcagagcgattgccgtaacgatcccatcggctgtcctgtcagccgcgttcatcaaaacaattaaacactatactttgatgctctctagagcttgaagtcgggtgatgtagcgcattaaatccaaggaacggccggggtgctctctccctccaatattcctacgtcctagggaacccgagggatcaaccaaggttgaagcccccggggtttagcgcaagttgtcccgttcggggggaacagtacctaacgctttccatcggtggagccgtcctgaagctattcatgtctgccacggtgcgttagcgtgctccatgttctgcgcgcatcaaagatggaatttgaatccagccaacgctaggtagcgctctaaaggttcctcaagttttactagggagcagagaagcatataataacgccnccaaaactaangagagctcactagtccccccccccccggcctcacacttaggatcttcactttctcgcactttccctctcattttcccgatcatagaaacagcattgtacagagatttcaaagaatgtcactttgctcttccttcaacgtattcgcttcctactcaccaaaacccaaaaccatcttcaaagattccaaattcatttcacaatttcaggtaaagtcgtctcctttagcttcaacattccacacaaatgaatcctcaacgagtcttaagtataagagagcgagactcaaaccaatttcatctctagactcgggaatttcagaaatcgctacatcaccttcattcaggaacaaaagccctaaagatataaacgttttagtggttggttcaactgggtacataggtagatttgtagtgaaagagatgatcaaaagagggttcaatgtgattgctgttgcgagagagaagagtgggattagaggcaaaaacgacaaggaagagactttgaagcaattacaaggcgccaatgtgtgtttctctgatgttactgagttagatgttcttgagaaatctattgagaatctaggatttggtgttgatgttgttgtttcctgtctcgctagtcgtaatggagggattaaagattcgtggaagattgattatgaagctaccaaaaacagtcttgtagctgggaagaagtttggtgctaagcattttgttttgctctctgcgatttgtgtgcagaagcctttactggagtttcagagagcgaaactgaagttcgaagcagagttgatggatttggctgagcaacaagactctagctttacatacagcattgtgagaccaacggcttttttcaagagcttaggtggtcaagttgagattgtgaaagatgggaaaccttacgtgatgtttggagatggtaagctatgcgcttgtaaaccgatcagcgaacaagatttagcagcgtttatagcggattgcgtgttggaagagaacaagatcaatcaagttttgccaattggtggaccaggcaaggcattaacgccattagagcaaggagagattctgtttaagattcttgggagagagcctaagttcttgaaagtacctatcgagattatggattttgtgattggtgttctcgattctattgcaaagatctttccttcggttggagaggctgccgaatttgggaagattggaaggtattacgccgcagagagtatgttgattcttgatccagagactgaagagtatagcgaggagaagacaccgagttacgggaaagacacgcttgaggatttctttgcgaaagtgatcagagaaggcatggcgggtcaagaactcggtgaacagttcttctagtatgaattgtttttgtgcgaaatgagtttgctgtgtagtttgtaactgatgagattataaatataaaacctgtgaatttgagaaaaaaaaaaaaaaaaaaaactcgagggggggcccggtacccnatttcgcctatagtgagtcgattacat

SEQ ID NO: 17575 - DNA, 630 bp, Zea mays
atctcttgattccaatccattatctcttcctgtatccagttctgtaggggaaatggccactgttactactcaagcctcggcctcgatattcagaccatgcacttcaaagccaagattcctcaccggttcttccggcaggttgaaccgagatttgtcgtttaagtcaatcggctcatcatcctcaaagacggcctcgttcaaggttgaagctaagaaaggagaatggttgcccggtttggcatctcctggttatctcaacggcagtcttgccggggacaatgggtttgacccattgggacttgcagaggatccagagaacttgaagtggttcatccaggcagagcttgtcaacggacggtgggctatgcttggcgtcgcagggatgcttttgccggaagttttcaccaagatcggaatcatcaacgttcctgagtggtatgatgctggaaaagagcagtattttgcatcatcatcgacattgttcgtgatcgaattcatattgtttcattacgttgagatcagacggtggcaagacattaagaaccccaggaagtgtgaaccaagaccctatcccctcgagcaatacagcttgcctccaaatgaaagtggttaccctggaggaaatcttac

SEQ ID NO: 17576 - DNA, 640 bp, Zea mays
aacatctatccatctatttcgatcaaaatctctctctctcctcagctttttgtgtgacgcaacactcgtggggaaatggccgccgcagtttccaccgtcggtgccatcaacagagctccgttgagcttgaacgggtcaggagcaggagctgcttcagtcccagctacgaccttcttgggaaagaaagttgtaaccgcgtcgagattcacacagagcaacaacaagaagagcaacggatcattcaaagtggttgctgtcaaagaagacaaacaaaccgatggagacaggtggaagggacttgcctacgacacgtctgatgaccaacaagacatcaccagaggcaaaggtatggttgactctgtcttccaagctcccatgggaaccggaactcacaatgccgtccttagctcctatgagtacattagccaaggtcttaagcagtacaacttggacaacatgatggatgggctttacattgctcctgctttcatggacaagcttgttgttcacatcaccaagaacttcttgaccttgcctaacatcaaggttccacttatttttgggtatttgggggaggcaaaggtcaaggtaaatccttccagtgtgagcttgccatggccaagatgggcatcaacccaat

SEQ ID NO: 17577 - DNA, 1112 bp, Zea mays
gggcgctttaaaatagggatcccccggccccaggattggcccgaggaaaaaaaaaaaaaaaaaaaaaaaaggtccctttccccccccccgtcagtatggaaacacttggttccacatctggtcgacgattaccgcgtcgtcctctacgacaacatgggagccggtacgaccaaccctgactatttcgacttcgatcgttactcaaatctcgaaggctactctttcgatttgattgcaatcttggaagatctcaagattgagtcttgtatctttgttggccactctgtttctgccatgattggtgtcttggcttctcttaaccgtcctgatctcttctccaaaatcgtcatgatctcagcttctccgagatacgtaaacgatgttgattaccaaggtggattcgaacaagaagacttaaaccaactattcgaagctatccgaagcaactacaaagcatggtgcttaggtttcgctccactcgccgtcggtggcgacatggactccatcgccgttcaagaattcagcagaacactcttcaatatgcgtcccgacatagctctctccgtcggccagaccattttccaaagtgacatgagacagatcttaccttttgtcactgttccgtgtcacattctccaaagtgttaaggacttagctgtaccagtcgttgtctccgagtatcttcacgccaatcttggctgtgaatccgtcgtggaggttattccttctgatggtcatcttcctcagcttagctcaccggattctgttattcccgttatcctccgtcacattcgtaatgacattgctatgtgattataagagatttaattagttaactattaaacgatgtaagaaaaaatgaaaataaatttctgatgtgatatgtctgtctagtctattgagaacattgtttcgttgtcttttggttctgattcgtttatcttgagtatcttgatctttgttgttcttatcttgttaaacgaaaagtctctgtcttctgtccacagctttgttcagagctcattattgctcgatgtaatagtgatgttcgtaattgatggtcaaaaaaaaaaaaaaaaaaactcgagggggggcccggtacccaatccgtg

SEQ ID NO: 17578 - DNA, 1702 bp, Zea mays
  misc_feature (1)..(1): n is a, c, g, or t
nagagagagaggagagagaggacttccctagttccccccctagtcccccgacaaactcaaaacacagagaacagagagagagagagagactccattgttgaagtgtgttcactgaactcctcctcaaacaacaatggcgacgacggttacactcaaatccttcaccggacttcgtcaatcatcaacggagcaaacaaacttcgtctctcatgtaccgtcatcactttctctccctcaacgacggacctctctccgagtaaccgcagccagagccactcccaaactctccaaccgtaaactccgtgtcgccgtcatcggtggtggaccagcaggcggggcagctgcagagactctagcacaaggaggaatcgagacgattctcatcgagcgtaagatggacaattgcaagccttgcggtggcgcgattcctctctgtatggtcggagaattcaacttgccgttggatattattgatcggagagtgacgaagatgaagatgatttcgccgtcgaacattgctgttgatattggtcgtacgcttaaggagcatgagtatataggtatggtgagaagagaagttcttgatgcttatctgagagagagagctgagaagagtggagccactgtgattaacggtctcttccttaagatggatcatccggagaattgggactcgccgtacactttgcattacactgagtacgatggtaaaactggagctacagggacgaagaaaacaatggaggttgatgctgtcattggagctgatggagctaactctagggttgctaaatctattgatgctggtgattacgactacgcaattgcatttcaggagaggattaggattcctgatgagaaaatgacttactatgaggatttagctgagatgtatgttggagatgatgtgtcgccggatttctatggttgggtgttccctaagtgcgaccatgtagctgttggaacaggtacgtgactcacaaaggtgacatcaagaagttccagctcgcgaccagaaacagagctaaggacaagattcttggagggaagatcatccgtgtggaggctcatccgattcctgaacatccgagaccacgtaggctctcgaaacgtgtggctcttgtaggtgatgctgcagggtatgtgactaaatgctctggtgaagggatctactttgctgctaagagtggaagaatgtgtgctgaagccattgtcgaaggttcacagaatggtaagaagatgattgacgaaggggacttgaggaagtacttggagaaatgggataagacatacttgcctacctacagggtacttgatgtgttgcagaaagtgttttacagatcaaatccggctagagaagcgtttgtggagatgtgtaatgatgagtatgttcagaagatgacattcgatagctatctgtacaagcgggttgcgccgggtagtcctttggaggatatcaagttggctgtgaacaccattggaagtttggttagggctaatgctctaaggagagagattgagaagcttagtgtttaagaaacaaataatgaggtctatctcctttcttcatctctatctctctttttttgtctgttagtaatctatctacactaatgttgttactcttcaatgtattcagtatcatatttatgttttctgttcaaaaaaaaaaaaaaaaaaaactcgagggggggcccggtac

SEQ ID NO: 17579 - DNA, 718 bp, Zea mays
  misc_feature (709)..(709): n is a, c, g, or t
caaacaaatctcttctaaaaattattccaagcagcagacaaaaatggctcaagcaatgacttcgatggctggtttacgcggtgcgtctcaggctctccagaccaatgactcaaaccgtctgagcatctctagagtcaccgttgggtctaagagaaccgggcttgtgatcagggctcagcagaacgagtcggtgccggaaagtagtcgccggtcagtgattgggctcgttgctgctggtttagtcggtggttcgttcgttaagtctgccgtcgccgctgaagctcttgctattaaagttggtcctcctccacctccttccggtggtctacctggaacagataactcagaccaagcaagagacttctcactgaagttgaaagacaggttttacttacagccattgtcaccaacagaagctgcagctagggccaaagaatctgctaaagagatcatcaacgttaagactttgatcgacaaaaaagcttggccttacgttcagaacgatctccgtttaagagcatcgtacctccgttacgatcttaacaccgttatctccgctaagcctaaggaagagaaacaaagcctcaaagaactcacggcagctcttccaaacatttgacactggactaattgcgcgagtcaagagcagccggatgctgagagattactcaagaactgctcgagtttgaacatggtcttgcaagattgntaaaggaaa

SEQ ID NO: 17580 - DNA, 1143 bp, Zea mays
aactcctttcccccctccagttcccatttcattgtgtttaacaattgcggtgatattcacgtggagggcgataagacgcccggagagcaccgtcagagaaggcagccgaagcgtaggattcacaatgctgaaacgtctagtgctgctgctgctgcttctcagtcgaatctagcttcttcggtgctcccggaagtttcttcgcctcgtgaggataatgcggtgcaagatgttgtggatcagttctttcaacctgttaaacctactttggggcaaatagttagacagaagcttagtgaaggaaggaaggtaacatgccgtcttcttggagtaattcttgaggaaacaagtccagaagaactccaaaaaagcgacagtgaggtcatctgttttggaagttctactagagattacaaagtatagtgatttgtatcttatggaaaaagttcttgacgatgaaagcgaggccaaagttttacaggctttagagaatgcaggagtttttacatctggtggtttagtcaaagataaggtgctcttttgtagtacagagataggaagaacttcctttgtcagacagctagaacctgactggcatattgatacaaacccggaaatcagcacacaactagctaggttcatcaaatatcagcttcatgtcgctacggtgaaacccgagcgaacagctccaaatgtgttcacctcgcagtcaatagaacagttctttggaagtgtttaatatcaacaaaaaaagagaggtgaaagatattacgttgtcctgacttaagcatcgttgatccagtgtctcttaggctgaaacttgaaacttgtttttcatttttctttgattgtgtctaaattaaagtttgatatacatttggagttagatattactgcgagtgcctctgtgaaagtatccaagtttgtaatttttgtattagcaacttagcaaaattctttaagaaataaacaaatgtccgttgtttagtcattagttcatcgacgaagtgtggattagttctatatcgtaatgcttaaagaaaataagacttgcttataaaaaaaaaaaaaaaaaactcgagggggggcccggtacccaattcgctgtttaaacacaataaagttggaacgggaggggggaaagta

SEQ ID NO: 17581 - DNA, 1618 bp, Zea mays
  misc_feature (1)..(603): n is a, c, g, or t
  misc_feature (607)..(607): n is a, c, g, or t
  misc_feature (612)..(613): n is a, c, g, or t
  misc_feature (620)..(620): n is a, c, g, or t
  misc_feature (629)..(629): n is a, c, g, or t
  misc_feature (631)..(631): n is a, c, g, or t
  misc_feature (633)..(633): n is a, c, g, or t
  misc_feature (635)..(635): n is a, c, g, or t
  misc_feature (637)..(637): n is a, c, g, or t
  misc_feature (644)..(644): n is a, c, g, or t
  misc_feature (647)..(647): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagancgagnnaaaaganagtagaganananananagctcantanttccccccccccccccgaatgggagagagaatgttctacttcttcttcttcttcttcttcttcttcttcttcctcctctctcgtcggatctctctgatttagtgatttttcaaatttcaagttttcttcacctttaattttgtgtctcgttgatctctctttggacattctgctttggattctggaggcttctcattagatctctattagtgggtttaggtcaagttcttgaaatggataaggagaaatctcctgcaccaccacctagtggaggtcttcctccaccatcgggtcgttactctgcgttttcacctaatggaagtagctttgcaatgaaagctgaatcatcttttcctcctttgactccaagtggaagcaatagctcagatgctaaccgattcagccatgatattagccgaatgccggataatccacctaagaacctaggccatcgccgagctcattcagagattcttactcttcctgatgacttaagctttgatagtgatcttggtgtggttggtgctgctgatggaccttctttctctgatgatactgacgaggacttactctatatgtatcttgatatggaaaaattcaattcttctgctacatcgacttctcaaatgggtgagccatcagaaccgacttggaggaatgaattagcctcgacttctaaccttcagagtacacccggtagctctagtgaaagaccgagaattagacaccaacacagccaatcgatggatggttcaacaactatcaagcctgagatgcttatgtcagggaatgaagatgtgtctggagttgactctaagaaagccatctctgctgctaaactttctgagcttgctctcattgatccaaaacgcgccaagaggatatgggcaaacaggcagtctgctgcgaggtcaaaagaaaggaagatgagatacattgcagagctcgagggggggcccggtacccaattg

SEQ ID NO: 17582 - DNA, 1355 bp, Zea mays
tgcagattcgccccagaggagaggagagagagagagaggtcccttttttttccccccccccccccccccgatcggccttgttcgtcgtctttttcttcttccgcttgagtggcttcgggtcagatttaaaaggaagtaaaaatgagaagacagggaaactttgcggactcatcacctgccagtgcatatggagctggacagatacaggatccccattctgattttcaaggtcaattagaggcattcacgcctgagagggatcagccatattcagattcacaagctgagggtcaatggagatgggaaagagatggccctaatatgtcaaggccaatggctactgccgtttacaatgaaggacaacaaggtgttgattcatcgaggacgtattaccgtggccaaatagatccaaaatcaggaatggagaagcaaggcagtgatccaagagctcaaccacaacaccaagaaaatccaaaaaccggttatgataataaccgtggggtgcagacatttgaaggtcttgaacagaagttcatggatgatataacaagactagcaaaagatcaaatcgaagcagaggatgcagagatcgccagacatcgagagaaaataaacactataaacgctagatacgaagaacagttagctacacttagagcacggcacacaggtaagagagaagagatcatgaggaaagaatcactagctaggcagcaacaattcaagcagcaaaccatggggatgatggaccaataccatccaaacgtggttggtcaggccaatctaatgccatctggtcatccccaaggctacattggcagtgctcaagatccagcggctgtggcggatgcaccaccaagatcatatggctcagatcggtttgaagcatacggagagagagctaggtttcagggaggaaacagagatcacgggttcgagcctaggggtccataccctggtgggaatgtctatgacaccagctcacggttctactgatgtgatattacttgaacatattgtgttttaggggattcactcactcccactttttttgtggctttatagatcaaaatcaagcttttcagactatccggaatttgaaaatgaaatcagggttccattttttaatcctgacgagagcattttagaattgaaaaaaaaaaaaaaaaaaactcgagggggggcccggtacccaattcgcccctataggggggccggaattacaatttcacctgggccgtcggtttttaacaaggtcccgggactgggaaaaacccctgggcgttaccccacacttaatcggccttggcaggaaattcccaccctttcggccggttggggggaaataagcgaaa

SEQ ID NO: 17583 - DNA, 2959 bp, Zea mays
tcggtaatctttccttataactttcagaaattttagttagtgttattgtcatcttgtatacactgtgttttcttactctatattgagtgtaattaacaaggtatacatacgtataaacatgcaaattttattggatatagttggtgatctacacaagaagtgtagctatgtttgagtcattgaggaatggagtaattccatttatttacagcgtgtttagtttggggaatgaagtggtccattatcttttcgctcactttcatgtttggtttgtagaatggaatacgtttgattcatcaccatttcattccttataaactaataattagtaataatatgagaaataggttcatttcaccaaaattgtgaaatagactcataatgcatcaccttatataaaatggattgattctttaaatcaaacactccttaatttctagggtagtatctgaatcaggttcactttgtaaaaaaaaaaagatgaatggaaggctcctttgcatatagtatatgactggccggtaaatactagcaggttcgtgtatttcttttttagttttattattactatatatgttttattatttgatgaattattttcgtgtaatgtgtccaaggaaaccgtcgagaaacaattatgtggataatacgttgcgagcacatatgacatatgtggtcagtcaggttctaaaagaagtggtcaagagcgacttaaagtatgtaaataatatacataaattgtttattacccttgtgttcgtttacacgcgctatttatatattcatgttttttttcgttcattcgaagcttgagcgaaggaaggaacagatcgtcctaccaatgaaataacccaaaacaatttaagagctattgccagggttaaatatttctatggtgaaaagctacaccctctgctctaatataagatgggttcattacaaatatacttgttgtaatatataagctcttttaaaatataaatttatactatattttaattgatcaatggagagagatgtgtgtgtgtgaagttggaaatcgggactagatgcttccccaactgagtatgcaagctatcggacagagtgacagtatacgacggtaccatgtgattgcataaaaacattaatcaagagaaaaatatcaatcgatcaagagggaatattgaaaaactaaatagtagccaagttgtgcatctagatataggtcgtatgtagatattttatgaaaactaacaatgtttagtaatttgttaaaatagagaaaaatatcatacatgaatcaagacggaacaagcctgttattatggtcgaccttgtagtacggtaggtcatattaagtatattatatatattgttctattttattttaacgacgcgccacggtttacacgttgtgcgtgcgtccctggtttgatcatccttatcaggaacggtacggaaccttccccctctctgccggcggtcccactcccaccacacaacacaacgcggcacggcgcccatagaaaacccgtccggcggacgcgggccagccaggcgttttgccgggccccagttgacagtggactagtggacacaccgcgttttcctgacgaggccgtgggccatggccaagccgacaaccagtctccaccctgggacctcccgagtccgccgttcgggtcaactggcccctggctgcctggctataaacacccgccctcgctcccggccggccgggcacggcacacgtctcggcagccacaagaaaccacccccttccggcacacgggctcgaccacctgactccatcaccgtgcctgtctgtgttctagggacaagaagagcagagatatacaggagcgagcagaggcggggagaagaggatgagcaccacaacggcgtcgtcgctgaaccccaacgcgccgctcttcatcccggcggcgtaccggcaggtggaggacttctcgcccgagtggtgggagctcgtcaacaccaccgcctggttccgggaccactgcttccggcagcgccagctccacgaggccgcctgcgacgacgtcgccgcgctcctccccgacgacctcctcgacaccaacgacctcttctacgcgcccgacgtcgtccaccaccaaccagcgacggcgctgctgcccgggtacgatgtcctcgacgtgctcgcggcgctgagcctcagctcccccagggccatccgccagcctcgctaggagaagcctgctcatggcgcctggcgggccaccacctccaccacggctgctgtgcctagtgtaaccccaagcaaggctagtctgtttctgtgtatacaatacgactgaaaaactaggagaggggggattcggccaaggcggccggtgctctctcctctcctcgtagctagtttttcctcctgttccagctcagttcttgttcatccagccgtgttaggaaaacaaacccagccccgtgcccatgttgttgaaaaatatattagtctggtatttacaactcttcgccaggtgcttcttgttcctcgagatttttttttcctctgtttcaacagtgtgttctctgatttgagagctgcaaggtgtgttttttgtctgtctcaacttcggtgatggtgggggcctgaaaatgggatgtgattgatcgctcggttgctacatagtacaaaagtacatctgctcatgtgccagcacttaagcgaataattgctgcagagatgtgacacggaacgtaatgctagattggtctatggggcggagattgtcggtaggcacttcattattatttattgggtatcagactggtgcgtactacttcactagtgttgtaatgacgagttgatcgttgcccggtctattcaaacatctccgcccctgcctcgctctacttttctattactacctcgctttgcttcagctgtgtataaaatcatagtatgaaagactttgcaagccacaacaaaattccatgt

SEQ ID NO: 17584 - DNA, 2600 bp, Zea mays
agtcagctaactagagctctagtgcatatattataaaaatgattaaggttttcacatgctaacatcgtattcatatcttgtccattagatctataatctacagtggagtgtaatttcgcctctcctcaggttatctctagcagtttacatatcctcatacttaaattcaaactttactctgcgaacaatacagtctacagtgcaaaacagtgttttagatgatcatatgggtaaactgctagacacagtgtcacactgttttctaaagaactcaatgtttttttacttaaatactccatccgttcacaaaatgtttgtcgttatggtattcgtgtcagtcaaaatttcttaagtttaactagatttatagaatatattagcaacatttgcatcttcgaataattttactacaaatatagatttaaatatctacatagcgatactaattatgtactataaatattaatttttttatataaactataaatattaatatttttttatataaatgtggtcaaagttaaaaatgattgactccttaaaaaatgagaacgactaatatttacagacagagggagcaggacactacgttctcaggtgtgatttcactcggtcgtagataataagtctaatgtacaagattcgatatcggcacgttaaaacccaaatcgtttctatgctagatatgttgtcctttttttatgcatttgttttcttcaaggaacgaggagtgggacgtctcgccgacccaatttgcaaattaagtattggttattacatgcgtattacgaggatcgtgacattcgttgtctctagcgtgggtgggttgggttggattcactggaccggccggagtggagactgttggcgcgccacggtttccttttacacgttgtgcttgtgcgtccctgtcctcctgctttcattcttatcgcgcggaaacttcctcccttccactctgccggcaggtcccgccggtgccggtgggacccacgcaataatttagacccaatcaaaccacccacacaacgcaacgtggcgcggcgcccacagaaaatccgtccgagcccccgtctagttcagctggcagctgactggctataaacaccccactggggctccccccgcgcggcccggccggcacacggcttttggcagctacaaaccacccaaaagccacccccagaaaccggcggtccttgggtgttccggatctgagccagcagctgagaagaggatgagcgccgtggccgccatggcgacgtcgtcgctgaaccccaacgcgccgctcttcatcccggcggcgtaccggcaggtggaggaattctcgccagagtggtacgagctcgtcaacaccaccgcctggttccgggaccactggttccgccagcaccagcaccacgaggccgccttcgccgccgccgacgccgagctcgacgtcgccgcgctccttcccgacgactccgtcgacctcctcgacaccgacgacctcttctacgcgcctgacgtccaccacccccacaacgccaagccggcgctgctgcccgggtacgacctcgacatgctcagggcgctgagcctcagctccccccgggccgccgccgcgccgtcgccgtcgccgttgctgcgcgcccagcagcagaggcacgcggacaggccggcgcaccacgccaggggcgccgcgcgccgcgtcatcatccaccagcctcgctagaagcagcctgctcatggcgggccgccgccatggctgttgtgcctagtgtaacctcaagcaagtctagtctgtttctgtctgtgtatacgactaaaaaaacaagtctagtctgtttctgtctgtgtatacgactaaaaaaacaacagatgggggattcggacgaggcggccagtgctctctcctcgtagccagcttctcctggacgaggcggccagtgctctctcctcgtagccagcttctcctgttccagctcagttcttgttcatccagcagagcaccaaaaaaaaaaaacagacaggcggagtgatgtacttactattcctcctcctcccatgtccatgttgttgaatatatatatatgatggcaagcagcctgatcttttcaattcttcttccattactacctcgctttgcttcagttgtcctatgattcagatggcactgagttgtcaacgactccaggatgctacatctgccgagctactctccagatgactttctggatgtctagctgtcagcgtccactgaagaagaatcggtccttgaaacgaaggccgtaggaagcactgatggaccactgatttgccaccaaacaacaggtgtagcataaagcaatctacgccagcaggtataaccgatggtagtttaacaacaaactgcaaccagactagctcagtttgctccagaacatttgcgctataccagatttcctacgtcgcagccacttcagtccattcctcatttgtcctctcatttcaacaaccagctccatttagaagccaagtttccgttggcgcagcgttcaatcaaatcacatgaaagactctgcaagccacaaagagaagtccatgtcggccgcacaccttccttacagacatcaggacga

SEQ ID NO: 17585 - DNA, 950 bp, Zea mays
cactcctatgggcgattgggaccctcgcggcccggccggcacacggcttttggcagctacaaaccacccaaaagccacccccagaaaccggcggtccttgggtgttccggatctgagccagcagctgagaagaggatgagcgccgtggccgccatggcgacgtcgtcgctgaaccccaacgcgccgctcttcatcccggcggcgtaccggcaggtggaggaattctcgccagagtggtacgagctcgtcaacaccaccgcctggttccgggaccactggttccgccagcaccagcaccacgaggccgccttcgccgccgccgacgccgagctcgacgtcgccgcgctccttcccgacgactccgtcgacctcctcgacaccgacgacctcttctacgcgcctgacgtccaccacccccacaacgccaagccggcgctgctgcccgggtacgacctcgacatgctcagggcgctgagcctcagctccccccgggccgccgccgcgccgtcgccgtcgccgttgctgcgcgcccagcagcagaggcacgcggacaggccggcgcaccacgccaggggcgccgcgcgccgcgtcatcatccaccagcctcgctagaagcagcctgatcatggcgggctgccgccatggctgttgtgcctagtgtaacctcaagcaagtctagtctgtttctgtctgtgtatacgactaaaaaaacaacagatggaggattcggacgaggcggccagtgctctctcctcgtagccagcttctcctgttccagctcagttcttgttcatccagcagagcacccaaaaaaaaaaaaacaggcggagtgatgtacttactattcctcctcctcctcctcccatgtccatgttgttgaatatatatatgatggcaagcagcctgatcttttcaaaaaaaaaaaaaaaaaaagcaaatagggcccggcc

SEQ ID NO: 17586 - DNA, 657 bp, Zea mays
agaggagacaatgacgaagagaggactcaagtcgcggccttcgtcgccgtcgtacggcggtggctctgctcggaacttggagttggttgggaagtcaagcgaggatgtaaggagctctacaagactcagactcaagcctttgaggaagccgaagactagccacaagcagaagaagaagaaagctactaaagtccatgagaagatgcccaagaaacctcccactgctttcttctttttcttggaggatttcaggaagctatatcaagaggagaatcctgaggtcaagtccatgcgtgagattgggaagacatgtggagagaaatggaaaacaatgacttacgaggagaaggtaaagtattatgatatagccactgagaaaagagaagagtttcaccgagcaatgactgaatatactaagcgagtggaatcaggtgaatttgatgaatcagagaccgaatcagacttttctgaatagacccacattagaaaaacatttgttctaagccttctaataacatttagaagtttgtttttggttgagatcttttctttccttgacactcctgttgactgcactttgagattaatagaaattaaccagtttctcaggtaaaaaaaaaaaaaaaaaaaaaaaaaaaaataaaaaaaaaaaaaaaa

SEQ ID NO: 17587 - DNA, 1084 bp, Zea mays
  misc_feature (1033)..(1033): n is a, c, g, or t
  misc_feature (1036)..(1036): n is a, c, g, or t
cccctcattcaagcaactacaaatcagcaaccaggatatgatataatagggcagttcattatcggttatatcctgcctggaaaacccattgcaaacctgattttcaagatttacgggagaatcagcacagtccatgctctctcatttttggcagaccttaagcttggccattacatgaaaatcccaccgcgctgcatgtacacggctcagctggtgggcactgtggtagctggtgtggtgaatctgggagtggcctggtggatgttggagagcattcaagacatatgcgacatcgaaggagaccaccctaatagcccctggacttgccccaagtatagagtgacgttcgatgcttcagttatttgggggttgataggaccaagacggctctttggaccaggaggcatgtaccgtaaccttgtctggctcttcctcattggagctgtcctgcctgttcccgtgtgggcgctgagcaagatcttcccaaacaagaagtggatccctctcatcaacattccagttatctcctacggctttgcagggatgcctccagccactccaaccaacattgccagctggttggtcacaggaaccatcttcaactactttgtgttcaattaccacaagagatggtggcagaagtacaattacgtactctctgcagcgctcgatgcagggaccgcgttcatgggggtgctcttgttcttcgccctgcagaatgctggacacgacctcaaatggtggggcactgaagtagaccactgccctcttgcctcctgtcccacggctcctggaatcaaagccaaaggctgtcccgttttctaagctcagcagaatttattagattcaaacataaaaattcacatgttttgccctttctattgcttctttctgtacagccttctactgttagatagtggccatcagaatgcaataaactctaccttagattcatttgagaatgataatgagctattgagacaaaaaaaaaaaaaaaaaaaactcgagggggggcccggtacccaatcggganaanggggggagaggagagagagtgtgagaagtggggttgagaagaataaat

SEQ ID NO: 17588 - DNA, 2532 bp, Zea mays
  misc_feature (26)..(26): n is a, c, g, or t
gctgagctcccgcggggggcgctccnaaccagtggatcccccgggctgcagggagctcactagtccccccccccccctctgctcatggtctctgagcccctttgccattgatgccaatggttgaaagacgggaggctaaagttctattgcgcagaagcggttattgtcgagaagagttcgacagaggcttggcgtgacaggcctttcggcatctggtagccgccagcccgcatatcgtagggggtatgtatgacttaatgtcaacccaccaagcttcagcgcacgccaagtcttgcgcgtcttgcctcgtcttccctcctgaactcgcttctcgccaggaagtcctgcctggcggcatacgagtctttcgatttgccggccagctccagctcgtccttgatcccttctttgtccacgaagcccgcccaatccattcggctcttctccacagtattgagcttcctcgcctgctgtgcctctttaccagcttgtgtcctcgctgaaacgccaagattaaggtctgaacgctggggtgtagggtccgtcatggcgggtttccgaaagcggaacggaaggccttgcgagcgacgcgtttggtgggcaggtcggtttcttcgtctgcggcggtaggaacggggagaccttttgaggcgaagtacagcttggcttcggctgagtcgcgagcaacaagcttctcttcggtatggacacggccagcgaagttgtaggtttgttttatgcggataagggcagaagggtcgaccgacgccgcctcgaccgtgggtgcctcgacagcatcctttactacatcttgcgcgatactttcttcagctgtgtcggttttttgaggctgcgctgccgccgtgccagccagcatctcagcccatactgcatcgacatcgatcgtcactggtcctgaggcaatgatgtgtttgcgctcctctttcctgcgccgagttagcgatgttatgggccagcaagaaaaaggtcacgcactctgctgctctctgacgtctggtcttgacaagccctccctctcctccctcatcgtcttcgtctacgcccttgtcctgggccctcttccgtcgcttgcgccccctctggatgatagcctcatctccagaattgtcatagcctgtatcatcctcggcatccgttcctttgcgcgtgccagtgcgtggcttcttggattctactgctgccggctgctctggttcgccttccgagtcggatgcatctgaaccggcagcgttggcagcatcaggtgcgaagtcggagtcctctgaggaagcgtattggtcgtcgtcgtcgactgacatccgatcggcggacatggcgtgcagtatagcagccgatagcaggccgatacgatgcagacaggaccgggttgtttgtgctggcggcaaaagtgaagttggatgttggaagccggagcttttgcgcgtcccggaacgcggtagtgcgctgcagcaatctttgggtgatggtggtggtggtggggcagctggaaagacgccctggtcctcctcacccacctttccccaagttgagaacatggggaggccaaccgaggattatcagctcgctacctcgttccaggcagtacgtggttttgcgtgtggtcgaggaccgtaatcattctcctgctactcagctggctcaagccaaattgatcagccacagatcaaactcaactgcttgcaatcgctattccttgcaatgtccttcggccaagctcctagccacggctaaggctaatgcgtccataccatccatcttcaagaccctccccaggataaccgttactcgctgggtgatgccaaatggggttcaattgaatttagccggctctagttcgagcaatgcccccatctggagttctgtcaccgaatgccagccagtcaccggacctcataccacataatgacccccgacaaagaccataaaccccacgtccaagtggtcagacttaccccaagtgagccgccgctatggttcagttaatggaccagcgtttctcggcatggtaccgcctatccccgcaaatcagatcgcggtacgcccgcagctggtaatagacgctcagcgccatggacgttgggcttctactgctatgacccgtcgctcgggtataagacgaggagggattcgctcccgtgcctcagccagcttggctctgtgctgcaacctcataccaatatccagctacctgcaaggtacctccttttaatacaccatgagttccgtaccatcagtcctcacagaagccgagaaggagcatttccttcagaatggcttcgtccgcctcaagggatgtttcactcgggaacaggccgagaaagtcacaggcaacctctggactcgactcggtatggatcccaacgacaagtcaacttggaatcgccttcgcaccaacatgccctgtcagagcactttcagcgccgaggatttcgcaccgagagcctgggcagccatttgcgagctcttgggaggtgaggataagatcaacctcgagggggggcccggtacccc

SEQ ID NO: 17589 - DNA, 726 bp, Zea mays
  misc_feature (517)..(517): n is a, c, g, or t
  misc_feature (538)..(539): n is a, c, g, or t
  misc_feature (552)..(552): n is a, c, g, or t
  misc_feature (561)..(561): n is a, c, g, or t
  misc_feature (577)..(577): n is a, c, g, or t
  misc_feature (590)..(590): n is a, c, g, or t
  misc_feature (602)..(602): n is a, c, g, or t
  misc_feature (608)..(609): n is a, c, g, or t
  misc_feature (614)..(614): n is a, c, g, or t
  misc_feature (618)..(619): n is a, c, g, or t
  misc_feature (621)..(621): n is a, c, g, or t
  misc_feature (646)..(646): n is a, c, g, or t
  misc_feature (652)..(653): n is a, c, g, or t
  misc_feature (655)..(655): n is a, c, g, or t
  misc_feature (668)..(668): n is a, c, g, or t
  misc_feature (673)..(673): n is a, c, g, or t
  misc_feature (679)..(679): n is a, c, g, or t
  misc_feature (689)..(689): n is a, c, g, or t
  misc_feature (697)..(698): n is a, c, g, or t
  misc_feature (709)..(710): n is a, c, g, or t
  misc_feature (715)..(715): n is a, c, g, or t
  misc_feature (724)..(724): n is a, c, g, or t
gcaaaaacctccctcaggagcttccgccttattcagagtgtagaggaggatccaaaagaaaagaggaaaaaatggactatatgtatggaccagggagacaccatctgtttgtaccaggaccagtgaacataccggaaccggtaatccgggcgataaaccggaacaacgaggattaccggtcaccagccattccggcgcttacgaaaacattgttggaggatgttaagaagatattcaagaccacatcagggacaccttttctgtttcccacgaccgggactggtgcttgggagagtgccttgaccaacacgttatctcctggagacaggattgtttcgtttctgattggacaatttagcttgctctggattgaccagcagaagaggcttaatttcaatgttgatgtggttgagagtgattggggacaaggtgctaatctccaagtcttggcctcaaagctctcacaagacgagaatcattccatcaaagccatttgcattggccacaacgagaccgngaccggagttaccaattgcanntcttgttgtccgnacacttctngatcactacaagcatncggctttggttgntaatggaccggngtttcnnccatnttgnncncttggatttcccaatgggatgaatngggaanngncctgggccttgantgggncttaanaagccctttntttttcannaggaacttggnntttgnttggccccnct

SEQ ID NO: 17590 - DNA, 1423 bp, Zea mays
  misc_feature (26)..(37): n is a, c, g, or t
ggggagagggaaatcttttttttttnnnnnnnnnnnncccccccccccccacctgaatccgccgtagcacctgtcgtggtagagactgtcgccgttgctgaggcagagccagtggagccggaagaagtctcgatctggggagttccactactccaagacgagagatctgacgtgatcctcacgaaattcctccgtgcaagagactttaaggtcaaagaagctttaaccatgcttaaaaacaccgtccagtggcgtaaagaaaacaaaatcgacgaactcgttgaatccggagaagaagtgagtgagttcgagaagatggtgtttgctcacggtgttgacaaagaaggacacgtcgtgatctacagttcttacggtgagtttcagaacaaggagcttttctccgacaaggagaagcttaacaagttcctcagctggaggattcagctacaagagaagtgtgtgagagctattgatttcagcaaccctgaagcgaagtcttcgtttgtgttcgtcagcgacttcaggaacgctccaggacttggtaaaagagccttgtggcaattcatcagacgcgctgttaaacaattcgaggacaattatcctgaattcgccgctaaagagctattcatcaatgtcccatggtggtacattccatactacaaaacattcggatctatcatcacatccccaaggactaggagcaagatggtccttgctggtccatccaaatctgccgatactattttcaaatacatagctcctgaacaagttcccgttaaatacggtggacttagcaaagatactcctttgaccgaagaaaccataacggaagccatcgttaaaccggcagcaaactacactattgaattgcctgcttctgaggcttgcacgctttcatgggagcttagggttttgggtgctgatgtgagctacggagctcagtttgagccaaccaccgaaggaagctatgctgtgatcgtctctaagacacggaagattggatcaaccgatgaaccggtgataaccgattcttttaaggtgggtgaaccgggaaagattgtgatcacaatcgacaaccagacttccaagaagaagaaagtgctctacaggttcaaaactcaataaaaggtctgatctttgaaatccaaatccaaggaagaagcaaaaaaaatgttattttgttatttgggggaaacaaattttaattaattaatttagtttgttatttattatgtaattttgaaatctcaagatgtggttgtgtttttgctttgttttggtattgggggttgttttcgtgtgtggagaatatgtgattaaaattcaaaagaaagtaaagaaccctttgtttcaaaaaaaaaaaaaaaaaaaaaaaaaaaaaaaaaaaaaactcgagggggggcccggtacccaattcgcccta

SEQ ID NO: 17591 - DNA, 601 bp, Zea mays
  misc_feature (581)..(581): n is a, c, g, or t
actcaccaccactccatacctatctagagagagaaaaactaaagtttctttaatagagatgtcgaaagaagtgagcgaagagggacacactcaaagccatggaaaagactacgttgatcctccgccagctccgttcctcgacatgggggagctcaagtcgtggtctttctacagagctctcatcgccgagttcatcgcaacgctcctcttcctctacgtcaccgtagccaccgtcatcggccacaagaagcaaaccggtccttgcgacggcgtcggtttactcggtatcgcatgggctttcggtggtatgatcttcgtcctcgtttactgcaccgccggggtctctggtggtcacatcaacccagctgtgactttcggtctgttcttggcgcgtaaggtctctctggtgagagctgttgggtacatgattgctcagtgtcttggagccatttgtgggtgtgggtttcgtgaaagctttcatgaagactcctttacacactctcggaggcggagctaacaccgtagcccctggttacagcaagggaactgctctcggagctgagatctttgggaactttcgntctcggttacccccctcccc

SEQ ID NO: 17592 - DNA, 1710 bp, Zea mays
gagctactactgttgaagcgattctcactaaaaccctcgaacacatcgcctttatctctttctctagatctactcgctatggctactatcaccgttgttaaggctagacagatcttcgacagtcgtggtaatcccaccgttgaggtggatatccacacgtcaaatggtgttaaggttacagcagctgttccaagtggagcttccactggtatctatgaggctcttgagctgagggatggaggatctgactaccttggaaagggtgtatctaaggctgttggcaatgtgaacaacatcatcgggccagcacttattggaaaggacccaactcagcagactgctattgacaacttcatggtccatgaacttgacggaacccaaaacgagtgggggtggtgcaagcaaaagcttggagccaatgcgattcttgctgtgtctcttgctgtctgcaaagctggggcctgttgtcagcggcattcctctatacaagcacattgccaaccttgctggtaaccccaagattgtgctaccagttcctgccttcaacgtcatcaatggtggatcccatgccggaaacaagcttgctatgcaggagtttatgatcctccctgttggagctgcttctttcaaggaagccatgaagatgggtgtggaagtttaccaccacttgaagtctgtgattaagaagaagtacggccaggatgccacaaatgttggtgatgaaggtgggtttgcaccaaacattcaggagaacaaggagggtcttgaattgctcaagactgctatcgagaaggctggatacactggaaaggttgtcattggaatggatgttgccgcttcagagttctactcagaagacaagacctacgacttgaacttcaaagaagagaacaacaatggctctcagaagatttctggtgatgctctaaaggacctgtacaagtcctttgtcgctgagtacccaatcgtgtccattgaggacccatttgaccaagatgactgggagcactatgctaagatgaccactgagtgtggaaccgaggttcagattgtcggtgatgatttgttggtcactaaccccaagagagttgctaaggcaatcgccgagaagtcttgcaatgctcttcttttgaaggttaaccaaatcggatctgtaaccgagagtatcgaggcagttaagatgtcgaagaaagcaggttggggagtgatgaccagccacagaagtggtgaaaccgaggacacattcattgctgacttagccgttggcttgtctactggacaaatcaaaaccggtgctccttgcagatccgagcgtcttgccaagtacaaccagcttttgcgtattgaggaggagttgggatcagaggcaatttacgctggagtcaacttccgcaaacctgtagaaccctactaaatggagcttttagaagcaaagtggtcttctttgtgacgaggagaagatgacctgagtttgatcatttgctttaattaaataaaacgttctgtttttgtttcttctttgtttggtttcttacgtcttttgttgaaccctttttgggaaaagttactcatttttgtaagggaaacatgagaatgctctgcctttgtcgaggacggtagccccttatttcaatctaatttcggctttactcaaaaaaaaaaaaaaaaaaaactcgagggggggcccggtacccaattgttaaacacaat

SEQ ID NO: 17593 - DNA, 1326 bp, Zea mays
gctcccccgcgggggcgggccgcttagaaattagggattcccccgggctccagattcgcccccccggttggtagtcccccccccccccgacaccatccactctactcaacatggactcctccaaactctcatctctctctctttgcctcttcctcatttgcattatctatctcccccaacattctctcgcatgcggctcttgcaacccacggaagggcggaaagcactcccctaaagcccctaagctaccagttcctccggtgaccgtccctaagctaccagttcctccggtgaccgtccctaagctaccagtccctccggtgaccgtccctaagctacccgttcctcctgtgaccatccctaagctacccgttccaccagtgactgtacctaagctacccgttcctcctgtgaccgtccccaagctacccgttcctccagtgaccgtccccaagctacccgttcctccagtgacagtccctaagctacccgttcccccggtaactgtacctaagctacccgttcctccagtgaccgtccctaagctaccccttcctccgatttcagggctacccatacctccagtggtaggtcccaatctgccattgccacctttgccaattgtaggtcctattcttccaccgggaacaaccccaccagccacaggagggaaggactgtcctccaccgccagggagcgtaaagccaccatcagggggcgggaaggcgacatgtccaatagacacgctgaagttaggtgcttgcgtcgacttgttgggaggtttagtaaagatagggcttggggatccagcagttaacaaatgttgtccgttacttaaaggcctcgttgaaatcgaagccgcggcttgtctctgcactaccctcaagctcaaagctcttgacctcaatctttatgtccctgttgctcttcagcttctccttacctgtggcaaaaatccacctccgggctacacttgttccatatgataaactcactccacttataaaggatgctttggagaaaaaagtgagaagagaatggcagagctccaatctttcctgtcttggtttaccaaatacatcatatcaaatcctatccctttgattctttcctctatcgttcccttatgcttgtatcattaattaatgtgtgctttttagattaatgattcttctcttgtattaaagtatgatttgaaatccttttttttctctatctctttttattgaattgattgaactgcgttcatgataaaaaaaaaaaaaaaaactcgagggggggcccggtacccaattcgctaaacacaataaagttggaactggaggg

SEQ ID NO: 17594 - DNA, 1325 bp, Zea mays
tcactagtccccccccccccccccgattgcaaatcaaatggatcgtcttaagctttatttctccgttttcgttttgtctttctttatcgtctcggtttcgtcgtctgatgtcaacgacggcgatgatctcgtgatccgtcaggtggttggtggagccgagcctcaggttttgacctcagaggatcacttttctctcttcaagcggaagttcgggaaggtctacgcttccaacgaggagcatgactatagattctcggttttcaaagcgaatctcaggcgagcgaggcgtcaccagaagttggatccgtcggcgactcatggtgttacgcagttctcagatctgactcggtctgagttccgtaagaagcacttgggggttagaagtggctttaagcttcctaaagatgccaacaaggctccgattctccctaccgaaaatctccctgaggattttgattggagagatcatggcgccgttactcccgtcaaaaatcagggatcttgcggctcttgctggagtttcagcgccactggagctttggaaggtgctaacttcctcgctaccggcaaactcgtcagcctcagcgaacaacagctcgtcgactgtgatcacgagtgtgatcccgaggaggcagattcctgcgactctggttgcaatggtgggctaatgaacagcgcttttgaatacaccctcaaaaccggagggctcatgaaagaagaagactatccttacaccggaaaggacggcaagacctgcaagctagacaagtccaagatcgttgcctctgtctccaacttcagtgttatctccattgatgaagaacagattgctgcaaaccttgtcaagaacggacctcttgctgtagccatcaacgctggctatatgcagacttacattggaggagtctcatgcccttacatatgcaccaggaggctcaaccacggtgtcttattggttggctatggagcggcaggttacgctccggctaggttcaaggagaagccttactggatcatcaagaactcgtggggagagacttggggtgaaaatggtttctacaaaatctgcaaaggccgtaacatttgtggtgttgacagtatggtctccactgttgcagccaccgtctcaaccaccgcccattaagcatctcgtcaataagttttaattactttggtgatttgtatgagcgagctctctttgcgctgctgactctctctatttatctctgcttcttgcttgtaaataaaatgcgttctattgagcaaaaccgtacaatgctcattagcaatgagcccactttaagggggggcccggtacccaatcg

SEQ ID NO: 17595 - DNA, 2665 bp, Zea mays
  misc_feature (2636)..(2636): n is a, c, g, or t
ctagtccccccccccccccttcgtccttagttacgtcctctcttccctttaccaactccagacggaccatgcctcttctcgatgcccaaacctctccttccggcagcgataccaccctttccactctttccaccccggccaccccggccaccatcaaaccctcccctgcccctgaatgcaccacctcttgcgccgccacgctcccttccaggactcatcttactcttcaccgccgcaacaacatcctcatccatctcctcatcctcgtcatcacctcccctgcggttcgagaacttcagcttaccgccacgaccacgtttggcaacatccttgcccttgagagcagcaacgtaagcgcccacccctgagtgctctgggtcgactgctctgccgtcgacgtccatatcttcgtcgtcgtccttgccgaggatgagcttgccgtcgagatcggtcttggcctttgtcttagtgggtttgcgttgcttcatgggcttcgtggaggagatgttggccattgccttcttgtcgagcaagtcaagcggctcgtcttcgtcttccatgatatatgtgttgccgcccttctgggacttcttgggccggaaggaaacctcgttgtcggagccgtcttctgagtcactgctgtaaagtgcctggtcgtactcgttctcgtactggcgcttaccggctgcgccatcctcgtcatcactgtcatcgtgtctgttgcgggcaccttccttcttcttcttagcctgatccctgactttacgaatgttcgcgaggatcttcttgccgtcctcaggggcatgctgatagatgttgtcgtagccaaagcgacgaaccatgcgctccagaatgtgcttgacctttgccctgaagtgacccttgtgctccgaactccatgtgaccaggttcgggacgagcgtcgacagacggggaagcatgagatcgacaggcaggctgatgacgcagactttgacgaacccaagacagctcttgacaatctcacgattgtttgatgtcaggaacaggtccattgtctgcacgagatcagaaagagtctgctcgctcaacgagttgcggaactcataaagcagccggctgatggccgtgatcgatgcggaaatcatgtgtggcgtgctacccgccaaaccagcgctcaccattgtgatgaactcctcgatattggctgtgccgtttggggcgtcagccgacatgtgaggcaccttcgtgttgtcgatcgttgcgccattggcctctaccatgcggttgcccatcttcacaagcaagtcgtacgctgtttccctggcgcgctcgttattctccttgcagcagataacgacctcactaagcacagatgggatgaagtgcaaggagtcgtcggcggtgaaggggagcagcgccatgatcgcggagagtctgtcgcggcgagcaggggtagagaccttgtccgtgctggagacaataagggtctgaagctcggcatttcgctccttgagggcgagcttgccgagcccggagtcagcaagacggggaataagcttgtaagccttcttttgaagctgtggctcttcttgcttggtgatgatgacggaggcaatttcaaagagcgctgaaaagctctctcggggaaggtagacggagatggtgatgacgagatccataagggtctgggcggtagatggcatatggtccttcttttggccagcttccttcttgtcggctccagcgggcttggagagctcgggaaccagcatttgactgaccctgtcgaatgtgtccatgatctcttgggagggcgtgatactgaggaaggtgttaatggtctggagaatgaggcctctgctattgggaagagtctgagtgtaaacattgaaaagcacagccagcatattgccggcatagcttccaaggagggcaaggttcttgcgtgcagcttcccgcctgacgcggctctggagaagcaaatcttcttcctctgaaccgtcgatctcggcgatggccttgttagactcaatcaacgtcttgagtgccctgcagacatccaggcgcaaatccacctgcttgtaaaggaggtttgcaatcatctcggcgaatgactgatcgaaggcatccgcaagatccaggggcagatcacagtaacccggcagaattgaccagatttgttgcaccagagtctcgtaaatctttacctccatagttttctcagcctgtccgtgatcgagcaccttctggaacatcagttcactgagggggaccatttcagttttgaagtggttgaggttggtgttgctggtatagtcgcgcaggatagggaacatccacgcacggccaggttggcccttaacaggcttcgctaagttgagaggcagaacgttgagcacagcctcggggcccatggcgcggacagccttgccaataacctcatcggcttccttcttgctctggaaggatgagttctctcggagttcaccgaccgtcttggttacacccaagaggatagggtatgatcgccagcgaagagcatcgaacatggctccgaagacgccaaaggtttgtagccatgctgcctggtattgaacggtcagaagcgcctctgaggccttcgcgatcttctcgagggggggcccggtacccanttcgccctatagggagtcgtattacattt

SEQ ID NO: 17596 - DNA, 1788 bp, Zea mays
  misc_feature (8)..(8): n is a, c, g, or t
  misc_feature (11)..(11): n is a, c, g, or t
gagatttntanttccccaacggaaaatcccccaaaaaagggcaggtttggccctggttcttcgcccgggtaggcccccgccttttccccttttttgggaaaccgcccctttggggcccccaaatttccgataataggaaaaaagaaagggattttctccaaccgcgaaggggaccatccattccgggggccaaaacccaagttccccccgaaggcctttaaagtgcaaaaaggcctagggcaagttttcacgcaattccccattctttggaattcccattcatcaagtaaagcccttcgttcctaatgttagaagaaaagttttttgtaaatccaaaaggattccaagtataggagaaaagtcgccttctttaggtttcatagcacacgtcatttggtgtcttatatataacgatgaagatttcaacatgaggatagtcttcttaattagtcagacaagcataaataaaagtaatcaagggcagctcctgctagtcccccccccccccccccacacgttttatcaaaagtctaagctactctgcaattcatttgccggcgaaaattctcaggatcatttgctcagctaaaaaatggatcaagagtgtccctttgctgccgaaagcataatccagaaatgccctttcctgagaaacatcaacaagcctaccaatttgtccttctcctccttgagttttccaattccggtgcaaggaggtaaaggtcctatttttgaagatggtcctggatttgattcagcattcaagctcttccatgggaaagatggtattgtgccgctttctggtttcgctgatgattctgaagatgaggcgggtcgtcgtgctctgcaattcaatccacttgctggtaaggtagctacaataagcctatcagcttttggtcctggaggcccttttggttttggtcctttctcagagaaatggaagaaacaacagaagaaacctaaaccttccaaaaaccaacagtctggggactcttcgaaacatgaggcagttggagacgaatggttaaaaaccgggaattgtcctatcgccaagtcttttagagctgcaagcaaagtcatgcctcttatttctaaagcattaacgctaccacctggtatgaaatatagatgtccagctcctatagtagctgctagagctgcactttcgaagactgctttggtcaaaagtcttcgccctcagcctttacctgaaaagatgcttgcaatcgctctcatgggaatggctgcaaatgtgcctctaggtgtatggagagaacacacaaagaagttttcgcctgcatggtttttggctgtccatgctgctgtgccttttatagcaatgcttaggaaatctgttctgatgcccaaaacagccatggctttgaccattggagcttcgatcttgggacaggtgattgggtcaagagctgagcgttaccgtctcaaagcagtagctgagaaaatggttcctgtaaccgctatggtttctggatacaaccagagccctggcgactcaggcatttctgggggacattgtggtataggggagggagtgaagcaggtttattacaatgtaaatattggagagtctgctaaatcaactggactctgttattgagagaatgttcttattgatttcagaaactacaaattactatgtaaggattggatatttgtgtgtgagggaaggtttttgtaattcaaaaaaaaaaaagaaaaaaaaaaaaaaaaaaaactcgagggggggcccggtacccaattcgcctttaaacaccagaaagtcgg

SEQ ID NO: 17597 - DNA, 2581 bp, Zea mays
tcggataattataaaggggttctagcgggcgggccctttgggtttaaaaaatgcgtttgtcggaccgtaaatttggcttgaactcttaaaacataaaatacggggtccaactttgaggttggcgaatttggacgcgacaggccaccgagaagggcaaaaaggactgggttaggctgatttgttccggtaagagggccaaaagcggcgattttacgggttgttggaaccaattgacggtaggagtacggcgttttctcaatagagggactgttgaaaccaaacggggcaatgacgctcaagtccatatcctcggaataatagggtagaattgggaaggggattttcccgagtttgaggtctatggggttaaaaagaagattctgttttttcagaagaagggggtatgggaatagctcactagtaccccccccccccccccccccaaggatcccccaggttatcggaacctcggaaagcagtttatcaggccccgttccccgttccccgtcctccatcctcagtcccaggtctcttctagttctgtcgttctctggccaaggcatttccgtgcaggacgtacgtcccgaggatgcagactcgcaaccctgaccagccttccccggacccacgcgagcgggacaccgagcagacgacgtctacaaggcggaagcgacgcaagtatactgctgtagcttggtacgttcagcattcatttggtttgtcctgttcagggagtttgcatcaagccgaatattgctgcaaaccgatgatggctgtgcctgcaactgcatgcggtggactgtagctagggcctaatggtcgagtgcttcccaagctaactccaggcgattgcgcagttctgaatgcagaagacggaaactcaaatgcatcccagactcaaaagaatcaagctgtgagagatgcatatccaaggggcatcatgcttgcgactacgatgcactctatcgtgagcatagagactcacagaaagtgaagagcaacaggtaaatgagcctactagagcattagttattgctgtcctgatgtttggctaatgactatggcaaaagctccgcaacagttgctgctctccgtcaagatgtcaagttcctacgcgataccctgagcggcttgataacaacggtccaagcaaatgccgaacccagtgatggaaatacccgacctcagagccagccgttagacacccatcaagcggttcccatctcaatgcaatcacggcggccgagctctccagctcctgaagctgtgacattcgtggcagggaccccccgttctgacgcctctgggattgatgtcgctcctgtgagtcaaaagttgcccacctgaagaagtcatgcagatagtacaagggaagcgagatttctgacagaactcaagccgcgacatgtcacctctccacactcgcttcggggtggcccagcagagcctcgcttcataggtccaacccgatcagcatacagtctggaggttggggaacgtgctctttctcgtctgggtatacctgtttttgatatgcctccacccagtggccaggaatcgccggcagaatccccgcgacagccttctggcaatactgaagaccagttctgggaaacctgcgatgcagccgagttcacgcggttgatcaccatctatcaggaagagatcgagtcggtctacccgtgcttgaacacaggctcgctgatcaaatatgcaccggccattccagaactgggacgcatgccggaggacgagattcgcaagacaatcgagacccgtcgcctgtcacttacagttaaagacgtgcatctcgccaaacttgccatggccacaacaattgtcatcgaaggccatggaaagagtgaaaagagttccaagcttgttgaacctgtggaacgcagcttgttaagcattctggagccgagccgagagctgaaagacttgcaactgttcatagccttggtaagttgctgctacgccgtcatcgatgtggaagtgtatcaggcctcactaacccatgttcaatctcacgagatagagcgtatactacttccattctgacgaagaccttttggcctggcgaaccatcggtctcgccgcccgagaggcattagtacttggccttcaccggagaggtaccttgatggaatcgttcagcgttcctgaagagcgcgacgcagcgataagggttttctggactatctatgtcttggatcgtcgatggagtttcgggaccagcttgtcctttgccctcgtcgatcgagacatagaccctgaacttccagaaccagtaggtcattccctctacccacaaagtgacaaagtggaatatcgagtataatcgctgactcagttgcgcagggagaggactgtgcctatttgcagtgtatggtcgggtacggtcgactttgctcaacattatgggatgccctggtgccctttggccagcgcaatcccggcggtgatgtggattcactcatgaaggagctcgacatcaagacacaggagtggctcgagggggggcccggtacccaattcgtgttaaacacaataaagttggaactggaggggggaaaggatt

SEQ ID NO: 17598 - DNA, 740 bp, Zea mays
  misc_feature (657)..(657): n is a, c, g, or t
  misc_feature (698)..(698): n is a, c, g, or t
  misc_feature (730)..(730): n is a, c, g, or t
gacaataaaactttggttcctccgaatttcgagttcttgttcttcccaaggcccctacttcggccctagcatcaaccattgtcgttttaaagctccaggttttcatggccaagaaagaattaactatcgttgagatcttctgaaattaatcagtctcgaagtctctggagattgtcttataacatggactccatggatattgatcaaagtaacataggtgaatcgcctcaccttctgctgagaccagtaagcccattggaatctggtgaaggtttaccttatgctcctgagaattggcctaatcctggagatacttggcattggaaggttggaccgagaattagcggtaaaggctacttcgtggatagatacttatatcctcctaagtatcttcccggtttagatactgaaatattgcggaaaaataaggtgtttaggagcaggctctcgctccaacgatatattcgtgtacacttccctgaagcggatgttcaaaagttctttgcttctttcagctggagcataccctgcagagatggtcaaggtgttttgcctcagaagcaggttcagttaccagtgtatagctcagatgaagatccaatgcgtgatgatggatctgatactgcggtctgtaaggctggtaatgaaaaatgccgnagcctgatgccacagtgcgaagccgagactttacctgctantgcctgtgacatttgctgccggggacgtaagntctgcgttga

SEQ ID NO: 17599 - DNA, 966 bp, Zea mays
  misc_feature (51)..(51): n is a, c, g, or t
ctgccaggaattccgccccgaggagagagaggggagagagagagaagaganctccctatgttcccccccccccccccccgggggaaaagagagagagatgaggaagttgaatccgcttctgaaacgaggcttgaaggctattgaaaatggtgatttgttgaagatcctccaaagtgaaattcgtcacgaaatctcccatcctcgtttccagggcgttgagaccggttctctaggagatttcaaattggattgggattcaccggaaagccaagatattgttctgaagagactgtttgattcaggcgagaaggttgtggtctctgctttattgcaaccagaacctatagaactagaagatgatttagtgtttcctagggaagctcatgccaaagtttgtatcaaaaagcctggtctcagctctatcttgcagtttcattgccgggtttacgaatcaggatctggatcttctcatttcgacatcaagagcgcctactttatccgctcttttgtttctgctccttcttccacttatggagaccattttttcagccaagtagatcccaaactacacagtgcactggagcaatacctaatatctaagggggtcagtgaaggcttaactaatttccttttgtgtcacctgaacaagaaggagcaggatcaatacgttaactggttacgcaggcttgaatcaactatgtcacattctccaaagccgtgagtgtttactccataagctcatttcttttcaagtttttttttggaacaatggtaaaatgccttaggagtagtattattagctaagagagtccttgcaatggatgttttgagggaagatgtatcgacgaatacatgttaactgtaatatttccaacaaatgggaaaaaaaaaaaaaaaaaaaactcgagggggggcccggtaccctttaacccaataaagttggaactggagggggggaagggattt

SEQ ID NO: 17600 - DNA, 1193 bp, Zea mays
aatcagcatgagggcctgaaggagcaagcagtctcggtctttatcttgtgccctggcttcctataaagctgaagcatctcgcgcggtctctgtcctgcctcgaggagcaagcaagtcgaagcatcaaatggcgcgtcaggagatcgagcacagccacctccccgtccgcgggatcaacctccacgtcgctcaggtcggcaaaggtgacctgggcacggtggtgttcctgcacggcttcccggagatatggtactcgtggcgccaccagatgcttgccgtggccgcggcggggtaccgcgccatcgcgccggactgccgcgggtacggcctgtcggaccagccgccggagaacgaggaggcgtcctgggtctgggatgacctcgtcgcggacgtgctcgccatcctcgacgcgctttccatcccaaaggcgttcttggtgggcaaggacttcggcgccctgccggcgtacgacttcgcgctgcagcacccggaccgcacctgcggcgtggtgtgcctcggcatccccttcagccccgtccccttcgccttcgacaccatgcccgagggcttctacgtcctgcgctggggcgagcctggcagggcagaggctgacttcggccggtacgacgtcaggcgcgtggtgcgcaccgtctacgtgctcttctcccgcgccgacatcccgattgccaaggaagggcaggagatcatggacctggccgacctgtccgcgcccctcccggagtggttcaccgaggaggacctggacgtctacgccaagctctacgagaagtccggcttccgctacccgctccagatgccatacaggtctctacgcaagatgccgcagcggctggacgccaagttccaggccccggtgctcatggtgatgggagagaaggactactgcttcaagttcccggggttcgagaccgccgtgcgcagcggcgccatggacaacttcatgccggacctgaagattacctacatcccggaggggggccacttcgtgcaggagcagctcccggatcgggtcaacgagctcctcctcgacttcctcaatggccaccccgtcgcatcatgatacctagtagcagttgcagcaataatcgcggcgtatctgcatgccatcgcatatgcttggcgcactggttgggtttgattttctcggaaaataaaagaaaaatgttctcttc

SEQ ID NO: 17601 - DNA, 3387 bp, Zea mays
tgaatcgatcctaggcactatagaatctaacaaaacacaatggtgaaacctattctatattttgacaatttcttaaaatagtcaattttagttgtcaacaataaatatagagggtatggatttttgtggataaactacaaaattttcttataaattataaatttatttttttggagatgacgaggacctaactaatatcgtacaaaatttaatggatacccagtgcattaaaccgaagcatatggacttttggattctagaagcgggtgacaaaggattgtctaaccaacatgtgatttgaagagagagagacgggtggcagtgtcgcataagtgcctggatgtcaataggcgaagcgtcaatgaaattccaacagtcaattaacaagtctccacgtgattttgagtttctgacaatgcgcttcacgtattattatgtcactacgtactggtaatagagtaagaagcctatcattacaaacaaagtaaggatagactgttcggttctgattttctagattgtggttgcagctgcagcaatacaccagtggcttctctttactcagtgttatgataatttagtctgctacgagtagggatggcaatggatcaccattcaaatatcattttataaaaagttatagcccttaaataattttggtttaaaaatgaatagtaataaaacttgaccataatccatcgaaatacatgtattatctcagttttttttggaaaaaaaacaagcaatgataagtttaactaaatgtataaaaatatgatactaaattaagattgctctggtttaatttgaaattacaagtcattctgacttttataaatacatagtttttagatgtagatagatataatgtattgataaatactaaaagtagatatctagaatagcaaaagcagttataatatagaatggccagagagtattagattaatcatataatataattctatactgaaactatttaaaaaaataatgccgtattgtatagagctagttagatttgaatcgattagtttttcagaaaacaaagacgccatctttttcaagcgcagctcggcgtggaaaaggagacaagaaaccattattgtactgtgagtaggcccccaaatggtcttggacgccactggtgcggacgtgcggtgatgctgatcgatggattctacggttcctgcctgtcaagtgtttgtcctcgtctcgtcttcggaaaacaacaaacgacaagtccaaggcagagtaggcacgtgggagactgatcaccgtgtctgaatcagggattacattttcggtttggaatttgggaaaaccccgttttatttgacttttgaatttcagattttagaccgaaatataccaaaaactggatcgaaaattgcatatcggactggactgagtacgaaaaaaaaaataccgagggaaagttcaagtgttcaaccttgaatggccatggccttcttttcgttttcgttttttttttgaagaacagacagacttgaaagttgagatatctcactaatccccaaaatgtccctataaaactgatgatctgctgatgagacatcccactcgccggccgtccttgaagagcgagcagcaatggcgcaggagatcgagcacacccacctccccatccgcggcctcaacctccacgtcgcacaagtaggcacaggtgagtcctcatcgttgctttgagccgatggatcccagcggagcaggcagagtatcgatcattcatgggctacggcctgcgggccgcacggctggccggctggtgccgttggttcgtgtgccgcaggtgaactgggcacggtggtgttcctgcacggcttcccggagatatggtactcgtggcgccaccagatgcgggccgtggccgcggcggggtaccgcgccatcgcgccggactgccgcgggtacggcctgtcggagcagccgccggagcacgaggaggtctctcctgacgacctcatcgccgacgtgctgggcatcctcgacgccctcagcgtcccgaaggtaaagcagcggctgcggcggtagcccaccgaacgggacgaaaaggaggagcgtccaatccatgtctccaagatctgagctgctgttgccgcgcgcgtgcaggcgttcttggtgggcaaggacttcggcgccatgccggcgtacgagttcgcgctgcagcacccgggccgcaccctcggcgtggtgtgcctgggcatccccttcaacccggctcccatgtccttcgacgccatcatgcccgaaggattctacatcctgcgctggcgcgtgcgtagccgcccgccactgactgcatacatacagctcttgctattctagtattcttcttcttcttgagctggtgttctccttttgctttctcttcttgttcaggagccgggcagggcggaggccgacttcggccggttcgacgtgaggcgcgtggtgcgcaccatctacgtgctcttcgccggcgccgagatcccgattgccaaggaagggcaggagatcatggacctggccgacctgtccacgcccctcccggagtggttcaccgaggaggacctggacgcctacgccaagctctacgagaagtccggcttcgggtacccgctcaagatgccgtacaggtagccactcctttcgccggccaaacggcagatctctctgatgttcattaattgcttttttggcttccctgcgcaaatttgattcccgtacagatctatgcacaagctcccgaaccggctggacgccaagttccaggtgccggtgttcatggtgatgggggagaaggactacgcgttcaagttcccggggttcgagaccgccatgcgcggcggcgtcatggacaacttcatgccggacctcaagatcacctacatccctgaggggagccacttcgtgcaggagcagctcccagagcaggtcaacgacctgctcctcggcttcctcagggaccatccctccgccgcataagcagtgggtgagaccgtcagaataatggaatgcttcctgagcaacggtttctctactctattgccgttgcctggatccatgaccgtgttaattaattaattagtgcatatacttcctactcaaatcagatgtacgttttttttatctgcaataaaaatcatcgtcgctgcattactcgaccaaaaaaaaaaaaaaaagttcttttgatttagataacggagtgaagtctactcagactgaccgcagcgcacccctcccccctagcactgtagacgcgtagaggcgctctacacgcccagcagtggcctccaaatggccccctacgcgctacagtgctaggggaggccgcacaggtcctctagatcaaggggagcactgtagcgcccccttgcacagtgctcc

SEQ ID NO: 17602 - DNA, 1477 bp, Zea mays
  misc_feature (5)..(5): n is a, c, g, or t
  misc_feature (16)..(16): n is a, c, g, or t
gcacnagaccattacntagaacatcctaatcaaaagatcgatggatttctacggttcctgcctgtcaagtgtttgtcctcgtctcgtcttcggaaaacaccaaacgacaagtccaaggcagagcagatttagaccgaaatatacaaaaactggatcgaaaattgcatatcggactggaccgagaacgaaaaaagaaaccgagggaaagttcaagtgttcaaccttgaatggccatggccttcttttcgttttcggccctataaaacattgggtacctcgaggccggccgggactcgccggccgtccttgaagagcgagcagcaatggcgcaggagatcgagcacacccacctccccatccgcggcctcaacctccacgtcgcacaagtaggcacaggtgaactgggcacggtggtgttcctgcacggcttcccggagatatggtactcgtggcgccaccagatgcgggccgtggccgcggcggggtaccgcgccatcgcgccggactgccgcgggtacggcctgtcggagcagccgccggagcacgaggaggtctctcctgacgacctcatcgccgacgtgctgggcatcctcgacgccctcagcgtcccgaaggcgttcttggtgggcaaggacttcggcgccatgccggcgtacgagttcgcgctgcagcacccgggccgcaccctcggcgtggtgtgcctgggcatccccttcaacccggcccccatgtccttcgacgccatcatgcccgaaggattctacatcctgcgctggcgcgagccgggcagggcggaggccgacttcggccggttcgacgtgaggcgcgtggtgcgcaccatctacgtgctcttcgccggcgccgagatcccgattgccaaggaagggcaggagatcatggacctggccgacctgtccacgcccctcccggagtggttcaccgaggaggacctggacgcctacgccaagctctacgagaagtccggcttcgggtacccgctcaagatgccgtacagatctatgcacaagctcccgaaccggctggacgccaagttccaggtgccggtgttcatggtgatgggggagaaggactacgcgttcaagttcccggggttcgagaccgccatgcgcggcggcgtcatggacaacttcatgccggacctcaagatcacctacatccctgaggggagccacttcgtgcaggagcagctcccagagcaggtcaacgacctgctactcggcttcctcagggaccatccctccgccgcataagcagcgggtgagaccgtcagaataatggaatgcttcctgagcaacggtttctctactctattgccgttgcctggatccatgaccgtgttaattaattaattagtacatatacctcctactcaaatcagatgtacggtttttttaatctgcaataaaaatcatcgttgctgcattactcgaaaaaaaaaaaaaagcacccagggccc

SEQ ID NO: 17603 - DNA, 1308 bp, Zea mays
gcacgagaccattacctagaacatcctaatcgaaaacttcttttcgtttttgtttgtttttggaagaacagacagacttgaaagttgagatatctcactaatctccaaaatgtccctataaaactgatgatctgctgataagacatcccactcgccggccgtccttgaagagcgagcagcaatggcgcaggagatcgagcacacccacatccccatccgcggcctcaacctccacgtcgcacaagtaggcacaggtgaactgggcacggtggtgttcctgcacggcttcccggagatatggtactcgtggcgccaccagatgcgggccgtggccgcggcggggtaccgcgccatcgcgccggactgccgcgggtacggcctgtcggagcagccgccggagcacgaggaggtgtcccctgacgacctcatcgccgacgtgctcggcatcctcgacgccctcagcgtcccgaaggcgttcttggtgggcaaggacttcggcgccatgccgggcgtacgagttcgcgctgcagcacccgggccgcaccctcggcgtggtgtgcctgggcatccccttcaacccggcccccatgtccttcgacgccatcatgcccgaaggattctacatcctgcgctggcgcgagccgggcagggcggaggccgacttcggccggttcgacgtgaggcgcgtggtgcgcaccatctacgtgctcttcgccggcgccgagatcccgattgccaaggaagggcaggagatcatggacctggccgacctgtccacgcccctcccggagtggttcaccgaggaggacctggacgcctacgccaagctctacgagaagtccggcttcgggtacccgctcaagatgccgtacagatctatgcacaagctcccgaaccggctggacgccaagttccaggtgccggtgttcatggtgatgggggagaaggactacgcgttcaagttcccggggttcgagaccgccatgcgcggcggggtcatggacaacttcatgccggacctcaagatcacctacatccctgaggggagccacttcgtgcaggagcagctcccagagcaggtcaacgacctgctcctcggcttcctcagggaccatccctccgccgcataagcagtgggtgagaccgtcagaataatggaatgcttcctgagcaacggtttctctactctattgccgttgcctggatccatgaccgtgttaattaattaattagtgcatatacttcctactcaaatcagatgtacgttttttttatctgcaataaaaatcatcgtcgctgcattactcg

SEQ ID NO: 17604 - DNA, 1205 bp, Zea mays
gttttcgttttttttttgaagaacagacagacttgaaagttgagatatctcactcttttcgttttcggccctataaaactgatgatctgctgatgagacatcccactcgccggccgtccttgaagagcgagcagcaatggcgcaggagatcgagcacacccacctccccatccgcggcctcaacctccacgtcgcacaagtaggcacaggtgagtcctcatcgttgcttgagccgatggatcccagcggagcaggcagagtatcgatcattcatgggctgcggcctgcgggccgcacggctgggcggctggtgccgttggttcgtgtgccgcaggtgaactgggcacggtggtgttcctgcacggcttcccggagatatggtactcgtggcgccaccagatgcgggccgtggccgcggcggggtaccgcgccatcgcgccggactgccgcgggtacggcctgtcggagcagccgccggagcacgaggaggtctcccctgacgacctcatcgccgacgtgctgggcatcctcgacgccctcagcgtcccgaaggtaaagcagcggctgcggcggtagcccaccgaacgggacgaaaaggaggagcgtccaatccatgtctccaagatctgagctgctgttgccgcgcgcgtgcaggcgttcttggtgggcaaggacttcggcgccatgccggcgtacgacttcgcgctgcagcacccgggccgccccggccgcgtggtgtgcctcggcatccccttcagccccgtccctttcgccttcgacaccatgcccgagggcttctacgtcctgcgctggggcgtacgtgtgccactgctgctgcatcaccatggtcctctcaattctccagtttctggtcaccatcatcagtttcgttcgttccttgttaatttctgcaggagcctggcagggcagaggctgacttcggccggtacgacgtcaggcgcgtggtgcgcaccgtctacgtgctcttctcccgcgccgacatcccgattgccaaggaagggcaggagatcatggacctggccgacctgtccgtgcccctcccggagtggttcaccgaggaggacctggacgtctacgccaagctctacgagaagtccggcttccgctacccgctccagatgccatacaggtgaaactccatggcagtaatttgccaaactgtacaggacagaatacagcaggtt

SEQ ID NO: 17605 - DNA, 4349 bp, Zea mays
ctgcccatgtcttcgtcgggctctttgccggcgacaggaacccacaacaccaggtatgcccgtcctttctcttgctgtacaaaattgagcacccgaaccctaacttgcgctatttgtattcggatctgatctagtcaaaagtgtatacattcgtttttttatcgattcatgttctgtcctttattgttccgctcctgattctaggtgatctggcaatatagtactttcaagttagaagttagcatttgctccaactttctactaacttattccttggtcatcacaaaattgatctaaatttctgattatttctctggcatgaaatatcattgtacatctacgcttctctggcatgatcgatggaatgggcaatgtttatctgaaaagttcccggagcgatggaatgggcaatgtggaaggatacagtagaatatttattatatataacaactataagtgatattttacactgcatagtttacaaccgatgtgccttgttctattgttggttagttacacatagcatattcatataacagtaaaacatatatacaattccatagtgcctgtttcacaactatcctagcaattgtatttcactattacttgctatcactttctagtttctacattccaaatatttggaactagaattaagtttgtgtgtgtgtggtgtgtgttctttgttgtactcatttttctccttttaatgaaatgatgcgcaggtctcctgcgttttcgggaagaaaataagttcagtagacctagcaattactttacctgattacctcccagagtaaaataattaaaatcaataatttgatgctacattttagtttacaaatagttcgagaatgctctctagctcatagaacatagcctcaatcatacaacacaactactatatctccgaggtagaaacaaaataacgcatctttatatctggagcccatatcatttcccttgactggacaacaaaaatgtaatactggattactgcagttgcaaatcttggtgatgtgatcatattgttatcttccttcaacagatggccctgcactgctagatttctctatgtcatcatacaccgagtcgttgaagtgcttcattggtatcccattgccggtttcatcaacaacatcacctttttcttgaagttgcaaggcaaattcaagtttccacaaaacatcccccattgatggacggtcgactccatagtcagcaaggcatttttcagcagcctcagcaaacatctctagtgaatcaggcctgagttgacctgcaatgtgaggatcaattattttattgagctctcccttgcggtaccatgtaagggcccattcggcgagattcacctggtctcttggaagtgctggattgatggctggccttgcacacagcacctcaaagagtaccaccccgaatgagtacacatctgatttatctgttagttgttgacgtctgaagtactctggatcaaggtagccaaaacttcctttgacagcagtgctgacatgggtttgctcaagggatggagcagcttttgataggccaaaatcagcaaccttggccacaaaattttcgtcaaggagaatgttggtagtcttgacatcacggtgaattataccctgagctgcacctgtatgaagataatgcaggccttttgctgctccaatgctaatctccaaccgttgcctccaagatagaggctttaggtttgtaccaccatatagatgatccctaagtggaccgtttgacatgaactcataaaccaggatcatctcattgttctcatcacaacaaccaatgagtgaaaccaggtggcggtgacgcagctttgacaacatttgaatttcagtcaggaattcattcataccttgatcagaagatggattgcctctcttgatagctagctttgtaccatcctcaagaacaccaagataaaccttcccaaagccaccgacaccaatgacatccttttcttcaaagttttttgtggctttctgaatttcagcaaaggtgaaatagcggcccagtccataagcactcgatgcaaacaggctagaaaaaccactcttggtccttgtggagccaaagcgacttctggagagcctgctgcagctgctcatgaagctggactgtctggagttgaggcgaaggaaccaagaatggaagctgtctgtcttctgccattctggcctttggtttcgcctgcagcacatcactgtggccaatgcagctgcaatcactgccaaagaaagacctatgccatttagtatcctcttaccaagttgtgagcttgtttttggtgaaaataggccatctaagctgtttgcttggttgcttattttcatgacttcaaggccattaaggatggcatcagtattgctggagtcggttgtgcttgggccaacctgcactagaagggtggagttgatgatgctggatgagtccacgataaagtcctggtagtaggctactgcaaggcccattgtcaagcttgagaggtcaaggttggatacacccatcatgccatttatgtagacatcgaagtagaggctattgagtgccttgcttataatatcacagaaatgtaggcggatgaggtacttgaatcctggctctgcttccatttcccaagttatgttgaatcttgcttgcgaggtatttgttgatgctgactgctgtgccgttgagtatatatttgctggagcaatgagcggtgtgactgtcttgtcatcagggtacttgatagttctaggaggaacccaagccacctgtgctgctgcctcaagcttcaaaaaaggtgcatctggtaaccaggtcctgcccagtgtgtcgttgaaggctgtcacaagtgcaccgcccatgttcagtctgtagactacctgcaatgcattgttggagatgtcaaactgttctagaggaggcaggccaatggtggtatttgggattagggtgggtggtgccaagacaacttcaatagcattgatgaatgctattgagtccttctttggggtgaaaatgatcttcaaggtgtctccttgtgttacaacaagatactccttaaggacggggttaggaggattggctatgaaggagaagtcatggagaagaaccatattgtcagtgaacacagagaatgttgctgaggtgaggttgtattgtttgtcagggataggcaagaagtagagacggatccaatggcggccaggctgcgagacaaagaagctataagtcgaaacatcagagaaaactcttgcagacaggtaaagtggggataatgatgaagcggcagttggagaattgttagctgtaatcttgatgtccactggggtggacagaaaagataccgactctggatcagagcggaatgtcctgccatcatcaagctgcacagaactggatgccccgcagctaatgagatagttgtcctgaggtacaaacggacccttctgtgatgcaattgcattggtgctggctatgctagtgataccaaggatggagaggatgatcaacatcggtactctcttccactcaagcatgcttctggtcatctttgttgatgttggcatcagaagcaccagtatgtagcaaaactgattggtggtttctcatagggaggaaagtggtctcgggctttgaagagaggaacagggtgcagggatggatgacatctttagttcgcttttggagggaatggattgattactgagatataaggttttggttgagcgcacgtccagatgagatcaggctgcaacttaaatatcatgtctaattattatctagccattatgttcaaacggtctattccgagctcctatacttctgacacgtggacgtcgaaatattatttgaaaagggagcttgcaggacaatagctgcaaagtacaatagacaggctggagtaacttaagcatagctatctttttaacaaaagaagaatagctgtatcatgctggtttattcaagtaggttgagatttggaatctgtgagttcttttctggcgatggtttgttgtaccgtactaatggaggaactaaccaatctaactaccagttggttcttggatgtttacccagctaatggcttaagcatggtaaccctcattgacagtttgaaaagaggttagtttgtcaaacacagttttgagggatgaccattattgtcttagattccagtgcccaattattgctgtaatcaacataactatcttgacacaattatctcggtcaccatgtttgtatagcttttcccttccatggatctggtttgatctcaaaaaaaaaaaaaaaaaaaaaaaaagaaaaaaaaaaaaaaaaaaactcgagggggggcccggacc

SEQ ID NO: 17606 - DNA, 1554 bp, Zea mays
ccggcccgggcataatgctctgcagaacgaacaactcatctaaatccgtaatgcgtgctcctggagatacacaaggctctctaatcgcagatgctgtaatcgagcatgtggcgtctgtcctgtcactggatgccaacagcgtgagggaaaagaatttccacacctacggtactcttcagtcgttctaccctgacagcgcgggcgaagcttctacgtacacgttgcattctatttttgataggctggtctcaacttcaagctacctggatcgagccgaatccataaaggagttcaacagcaacagcaagtggcggaaacggggcatctcttgcgtgcccctcattttcaaagtggagccaagggcggccccaggaagggtttccgtgctcaaggacggctccgtagtggtggaggttggaggaatcgaaatcgggcaaggtctgtggaccaaagtgcagcagatgaccgccttcgctctgggaagactgtggcccgatgctgatggcggcggcgaatgtcttcttgggagagtgcgcgttctacaggctgacaccttgaacttggtacaaggtggactcactgctggcagcaccgcttctgaatctagctgcgcagcgaccctccaggcatgcaatacgctgtacgataggttaaagctagtcttggacaggctgcagcagcgatcagagaatgtctcgtgggataccttggtttcgcaggcctatgaagacgatgtcgatttgtccgcgagtgcgtactgggtacctggtcaagcttctaacaagtaccttaactacggagctggtataagcgaggtggagattgatcttcttacgggagcaatcactataataaggggcgatcttgtgtacgactgtgggaagagcttgaaccctgcagtggacttaggacagatcgaaggctcgtttgtacagggaatcggtttcttcgtatacgaagagtacaccacgaacagcgacggcctgatgatcagcaacagcacgtgggactacaagatcccaagcgtggacatcatcccgaggcagttcaacgccgaggtgctgaacaccggataccacaagaaccgtgtgctctcttcaaaagcttccggtgaacctgccttggtccttgcctcgtccgtccactgcgcgctgcgggaagccatccgagcggcgagggtggagtttgcggacagcaccgtgtcatctggacactcgccgctggagttccagatgggtgtccctgcaccgatgacactggtgaaagaactctgcggtctagatattgtggacaggtacttggaaggtctgtctacctgtgaacgtgcggctggtggggcgtagtcttcttctaatctaaactcatgttatctcatacaagggagtggtatcagcctattgtttgcttgtttgtacgtgtatatacaataaaacgtgctcgcggcgtggtggtgtgtgtgtcattgtgtgtgtgagtgtgagcacaatatctatctgaatgctgtcaaccatgtgtccttattaaaactgcccgagtggtcatgtttcagtcgtc

SEQ ID NO: 17607 - DNA, 2790 bp, Zea mays
tgaaattgatctgcacactagagtcgcaatgcttgtacagtagtgcacgccaccaaccaaactactgaagttatttcctgtttgatgatttaaatcttttgagtcttgatatgcgacttcagccattacttcaactttatgtaacatcatgtcactaggatttagcaatagtgtagtgttggtaactatttttaatgtcacatattttttctctgaaagggaagcaaaagttttgccgctagtttattaggaagagaaaataaaaacaagtgtaagcccagttctttgagtggaaactgggtccagaaatcacatgcctaatgacacatttagtgactcattttttttgtatattcagtttttacttgaaatatataaatgttgaaaaaaaatgggatgcttcactatatataatgaagcgtcaattatggtggaagttttaaaatatagaagtttgaaattgcatagtaaagacccatcaatgtacttttcactagtacctatcctacttcccttttcatggaagctaagagaagatatcttatgtagtttggatgactgcaggtaaaacttgcctcagagtactacttctacatggaaacacagacagcactagcagttccagatgaagataacactttggtagtctacagttcgtcacagtaccctgaacttgcacaaagtgtcatagcaaggtgcttaggtattccattcagcaacgtgcgtgtcattacaagaagggttggaggaggcttcggtggaaaggcattcagatcattccaagtgagaataaacaaagctagaccataatacccaaaatcttccatttcataaaattaattatttttaatatgaattctttaccctggagtataatttattgtacttttgtaccttttttttaacttgcgatgaggtctttccatgtttagacctggactagtgtcaatttttttaattccttattattcttcagttaagagctctgtccttggaagtgcaaactgaaaaaggacatccaaagtttacatttatagtacagatgagaaagaaaatgttattctgttttttatagatacggctttaaattttgagaaatttgcagtatgatgtttggttatgtaggaatcatgttttctgaggaaagtcatttaggcctaatggacaataaatccatctaaccatgtgcttttccaccatgaaaatgcatctaaccatgacttttatttgggctttgcaatagaaagaccctttgtaagacctctagcaactattttagacttaatctacttaagttgacatatttggtatttccatctctgtggtgattgcatatgacaatctgctaacagtatcatgaaaccataaagacccagtatacatcactatctgtttcttacatatggtaaatgcttgtgcaggttgcaacggcagctgcactttgtgcgtacaagttacggcgtcctgttcgaatgtaccttaatcgcaacaccgatatggtcatggttggtggtaggcacccagtgaaagctcattatactgtcggattcaagaacgatgggaacgttacggccttgcatctagatttattgattaacgctgggatatctccagatgcgagccccataataccaggcactattatatctagtgtgaagaagtacaactggggcgctctgtcatttgacatcaagctctgcagaacgaacaactcatctaaatccgtaatgcgtgctcctggagatacacaaggctctctaatcgcagatgctgtaatcgagcatgtggcgtctgtcctgtcactggatgccaacagcgtgagggaaaagaatttccacacctacggtactcttcagtcgttctaccctgacagcgcgggcgaagcttctacgtacacgttgcattctatttttgataggctggtctcaacttcaagctacctggatcgagccgaatccataaaggagttcaacagcaacagcaagtggcggaaacggggcatctcttgcgtgcccctcattttcaaagtggagccaagggcggccccaggaagggtttccgtgctcaaggacggctccgtagtggtggaggttggaggaatcgaaatcgggcaaggtctgtggaccaaagtgcagcagatgaccgccttcgctctgggaagactgtggcccgatgctgatggcggcggcgaatgtcttcttgggagagtgcgcgttctacaggctgacaccttgaacttggtacaaggtggactcactgctggcagcaccgcttctgaatctagctgcgcagcgaccctccaggcatgcaatacgctgtacgataggttaaagctagtcttggacaggctgcagcagcgatcagagaatgtctcgtgggataccttggtttcgcaggcaagcttatcctcctctctagttcgttctcatcgcttgctatttccagcgatcagaaaaatgtcctgtggtgtttccatgatgcaggcctatgaagacgatgtcgatttgtccgcgagtgcgtactgggtacctggtcaagcttctaacaagtaccttaactacggagctggtataagcgaggtgtgcgtcgaaatcctcaagactagtttgattacaacaggccgtttgattacaacaggccggggccccctagggcgtgtttggttgcctgggacgcggtttgcgtcccctcttcgaaatcgtgcaggtggagattgatcttcttacgggagcaatcactataataaggggcgatcttgtgtacgactgtgggaagagcttgaaccctgca

SEQ ID NO: 17608 - DNA, 1728 bp, Zea mays
ttggatgtcttataggcggattgctatttctattcgaaatcgtgcaggtggagattgatcttcttacgggagcaatcactataataaggggcgatcttgtgtacgactgtgggaagagcttgaaccctgcagtggacttaggacaggtttgctgtcgatccttttatgcttcatgccttaaccaattttaattctgaatgtagttcgttcattgatttatagagtatataccatggttttggactggatgagggtaatataatttgagtacatgagaaatatgaagcgcatttttctgttaattgtttgatctgtattagagagttaacttgttgggtggcattttcaaatgaaaatgggttgactgctgggagtttaattttatatctgcaaacattcaatccattgcaggtatacttttgaaatgctgcatgtttctttttttgtcctcgaactgcatatgtttaaagagaaataatagacccttacaacacaagccccttaaaaaaacgatcacctgatacaaaatgactgtatgctttcatattttgcaacattcagtcttggcgacgtttgcaaacaatgtatctcttgtcaagagcttactctgccttgttgtgctccataccggtctcttgaacaaaatgagtacagctaaatactggcacgggtttcgcaacatagctagtgccttatccatggaatctatgttgcagatcgaaggctcgtttgtacagggaatcggtttcttcgtatacgaagagtacaccacgaacagcgacggcctgatgatcagcaacagcacgtgggactacaagatcccaagcgtggacatcatcccgaggcagttcaacgccgaggtgctgaacaccggataccacaagaaccgtgtgctctcttcaaaaggtagtttctttcccccattgcagtgcaggttgaaacaggcggggcttggtaatggtaggtagatactgatcatcagtctgtgtgctgtgtttctgccacagcttccggtgaacctgccttggtccttgcctcgtccgtccactgcgcgctgcgggaagccatccgagcggcgagggtggagtttgcggacagcaccgtgtcatctggacactcgccgctggagttccagatgggtgtccctgcaccgatgacactggtgaaagaactctgcggtctagatattgtggacaggtacttggaaggtctgtctacctgtgaacgtgcggctggtggggcgtagtcttcttctaatctaaactcatgttatctcatacaagggagtggtatcagcctattgtttgcttgtttgtacgtgtatatacaataaaacgtgctcgcggcgtggtggtgtgtgtgtcattgtgtgtgtgagtgtgagcacaatatctatctgaatgctgtcaaccatgtgtccttattaaaactgctggagtggtcatgtttcagtaatctattgttactacttattggcctcgtgcgtctctacgcacatctaaaacttaaacgtaataatttctattctttcttttctatatattctttcttttatattatatatatatatatatatatatatatatatatatatagagggcaggtataacgggagccctgggcttccaacagttaaaggaagcccaggccgaccatcccactagcgcgcccaaccaggctgtcgggtgcgccacctgccgcacgtctgttagcgcaaaaaaaggaatg

SEQ ID NO: 17609 - DNA, 1370 bp, Zea mays
  misc_feature (50)..(50): n is a, c, g, or t
  misc_feature (1370)..(1370): n is a, c, g, or t
agagaagtcttctttttttttccccccccccccccccccccccggagggnttatcttgtctccactccaaactttcacaacaatgagaagtcatcacagacattcttcttcatatgtttccttcatcctcttcctattcctgttcttcatctccttctcatcctcaacatcaaaactcgaacccgcaaagtctgaacctaaaagaaaacattcagtttcagctattctcgtgttcggagattcaacagtggatccgggcaataacaactacattgacacagtattcaagtgtaattttccgccctatggactcgatttcagaaacaaaactccgaccggtagattttgcaacggtcgactcgtcacagattttatcgcttcatacattggtgtgaaggagaatgtgccaccgtatttggacccaaatcttggaataaatgagttaataagtggagttagctttgcttcagctggctctggatatgatcctctcactccaaccataactaacgtgatagacattccgactcagctagagtatttcagagaatacaagagaaaattggagggtaaaatgggaaaacaagaaatggaaaaacacatagaagaagctatgttttgtgtaagtgcaggaaccaacgatttcgtcattaattatttcacaattcccatacgaaggaagacttttactatcgaagcttatcaacaattcgttatttccaatctcaagcaatttatccagggtttgtggaaagaaggagcaagaaagataacagtggcaggtttaccaccgattgggtgtttgccgattgttataacattattctccggcgaagcattgaccaaccgtcgttgcattgaccgtttctccactgtggccacaaactacaatttcctcttacaaaaacaattggccctcatgcaagtgggtttggcccatcttggatccaaaatcttttacctcgacgtctatgacccagtttatgaggtcattcgtgaccctcgaaaattcgggtttgaggaagtcttcagtggatgttgtggaagtggatacctagaggcatcgtttttgtgtaatccaaagtcatatgtgtgtcccaatacatctgcttatgtcttctttgactctatccatccaagtgagaagacttacttcagtctttttagatctctccgaccaatttatgattctattctcggttctttctgaaatttttaattaatattatgatcactattagctaattgataagttaatttcaatttaaaaaaaaaaaaaaaagaaaaaaaaaaaaaaaaaactcgagggggggcccggtacccatttcccctatagtgagtcgattacattccaccggccggcgttttan

SEQ ID NO: 17610 - DNA, 4173 bp, Zea mays
  misc_feature (2193)..(2193): n is a, c, g, or t
  misc_feature (4084)..(4084): n is a, c, g, or t
  misc_feature (4086)..(4086): n is a, c, g, or t
  misc_feature (4100)..(4100): n is a, c, g, or t
  misc_feature (4143)..(4143): n is a, c, g, or t
  misc_feature (4159)..(4159): n is a, c, g, or t
attgatatcactagatacacctaatatatatatatgtatatatcttatttgatttcatacaccatgttattattttctataaaatttattaattaagaaagtttgactttaagatttggggaaattaatttattttaggatatagattatagttagaagcatatagattttgtaattatataatttaataataaaattaaaactggtccagctgtcgcgcacacgtcagcccaaacccggtggccccgccgctcgaaaccaaatcaatcacggggctaaacgtgcccacgcgggtcccactgtcgcataaacccgccggttaggctcttccttcctctgtaacccaccagcacacccatccgccagccctcctggccccattcctctctctcccctccctcctctccaccgccaccgcttcatccccttcatctccacctcctacgaggcggccgccgcctccatgctcggccgcgaccgcagggcctcagctctagcagcgttcaatactgtaggctagcggagaggtgggggatggcgaagccgacgccggtggcctcggcagaggaggcggcggcgatgcggcgccggctgaggcgcctggtggccgcggtggcggccgggagcgccgacgccgaggccttcgacgaggctgcagaggcgctcgccaagctcagggacgccgagcttggcccccgcaaggacaggaccggcgacggccgggagaacaagcgcagcacggaggccgccgtgccggagcacttcctttgccccatctcctcagagatcatgagggatcccgtcgtcctcgcctccggccaggtagtccacaaatcataggcatagagggtataatagcaaagtgtcaacacttgggtggcgagattgcaaatatttccgccacatcgccttcccttgccttctccgtggcttggtccttgctttttgctcgctgggtttttttattttaccagcgtgaaattgccgtttctcagcctgttggtaactgcgacgtttgtggaagcacaagctgagttttagcctgcctattagtacgattttttaagaacataattgaagtgcgattttattattttctataagtaatagagtgatcgacgacgacgggacggatttcgaatttccttttagcgcctatataatttacctacccttcccggcgcaagtgcttttgattgctccttctctcgtgtcctcatccttctctgcgctagcgctgctgcgacgtctgaacctccacacacagctaaatttattttgtggtgtgccagaagcttctgaattctgatgatacagccacctgtccctttcgagcctccgacagttttgtttgtgctccctttatttcagtctagatttttttttcttcatatctgctactttatactcgtgattcgccgctcccccgtgatgtgactgcggctgctgagcagtgttttaaaaaaattccgtctactagttttttacttttccatttgttacaactttctctttcggcgatactgttgcttttgtcgatcgattattggtgggttattattcttcagtcatgagataaaatagactgttcttactgacgacagagtacgataattttctgtgctgttcttaattactcctatttaactacttgctagctctagtaaaattacgattcctgattgaataagtgttccatacctgttgctggaattgtcgttgcacagttctcttttacttttctccatgcaagtaggataaatagaaatgagcccatatggtgattcttcctcttcgccacgcaaccgcgtgcgcttccgctctctttccacggatgatgttgcgtactgcaacacgagacccggattttatggtgcggggatttattattacgtgatttcagatgggtgctgtcactttgaccgtcttacgcccctcatgttggacagtgcatgtgactcgagtttattgccatgttcacttgccgttcccctgttctcagcatggacaaatcatgaaaagattcagcttttatggccttggggttatgcttgcatcattccgtcagtatgatgtgagcaccgcatcaattgaaccaaccttttagctatttttggtccgctgtattgatgactcgtccttgtttgctaagactttccgagctgttcttcttggttcgtgtcacaactatcnctttcctggttttccttgattcttgtttcaattgcttgatcgcaccaagtgaaagtgttacatcattaaaagttaatggaagggagcgagtcaacatgtaactgtatatatattatgctgaattaaaaaaaagttgtttttatataaatttgcacaatggatgaattatcttgtaataatggaatggagagggaataaagctgctcatcacaaaagttaactggttttggatactagagttttatcacctcaattgcctgtccctatggagatgtgctgtaccccatactatctcttctgtgttgacttggtcctgcctttgttcgcgtgtcctgttcagaatttattcctactttcagggaaaggaaaagcatgctatgttttcctacaaacgacgtgacaagtttaactcaaattttaattagcctttaattcgaattttaattagccctgcaccacccagttgtgttcaaataataaatatgattgaggcttttgtttgcagcgattttgcacgaaaatgttggtatgaccctgcctgacatttctcttaaggagaaataggttaatttagattcttcttgaataaaattgctggtataccagctttattcatcttcctggccgagggcctatattcatcactgtgcgtcccatattcatcattgtgcctgaatgggtgatgtgatttaactatattctcattataactaacccctactttgtgtggtccctgatgttgacgttgtgtatatattgacgcattcatgaattctcttgttttgcatgaatccaaaatggtgtattggcttagcataatggttgcgaaaagtaacagatcagtcaatgtgcttcatacaagtgtttacttctctgtgtacttacacaaagtcatgtagtttatgagttataaaactgttttcataagtaattgctttctttactgctgaattgtcataaatttctgtggcatgagcttggcataactattctactccttgtgcagacgtatgatcgtcgtttcattccggaatcccggggcgctggaaaccggacatgcccacagactcaacaagtcctttcgaacacaattatcaccccgaaccaccttgtgagaagcatgatctcacagtggtgcacagacaacgggatcactctgccaccggttgagaaccaagatgaagatctggttacaaacaatgagcgggagacatttcgtaaactgtttgagaggatcgtatcgtcgtcgtcagacctgtctgagcagagggaagccattaaagagctcaggctgcggactaagtgcaacagttcactaagagcagcgataggagagagaccggattcaatctcgcagatgatttccgtagcgtccagcccagagctagaaaacagtgcagaagttgtggaggatacggtgacagctatccttaatctctctatccacgagagcaacaagaagatcattggagacgacccactggcagtcccgttcctgatcaaggccttacagtcaggaaccatggaggcccggagcaacgccgccgccgccatcttcagcctatccgcgctggacggcaacaaggcgaggatcggcgagctcggcgcgatgaggccgctggtggagctcctcgagcacggcagcacggcagcgaggaaagacgcggcctcggccatcttcaacctgtgcacgctgcacgagaacaagtcgcgggccaccaagagcggggccgtcgacgtgacgctgagggccgtcgcctgcgccggggacggctctggctccggctcgctggtggacgagtctctggccgtcctcgcgctgctgtcgggcgaccacgaggcggtggaggaggtcggcgagacgggcggcgtggcctccatgctccacgtngngaaggacgacccgngcaagcgcaacaaggagaacgcggcggccgggctcttcgcggnctgcgtgtacaaccgnaccagggtggggga

SEQ ID NO: 17611 - DNA, 849 bp, Zea mays
  misc_feature (19)..(19): n is a, c, g, or t
  misc_feature (31)..(31): n is a, c, g, or t
  misc_feature (36)..(36): n is a, c, g, or t
aagctggagctcccgcggnggcggccgctcngaacngtggatcccccggactgcaggcccccccccccccctctaggcgactatcacagtgtaattatccgaaaccttcgcacactagggaacctgatggtataagcccttggggcacctcacacccgagtcaccgacggtgtacgcccctggagcccctcatgccccgatgcacttaatattgtaaacccttaggaggcctcatgttgacggtataagcctcaaggtctgtcatgccttggggaacctgacgatgcaagatattaaggatcctcacgcctaacgatgcaagatattaagcacattacattgtaagtccctcgttccctaggatgcaagatattaagcaagatattaaacacattacattgtaagtccctcgttccctaggatagtacaaaggatgtcatgcaagaccagccaccaaacacatacttaagtctggctatgcaaggcccgacctcatactatgacagtcgaggcctatgcccttcagggcttggggatcccttaaaagagttaaggacacaaggtggctaagtctaatcttgtcttgagccagaaggatgtggtgggcccactagggtagtaagccctcaatacatgggccccacatctaaagtctaaagattatcccagagcgatagcttaatcgataagttttgggtaccatgcattaaatatgcaatgggcgatattatgggactcatttagtgtggtggcacacaacttagactataaggcacttaagatcactacatggtacatatgccgattatgtaattatgtgagtgcccccaggctgtacccgaaattgta

SEQ ID NO: 17612 - DNA, 1628 bp, Zea mays
cccaactctggaaatttaccctcactaaagggaacaaaagcgtggagctcccccccgggtggggccctttttgaaatttgtgggttcccccgggctcgcaggaattcagagctcactagtccccccccccccccccgattcacttcacaaaccgctcggcgacaaagacgaagaagccgaggaagcaccgatacgacgattgagacttagttttgctcagattcatttaaccaccggcgccaagtgacgacgacgacggagggagcagattcgaattgtgtgaagacagcaatggagtctactgagtcatatgcggcaggttcaccggaagagctggctaagagatcccctgaaccgcatgattcttccgaagctgattctgctgagaagccaacacacattcggtttcttgtatccaatgcggcagctggttccgtcattgggaaaggtggctcgaccatcactgaatttcaggcaaagtctggggcaaggattcagctttcacgtaatcaagagtttttcccggggacgactgacagaattattatgatatcgggatcaatcaaagaagttgtcaatggactggaacttatccttgataaattgcacagtgagcttcatgctgaagatggtaatgaggttgagcctaggagaagaattagacttgtggttcctaacagttcttgtggaggtataatcggaaaaggaggggccaccatcaagtcattcattgaggaatctaaagctggtattaagatatcccctctggataataccttttatgggttgagcgataggttagtgacattatctgggaccttcgaggagcagatgcgggcaatcgatttgattttggctaagcttactgaggacgatcattactcccagaatgtgcattccccatattcatatgcagcgggatacaattcggttaactacgcacccaacggttctggaggcaagtatcaaaaccacaaggaagaagctagtaccacggtgacaattggtgttgcggatgagcatataggattggtgcttggacgtggaggaagaaacatcatggaaatcactcagatgactggtgcccgaattaaaatatcagaccgaggtgattttatgtctggaaccactgataggaaagtgagtatcacagggccacagagagcaatccaacaagctgagacaatgataaaacagaaagttgattcagccacagagagaaccaccgattgaaaccgttaagagaatccatctcggttcctatctttggtctgttgacttcatttgtggaggcttaagctatcggatggggatcattaatcatctttgagtgaggcagagatttctctctaggagctctctttcgttttatttatatgtcgacattatataatgtgtttttctctgggagagaagcagatttggagttagagaagtactattttcatttgttcttttaataactttgttgcaatttgttgaagttttgtttcccttgagttctttctgttgtaacaatttacaataaccagccattacattgcatttgcttctttcttttaaaaaaaaaaaaaaaaaaagaaaaaaaaaaaaaaaaaaaactcgagggggggcccggtacccaatcg
